United States Patent 9,328,346 (POLYCOMB-ASSOCIATED NON-CODING RNAS) - sequence listing, part 18

SEQ ID NO: 2898 - RNA, 724897 nt, Mus musculus
uccgggucagccgcggaguuuacacuuucccgguccugucaagcaccuggcucucgcucccguaccaagauggcggcagaagcagcuggugggaaauacaggagcacagucagcaaaagcaaagaccccucggggcugcucaucucggugaucaggugagggaggcaggaggcaggcagggugaggucagggcagcggcuggacuuccgcgguggaagggagaggcaucggcugggccccauccgccggcccuucucucccuuuuggccucccccgccccuccccagggccuauugcccgcccccgccgggcaguguucuaagacucucuggggccgggguuaaggggaggacaccccaccuccccagucuucuccucggggcauggccuuuacuucuguccccgguccuaaaagcuggcccgcuuggguucgggaagaaacccagcgcagguguacucauucauuccuacaacagguucugguugacccuggugcugugcacacuccugaaggccgggagguguccugggcucguggggaucaggcccaaguuuccuguuaggaguugcagaguguccaacuuugggcacuuuccacuaccugugaauagccacagcuucagauccuagguuuugcgugagcuguuagcauugaauauuaaagugauccauccauccuuccuucuuguuuugcuuuuuucuuuccuuuuccuuccuuucuucuuucuuucuuucuuucuuucuuucuuauugcuuucuuauuccaguuucuuacucaaaaccauacaaaaauagaauuucaaacugcccuccucauuacuuuuucccuaaacuauuagggugagagugggggugguugacuauuuacuagucuucuucuucuuauuuuuaaauguuuaaaauguuaaacagacuuagaucagccugaauaaaaugcauuaugacacacuuauccauuguugucauuugcauuucaucccauauauuuuccuaaaacaaauaccccuugcuucccacuuuccucgacuuauccuucacuuugauuugaguuaagagagcuccuguaaugauccugauuaucuuuuuaaaaccuaggauccaccagaaucugguagguuaagcccuugagagaauggguaaaucaagcuuugaaaggcuuuaaaaguuuaccauuuaaucgacugaaaaggacccguguauugguuuauggcagaguuuaagagaauggccuguuuuuaucaauuuuauuuuaaaacgagaggauagaacugucugugaaagugauacacuuuguaggcccugaagagaaaacacugcaggcacacauucuuaguuuaacaauguacaguucagauuuaucccaugauauuaaaaccucagccggagccuuuguaguagugcgccuuaauuuucucuggaauucuaauaugaguguuuggaauccuuuucugaucuuguuuuuuuuuuuuuuuuuccugccagauagucaacacucucuuauacaguagauaaguauguaguauggugccuagcauuuauuuaguacuuaggaaauauuuguugaaugagggaaugagugaccugaguuauguaugcaaagacaagauauauuauccccuuugaggagaguaugggccuggagaaagauggcgauucagaauucauggaaggaguggucacuuccauggaaguggagugaguuagggagaauaacaacuguaaacaaaugucccguccucuuccuugugcuucugaaacuuuaggcuauaugucagauuccuuaaguggcaguuagauuuacccucaacaugugauacuuaaaaacugaaaaauaacuuaaaagcuuucugacggauucugcuguggagucguauauuuaccuguaaggaccaauuccuugccguuuccagggggcaucaccacugcuggacaguguaccucauuguuuuguguugaguuauggcaaugguuccaccuuuaauacacuuccccauguugugaugaucucaaccauaaaauuauuuuguuucuacuucauaacuguaauuuugcuacuguuauaaauuguaauguaaauacuugcuauuugaccccaaaggggucaagacauacaccacagguugagaaccaccaaaguuacauguagccccgucuggcuucagacucauuguguagauaagaguaaccgugaacucuugcuuccaucucccaagcccuggagcacggguguccaccaccacaucuggcuuucuuugguuauccaucccucaugcucgccugcaucacccucacuuuaucacuaugauuuuggcccagacaucuuuuacuuuggcuuuuguugugaaguacugcuuuaauuuuaacuccuaauccagauggugucaggacacaugcaugacauguucccuuuacuguguuuuuuacaaccaugcugucgagguauauccacacuuaugauucuaggcaaguuuaauaaagauugggcuucgugauuaugcacgaacacaagauucgauguuuuugcugcugaaguguugcuguuuguaccucagcauuucuuuuuauaccgaaaaguuuggcuuuggauugagggaagauguugccaaucucuuuugguauuuucuuccugauucucuuuugugcuuaauccagugagaggagaaggguaguauaacuucagcggugggauuuggggugggaggagucugggcuggcagacaggaguaggccuguguguuucucaugaguaacuguguuucugcucuugguaucuguuuagcuccugcccuucaugcugcuucuguugcacagcacagucauuauucucagguccucccauguacuugaguuaucuccucugucuuuaacuuuucucagauucucucaagagacuagaccuuuuccgguugcuuuggcaacaagcuucacaaagggaaacccauuuuaggguuguguuuauaaaguccgaguauuccggaaaggguccuuggugcuugcuagcucguucuuguugccuuucaccuggcauuugucacaaaauagguuagugacagacuccacugucuuuugaacaguuugauuggcucaccuuuauggcuuuacaucacugagcagcagcagguuuucugguguuuuggaauguuuacaaauuuccuucaguucuuuuucagauguauaaaaauacuauuucuauacuagguuuaguguugucacaauuuauauugcaucuaucugucugucuaucuaucuaucuaucuaucuaucuaucuaucuaucuaucugagauaugaucuauagcuuugccugacuuauauuugcuguguacaccaggcuggccuugaacucacagagauguauuuacucugccucccaagugcugggaauaaagaugugagucaccacaguuggcuaaaauguuauuuuuaauaguuugaagagaagaacauuuauuguuguagacacuuuauaguacuggauuaaacuccagauaagguguaguguaaggacugagcuaguacacacaaaggaaaugccccagucucauugccacuuuuuccuuuuguuuguauguggauuuuugaaauaggcuugcauguagcccucacuguccucaaacuugcuaucuaggcaccaauaauuuagaaugucuuauccugcuuccaccuccuaaugcagauucugggaguucaggcuuggcccaccacagccaguucucauugccuagaguacuaacuagauaaugacacagugguuuuguuggcaucagagucugucaaugagaauuuaaaauaaagaauagaaauacaguacaguacaacugcauucuuauauuugaucgaaagggaacuuugagauauguaaauuaaaauuuuagucacuuaaaaaaaguccugaauaaacauauuucaggccagucaggugugugaugguucacuaucgugucugugaggagagauagugcuugugauuggucuuuuggagacugcuacuaacuauagaucgaagucaccacuggcccuuuacagcagaaauaauuggguagacaguguccuguuugaauguuuuacacacacacacacacacacacacacacacacacucucucacauacucuucacacaccauaucuaccgucuuuccuauugauuacuuuaccucaaccuuuuguuuggugugaaguugaaguugugaaaggagcaagauggcauuuuggagauguuauuuuauuuuugugaguucuugugagguuuuuaauuggguaaugugucuaccacuuacuguuaggugauuugcuuuccaauuaagcauugacucucccuucuuuguaugucagccuguaaauagccaguuuaauuggagagacaaacucugguugggacuuagagagaccuuauugaaaccuuggagcagaacuuuuguagacagccugguugcagaugccaaggagguuugaaggcaguuggaaacucacauuuucaucaacuuuuaugucuucacagaaguuggaauuucaguaacauagaaaauccuuuauuguaugcuccuguuaaauucuguccuuccuuugcaaaggauauuuuggucagcccauaguuuauucaaaguaagguuuguugacaggaccaggcuuugugugauguggaccuuugagguuugugacaguuuguggcaggaggagcuuggccacucugcuuuuagcugggccccaagagcuguguuaggcauagauacuauuucuagucuccucucuucaucagaguccaccucagaguagccuuuagguuucucacuuuguuucccucagcccuguuccccuccacgaugcauugcuauuugcaaaucacuaucagaauagagggucaggacuguugauagacccaguugauagauuacuugcccagcacaaagcccuggguuugauccacagcauaaacucggcgugguggugcauaccuguaauagcagcacgugggauacaagauacaugagcgccugauuggaaacagaacagacacuuucaggagguccugggacaguugauaauugcauuuacagaaaugagaagaaaaaugcuccaauuucugguuauacaugcagaguuaguaucuuggagaacgaagucuugguuucuagccucaagacucauuguuaauguuggaguuuuuugguugugagccuagccuuuaacggcugagccaucucuccagcccauguuggaauuuuugaaagcuuugaggcauauaguuuuauuauugggcaguaccaucaaguuuuucuauccaugccuuuauagguaagucuggucauauccuuuagugagagggugugguuuaggguagcuaagaaaaauguacuaaccucuagucucaaaucacuuacucagccuccuaccacccccaguguuacuuucccauuuaugaaaugagauggugaagaucuagugugguuugggggaacaugaaaugagacaaggcauauaagagugccuuguauaguuugaaacaaagaggcacucagaugcuuaauucuucauuucuagugucuguagugucuuugguuagaaauuugaguuuuacuagaucuaagaguacuugccugauauuccucaggccaccgguccaaucuacuguacaacacacaaaccaauucggagcuggaggccgaacccaggacucugugcuugcuaagcaaguuucuaccacugagcuaaauucccaaccucuauuuugcaucucauuaaaccuggagcucuuccauuaggacucugagacaugccuugaaaugucuuauaguucuuuauuuuaaagauauagcucuuuugccaccugcaggaguguuggucugguguuugauguggucacaguagguuuacuuugggcauaguaagcaguagccagucguuuaugugcuugggauucagccuugaagccacugagaacucacaauuugaugcaaaguaauaaaagaaugcuauuguguuacuuuugguaguguugauaaaaacaauaugcguuucaagauuuuuaugagaauuuuuuucugaguuguaucuuuuacuagaagcccuuucaaaaaguaaauucaaaaaucauuuaugaauucaagagauacuguuuguuuuucauuuaaaacagugcuguucacacacacacacauauacacacacaccccucaucuuaaagggaauaagagauaguuuauucuggagucauuuugaggacccguggccuaggaacacagauuaaggcuauaccaaauuccagguuccaaagugggugcaguuuuauauuuauaguuauaaaucaagggaaguuuaaaguacauugguggguacaucagagaggcagguaaagcaagaugggggagguucuccuacaggccuaagaugcucucuaacaguggucuuagcuuuuuauguuggugaagcuauuggccugcuaagacaauagauuuccaaaggcuuuuaucuguuaaguuacaggauguugauucauauacagaggugggcaaggugugacuguuccaggggcuacaguuaauccaggaaaagccucuggacccacaacauuccagucucuauuacuguaguuuuaaucagucagucuuuguagacacagcuucuuuccaggaauugucauucacauuaucauauauauauauauccagaagcacccuugagacuuuucuaggaauucacugucucaggcacugccugacccaucugacacguaucugcauuuuuauaacuauacagaugauuuaaaagcaugaugaaguuugaguaucgcuuaaacgugcuuuauuggggaaaugagauauaagaaacaaauuuaaauuauuaccuuaaaaaaaaguugagauaauaauugggcuaugauuuuuuuucuccucucugagucucauuuuuuaaaaguauuacucaaguggagagauggcuuagcaguuacugcucuugcagaggaccuagcguccauauugggcagcucccuauaacuuuagcuccacggguaucagauaccucuggcacugugaacauguacacacacacacacacacacacacacacacacuuaaacaaaauacuccuuuaaaguuuuaaaaagcauugcugcuaagaugaucauuuguauaaugaaauauucaccaagacaagucauucugcuccuguaguuggggaagaggaucggagccaaucagggcuagaugaagucagauggaauauggcauuaucucuugaaggugacauuuuuugacaagucuuuuaauuuuaaauuuugccaucagaaauuuuugaccaauuaaaaaauaugguaacaaaauuuccauaaaauauaugugugggggcuggagguagagcguuugcuuagcagcuagauuaaucacagaaauucucuaugauagucuuuuagaucagugguucucagccugugggccauggccugugucaaaagacccuuucacaggggucauaugucagauauccuucauauuagauauuuacauuucgauucauuacaguaacaaaauuacaguuaugaaguaucagugaaauaauuuuaugguugugggucaccacagcgugagaacucuauuaaaggguugcagcaugaggaagggugggaaccaaugcuuuagaucuuggcauuucuccaugacaccuuuauucuaaagccucauggaucuuugcauuuaugaagccugccccuaauuuccuaauuuccauuaugucagaagugcagaacaucugcuugugaggaacucaccaggaagugaggcucuuuguggacaauacuuucugagcaugcugguuuuuucaaggaagugagaaagagauagauuuuuaaguugacuuugucagccguaaacugaguuuuaugccugagucgagugauuuuacuuaauuuuagauaauggccuuuuuguugccuaagcaauuuauagcuuucggucucuaguacuguucuguauaacugaguuaauugcacuauugaagcacuauccacauauacguuggguguaguaauuggcucuaagugcugucuacagccagacacuagugaguuuucaaaugacuuuaaagcagacauuguuuacugucacuugaggcuacauaagucucucuguacuguucagggaugcucauaugcaugagagaacucuuucagagggacuugucauugugaauugcuaucaguugggaugggauuauccuguauuucauaggcucuaaugagucauaauuaagaaacaaggcaucacaauguauaauugaauagaauaaaauccguuuugaaagugagguguugauuugcuucugcuuugagucaaauauaucuugugugauuauguagugauacauaucucuagcauuucuguaaugugggaucccuuauucaaucucagauucaugacgagggccucucauuuugauaacacccuggaagcaguuauagaucaggcgccaucuaugaaguguagcggugugucaugcuuugcauaaucagcuuggaacucugacugagcuguguagugagccuuuguauccuucagucucuuuucuuccucauggcucuggguuuuucucuacucaugcauagagcuguugucuuuaguuucccugcuagauguagguguauuuugcuaucagcuguguaugaggugggcuggguuccuuuuuggaaagaagaugugccucuaguacccagcaagugcuggguagagcugaugauuuaacagcagugagggaaggaagcacgauugauguuggaagagucacaucagcucugcacauuuucccccuuguguugggaccacuaacaaaaagagacauuuucuucugaaaagacaguucugaaucacucaguuuucacuuucuggagccaggcuuggaaucucgugcaccucaaguuccgcucuuguuuuguacucuugugucggagagcagguaucuguguggugggguugagguucuugaugguaagaagcucaggaacuuugcagcaucuggccagucuccucggcccacgcggaguacuucugagaaagaggguagcuuaggacacuugaccccuguuggagauggugcucuguuguuugcugaugagugauuuuuggauaugugaagguguacuuguaauuaguuuuucuuaguugcauaaggggauuuucauuauuuguuuucuuaguuuguguuacuucuggaagagaggucagcggggccuuaguggacagguaagcccauuaucagcuuucagaaaauauggcucaguuccguucauucugaauggucacugagauuuagauguguaacuuuaucucuugcagcaaguguuuuagccaucugcugcuguauucagcagcccauucuucaugcagauuggucaaggauguguguuguuuaggcugaucgaugacauugccuugagaguuuaaccaaccaacuugagccugguggugcacaucuucaguuuguggauuuuggcagcuagagcaggagaucacaaauucucugccuaaagaaacccaacccaacccaaccguccaaacccagauaaacuagcagcaaacagagagggcaaaugggaauuuaacuaacuguaauaacauugccugcacuuucugaggcaguguagcuuucugcuccagcagcucucacagaacaccuaugacuggauggcuaaacaauagaaauguauuuccucacuguuuuggaugcuguacgaccaaggucaaagcaccaucagauuugguuguuggugaaaucucucuucuuggcauauaaauggccaucuccuugcucugucccccugagagccuuucuucugguugugugcacaggauuccuuccugucucuugcuuuucucaugagaacagcauuccuagccgugagguuucccugacuugcuggacuuuaucaccgccucucuuuucugucucuaaacacagucaaguagaguacuaagauguuaucauaaaaagaaaaaacaagccuuuuuguggggcacacagaucaguuuauaacuaagcuaggccccuuucucaccuuguucaaaugcucaaagcuuccagaauaagagucugucaccugcagacagguaaccuggaagcucaggcaggagugauugccgcugcagucagcacggccugucacgcugacuuguaauguuggaguauuacauuaacacuuaauaccgacaugcgugcugugugcucugcagagaccugcuagccaguggcuggagcugucaaaagauuugcugagaggagaaaacuaagagaacauggccugacuuacuuaguucuauauguuuuuuaaauuuuaucccuagauuagaauggaaaagauaagucaucagaaagcuguauacucggauuauauccauugccuuucagaauauggaagccugaauuuaguuuuuaauugugcuccugaagagauauuaauauaaaaucuguuaccuuauuuuaaggagacuguugaggcuguguuuauuauauuguaaaaugaaaaaugagcuugcauaaugagucuuuagaaagugagaauuagaacuuuuugccuuggcugcuuggaagcucaaauuuagauuaggaacucauuuacuaugaacucuguguggccgugugaccuacucguauuuuacauuuauauaaugaugagcuguauauuuuacuauagucuuagaacaucuuugauucuuuuuguuuugaaagagaugagauauaauuaaaaugaagcugggcgugguuucgcacgccuuuaaucucagcacuugggaggcagaggcagguggauuuuugaguucgaggccagccuggucuacagagugaguuccaggacagccagggcuacacagagaaacccugucuugaaaaaccaaagaaaaaacaaaaacaaaaacaaaaaacaaacaaacaacaccaccaccaacaaaaaccuacaaugaaacuauuauaaaugugguuacuggcugauaaguuaucaccacccugagguaguggcuucagugaccacccagagcgaggcugacagagcugugucuggucugauuccugaucucgucuccugucacuuccacacuggcaguugguacccacuaugaucgcaugucgguuccuccccauggcaguuagaauuuguucuccuucauggccuggcaccuucccucccuagaacagcuuucccacagaggauguucuauucacgaaguaccuuuuugugcccuugcuggugccaguguggggggcauuuuuuuuuuuugagacaggguuucucuguggggggcauuuuuaucucugcuguacuacagcuucugcccgacgcacuugcuuacccacccacucuauggcuugcaucuccaagcugacauguuagcuuccugagggagggcugguuaguuacugcuguaugucuagccauuuagucugccugguaggugaccugcuuaguaaacccuguugaaaggaucagugaauugauggggccaccauaccuguaacuguugcuuuccuucccagggauuuaucagcauguauggcuuccagcgaggccauuccacggcaguugucucagucagggagcuguccugccugaccuuuuacacucugcaucuugcuguugcucauuauguagcuuuuacuaaacauuuaaugugccaggcacugugagaauacagagaaaagaucugcuccgaguucauaacagacucccaggaacugggauggggagguuugaggggcuucgggcugacagugucaggagucacagcugauuucuuuugcuucuguaaugugaguaagcaccccaccuuucucuccacgcuucuucaguccuuaaaacauccuggagaggcaggaguucuguucucuugccuguuuuaugaggaaaaacauccaaggagagguugaggaacucaccaggguuucagaauucuauuugucacuguuugcuaagaauuucuuuuccuaagccagagcaucacuguguagcccaggcugaccccaaaaucaugaucuucuuguuuuauccucuaagugucugggauuauagggugaugcuuccuugccccacugcaaagcccuauuugagucugugguuuuacuuuuaagaacaacuguuugauuuugacuuguuuuguuuuugagacaguuucauauagccuagguugaccacagauucacuuuguagcaaaggcuggcuucaacucuugaucuuccugccucuaccuucuuaagugaugagauuaccauaccuagcccaguuuacaaacuuuauguuccucuuuuuucuucuuuuuuuuugacaagucucucucuguagucuagucugcuguugaacucccacacaaagagccacacgccuuugccuuuaauuccucuguugggauuaaaguuuugugucacuguacuuagcuaaauauguucaaauuuugcacagguaaauggaauggggaaagaaaaaguggcuuuuuaaaaaugcaguguuguguacugaacccaggacccuugcacaugcuaggcaagugcugucuacugcuccuucugcaaaccucagaugccucggugugaugugugcugagggccccaaaaggugggacauguuugcuguauuccuggcgguggucuggguuuggcugauuucuuuuucucugucucuggcuggaaguccuugcucugguaagugacggguuguccuggugaguaaccugaucuucauaggugcacuuucccuucuguguguguucccuuugaucuuuuaaaacauggcauugacuuucaugugcuugcuucugucuggacuccauuacucuauuaaauccaaagagagcaaaauugcuccaagaaggaauggcugauggugaguguguguuuuccugucacaacauuuaacuggcuaacugaaagacugaaugaagcugguguucuaaaagggaaaaaagaaagacgugaaaagaaacugaccaauuccacuuuuagucuccagaucuuuaugccauguuuuaauuuuugucugggagucacugggagcugguggcuugugagucugcuggaaccaucucccauccuuguuccugcuagaagcauuugguggacccuuuagccuguuaggugaacacauuccuuccuggggauuaauuagucaugguuagagauauaauucaucauguaaaauaccagaggugucgucgugaaaaauugcuagugauccagaaaugucucugcauccagcuucguugcagucuaguuuagcguuuccuguuccaguguucacucagcagcacuuuguaaauuguaaucacaguuuacaugaaauagggcagagcaaaagcuaaagaguggcuguguaauuugaaugcaucuuggagugucaacuuuauaucauguuccuugcuucugucuuuuuguuguucuucuuaaccauuuugucagguccaacaguguuucuuaaaaaggaaaacaagaauaagaacaacaacaacaacaacaacaacaacaacaacaacaacaaaaaacagagagaaaaaacuguaguagggcccaugugcaucuuuucuucuuuagcuaaucccugcuuucuuacaggcgagcugucauacacuuagagugaaguucucggcucaggaggugaggcagggacuacagcagcucacauguaugguagacggagggcaggcugcaugcgugugugcuaugugcaccuuauucccuucucugagcucugcgaugugucucagaaaaagggucagauucuguccagcucaucguacugucuuagggauaaucacagacgugcucaccaaguggccauugcauugcuucuguuuguguucuguuuacuuucuuccccaugugcuggacauggggcaucuauacauuucugggcuuaguauuaacauuuuauaaguagagaugugaaaucuugcucaucagcauggacuguccaccagaacgaagauuuuuuuuuuuaaacuaaaacugcauuguagugcccagugugguggugcuugucuguaacgccaacacuugggagguagaggcaggaggauaguaguggucagcuuggucuguacagugauugguaggccagccugagcuccauagcaagccacugucuuagaaaaugaaaaccacaaacaacuuccucaaaaccaaccaaccaacaaacacaaacaaagauaaauaccccuccaaagcgaaaccguucuuguagcaaugaucgcuaauaacuacggacaacguuuguugacugauagugguguuugaggcuuuguuugauugugcuuaacaccuccauccuauaaggaauguaucuucuuuucauuuuauagaugaacaaaauaagauucaguagcugaaguccucuggguaguaaauucgguggacuaaggagcccagccuaggcaguuagaauucagagacagguuuuaguuacucugcaguuauucaaaccuguaaacagacucgggguuuggagucuucuaggaucuuuuauucucacugcauggggugggggaguuguuuagccucuucaaagcccaacugcuucuagugagaaaaggagacuggaagauaacagacuccaguccagcaggagugagcauuugauaaaaugcugaauaaagcuggguuuuggcaucugcaaaccucucuaaauuuuggaggucuuuauuauuauuuucauuauccuuacugccuucucuucacuaaaaaagacaccguaacaauuugugaguuuuauaauaguguuugacuaaacacaaagcugucaaucaucccaguuauaucaaaaggaagagggugaucucucagugcgaguuaaacuuggcacaggauauuucuuauauaaauauuuccucuggaaaugaaaauaggagaaaugaucccccguggacucaauuuacuccugaucuucguuuuaguaacccuuucucuuuuguaaguaacuccuaaugaucugguaaugcauugcggugacagcucaugccagagaagguguccucccugggccugacagucuccuuaaugguaauucugacuaguuaagguaaauagugugagagguuuuuggcauguuuccuuccacaaauggcagugcgugugugaugggagagagaacguggaaggcacugugaaaauggcaggcucaugcuggguagcucugcagaagcuauggaguuaaagcauccagagacucuuaccuaugggacaguugauaaauugaaggcauuucuugguuguucuuuagaguagcauacuggaagacuucagauuuaaagagcaaaguuauauaucauaagaaacaacagagagacaugcuaagguacuucgagccaaauaucagaggagauuuuguuggcucuccuccugugaucaaguugauuuacuuugguaguuaaauacuuguguguuuuuuuauccagaaacauuggaaaucaccaggcuuaggaucagcaguuuauagaugaggaaauagggucuagucugggacugcccuuuuuagcucccaggacuguuucauuucaugcaacacuugaucucuuggcaucccuaacacauuuacagaauucauuuuagaaaguacauugaagccacagacaggccuccugaauuccccucuaaauugaaaaagaaguuuuauauauuguguggcucaugaauuaagaccccuugcucugagugacaguuuggagaagacuguuguacggcguuuugcucggaaguaucuggagguggguaugugauugauuugcugacagaccaucucugaaagcaguucuaaugauggacuuauaauugauugcauccaucaugagagccaaaaauaccccccucccuaaauuaaaaaagauaaaugaaauaaacuaggcugaauguauaaggugacaaaucugagggaauuuaaugaaacucuaaauuaccacaguaagcagauaagagggaaagguuucuuuauuauaauacuaaauuaaaaaaaauuauccaagaaagauaauggaggaaacaaagaucugugucccauguaucaaacugaguuauugaaagauuuuuaauaaguguaccuaucucauugucugguuauuguugauuccuaucaaucuuguugguggucuuugaagaauagugaaugcaggcagugucguguagugcugcuuagguuauugcuguuguaacagauuuuagaauuaacaugaccuuauuccuaggcugcugggagcugugugcauuucaggccguucacgugaacucucuagaaagugguuucuugugagaaauuuuaucccuucaccacauacgaaagaaggcuauccagaagugacuuaaacaauauuuaaauuuaucaucucccccaauggagggccgcuucagggauggcuccuucuuguugcccaugggcacagcugcagaagcauuucccaugccuuuugcuuccacagauaacagaagugccuaagaaucccagcucuuugugucaguguccugggcgugggaagggaccuuucucuagacguucuguagggcuuguuagccagcauuguaagcagggcagagcugguaaggauuacuaugauucauacaaaccaagagcugcccagcuuuccucugaauccaugcccaccugcuaucugcuugaaauccucucaggggucaagagaccaggugaaggauggagucuggcuaggcagccugugcacgcgcuuaugugguguuagaaucaacuuugaagguuauuuuguauuuucgguuaagucacuucauuuccuaguuuguagaaugaaugugcuaguguguugacuguauacuguucuuauuguugcuuugaaguuuggcacagcuugacaaauucuguccucaacaggacucugucuaccagugaugauguugaagaccgagaaaaugagaaaggucgccuugaagaagccuaugagaagugugaccgugaccuggaugaauugaucguucagcacuacacagaauugaccacagccauucgcacauaccagaguaucacagaacgcaucacuaacucgaggaauaaaaucaagcaggugagccuccucucuuccugucugacacgguccccuucccuuacagguguaguuuggagcuauaccacagagcagugccuaaugguccucgaccacugcgauucaugaaggcauuuucuggaguuuugaauagcuauuguuuccuggguacccugccuuuagugcccaaaggacaaagugcguuucuguuaggugcuuuuauauuucgccaaagggaugaacugacugcuaaaaaaaaaaaaaaaaaaaaaaaaaaaaaaaaaaaaaaaaaaagaagaaucuguguaccaucaaucaugucauauuuuauaguucuuggcuauguuuuuuuuuuuuuuuugguauguuauguguauaugugcaggugugcaugcguggauaugccuuugugugugccugugucuguguaucuguaucuccuugucugugugcggaagucagaggucagcauuggguaucuguaaucauuacuuuccacuuuauuguucugagacacgaucccacuguaucugaagcucccugauccagcuagacuggcuaugcagugaccgucagcgcuuuacuugucucugucuuccuaccaccugucacuggcacgugaugccauggccaguuuugauguggcuagggaccugaacuccauugaugaugcuuuugcggcaagugcugcccacugagccauuuccagaagccuauauaaaugcagugcauuuauaggagcucuccucuaaugcugcucuguacuguucuuugagaaguaacaguaauugcuaccuguauugaacacugccuuuuuuuggaccaggcacgaucucuugugcauauacaugcaugcacaacgucacauauaugugcacccaggcacauacagauccccuccccccaaugcauagccaaggacuacaaaacagguugcaucuaacagauuuagacaugcgaaauaaggacucccugacucgaaagccuuuauugacacauuauuuuuuccuaguaauuuuucaagcagugccuuucacuuuuaaaaagcaaagaugagacauugcagaaccccgagugggugagaucucugcuuguguaguauugcagugaggagugcagggaaauugcccccgucaccucugggagauugugcccugugcagacugcuguuugggacuugcuaucuggacugugagacauagaggacccccuagcuuguuccugcccgggaacagcugugcuuaugccauuguuacauacuuucugguccuccaggccuuuuacugugauucuguaagcagugcauacauuauauucagauaguauggaugugagguucagcuucuuagagccagcucuggaaccaguaagccuuuggccuuuucugaaacaaucucuauguuuuaaaaauaauuggccaauuuugaaagcagugcuauaauuuguugccuuuagauaugguagguuccucccauguguuuaucugugaaacagggugagacuauauagaugggcugcucuuauuuaaaacagacucuaguccauuuugacuuacagagacuaggaaaugagugucuagcacugcugaccuucuggcuuugccuaggcuaaucgcaguagggguggggacaucuuaguauuuguguuucugauuaguucgguuggcuggaaggaugccucuguccagggaggucgcaacagugauuacagcucuguuccuaccaugcagauccguacaguagcaucauugcugccaauggaaugcaucugcuuggucuugguacugcagaugagggcuugaucgugaggaucuugcauuuguuauagaagugacacucgauuucucuaauguaccauucuuacuuucaguauacuaaagucugaggugaagaaaacaaaacaaaacuaaacaaaacagcaacaacaacaaagagaagcuuuuauuauauuaguuugccaagaaagcaaaugccaccugacucaguguuagaaauuagugcagauuuggaugagaagcgcaggauaaaaacucugcaaaaaaaacccagcccacuuuaauauuugauuaagaagcaaggaaaaaugcugaaaaaugaagguaaacuuguuuguauuccauauuuugauaauuuuguaucauaaaaguaagaguuuuuaaugauuaaagaagcaguaauguuucccaaacuaucuucccguguuauuuuuguuuuguugcuugcacuucagguuguauacuaaguacagauagaugcuugucucaggggaaacaguggguaaguuagcuaucgucaggcuguguuauucuagggccacauagcagucggaugauacucagaucugaugugcaguuuucuuucuguucucuagcaaaggaguguaaagaagacugagcccauaauaucucuugagugccagcuaugcuccugguuugguuuuaggcauccugugcucacagagcuuacaugaggauagugugcagagacaaguacaguaucugcaugucugcccuaugcagagauuguuguucuagccucuagaguacgggagugaagauuucuguccagagaauuuuaaguuuuauuuacauucuaaacagagcacaugguaauaaaaaacaaaaacaaaaacaaaaacaaaaaaacaaaaaaaaaaaaaaaaaagaaaagaaagggaaauagugacuagggauuuuauuuuccuuuuuugaagcagguuuuuucuguguaguccugacuggcuuggaacucacucuguaggccaagccggccucagacucagagauccaccugccucugccucccgagugcuaugguuaaagguguguuccaccacugccuggugggauuugaucuuuuaaauaagucggucagggaaggccaauaucugagaaggaugaggaagagagucugcaaggggacuuugaggaaggaggaaagcaggugcaauaauccugaggcagcaggaggaccagucaggugagaaugugacaugagaugugaaagagcuggcaugugacagguggcacggggcgccuuagggucugcuggccacaauguacugauggacacuuggcccauguauauguuuauuuugcaauguguacuauuuauuaucuguagucuuuagaagugguaaguuuuugaauguaggaacaccauaguauggcuaacauuuaaaggcacacuauaccugauaguguaggaauaugcuuuaauguggaacaagucagaugaagauguguucguauccaugcaucaucucccaucuugacauugcuuccauaugcccauuuaggcuauauuagaguuauguccuuuggaauaaauucauggugaaagaugaguuggacuuucuucccaagugauuugaacauuuuacauuugcuaauaaguccauugagaauucuuuucuagauaaaaaauauuuauugugaaugaaaugcuauguaugaccaaucagaucaaguaaugugcaaaauaaaacuuuugagugauccuauuauuguuaaauacacuauaaaauugccuaaaaugagaugccucagaaugcauggauucugccaucucaugguugccuguuacaguggcauugacauugaugggaguuauuugauacagaugcgagacuuguacuguacaugcccugcuuggcaguguucuccacaguaugaggaggcaaagggguuaguucagugcagauuucuucagccauauuaauuagucagucucauguuaucauggaagaagggugggcacaguggagcauguacuuggcucuuuguaugcauacaaacacuuaacauuuuaccugcuauuggcuguuuucuugguauuagaucccaugcuaaaaaccugcuuuucuugucuacaacuaaaaaucacuaugaauaauuauccaagugauguugcuaggggccucauuauucaugaaugcaacauucauuacuuaacauuuaccuaaaaugacuuuugacuuuuauguaagcguauacuuugaaagguagcccuaggauaaagaauagccuuaauuaauacaaagaaugucauaggagaagagcgugacuuuuguaagauguuauuuacagccuaaauauuagugaaaauucuuaccuguuuguaugagaaagggaagaaagccucuuucagaaauagacaggcuaaacaaugaccaucaauaagaaguauaauuuaaaugcugggcaguagucuuagguacauuaucguaguuguaggagccaugaggcauuccuuccuuaaaguccaaggguuucuugaucuguguuugcauccaguagcugaagagaaagguauugcucuuggaaugaguugagggacaauuuucagagaauuuaaaacccaagauuggaaguuaaaagaacuaaagggaaccauaggaaauaaaaaugugagggguaauuuaaauaugaccuauaguuccaaagggcuuuuagacaucgguguuucucaaauucauucuuucuaugauauuuuaauaaacucuacaaaaaccucgguugggcccuucucacaggcaagcgugcaugacagcgcuuagauacgacuuacuuccacugccacaaaagggauagagcaguaguuuguuuguaaaccuaaguggcauugauguugaguuuuuagugaccuuuucucgcuuccagggaccaucuuguguucuuuccggcccacaggugucccacgcugccugcgucucacgcugcuuguguaucgcgcugcuuguguaucgcgcugccuguguaucgcgcugccuguguaucgcgcugccuguguaucgcgcugccuguguaucgcgcugccuguguaucgcgcugccuguguaucgcgcugccuguguaucgcgcugccuguguaucgcgcugccugugucucgcgcugccugugucucgcgcugccuguguaucgcgcugccuguguaucgcgcugcuugcgugugugcugugguuuuguuaugguguuagcacacagaggcuuugcccucuuuuuuuucucaauuuaaaaucagcacuuuucugccucuguuaagcagaauuauugaagauuauggccuuucuguguuaucucuggucaggucaauguuagccucuaaguguaucucugcuauuccucuuaaaaaagauaaggcagguuuuuauugguuuuaaagucccaguuaguuuucuucauuuguuguuuguuccaagauuguguuacaaaaauuguuaccucucugccaccugucucaucucacauuucccuuuucaguagccucuugagcccugcuuauauuuccuucuuccggucucuaauuagagugacuuacaguuuuauauauugaccccgagguucuugguacagcugagcacacgauuugaagcaaaugucaaguuccaugcaugauggcaugguuuuaacaacuuggcucuccauggauuuaugaaugcaacaaagcaauauuaaacauaacagugacgaugcugucaucauacuuaugaaaucagaacaugauuuugagaaaggaauguuuacgugaauuugguaccuuuuugacagauagagucccuacuuuucauccacacuuaaaaagacaauuuaaauuuauuaaucaacacauaaaaauuauauacauuuaugagugcaccaugguauuuggaaauaugaacacauuauuggauggugaaaauaauaauaaauaauaugcacaucuccucacauacauacuauuucucuguaguaaaacaacuuauaguaucucuuagcaauuuucacauauaaacaccuugcuauuagucagcaugcuguauaauagaucucuugaauuuauucuucuuaacuaaggauuuauauccuguggguaaugucucuucagucucauccuuugguaacugucauucucuuuugaguuuacuuaaacauuuucacaugugaguucgugugguauuuguaugccuggcuucuucccucagcaugaugucuuacaguugaauguuguugcaaaugucaggauuuccuuuuagaagacaacucacacauaguuuuaaagaaugaaugcugcacguucgugcaguguuaucuuuaucugauaacauugauucuaucugauugucuuuguaacacuguaugaacauggcagugcaaaugucucuuugacauacugauuucauuuccuucagauauacagauguuccuugauuuaugguuggauuauauuuaagcacucccaucauaauaugaaaaugacacaaacuaaaaaguacauuuaauauaucuaaucuauugaacaucccagcuuggcuauagugcuguggaagguccuuuguuuaccaucuugauuguguagcucuccgggagcuguagcuuacagcuguugcccagcguuguuacagugugucacaugaccuaauguugaccugggaaaugaucacaauuugagggaaugugccugcugaauauguuccacuuuuaugucauugugaagcugauauugugaguuggaaacuaccugaaugcccaguacuggaauucuugguucauacaguacuguuauuuuaucuuaucuuauuuuaaccaggaaccuccauauucuuuuuuaaauuuaucauuaucauuauuauuaguuauuguuuguuuguuugcuugcuugagacaggcucucucuauguaguccuuggcuguccuagagccuacuauauagaucaggauggccuugaacuaacagaaaucugccuaucgaaugcugggauuaaaagcuugcucccuauccuggcuuuauauuauuuccuauaaugguuuauuccucaucuuauugagguauauuuucauauaguacuaugcauauauuuugguaguacaggucagugaauuugguguuuauauauuugaauuuguuacuauugugucagagaauucacuccagccaucuagcccaggcuaacuuuagacuuggcuguuguagcucaaacuggccucaaacuuaggcacuugcugucucagcuuucccaaugcaaauuaaguuacacaauguguacuacuacguguggccuucugcuucuuauagccaguucucaccuacgucaugcuguguacagcucugucacaacucuguguacugacauaaacucugucacuggauuagauuuaccuguugugggacuccuauacaugcccuuauugcaccugucuucucucauuauacaauuuuuauauuuuucauguuuuuuuucuuuuuuguuguugacugguccuauuuccaauuuuucaugauuuucuaauaaagaaggcaaagacuagggauaguuugguagaauaauuucuuguaguuuuuuuuaugucuuuaccuuguuaguucaguuagauaacaaugugcaacccaaugccagugucuuccugccauucuacacuauuuucauuuuaguuucuauggagaaagaaaaacuaugaagugaucugauuguauguguauacuaguaugaaauuccauaauggucuuuucccaucacacaagaauuugccaagcuuuaugcacacuuuguaaguuuauucccccauucuuggucaagagccugguuggguguucuaacaaaauuuauuuuuacccacuuucaugauagccauuacacauggagagaaaaacuagaauuguagaauuaaguucauaagagaauaucagaaaccaaauucuaacauauuuuuaaauggagugaguuuaauaauaacuacuuacaucaagaacuaugucuuaguuacgguuuuacugauaugaacagacaccaugaccaaggcaagucuuauaaaggacaacauuuaauuggggcuggcuuucagguucagagguucaguccauuaucaucaaggugggagcauggcagcauccaggcaggcauggugcaggaggagcugagcguucuaugucuucauccaaaggcugcuaguggaagacugacuuccaggcaaguagguugaggaucuuaggcccauacccacagugacacaccuacuccaaccaggucacaccuauuccaacaaggccauaccuccaaauggugccacucccuggcucaagaauauacaaaccaucacaaacuauaaaggaauuucugaacucucuuuagagauauuuaagucaaagaaauccagacauaguaauuacaaacaaagcuuuccucauaucauccuugcccggucccaaguccagccaugcaaagguuccaacuuguauugcugaguuuucccuccugaacauuuccaugucugauacugugcuugaguuuccugugcuagaaacuguauguugaugucuuaguuaggguuuuauugcugugaauagacaccaugaccaaggcaagucuucuaaaggacaacauuuaauuggggcugguuuacagguucagagguucagcccauuaucaucaaggcaggaacauggcagcauccaggcaggcacgguucgggcagagcugagaguucuacaucuucaucugaaggcugcuaguggaagacugggcauccucaggcagcuaggaggaagagcuccaagcccacccccacagugacacacuuccuccaaaaaggccaaaccuuuugauagugccauucccugggacgaguauaugcauuccugcuauauagggagagcgauuuagucuuucucucuccugaccaccacauuuucuuccuuccucuuucuaaaaaugguagcuauucuuguuuugguuaagcuauuugugcuaccuauuguaauuauguaaacauuuacaucugagccuuugguggcuuugucuucugugcaguucuugcugccacugcucucccuagggugaugaggacagcccuguagccuucugugaaggagucccaaccuuacgcauuuuaucuguguucuuguauugauggcacagcauuucucacacguuugcugauucuguucauguaguguuuacuuugugagcacuugcauggcugaaaaugucuuuucuucauacuuaauugauagcuuuucugggaaaugauucacucgcagaaaugugaagagauaauguuccuuugucuuagaagcuugaguugaggucuaacucaccaacuuuuguguaggcccuguuguuuucuuucaaaagcuuuuagauuuucauccacugucuuugcugucugucucucugcugcucuaucccucucauuuucucucucuuuauuuuuucauccccuccuccuguccccaucccacuccuguguccaucuuuuuuuuuuuuuuuuuuuuuuuuucuucuuccucuaagauagauucucaaggaaggccagacugcuguggaauucuugguugcucugacacaaccucuucuuauucuguugucucccucacuuccugcauccuuucuaauugucccgcuuuggcuagugcuggcagaaggacuccugcccauguugcuugauggaugcuggucuuuaagcuaucucugugggagucugaauucuuccuuuaugcuuuucauguucugcugaugcccuucagugcagcuaaacccacugcaggcuguggcccuuagccuucccggucugcuaguuuccaccauccaccaucucucugacuggcuucuaggauuguaguguggucuucuguucgcuauuccuccucuguucuuucucucuugaugucagugccuauagacucucuuugcuuuuaccaugguggaacuucaagaagcgauggggaaagcuagaacagucuuugugagauuuucuuuaaucccuccauggagucaugcuaccugcuucucaaagaacaucacaaguucuucuuauucaugacuacuuucuuuacaucaaaguuguauagaaaacugauuuagauauuauaaaauucuaaaaauugaauaguuguuuucccaagaaacuucccaaccuuuuucacguuuuccaagcuuguuagauaaauacugaaauuucauuuuacagcuagcagaagcgcagugucaauaguauguucacucucaaaauauccacguuggagaagaauacagguuuucagaagaacugacacacagacucuaggguaaugggcaugccccguacuguugacaguuuggauuauauaggugaacaugguugucagaaugcaccaguguuacacugcggugcagucaccuuaggggaaauagagacaaacuaaacagaagcguaugcuaggauugucagcaauguuugaaugacuuaugugaguuuuuaugauaaugaauuuaaacauucccuucucccccaacaaaaacccaaauguagcagcaccugcuugaauccuagugcuugggagaaagagguagcgcggucacaagauccuggccagcggagcugcugagaccuuagcaugcuuuaaaacuuccuuuuccauguuuuaaacauugcagguuuuaaggguagaaaauuacuuuaugaugugaaugugauuacugucugucccccaacucccuuuauccccaaacuucucuaccuuuauuuggucacauuuugccugugcagcaguuugaaugcacagguguacagaaugcuggagauugucuauuuaauauuaaauuuacuaacugaugcuuaaaaggggaggcaaaaaaaaaaaucucucaugucucugagauuaucuaugugcuuauuucuuuuucacugugggccuaguuguauucuggucaucuggggugagcacugagauccugggcuguagacuuuggcuggaguucuagagcuguaagugugggccuagcggccuucagcugcaagggaaacuggggaagggaagucagcacuggccucuuacacugaucguucacauuucuaugaugcuccagauuuucagagugccugguagccauugaauuauuucuagauucacucaaagguaagcugggaguaguuuucucauuuuuacgggagaaaaauuagaaauauagagaggcagugaagcacacaagugacucaguacuaaaaucaggacuagacuuuugcaaggggaccaaccaaggggaauaagugggaggaaauuaggagcuugccugguuaggcaagacuuugaaccaccugaagaucaaauauguguuauuguaggucaaagagaaucugcuuuccugcaagaugcugcugcauugcaaacgggaugagcuucguaagcuguggauugaaggaaucgagcauaagcacguccugaaccuacuggaugagauugagaacaucaagcaagugccucaaaagcuggaacagugcauggccagcaagcacuaccucagcgccaccgacaugcugguaaggcagccugugcagaggcucgcccugcacggcgugaaagugcucuuccuucuguaccuaacaugguauaaauggcccuugcaauuggcaagcuugcagggaacccuagcuuguucucuuccaauaguguuugaaauguuagaugguuauuauuuauauauuuucugcccucugaaccaaggcaagaaacguaguggaaagaaaucgguacugaaaucauguugaaaugguaacgagagauuuauuuuagcuucagaggaagaucacggaucucauuuuagaggaugaagucuaugugacacagauaugaagauuuguaaaguuauguguuggcaaagguuaggaugccaguuuuggauuauagcuuugcuuuguucuuuucaccugauaagaaagaaaaugacuucuguaguacuaaucuuagagcagcagugcucugugaccuaaacuguacuuccgcaguccauggaguucugauaccuuuugaauuaaugaaaguuacuagaggaugcaauuuguggugaaagucaagccagacuuugcucccucuugguccugacuucccagggcuggcagcuuuucuggagggcugugcuauuuuuuggcccauuuacacauauccauauccacuuucagcuggguagaagucuauaaaugcuuucagcagcagcuguguuggguuugaauuguucuauuauccacaauggggcaaguucuuuaucuuuuuuuuuuuuuuguuuuguuuuguuuuguuuucaaauuauauuggugaaaacacugagggacuugguagagauacugaugaaauaauucauuucccuacaaugaagaaucuugcuggagguuugcuauaaggaguuuuaaugaauuugguaaccaaagugugagaagugcccugguguuuuaucccauaagucaacugaauaauuauuuuuuacaguagaaggaguggccuugagguaguaaaagaauuaggguuuguguguguauguguuguuggcuuuuguuauuggccauuuaauguggggccuuguacaugauugauaagcacucugcucucuaucacuaagcuguaucuucagacuuuuuauauucuaauccuuugagacaggaucuuaugcacuugucaagggugcucucauacuuauucuggagccuggugggccuuggguuuguggucuucuugccucagccuugugaucagucaggccacagcccugcacagccagguccagcuuguuuccagcaucuuaucagaguaacauuuuagcucauaaugacugggaaauuauuuuaguugauuuaugaauaauuuugcuaaauaaccaagauuuagcaaauagaauagauaaguuuuauauguuuguugggcacguauauaguuugauuuacugaaucacuguuuuggucugugucugccuuuaauuaaauggcauguacuaaaauggguuguuaggauuuauuuagguuaauuauguucauuuuaggauuucagauuguuauuuuaugacccuauuacuuuugugcuaauuuauuuauuuuaaggcuuuucaaaaaugaguauugcccuuuuguugacuaauuuuuguucaggauuuaauuaaauaacuucaucaaauucuuuguuguaaguuauagaaauuaaacuacaguauuuuuccuugguguaacaaacaccugagauaaaucagcucacgagaaggaccauguuuauuuauaguuuuaagaguucaggguugcuuggacaagccauuaaacugaguuguguacauguggcagaggagguuacucacuucauguugaccaggaagcaaaaagagaaucaggaagagccugugguccuuuaaagucauguauccauuggucuaaguuccacagggcacuaccucuucaagguuccaccaccucuuaauagugccacagagggauugcauccucaacacauggcucuuuggacaacauucaaguugcaacuguagcauuugauggggcuaaaauaaacuggacucauguaaacagucuguuaacaggacagaggcauacuuuuggaaagcuacuucuguguuguuucuguaugucuuuauuguucuccucuagacuggugucauaguuagcuucagcugucaacuugacacaaacauggaguuauuuguaagagagaaccucaauugaagaauagccuagaucagguuggccugcauuugugccuguguggcauagucuuaauuguuuuuugauguaggugggccugucccacugugggcccuaacuuccuuagaaaggugaaucugggguguguaugaaagguagguagcugcccaagucauagggagcaagccagugaguagccuuccuccacugguuucugcuucaagcuucugccuguaguucuugccuuggccucccuugauaaaagauuguagucagugagcuaaaaugaacccuuuucuucccaaguugcuuuuaguugugguguuugccauggcaacagaaagcaaaccaggacaauugguuuuaacuaugugugaggauagaguuggcugguuguguuuuggugggagagggcaaggaggauaagccauagacuucaucuguccaguuuuauagaagguaauaaauuauuuaucuucucuuuuacuaauaaaacucuaagaccuuuuugaagcaguucguuauagcgauuauccauucuaacuaaaaguuucguguuagaggagcggaaccauccccucucagacacggccaguguguaauacacauuguuauuuuccccccauuuauagcuguuuuuguauucuggauacuaaucuuuugucugcuauguggguuauaaauauuguuuuugaauugguguuuaucuuuuuacuuuguucaugauaucuucuacuaugaaaauuuuaaugcaaaaaguacuucaacuuuauuuaaggaauauaauuuaaaguaaaaaugauaauccuauugccuuuaagagaauuuucuauuuuuuucuuuaacccaucaaaaguccauuuuuauuuaugcugugagccagggaucuaauuauauuuuugcuccauguguuuauugacucuuuuuuucuuauuuauaaugcuauaugucacaugccaaauuuuugcauauguauguaucuccagguuuuuaucuuguucaauuggucuugucuaugccuuuuuguaaaaagucugucauuguguucaaaauuacuuauacucuucuuaacccucucuucuuccaugguaaguuuaguaucaguuuaucaaauuacacaaaaagaugaaaagaauuuccuuggcuuuauggcaguuuguguauuagcaauauugucuuuauauuaguggaugugaugcuugcuuauucaauuaugccuuugauaaugcuuagaaauauauuccuuauaguuuuacauauauuccauuacaucuaguauaaaccuauguucugagggcuugaaaauaauaacuuuuuaauaaugucuagcuauuuguuguguauaaagauacacuaauuucucuauuuaauauuuaucauuuaagaauauuguuuuuugaaauuauaauuauaucaguuuugccccuucucuuuucuccuuucaacucuucccauguauauauauuccuaauauauguauguauauauauuccuaaauauggcaguacaauccgcucaaucuuuauaauguuacuuguaugucuaugauuccacagcugaccaccugguacuggaugaccaaacugggggcuuuucccuggagaggauuauuucuccugcuccccaaauuccuuaggugcugugguucuuuuucuaggguuaccuagguuugagggccccaugagauuucccccuuguguuagcauguguguuggugguguccuuguucaggguuaggcagccauguugguguagcuucuuugauauuucuaggagaugcacucucacaguaauuuccuguuuccuuacacucuagucccugagccuuaggugcagagguuguguuguagauggaucaggugggacugagcuccacacagacagcacuuguucucuguacccugaugagcuggacuuucccacaaaggucucugucuauuuuugagggucagaagauagccuuuauggaccauuucucugccuuugccacaugaacaagggauggaauggagguugucagauugugcaacaaaugucuuuuaucuguugagccauuuuacuggcuugguuuucuuuauuaauugacuauauauuuuccaggaguaauuaccaaucccaucugcuuggacuuggcuuaaauuuacucaacuuucugaauaucucagauacuacuguuuuuccuuaugcuuucauaagcuacaugaauuucauuaucacauaauugcuuuuauuuaugugguagaucauugguugugagguuuauuuuuuuauuuuuauuuuuuauuagguauuuuccucauuuacauuuucaauacuaucccaaaggucccccauacccacccccccauccccuacccacccacucccccuuuuuggcccuggcguuccccuguacuggggcauauaaaguuugcaaguccaaugggccucucuuuucagugauggccgacuaggccaucuuuugauacauaugcagcuaaagacaagagcucccggguacugguuaguucauauuguuguuccaccuauaggguugcaguucccuauagcuccuuggguaauuucucuagcuccuccauuaggggccgugugacccauccaauagcugacugugaucauccacuucuguguuugcuaggccccggcauagucucacaagagagagcuauaacuggguccuuucagcgaaaucuuccuaguguaugcaauggugucagcauuuggaagcugauuaugggauggaucccugcauauggcagucacuagaugguccauccuuucgucauagcuccaaauuuuguuucuguaacuccuucuauggguguuuuguucccauuucuaagaaaggguaaagugucuacacuuuggucuucguucuucuugaauuucauguguuuggcaaguuguaucuuauaucuuggguauccuaaguuucugggcuauuauccacuuaucagugaguacauauugugcgaguuccuuugugauuggguuacuucacucaggaugauacccuccagguccauccauuugugggguuuauauauuaccuguucccacaacagugacacugauagagucagaguucacaaaucauuaauuagguggguaaguauaugaaagacuuuaauacauagaggaaaugauauuucuuaaagauauuuuuuccaggaguuguaccuuuucuuuucugcuuggugaauuuauuuuuugacaaaauacucuaauuuauaauguuuuauaauauuuaaauuagcaaaagcaauuucaacagagcuaauauuguacaccuacuaugugcugguauuguaaauaugggaaauguaucaauucuguucacucuuacagcugggauagaugcauuucugguaucaccauucuauagaagagguaauugugcuugauuaaggaaauugguguauccaaacauacagcaauuuuuccagucccugaaagguuggaaauacucuucgacaguuuuggggauauaagaauauaguauaaggucugcgacuacucuuuuacugacuucauauugaaaauacaaucacauuuccucucuccauggcuauaugcuguuacaagaaaaaucuacuuaaggaaucuccagggcccaaauggaaaucuucacuaaaaugcaucagaggaaaguaaagacaggacaauccaguuuuucaagccccacugauuuccuuggauuuguuugacagaagauuuugcauuuucauuuugaggcaggugcagauauagauauguaguaauuugaucccuccacaguguagguuaauaaacccagaguaaauaaaucaguggugacccauggcucuugccaucuccugcuacuccugauucaaaauuugaccugucuuguagcuguaggcuuggcuucuagguggaauuuuauuucuucuuuugauaugauaaccagaauauugcauaaaauaauuaaauugucaugacagguaaugucugcaaauaggcccagccuuuuguuuccuucuuuaagguaaacagcugcuguugguuuaugaaaagcuaaaauugauccaacaagaagccacacagaaaucagaggcuugauuaauacuguugccuguagcuuugugauauguaugguuuaaauuagaccuuugcagcauugugcuggguuggugcaagcacacuaaugacauaauuucugguugcugcaucacauuucugcagucgggcuuuguauuccacucacauuaauugaaguaauuuugccagugaagcguguuucaaaccucugcauuuaaauugaaauuuuaauucccuuauugucuugaaaagacggcugaagaugccuuguuacagguuucauuaucacucaaaacacuccagcugcugguuuuaauguacaaugacugauuaauucuggaaacaauuauuaauauaagaauagcagcuucuucccaguggcgugaguaaccaggaagguauuucaugagaguuaauauuuuuaugaacuuuuuuccccccagggagaauuuguguguagaagucugcaucauaugaaaauuguagggaaugcuuugaaaaccacuuacacaaguucugacuuaucagcuguagaagucaauucauaauugcauucaaucaguggaaaccaaggcaguggaagucguuuagaagcacuuuagcugacagucacauaagacuugugacgaaaauaaauuuccauuucuaagccugccugagauuguagagauuuuaaaugucuuuuuaaucauuuugucuuuauuuauacgccuuuauaaaaagaauccauagcuauauaguccgaugaggauuauuaugauaauuauaauaacauauuuauguaguugucuuuuccccagaggcucucagaaugccuuucuuugagcauuguguaacggaggcauuuuacucauacuuugaaaauauggcccuaucugggauaaagaccgcaaggcagcuauuuaauugaguaguuuucuagaauccuauaauaaacguauugucauauuuucaguuccuauuacuuuuugaagcugauauugagaacaguauggguuuuaguuguguaagaccuagacuugaaucuucgcuuugacuccuagcagcaguauggccaaucauuuaucuuugcugaaggcucugauguuuauugaaagauuuaaauuaaccacacugcacauuauaaguucuuuaaauauuuauaguuauucaauuuuuuaauugguacauauuuuauauguauugguauuugccuacauguaugacuuugccccuuuuacaugccugacgcccucaggaaguccauuaaaggacaacagauccucuaaaacuggagguacagaagggugugaacugccauggagguacugggaaucgaaccuguguccucuggaagagcaaccauugcucuuaacugcugaaccaucucuccaggcccuagaccauuaaaaaaaaaacccaugugguuauacaaauuuugaucacuucuguuguuggucugguugugaagguagucuuaagagcucaugugccagcagggugagagagaggaaacaguguucaucaugugauaaguacggggcgggggcaugcagagaaaaagggaugcuagggagaguggggguagggauuuugggguaaucccccuguggcugcuuuuagccuuuuucgaaagccuucauccucaaacaucugucugauaaguuaggaaaagcuaaaacaaaguuauugacugaauuggcuuuugugucccaaauuaauguauagauuugugguaauugcagcuuuuuuuccuacagaauuaaaacucagaacuuuguaguauguauuuuuccuguuguucagaucucuuuuugaacaacagcauuuggcuaugauagggaggguuuuuaaaaaucagacaguucuguagaugccuucacuuuuauuucuuucaaaucugcuauucauuuaccucuguuaucuuuaaaaucaauagaaauuccauuucaucgugugagccccucaugcggcuuagcaauuuuuauuuaauuuaucuggagcagugauuucuaaauuguucauugaggaucuuucaaaaauuguaaagucuaggccacaacccagucugaugaaauugaagucucugguuguggacugcuggcuuuggucauuuuugacagucucaaaaaaacaaaaaaacaaaaaaacccaaaccaguuuauaggcacauuuggauuucuugguauagggcuuagcuugugcuguggaaugaaggcagacuaaucguccuuaccuuuauuuaacaccagcucgaagugugaccgguugggcagcauuuguaccuguuaagucuagaguggugauacauucauguagaaauguuuguggguguuuuuugccauccuuuauuguagcuuggauauagcuggugccuggguggcuucuauucugauuauuuuagguagauuauguaguuuaaaagacuuuaguauaauaguuaagcugucuaggcuaagauucaacaaguuuggaccagcuauacacuugauuuuaaucuugcucaugugccucuugaaucuuugcuguuccucugguuuucuucagggcuuuaguggauugagauugggguacaacuguauuaguugacaagugguggcuguguagaguaugacaaaguggaaacaauuuuggaaaauguggaaaccugggcaaagggcuucaaagauguuccagauucucguccugccucaguaagucuccagugcuuuuagccuagagaggugaaucacuuucugucccugauuuuuagugucauuaccuauaaaaaugauaaauauuguugaauggguaugggaagaagagugaaauauugcagguaagguaugcuuugucaaacuuaaagcagucuaaagaguuacaccaucauugucaucaucauuaccaagugcaaaguaaaaaggauacuaguccugagccuguuuacacagagcaaacagcguuucuagccugaugccggugucacuagggcacacguuguucagucagguaaacuacacgaguguuugcacacuugauuuuagaggaaaaaucguccagaauaaugcccuaguuauuuguuguuauccauuacauucugguuucaguucuaccuagaggcuucuuugaacagauauuugauuaguugcuuuucagccaaaugugagccagaucuuugugccaguuugaaugccgguaaccuguguugauagaugucagugucucagccugacuaugaucuaagaaugcuuaguaguuuuuacuuagcuugacaggauggaguuaaguuguuccaaagucuguuuucucugacguucauccugauccuaauuaguuguauucccuuagcuauaaauacaaacugccccuuuucccuugugggauacucaucaggcgcuggugaggcugcucagcguuuccaguggccuuagaggcgcgugcaggauacuccuuugagaccucaauucuccaacucgcagcaaaguuuucuaaaacuuuuucuugucacagaauaacaaacaagaugcuggguaaguguagugacugggacacuuguaaaaagauaaugucuuucuuagaguucuucggcuuguggagaaacucaguuugaauccucuucagagagcucugugagaacugaaaauugaagggaaaaccggagcuucccucucccuuuuuagcaaccauccuuuucuuugucaucugguguuagauggagcuuaauuuaguugggaaaguaaaacuuuuuuuuuuuuuuuuaaagaauaaacaagacucuuaauuggguuuuauguuucagaacucugggauuggaauucuacuuguagaauuuuauguuaaugaacauuuuucaacuauuguguaccugcaucuauguuuuuguggauauagcuauuuaucacaguaagaucugugauacaaagacauuugcaaugaauuagauagagggaauuuauuuaagucauuugugauguaguaguucacauaccagugugacugucaagauagcacaacacauuccuagacuuuauuauguguugauauuccuaaauuauuacaaaugaaagaagccauguuuaagauauauaagacauauaucuauauguagauagauguaugucuuauauaucuauauaucuccccuuaucuguaaagucaagauaggcaucuaguuaaccuuuaaagaccucauaagaaaagauucauacauuucaucuaucagcuaaugucauuuuuugaagucugggcugauggacuaucuuaaaucuaguuggcucuacuucaagacaccccccccccacccuuaaaaaaaaaaaaaccaaaacccaaaaacuguagcuuuaauaaaauaugaguuauuugugguagaauacaaauguagagaggauaaaaaaagaaaugaaaaauuaagagugcauugucaaaagaaaguucaagaauagcuuaauaagagucuguuuuauaaggugaaaucuuugcugaagcugcauuuggucuuuuggaauuuuguuuucugagauagauuugaaagucuaaagaaguucacagauuuuuuuuuuuuuaauuugcugauacuuuaucuuacaggcccuccuuccaucaugcacuuaucaauaaccucauguuauuugccuuauucugaaaauuccauuaucucucaggcagucuauugcauuaggcccugaguacccaauaucaccucauuuacuugaggugugcuugaccucagcccuucuucucucuucguuaaugcaccaacaagcacugauaucucucuggagcauuaucauuuggcuguuagcucaacuaauaacaacccuucauuugagcugaugaagguuuauuaaauaaaaacaugcaauaacccuggcaauaaugaaaggagaguggagcuagacugcauccuguuuguaauggugagagugagcaugcugagucugcauuguagggauggucuuccugcgggagacagggcccugaauaggucagaucaaugcuguguuaucagucugguuuaagaauggacaguuuugauugucugaccugauaacugucgauaagcacacaggcugaggacucuggggaaaaagauguucuugcuccaggcacuuggccuugcucugugguacaucuaucuugggaagucugucuuauguagcugacuaucaauagcccugaggcuuccagacacuggguguguagaaccaaagagaaccaaaaagucugguuucuccagggaugguagcaucagaaauugcuuuuccuauagauuccuaaaccuccucuaaaccucauuauuucucugagccuugaauggacuccuuuuauucugcuuucuauacuccaacucuuuucuucauuggguaguccagcucuuguaaccacugagcugucaggcuguagacgaaaguuaagugagugacaucacugacuuuacauccgcaauggggauucuugugagcaggacuuacuuuauauacuuuauaucucuuacuuacgguguuauagccuaguaguaaaacugugucucauucauuggaugcaguuaaauacagagaguuguggguagcaguguguguguguguguguguguguguguguauguauuuagcaaagugggaauucauuaaggaaagguccuaguacagauuuuaggaagaggacacucuucagaguucuguaaaggacacagcauuuuacaguagugcucugauaucccagauagagcaaagcuuucaguccugcuccccaaacuguuagguuuaucagccuaaaauaauaacagguaggaugucuuuucacaaaauauuuuuauucaggaacaaaugggcauauuuauuccuggcugcauguacuauuacagcucauggguacauucaaggaggcaaagacuagaccuuuucaaaguuaaacuaggaagguuuucaaaauuguuucaaaacuauuaucuuuggccaaaaggaucacuaucagggaaguauccgcucaagucuguaaauaguagcuggaccggcagcuaagcaauaguaucuuuuuuguguaaagucgauaucgcuucugcugaagauugcugguuuuuuuguuuuuuuuuuuuuguuuuuuuuuuuuuuaggcugcaucaucucucucucuuuuuuuaaaauauuuuuauuauuacguauuuuccucaauuacauuuagaaugcuaucccaaaagucccccauaccccccccccccccacuucccuaccuacccauucccauuuuuuggcccuggcauuccccuguacuggggcauauaaaguuugcguguccaaugggccucucuuuccagugauggcugacuaggccaucuuuugauacauaugcagcuagagucaagagcuccgggguacugguuaguucauaauguuguugcaccuacaggguugcagaucucuuuagcuccuuggauacuuucucuagcuccuccauugggggcccugugcuccauccaauagcugacugugagcauccacuucuguuuuugcuaggccccggccuagucucacaagagacagcuauauuaggguccuuucagccaaugcuugacucuuuguaauccuuuuuuucucucucaguccccaugagugaggaccccuccauuuuagccucuauacucuguuagagucugauauaaaguaaaugacuaaauugugggagaaacuuuuuaauuuuuauuuuaucaaaaguaguuaauccuggcaaggacucauauuuccagaaaugucuccuuuucuguuguagaugaaccugucuccucagguuguguaguccaguccucaccagugagcacuuaggaauaauagauagauagcccuuugugugcuugcuagacuggguuggguucugguaacccuuuuaggaaaacaauugcuuugucaugcgacuuuugcuuuguuugcacauuuuuuuuugugggauuguaagauuguucuuuguuugugauaguuuucacuaguugaaacaagcuaaauaaauagccaacaugugaucauuaugacucaugaaaguaguaauaccugaaccuauuaccuuuaaagcuucauucaguuguguuucuuaguuccugucugauaaauauuuaaaauuuugcaaauccuugaucucauguuugcuuagagaucuaaaugagaguggauccacagggaggccuggaguuuggugucucuggcagucuacaguucacucucucuucagguagauacuugggaguaggaggcuaucuaggagaaggagguugaagccuccugcuucuccucguuuuuuggcuugugucuuaauuucuuuuggagauaguugcuaauaucauuuaucucugugaauaucucuaccaaauuuuuuuaaaaaaacuauuacuuucuuuuuuuuuucuuuccauuuuuuauuagguauuuagcucauuuacauuuccaaugcuauaccaaaagucccccauacccacccacccccacuccccuacccacccacucccccuuuuuggcccuggcguuccgcuguacuggggcauacaaaguuuacguguccaaugggccucucuuuccagugauggccgauuaggccaucuuuuguuacauaugcagcuagagucaagagcuccgggguacugguuaguucauaauguuguuccaccuauaggauugcagaucccuuuagcuccuuggguucuuucucuagcuccuccauugggagcccugugauccauccauuagcugacugugagcauccacuucuguguuugcuaggccccggcauagucucacaagagauagcuacaucuggguccuuucaauaaaaucuugcuaggguaugcaauggugucagcguuugggugcugauuaugggguggaucccuggauauggcagucucuacaugguccauccuuucaucucagcuccaaacuuugucucuguaacuccuuccauggguguuuuguuccuaauucuaaggaggggcauaguauccacacuucagucuucauucuucuugaguuucauguguuuagcaaauuguaccuuauaucuugggaauccuagguuuggggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggggucuuuccagcuucuggcuauuauaaauaaggcugcuaugaacauaguggagcauguguccuucuuaccaguuggggcaucuucuggauaaaugcccaggagagguauugcuggauccuccgguaguacuauguccaauuuucugaggaaccgccagacugauuuccagagugguuguacaagccugcaaucccaccaacaauggaggaguguuccucuuucuccacauccacgccagcaucugcugucaccugaauuuuugaucuuagccauucugacuggugugagguggaaucucaggguuguuuugauucacuugaucuucgacaagggagcuaaaaccauccaguggaagaaagacagcauuuucaacaauuggugcuggcacaacugguuguuaucauguagaagaaugcaaaucgauccauacuuaucuccuuguacuaaggucaaaucuaaguggaucaaagaacuucacauaaaaccagagacacugaaacuuauagaggagaaaguggggaaaagccuugaagauaugggcacaggggaaaaauuccugaacagaacagcaauggcaugugcuguaagaucgagaauugacaaugggaccuaaugaaacuccaaaguuucugcaaggcaaaagacaccgucaacaagacaaaaagaccaucaacagauugggaaaggaucuuuaccuauccuaaaucagauagggggcuaauauccaacauauauaaagaacucaagaagguggacuucagaaaaucgaacaaccccauuaaaaaauggggcucagaacugaacaaagaauucucaccugacgaauaccgaauggcagagaagcaccugaaaaaauguucaacauccuuaaucaucagggaaacuauuacuuucuuaauaacauuucuuuaaugaaguaguugcucagaguucaauucccagcaacuauaugguagcucacaaccaucuguaaugggauccgacucccuguucuggcauacagacauaaguacauguguacaugaagacaaagcacucauauacauaaauaaacaagucuuagaaaaauaaaaauaaaaaagcaacuuacauccuuccaacauaccauagcacauaauacacauugcuauucugaaaaggaggaacgggagcauguagggaguccuagaccaaagcaacacugaaaucccgcaggacaaacuccagauucuuagaggcuuuuucccgucucccacuccuuccagcuuuguugguuacaacaaguuuuucuccugggcugguuucacuuccuguuguguuucuccgugguagccaccucauagcuuuggcacauccaacaucuugggucuccuaugcagucuagacuucacuuucacagcuucaaguaauaguuucuucaggcaggaauuccuugucacaggucuggccuuaguggcuuuccuugacuggaguagaagauuacacaaccuauauccucuugacucuaaauccagaaucaccugaccaaauccgccaaauucugcuugcuggggcuggaguucuggccuccuccuugaauaacauuugcaguaaacuuuccuuguugcuuagaccuaggagaucaauagcuuucaggauuaagcaggucugggcuugcccugagaucauucugggcuucauuuaguaucaggcuuuuuaaaaaccacucuucuguuucagcugcucccuuuuuccucagacugugcauuuuauguuucacuuuaccccgcuugcuacuuuucauuguguauuugcauuaagagagaucacuaauagccaugcgccacagucaguauaugcuaccuugaaauuucuucugccaaagcaaucaaucuaagacucuucaauuuagucuccagcagauuuuaaggacagggcaaaaagcagccacguucuuugucaaaauaucacagacuggccucuaauauuccucuccucugaagccucuugagcugggccuccauagucuacagugcucucaguacuacugccuuccauguuucugcuagggcguucauuaagcccugcuuacagcauucuuuuuuuuuucuaauccaaaguccccaaaucuuccauauucuaaacagcagcuuggucaggccugucacaacaguacccuaacuuaccaggaugcauggccacuggcaaguugcagguagggagagaaugaaaaagagccuggcauggaccuuugaaaccuuaaagugcacuuccagugacaccguccuccaagagggccacacucaccaacccuucuuaagcaguuccacaagcuggaccuugacacugaagccugugagccuguguggcuauucuuauucaagucaccacaggcacuguucucaauucuucuuuagguugagauuuguaaaguuugaaguucuaggacuacccuuguguguguauguucauguguauacaaauuauauuugguuucaagggaacauagucagaaaacuuguuuaaaugacuacagugggguccugaagaacacuugcucaagugcuguauugaauaaguagguacuguuaaaaauaauuucugugaauacuguuugccaggcauaguguuguuuuuaccugaaguuuauuuauuuauuuauuugauugaagggcuuuggaagcugucauuguuaugugaguuuguguuugggguaugaauuaaaucucuucaugcgaauuccuacaagcaaaucaaguguggcugugcaguggguggcuuuuaagcuuaacuauuuugguuggauuuaauuaccuugagggauaaggcuacacgaugggccagugguuuaccaaauuauguuuuauuuucuggaccuagaugucacugaagguuaaugcguccucuuuucuucacuagagacuugaguuaaaaaaauccauuuuagggcgugaguauaaaugaauuuguuguugcuuuuccucccuuggggacacuuuggucauuuuaagagucugccuuuccauuuggaauuacuggcagguugcccaggacccaggggcugucauagcaggggcaguugcaagucagugugagaaugucugggcaggcuucagagggcagagcuggcccagggcuugucaaucuuccacucuuugauucuuuccugcuuuaaacuuaaggaaacucauuugcugcugacauuugauugcagcacaucacaaaacaagugauguguuuaugggugagccauuacacuuuauuauuauuauuuuuaaguuguuuugggcugguuuguauuugacagccacagagcuuucuguauucauugucuagaagcuuucaggugucuucuuagaccgcuauagaucugugauuaguacuucuuauuaccaaagcauuccaugacuuuccuguuugagacagggauucucuguguagcacuggauguccuggaccucgguuuguagaccaggcuggccuccaacucauagagauccgccugucucugccucacagguacugggauuaaaggugagugcuaccaccaucugacucauuucaugacuuucauuaacuauugcuuuuaugugaaugauuuaguguugagggucauuuugucucuauaaucagauuaaauggggucaccccguuguaaaugguguuauuacuucuuuagcuaccucugccugaaagaagcauaacccaagcuggcgauagccauacaccuggauuccucagagcgugugagcuuuauuucucaucaggauuucuuauggcuuccuuuucuucuuucucaucuuuccccuccaccguguagccucaaguuccccucuuuaaccccccccccccccacuccugaguaguaauacuuagaaucuacucuucacuuuuuuccuuuccagauauaaaagaucauuagcaccuagagaauuaauuguacuuacacaaagaaggcgaucacaccucacgugcuccuucccacucugcaguuaucacuugggguuucaaagucagcuuagaucccgaggcucuuucauccuuucucuguuauaggcauuccuuuacgauuucuuucauucaguccuuccugcuuugaaaccucucagccaucagagcaucuccuuuguacuguaccuucaguucuccauuuuuguccccccuuuucaaucagauuggaucagguucuccucagaggucaugauugcuacuucucaccuguagaaugcaugcaaaagugcauuuacuuccacaugcuugugcaugugagaacaugaggacagccugguucuuuauagguauaugcgugaccucagcuaacagagcuaucuggcuuaugcucaccacgagaauaagcuauuaaaaaaguauucuuugcuuuaauuuuaguuguaaggagaaacuuuuauuaagaaguugguuucaagcuagugugguguuucauugcuaggaagccugaggcaagagggguguggguuugaagcuaccuggggccacauaguuagauccugucucaaaaaacaaaacaaaacaaaacaaaacaaaacaaaacaaaccaaaccaaacaauccaaacaaaacaaaauaccacccucgaagaaguugaucucagccauaggcauugagauucuagugaaaauaugaauggauguaguuauuuuacauguguuuuggacacgcaguaugugggggaguaaacagcaccuauggcuuugcuguguugcuuuaugugccuuaugcauuucuuugucaggauuuucuuuucuuuuucucuuuuguuguauuuaucuuagcaaauccuuaagggccuuacuagguuaguccacacaauacucuguagucugauauugcacacacaguucucaucacuccuuuuagaugguacuguaaaacccacucuuucucuuuauggggcugcaagacucuuuacauauacuuauuuggcuuucuuguccuuucuaggugucagcaguggagucccuggaggguccacugcuccagguggaagggcucagugaucucaggcuggaacuucacagcaagaagaugaaccugcacuugguucucauagaggaacugcaccgccaucuguauaucaaauccacuagccgggugguacagcguaacaaggaaaaggggaagaugagguugguuacggggcccgucuacuacaaugucuuguggcaguaacauuauuuggaguaacauucucugaauuccagaauacugugauucauuuuccuuacccuguaauauauauacugucuucaaacucauagaagguuuuauaauagaaaauaugccauauucagagaggguaacaucaguuuguucauucauucauuguguauuguucugguccucuuauauaaggauauguaagaacauguccugugggccuguuguuccuuauggaucagagacauucuugugcucucagaaggaacugagaaagaacuucaguuaaacugugaagucaucaauguuugaaauacugagaucuacgaacugaaguugaagauuuaguagggucuucucagcuuuagcugauuuguucuggaggagcucaagagaaguuuaaggaagaaacuuggcuuugaauccuugacuuguagcacagcccuauguuuuacaguccagguaggcucaggaagaccguuacguuaguguaaauauggaguggagucaggcuagggcuuaagauggucgaucauugcaguuaugugauugcugcacacaauggccguccuucuuauauuccuagagagaauguaagaacuuuuccgaaggucugucaugcacugucuacugaaauauucacauuuaugccuucuuauccagcuguauacuaggcgagcacgggaaguggugcaugcugggugguguccugugcuagguggugcuucuguguaaccagagacuggacauugaaagggaaaggucuacuucuguuuagcagauggguaguagacaaacugcuaggcccauagauggagcuacugaguuuuggacuccagaguuacuucaggaauagaugugaaugaguuacugucaguuaccucuugaguaguguauucuccuggcgacagugugaacagaaugaucagagguucagaaauuguaguuagaaugcucauggacauuccuguuuuuucuuauauuuuaaaauuaucuuauaaaauaagaguucugugacuuuuaucauacaucccucauuuuguuaacucuccucccacccuucaucuccaucccuaucuccacugaaacauuuccauuuuaguaucaccauuucuacuuugauaccauguauaaaggacugaaauuuuugaaugggcugcagacugguugguuauauaauaaauucuaaacuagcuaaagacugaaaacacugucugaaaaaacaaaacaaaacaaaacaaacaacaaaauuguaguuaggaagauagcuuaguuacucagaacauuugcuauaagagugagaggacccaaguugaaauccccagcauccuuauaaaaaccagacuuaggugugcaugucuguagccccagcauuugggacagaggcaaacauaucaggaauuugcuggcuagucaacauagccaaagcgugaucuuucuguuccaugagagaucuuauuucaaauaauagagggcagagaagcaauugaggaagacauuugacaucaaccucuggucuccaugugucugugcacacauccuugcauacauggauguguacauucuacauauacauagaauaaaauggaauaaauaaagaucucuggugggaaggcagaagaaagaaaagaagggagaaagggagggagggagggagggagagcaggaagacauaguaaaagguggauucugaagaaauggacaaaugggaagacuggcagucucacagcacacagaugccugauccauuuaaauccaguuaacauguuugaugccgucacaucugaagucuacuaagaagaaaaaguauguaacaauuguaaagaaaaugaagaaaggaaguucugagggagguauucuucaugugacauucauguauauuauaaugcuacucaaagcagaacacagagugcaaguagagacauugccaggacaaaguagaguucugaaaccaagcuuacaauucacagaaauaaauuuagauaucuuucuuuuacauacaaaguguucuagccagauauaaaaauuaucugauaaaacgugguaggcauuaacagacaagaguauguguggagcaggcuuuucuaagcaaucagacaauucauaaauaauaauguuaaauaauuuaucuauuucaaaacugaaaacauuuauaguaaaguggaacaaaaguuaaaacauagacuuaaaaaauauguaguaagguucacuuucuaaagugugaaacuacuccucagaauaauaaaagagaaaugaugcaacuuuuuuuuuuuuuuuaaacaaaccuuaaauagauacagacauaucaugauuagagaaacccagacuugagaacucagguauggccuuuugaucaucagacagccaaagacauccauagcgugcuaucuugguaagaguaggagaaaugaaguuucuucuguuugguugaauaaccaauaugccuuuguaggaaauaaaguuuaaccaugaaauuccauuucuuaguucacauccuauuuaaaauauuaccaguuuaugaaaauauauauaguaggauguuugcugugacauuauuguuaaauucguguaacuaagauugguguagugcagcaugccugaacuccuagcuauguuaacucucucucaagaucacacuccauggggcacaaaaaggggcaucccccaauccaacuuccuugcuccuuacaaagcucaauacagcuuuaaugcuuaucacaaagacuauggcugaaugaauuauauguuguaacacaacagcauaaaauggaugaccucuagcauauagagaaagaccucuauaugcuuauuagguaagauuuccaagauguacuacgggacccucucagaaaugauaggucacccuguguguauccugagucaguacuugcuuugaccuuucuuuuuugugccuucucugacauguuauacugguagagaacacugcagagccuauggguucgguaucuauuuuuguguucaaaugugaaaaacauauuuuggauuccuuuguguuacuuguuuucuauuuuuccuuugcauuuucaccuauuuauauauacgcuuuuguuuuaucuuucaguucuguuuuuguuuuucucucucuuucuuucucucucucucuuucuuucuuccuuucuuuuuucuuuuuuuuuuaaauuuaaacagcucagcuccacuuuuuuuauauucucuucaccuuuggucugucauuugaagacaugacucuacuuuuuccucaguuuuucugacuucuaaaucacucccuuuucuuucugcauuuucagcuagaucuuggaauuauacagaauuacuaugcuagugauucccaucucauuauaucaucucugaugaauauuuugcagcucagucugauuuaaccaacuuuuaugaacauuuuugaucuucgacaguuacuauaacagguguucuguuauagaggugacuaucuuaguuauuaauuuuauaguguaaagcuuaacucacuuccaucugccuuugacaaucaaaucuaccaaaugagcuggacuggggaauuuugugauaguugaacacacacacacacacacacacacacacacacacacacacacacgugcgcaugcauauauauauauauauauauauauacacauauauauguauauacauauauuuacacacauauauguauauacauauacacacauauauguauauacauaaauauauguauauacacacauacacacauauauagacacacgcauauauaaauguauauauauacacauauauaugcgugugucuauauguauauaugugugugugucuaucuaucuaucuaucuauauauauuuauauauggguucaaguauauguguauauauauauaugugaguaugcacacaugcauauacauauauguguauauauauggguucaacuauauguauguauguauguacacacacacacacauacacacacacacacauacuaauccaagguuuccaaguuagcaauuacaaaucuaaggagcagaaauaggcuguaauuaaaaacaaauguuuuacaagcuagaggacuucuaacuggucuuuuaaaaauaugaaagaacauuuuugauggauuugagaaucuaacauguauugaagaagguccuagcaaggugggugguuaauuuguggccagaaaguccuuugauaaauuacgguggugugggauuuggguaaauuaugauggcaguuggcuuugguuguuaugguguaguauaggucugucaucuugcacaguguugcuguuuauguaaucaagcccauaucacucacaauugauuaugaucacucacaguacacauugauaugcaucaauaauugcuguguuguuuucaacucagcuuuggaugauucugugugggguaaaaauaaaaguuaucaucaguauuuaaaacauagcugcuauucauauuucuuucaaaagaaaacaauucagagcauucuuguuaauuagaaacuucagagucuuucacuuauuuucuuuucuaaaauaacucucggauucaaagaccuaugaggaaauuaauuaauaucuuuucaauuuccucucugaugcauggugagaagaggccuuuucuuuucucuguuuugaaaugaaagcuaagguccauuuaaugugcuauucuguaauagcacccaccucucuguugagcuccaagacucuaguugguaaaugaguagguguagagucuuucucugacauuuuugaaaccaaguccuuccauagaaaucuaagagaaaccaggagcaguggcacacaccucuaaccucagcacuugggaggcagaggcagauggaugucucuuugaagcuauccuggucuacauauugaguuccaggagagcuggagcugucuuaaaaaacacaagauaaaaaagaagucaaagagaaacccuagaaauuauuuuuagagguacuugccauugaauuaguguucacagaggaaaaaauuaaagccuaauggaaaguguguguguguguguuuguguauauguguuggagacaaagaaauggaggaagggaggaaggaauaauauuagguguaaauggaguuuuuuaauaaauugauuuucuaaaaauuuguugacauuugaagguccuucuggcuuugguuauaaaguucaacagcuauguuuuuuaaaguagcaagccauuuauuacccuguauuuuucagaaacauauuuuuagguuaauauugagaaaauacuuguagauuguggucuaaagugaaucccuugucgucuguguggguagaaguauauagguaccauccucugcauacaggcacuccaguacacucucaguguauauauaccaucauccucugcacacaggcacuccaguacacucucaguguguguauaccagugccugcacacaggcacuccaguacacucaguguguacguaccagcagucauucacagguacuuuuguuagacacucaguguguuaauaccaauauucacauacaggcacaaccuguacuuguuuauuuuuagaaaggcaggcaguauuccagcuauacauaagucuguuuuccugcucauugauauuuuuauuuauucuacuauacaaauaacuccucuaguucuuuaaauauuuauaaauguauuuauuuauguauguaauuuuucugucauuuacaguggaaaugaacuuuuucaaaauugcuugguaacagcacuguauuccucagugguuguacuauuuuuauggacugcauaucuugggacuagggaugugugcagaccucagcugcuuguugggaauaccaugcagguagcagaggaguaagaguaaaacacugagaguucaaagagacauagugguacaugacuguaacucagucuucuggagacuaaggcaggcacucgaguuugagauuagcuacauaauaggacuguuggcacauuguucuuuuguuuuuguuuuuguuuuuuucagcuauuuuaugauguucuuauuucucuaccuuccuuuuaacccuuauugcacccuaauucuuccaaucccccaacacuagguaggagagaaagagugcuagaagagaaggaggauguagaccccuauaggcuauugcccacugauuaggguugucagauucuuggggcaaguccagucuucacugucuagaauauccagaauuccagcaacccaacaacagcaaacgcagcagcagcagcagcagcagcagcagcagcagcagcagccgccaccgccaucaccgccucaggcccucuugggguucucucauuuauacccuuuccugaguccccagaauucaacuaugugcagcuggcaaaaaucacuccccugcuccccaagcacaauccuaguucaaugcugaggacagucugaagcagccccaugucccacagcugggaguaaaacaaaaacauagucauaugacauaacuggguuuuaaaagaaaccaaaacucucacuacauaggaccccguuucaaaaacaacaacagcaacaaugaacaacagauuuuugaacauacagacagcuggauuuacuuagaauggcuuagguaauuauaagcaugauguuuuguguccacagagaagacauaguuggaacuaacuaucccaguucacuuccuaucacuuauguaccugaauugagcuucacauuacugggagugauggugucuacuggaaugugugauguuugcuuuaucucagucacacuuucuagucaacacugacacagugccagcuacucagacaucacagaaguugucuggguaacaguccccauucaccuuagucaaugaaaauggagaaguuacugacuaccauauuaucugcaauuccugggauaaugggucauacaucauuaucauggaauaagaguacuauuaguauaagagacaauuuuacucuuuagcaaaguuuuuguccaaaaguuucuggaauaauauuguccuuaguuagaaauacagggguauaauacgcucagagguaauauucuuauguagcagggguuugauuucuagcauuguaagggaggagaaggagaagggggagggggagggggagggggaggggaaaggagaaaggagaaggagaaaaagaaaggagaaaggagaaggagaauauauguaacacuuagacauagugcuuugguuccagaagcaucaugggaagacagugggggaauauugcaaaggaggagggucuagauuagugguaugugggucaccaccccuuuggaggucgaaugacucuuucacagggguugcauaguagaucuccugcauguuuacacuaugauucuuagcaguagugaaauuacaguuauaaaguagcaacaaaaacauuuuaugauugggggucaucacagcaugaagaacugcauuaaagaaucuuagcucuaggcaaguugaaaacugcugguuuaaauguuguucccacuugaaucuguccccuccaucuugucugaagucuccaugggcuugguuuuucacuuaucuugugccuucucucccuugaaagaauuaauuugugagugauguuacuauuacuguguuuugggcuggaagaaagugagaacuguagcuuguauuguugggguagacucagagaaacuuaugcuguccaggcaaugugguuagaggauuguuuacuuugaccagagcucaagcuguacuugcuuugacauugcccagguaauuauaaauuaagaacuuaucuugaaaauauaauugcuguuuauaaacucuauauccucucuaagcaacuuauuuauuuuuacuaacuucaaauuagagacuaggcuuuauugaaaccauaaugcugaaugauucuuugaggaaguauuaaagucagccuuuauggugauucuugacuugucaaaaguuaugagucuauuuuagagacaauguuaacguguaaacuacugaaaaauaaguacaaagugaucuugaagaacauaaguuuaaaugaggcuucaauacuauuaacccuucccucaguugucauaccauagugucacugcaacuuuauuuacauauaagaaaucuuuacuacagguacaaagacguucagauaguugcuuggcauacuuuuauuaugugaugaccguuuagacaguccacaguauccuuauaauaacuaugguaaacaguugggacucuuagaggacauauuuaaaccuccagcuguggcaacugcugcauuaucaauguacuugggagguguuugaagucacaguguagaguucugggcaauaaauaggacuuuuguugguuuuggagaaaguaguaacaauuucuugcuuuccccacaguucucauggcaaagaucccucuccugguccucugauugauguuucaaacaucccuacuccacgcaaauuccuugaugcuucucaauauucugcugcuggaggcucaagugguaaguuaauuuuauuaugugccucagucuuaguauauuagaaagccaggcaaagacuuaaugguagccugugcuagaugcccuuugggaccuucacaggaaauagauauaaaaccauuggguggaccugcugcauuauugggguugaaaacuggcagcucacuggccugugugcagauuccagcuuugaauacauuuuauuucagugguacuguuuucugagcugcauuugaaugcucuuugguagaauguaugcuuuucuuuuugguuauagucuuauugcuccuguugauaucagauggcaaaaaaauagaaacgagucuaagccauuuauaaugaacaugccagacaaguuucuuuuauuggaacuugaguucaaggugacuaacaagagccaaagagaaguaacauugauuaggggugaccaggcugcuugcuugacuaaggaagcauucggcuuuuguuguguuuuucaggaauagaauaaaguuugguaauuguccacugucaugagcacaguuuuaaggauguuuccuuucuugcacacaagcauucuguccuuggcuauaggcugcagacuuuaauccacugcugcguccuccugcuguuugugauguuuucuuuguguucuugugucuuuugugaggcaagguauuucuguguagucagggcuggacucacacuuagaauccucugucuuagcuucccaaguguggcuguuuauuuaggugugugcuucugugcuugguguuagugucaucuugcacaaacaucuggcuuuguggcaagucugagggaugguaaaagaaugagcugcggagagagcacaaggucaggguuaaacacacaccaccuccaggggcuaaaagguccagucucaguguagagcagucucagggaagacaucaccaaaugugcuguaugagcuguagggaaguauauacauuauuuuauauuuuuucuuuucuuuuguuuauuuaguuucuaacuuuuccuaaaucuuuaauauuaguuguuauuguuacaccuuauagagguuuguucucagucugucuuucagauauaggguugccuuucuuugagguuuugauacuucugugagguauuguagaguacagaaguauaaaauaaaauauacagagcuaguuuugguuccuacuuuacuuaccguuuuuauaaaucgccaauuauuuauaucuuuaugauuuuuaaguaaacuauuccaauauauuaauuuaugccaguguugcugagucauuguccaagugaaauaaaaaauuuaauuguuuauauagaaauuauagaucauuccuuguaaaaugaaagugcuauauacauuucaaauaaacugacaaaauuccaaauauagcuugccacaucuacuauguuuaguaaggcagcuguuacuuucugaugaaugcuuuauuuugucaguccuagaauuaacaaugucauguaguggaauucauguucccacagugacuaugguguuaauucggaaacucuggaagaaucucaugcuagcuuaaguggaagcuacauuuagagauauguacaaaucuuucucuuuagaaggguuuauuuccuggacuuuuuuggauacuguugaucucaugacuuuccuaugaaaggaggaaaaguuauaauauugauucaugucaguaacagcauaggcuaagaagcguuuauugccugcuaugugcaaagcaauguuuuaagugcuuuacuugaauagcugauaugugaauuauuacauuuacauuuacaauucuucuuucuuucucucucucucuuucucucuuuccaguuacauuuacauguaucauugacauacaggaaaacugagguacagcaaaguuaauaauuggcuuuaauuuaccgagcugauuaaguagcaucuggauuucaaugcuggaccugaguucuagacuauauuuuucaaaucaguuuguuguuguuguuacaaguaaacaaacugcauuguguguucauuuucuguucacaaacauggcuuaccuaaaauaaauuuauuaauuauuuuacaguuuuguagguuaaaaaucuagcaugagcuaaggguaugguucagcagguaaaguacuuacugucuaagcuugaagaucugagguugguuccugaacacccguauaaagcagcagcauguugcuguaucuccagagugggaggaaggggcauggagaagcagaugccacgggcccacugcuuagcauguuuagccuaaaaaagcaagcuccagguuuagugagagaccuugccuuagaaaaauaagguggugagccauagaaggugacaugugaugcugaccuugcccuccauaugcacaagcaugggugcacaagucugcacaguacauccuagcgugcaggaugcggaaguggaaggaucaggaguucaaggucagcccagguaugaagaaauuucgaagcuagcccaggcuacaugagauuaaaaacaaaacaaaaccauaauagaaaucucacugggcucaaaucaaagcauucauagggccauguuucuuauugaagguucuagggacucuuuuuucuugucuuuaucagguucuagaauuugucacuugucaccuuacaaggcuucuuugucuuuauucaaaacagcaauggugcuagaugguucuucccuugccaaggaccagucuugacuuggagauggguucugagaaaggggugucugggaguggugaaaacaaaugacuugaagucaaauuauggauccaagcugacagccuaugaucugcucgagauggcuuuucagauugcugucucuguguucugcuauagacagcuuuucaggcugcauccuggcucugcucucauaguucaucucuugcagauaaaaagucuagucuuuuauuuacauauccauuuauucauuaccccagguucccuuuugauuaucccaugacucugcauccuaugaccccaguccuuugauucuuagaaagagaccccaaguacagauagcugagugggacccagccaugaaauuaccauuccuaaugugccugggccuggacuuaagcucccgcugaccuugaacucaggaaucugccugccuuuguaagcauaaacaaacaagcaaacaaacaaaaccucaucuaggugggaucuugcccugccuucaccacuuccucauuaucuuaacccccuuccucaguaucuuucugacaagcuggcucauagcaccgcugccuguguuccuuuagaguaugaagcuccuuauccaauuuauaguacauccuucuauuuugcauagcugagaaauuuauauguuucaaacucauguuuucagagaucuuucucucagucuuaagggcuguccugaaggucacagcauuguaccauuuugcugugacauuagacacauccuggccucccagacucaugcugucucuaauuaucuuggcgugauuaaccuuggcagaaaagacaucccuggaaggaggaacaugaaaauauguacacuauuauacaaacaagccuuucucccacagcaaagaugacacccguggaagcccaugcccugcugucucuguuucaggggcaggaaccaugucuugcugucucuuacaugccaaaccagacuugauguuccuuuauuguuuuuuuucugacccacauuuuuuuaucucuuccuuccuuuuuaaggacaccuaugguaggauugagcccaucuggguacuucaggcuaaaaaucuuugacuuuaaugguauccaucuguaaggucuccuuugccauguaggauggaugaccuacucacaggcuuggggacuuaggcauggauauuuggagauccaucauuugcuuacuguacugauuuuuuuucuuaaguuaucuuuggaaaccaaugugugaaaaauuugauguuuuugaaauuauguggugauucuuuuuaagucguugccauucuaguccuuagaccucuauuaaucuuaaucacauuauuaaaagagauuuuacaagcaaagaagauacacauuauugagagacuacauaaaacguuacuaaguacauauaagaagcuuggagcugaugaaauauaccauaauaaagggcagaaauuugucugauucuugguacugaccagcaagucuuuagcaucuauuuguggaguacccugcaagucagcugagaaaguaauagacauuuucagcagggaauuuaacauaggcucuuaaagcuccccucucaucuugugaaacaguaggauugaggguguaauccauuagaauugacacuuuuauagaggagguuccaguagggaauccccaggcagagcggauuucccauuggggugccauaaauuaagguuggaggugauuccugagaauguucagguuauuauuaauuaaaugagaauucugauugcuugugaacaaguccuuuugcagaugccuuauuuagagaugcaauugugacuuuucucugagaaguuuucuaucauaguuuguaaaugaaaguuugcaaauggcauuuuguuguucaauggaugaaacaguucugugaggucauuuuagggcagcugcuauuguuauuaccauuaugauugucaucuuuauaguccuugcauuuaagugugagguuauauaauuacauguguguauguguuagcuagcuaaguaaaguacuuacuuaauugcaaaauugacagaagcaaguaauaucaaaagccaaauaauugcaauuugcaaugcuuuucuaauauauauuaaccagauuauaaauaucauaauaaagagcagaguagauaauggagaacugaaagaaagacgggucuauaccuaagauugguuauucaucugauagaguuaagcaacuagaguauaugagcucguguuaaucaguaaaacaagcuaguagaauaaagggaaaagaugagccugccccuuucuuaaugaaaaucucauguugcuaauauguaaaaauauuaaucagcuauuauuuaaaaaaaucuuuuuacaaauauagaaagugauugcccagagaucaaauguuuguucuggguucauccaagaaggucaugguuggaauuuggccucaugcuguuuccacucuuguguaagggauguguguugccauccucugucuugucauuacaguauuuuguaacauaugggaaaacuaaugucuuauuucaauguaauaguuugucuaaagaauuagguagaaagauugggagaaaagccagcaauuauaguaaaaauguugguguaagcuuuuggacucccaguauauccuuccauuuggcaaagugccuuggaacauuuugacuggggaagcacuccaggguacacaggcauuucauugugacuucuugauucauuuuguucaugucccacugggcuacugugaucaugaccauagcaaaacuggacuuuucacuuuugucccuuuugguguagcauaggccaaucgauaaaaccuaaaauagacugcaaauguuuuuuuuuuuuuuuuuuuucccucauugcuacuguuuucuugauucggauuuuacuucauauaaucuuaucugaaacuuaauauuucuaauaauuggagauuugacauuuaaggaauucuuucaguauggaguguuggguuguauguuccaauauaagaggacaugaacuacuuccucauagaacucacauguauaaaacagugacguucugguuuaccaaaauagcagggcaccuuuucaaauuacuucuguccuuagugaaugaaaugaggaaaugagcguuccuggguaugggugaagagcagguuuuuauuggagauaugagggagugaauaugacccccagacugagcuggaccacgaggggagagagguaggggggagaaugagggagagagagagagagagagagagagagagagagagagagaaagaagaggaccaagaagggagccaagagaagaaccaggaaaccaccugccaggaagugaaacuggaugaagggaagggaagggaagcccuaggacuagagagauuuaggcuuggggguagagugaggagagcugagaggauccccugguacauagugagucuagaggccagcaugcacucuucucucccucuccaucuccuccuccuccuccuccuccuccucuuucucuuucuccuccuccuccucuuugcaccuaaaacuuagaaaccaguggagacaaacuguugaaacaaggcagucuccccacagccgugacacugcuccaguuaaaaaaacgguaacaugaaaagucugagagucauaguuaccuauuuguccccaguuucuaugggacuugacacuuagguuagggacuucaauggcguuucaaucaaauauuucacugucucucuuggucuggcugauuuuguuuaggauuauccuucguuccuuuuguauuacucuuauuaaaugucuguguugacgucuaugauuagucaugaguauaacuuguaugaaaauauaaaggaugccagauagaaugguaaauuagugaccauguuuuauuuaauuaaauacauuuacuacaaauauuauaauuaagaagagauuacaugauuccuaucuuagagaucagugcacccauuaaccucuaugucccacuagguuaauuacguccuucuccaccugcuuuguuuuguaaauuauggaauauccauuaugcaaaaugauggcuuucauguuaaccuuuucauaaaaucaugacauauguuugaacauggucaacuccccacuaccuucucuccccuucuuugcuccuucccauggugucccuccucucgacagaguuucccuccccuuccacuuucauguuuuauagcugucuuuuaaaaugcacguagaagagaaaacauguggcaucgucuuucugcguuugacuuuuuuucuuuauguaauacgauuacgucuuguuccauccuuucccuuucaaagaacguugucuuggucuuuaggggugaguacaacuccaucauauguauggaccacauuucuacuacuuggugaugaguaauuuaggcuagggucuuuuuuuacaucuuuguaaaucagauggcuguagauacaugagcuuauuccuggacccgccauucuguuuuguuaugugugugggccacuguuaugcuguuuuuguuacuguugcucuguaguguaaauugaagucaguauugugauauccccagugucaccccuccccugagguuuuggcuuuuuuuuuuggucuauuugggguucuuuugugcuucaguaugaguuuuacgauguuuuuccaccuucugugaagaguauaauuagaauuggauugagguuguauugaaucugcagcuugcgcuuguuacuaccaucaucuuuacguuauaaaucuacuaauccaugagcuucggaugucuuuccguuuccaguguacucaucaauuucuuaaaguguucuuuauuguagaaaucuuuuaccuccuuggguacauuuauucacauuuccuuucuacuuguauugaauauuauaaacuuucuuugacuucuguuuuaguauauuugguauugguguauauaggagguacugaauuuuguauggugacuuugugucccgugacuuugcugaaaguaccagauacaaagacuuucuuguggaguguuaggguacuuuaaguguaggauagugagguuuguaaacaggaguacuuuugcgucuugcuuucccaucuguguuccuucaucuuuaguuagcccaaggaaucaaaccuugauuugaauaugcagggacauguggacacccuugucucauucaguguaauauaagccauuucuugcuuuuacuauuccuaguuucuuuagggcuuuucucauggaggaagguugaacuuugccaaaggguucuucuguguguuuugagauaaugcagugacuucucuccuuagaccccuuuaugugcuguuuacccuuauggguuugaauaugguaaaaccaucucuucauaaaacaaacuuggucauaauauauaccucuuaaugugcucuugguuuuugauuugcaagaauuuuauugauaaauuuugugucuguguuaucugagaaaucaacuuauauuugcuuuguuuuuauuuugucuucaucugguauuauuagcauaauucugacauuguagaaugaguucaggaguauucuucuucccuguuuuuguaaaggaauaguuugaaagacauucgugguaguucuuuaacauccuugaguagugaauucagaauuuuuucuugggaaacucuugcuacuugaaucuuuuuuuuuuuuuuuuggcuuuucgagacaggguuucucuguguagcccuggcuguccuggaacucacuuuguagaccaggcuggccucgaacuuagaaaucugccugccucugccuccugaaugcugggcuuaaaggcaugcgccaccaugccuggcuuuacuacuugaaucuuauuauuaguuaucagccuguuuuuuuuuuuuuuuuucuucuucuuuuuuuuucuuuuuucuuuucucauaugugugaagacuuuuuuucuagaauuuccuucuuuuuuuuuaaauuuaggauuucaaagaauucuauaaucauuuuuuucaggauuuuauugguaucugugguaaugucuuguuuugcuccuaauuauauuucuuugaguuuuuuuuuaaaucuuuuuuuuucuauaacuaacugugucucauugcuucuuaauguuuauacuuuagucuccacgucauuaauuuuugcacuguucuuuauuuuuucugucuaccuauuucaggauugguuuauucuccuguuucuaaggccuuaagguguguuuuuggcauuugcuuuguugucucucuuacuuuuuaauguaagaucacauagcuauaaaccauccucuuauaacugcuuuaauguauugcaaaggauuugcuaaguugugguuuuguuuccuguugauucuaggaauuuaaauuuuucucucugauuucuucaauaucucaugauuauucaagaauguauuaauuaaucgcuauguguuuaaaucguuucucuuauuauuggcuucuagguuuuuccacuaugaucuuauuagauacaagaacuuauucuguauuuguuaauaauguuuuuguggaucugucuguguucuauuuugaagaaccuucuauaagccaguucuugcuuuuacuauuccuaguuucuuuagggcuuuucucauggaggaaaagccuauaaagagucuauaaacugcugacucgaaucuguuuuccauuuuuccuuaacuguuggauggaacaaaacuguagauaucuguuaagugcauuugcucuaugaugcuguuuagggcagaaaugucuuuguauguucuacccaaacauuauacuuugguauugaagccccugcuauuaguauauuaggacauaucuguucccuuauaugagcaguauuuguuuugugaaauaaaguucaccaacauuuggugauuacauacuuauaauuuuuuaucuucuuuaaauaauauauguauuuguuuauauauguaugugugcauguauguauauugccucuaugaauguauguugcuagguauauugauuauugucauuacuuucagucugggucuuuuaagaaaguuuguagggcucauuggcuuucucuguguguauguugguaauucuguuuuagaauggauguguuuuucaguucuuuccuuuuucucauuuacuuuguaaaauaacuguccugcuggucauucuucucuuugagaugaucagauaacaguaaaaauagugacuugacaacacaccaaauaucaaaauguaggaaaaagcugucaaguacuucuauauuuccaauaagguuagcauguuaaugcauuaggaugcuaguaggguacacuaccaauucaaagauuauucaaacuaaagguauuagugauuaagaaaugagaagagcaaggauagggaaauggaaacaauuacaacaggaauggaaggggagugaacugaaaggcgcguggugguuggaauaugcuugguccagaaaguguggccuuguugaaguaggugucgcuuuguuggagaaagugugucacuguaggcuugggcuuuuagacccucauccuagcugccuggaagccaguugucuuguagcugccuucagaugaagagguagaacuguguuccuccuacacugugccugccuggaugcugccacacucccaucuugauaauagacuaaaccucuaaaccuguaagagagccucaauuaaauguuguucucacaagaguugccuuggucauggugucuguucucagcaguaaaacccuaacuacgacagacagaacggucauaaugacaacccaaggacacagacaccagaauaaaguaaauaaaauuaaaaugacauggcagcagucaagagucuucuugcuggugugaacaguuuccuguaugcccaagguucuuuucuguaguuuauucuagggguggaaaagcagcuguuuuucucucugggguugaaaaugguuagauagaaaaguacuguuuguuuaugaaugacagaucuuuaccucaauugguuaccuuucucuuuuaccacagaugugauucuuguuuugaaauuguucuuuauuuuucuuacauguuuuuauguuuacuguguguaugcauguauauguuguauguaugugaaucuauaugguuuauauauuuauauauuuguauuauuuauauggguagaagauguacaauuuucuuuuaggcugaacaaguuguauagaaugauauaucauccuuuaucuuggauuuuucuauucaauauaauauuuauauuuuuuaaaucauauaacaguauagcucugaucgauuguuuuggcuacuauuuauuauuucuguauuuaacaggucacaguuuauccauuaauuauauauagguaaagaauauguuuuucacuguuaaucuuauaauagagacuggcaggauggcuaaguggguaaagaugcuuaccaugugaguuuggcaaccugaauuuauucccugggacacauguaaagguagacggagaaaaccagccccacagaguuguuuucuagccuucacacgugcaccgcagcacacaugguuacacacaccucacacacacacacacacacacacacacacacacacacacaaacacacaaguaauaauaauaauaaaaaauauuuuuauaaaguagagcuucccaaucacugaucucuuagcuucuaguguaacugagagccugacuccuuuagucauugguguagucagaaucccagguccgugacuccagguaugaacccaguacccagugguguuauauacuucauaugugguuuuauuuuccauaugugcaugaugcccaaagauaaggaaaccccacucuuccaguauguguauuugcuuauauaaauaugggaauguuggacauuuuaaaaaaauauacauuuaacuaauacagaauauacauauacacacauauauucauucagcuuaaacauauauuccucaaaaauugucauuuuuguaaaguggaaaaauucaugaacauauuuuugaauuucuuucccucucgccuuucucccugucuccuucucucccucuucuuucuuuacuauuuugccaugagguuucccugugaagucuuggcugacuuuggucucuguuaguugaucaggcugacuuugaacuuguguugaucauucugcuuccauaugggauaauaggcauguguuuaccaugccaugcucccgucgcugugaaaggugacuuuaccaagguggcuagauggcucuacauagugaugauuucuccacggucacuuugcuucuuuccuuuagauuuuaauuuucacuugucugguaggugcugguaggcagguauguuuuuaaugggguugagagcaucuuucuguaauugggggcaccucagucuuuuuugcccacugccaguguuugcuuaguuuccugggcaaggauacucaucuccuucugagcguggauugcuugcacacacuugguagcuacaacuuccccuuauguucuuauuauagcaauuaaugaucuuauuuuaaaguugcuaaauuugcuauuuacuuauucauuuauuuuuggaauuuguauucuugccuuaaaaauuuuguucauauaagaacaaauaaauuuguccauauaagggugucaggauuucaaauguuuucuuaauauuuuuuuguagacuugccuuuuaaacuugaagcuauuuggaauguguacuggcugguauugugugucaacuugauacaggcuggaguuaucacagagaaaggagcuucaguuggggaaugccuccaugagacccagcuauaaggcauuuucucaauuagugaucaagggggaaaggccccuugugugugggaccaucucugggcugguagucuugguucuauaagagagcaggcugagcaagccagaggaagcaagccaguaaggaacaucccuccauggccucugcaucagcuccugcuuccugaccugcuugaguuccaguccugacuuccuuuggugaugaacagcaguauggaaguguaagcugaauaaacccuuuccuccccaacuugcuuuuuggucaugauguuuguacaggaauagaaacccugacuaagacagaaugcuuuaaaauuuauuucauugggaacuacuuuuuguuguuuucuuaugaguaaccaauuguucuaacguuuugugauaauauauccuuugcuuauugacugaaaauguuuuaaguuggcuucuucuuauaguuuuaggugauauaaaaauuguauacaguguaaagagccgcaaggauuuuuaaucagccagucuuuuguucuauuauaccauuaccucucuggacuaucgccauacuguuuucaugguuguaguuuuguuuauuuuaauagcuggcaauggaauuauugacuucuugcucaucuucaaaauuagcacggcuuuuuaugguccugugcucuucuuacauuuuagaaccaagauguaaguuucuauuaagagucuuuuaggauuuuggccagcaauuaauuuaauugauaggauuagggaaaaugcgucuucucacccauaagcuugagacaacguucuuuaauuuuauagaucuuaagugucuuguucaucuuuuauuaggugcuccuggagcucuuuguuuuuauugauugcuuugaaugauuuuuuuuuucuguuaaauuuucuauuuuauuauauuccugggaggcuugaaaaauuucauguuccacuucagaccguccguagagcugguucuaagguugugagaacugcggagcugguucaguuucuagcaggcugcagcacucagggacugagccugccccagcacugcacaacauaguacagcuggcucucggggccugggugugggugagcagcccgaggaccugagagcugagcauuggaugagcaccgagcauugggugugcgagcuggggcagcuggagagcucgcccuggugguaggaguacgggagaacuggugggcugauaaacucagcuacuccccaggcccagauccgaggcucugagauggcgcaccucaacuuguaccucaccuaugaacuacuggagcauuugucuaaagcugcagcuuccaagacaagauguuuucuaugcuucauucauucauuauuuucguuuucuguuuucuuuucagagggcauugccagagcagaugacagacaggaaggaggagaugagugggauugggaugcaugauguaaaacucacaaagaaucaauacaaaguuaaaaaaaauucuuuccauguucaucuuguuuauuacaauuugcugaguuauuuuaaaagcccuauaguuaucugaagaauaaauuuguagauuuucccuuaauuuugaauguaaacaaucauaguuuuuauaacuaaaaauaguuuaucucuguuuauuaaaauugaaaucuuauuugucuuacaucuuuuuuuaaucuuuuguuuauuuuacuuggcaggaaauauaauuuugagugauggaaaaagucuuucucucucuuuuuuuuuuauuaaguauauguguguggauuuauccauguguguuugcacaugugugcauacuuguaccugugggcagagaccaggauuuugaguguccuccucuauuggucuguacuuuaugcccuugagacaagguuucucaugaaaaguagagcucaucauuauucugucugacggccuguuuauccauccauucaaucacgguuucagauggcacagucuaaugugaugagaaggcauggcagauggcaaaggucugguuugugaccauaggagcuugcaauauggcaucuugguugaucaggaccuagagagcaugguugcaagugacucuugaguauagucuucagaguccugcuaaaugugacccucaucuccagccaugacaccugacccccaucccccaauucacaauuuacccagauagugccaacagcuggaccugagguauucaaacaagugagccuuuguggcuguuuaacaugacagccucugguguuuacauuguugguggcuaagcagagguucgcucaccuuucuuccugacuuggcacugguugaagaggaugaaaccucuuuuuccuuguagaugggcgucuuagcuaggguuuccauugcugugaagagacaccaugaccaaggcaacucuuacaaaggacaacacuuaauuggggcuggcuuauagguucagagguucagucuauuaccaucaacacaagaagcauggcagcaucuaggcaggcauggugcaggggaugcugagaguucuacaacuugaucugacugcauccaggagaagacuggcuuccaggcagcuaggacaagggucuuaaaguccaugcccacggugacauaccuacuccaauaaggccacaacuacuccagcaaggccacacuuccaaauagugccacuuucugggucaagccauccauccauccauccauccauccauccaucuuucuaucuaucucagcuagguuuaucacaguacaggauguuccaggcaauguccugucuguuccagcucuuccccauugcagugcugugauuaaagcaccugcgagggcacuucuagguuuuuguguagacgauagggagccaaauucauacuggcucaacuauaucuauaagucaucuccucacacccuucuuuuagugacucauuuuuuacuuggauguagacuguaucuuuuagacuuuaagcuuaaucuuauaguaacucauaugcuacagagauauuuuaacuuuaccauugcccauuuucccuuauuguuucauauauaucauuuauuccaagcuaauccuuguggugaacuucuaaaagauaauuugcaaauccguauuuucuuuuuuucuauucauaguacaugaagaaauggaauucuguagugauaaaguacuguccuccugcauuuauuuauuuauuuauuuauuuauucacucauucacucaaccuuuaaguaaaugccauugucauggguuuuauucuuaccuacauuccagaagugcaagucauguggaguuuacccacuauuuacccuggccacaucugccaguuagcagucucucuaaggaucugugguuccuuuucuuggaaauaauaauuuucaaauugagaucugugcucuaguuguacacguuccuauuagugugugauugcuguacucccucucagaugacaaaaguagaaagcauaucugucuauaauggauauauauguguguuuauauuuacauguguacaugugcucauauguaaauauauauauguauauacacacauauauagaucuguaucuauuuauuucucuguauggguauauacauuuauauuaaagcaugaguuuaauuacaauugaaguaaacccacuucaauuccgacuuuuccuuuucuuuuauuuacaauggugagguaccuauuuuacauuuuaauuuuucaaauaauaauuuaugcauagguuaauuucagaauuccuuugaaauucaauucaugacagugaaaauaaauuuauuauaauuuaaaaaauuuuuucaauuuuuuauuagguauuuucuuuauuuacauuucaaaugcuaucccuaaaguccccuauacccucccccaacccugcuccccuacucacccacucccacuucuuggcccugguguuccccuguauuggggcauauaaaguuugcaagaccaaggggccucucuucccaaugauggccaucaucuacuacauaugcagcuagagacacgagcucugaggguacugguuaguucauauuguuguuccaccuauaggguugcagaccccuucagcuccuuggguacuuucucuaucuucuccauuggaggcccuguguuccauccaauagcugacugugagcauccacuucuguguuugccaggcacuggcauagccucaugagagacagcuauaucaggguccuuucagcaaaaucuugcuggcguaugcaaaauuaauuuauuaacuuuaauguaagggguuuuauuauagguuauauggcuuagaguauguauuacuuuaaaaauuauuuauuuauuuauuuauuuggaaaguguuuuccauagaauauauuuggaucauguucaucccacucccaacuaauaccauuuccucgaacuucccuaucugcucaguuuuauguucauucuuuuuuccccucugucuccaaacaaagccagaagccaaaugcaacccacaaaaaugaaggugaaaaucaaaacaaucauaaaaccuguaagacaaccaccaauaacaagaaaaaugcccccaacaaagcaaaacaaggagucaaaaagauaaaaaagaaaaaaagaaagacgaagaaggaaaggaaggaaggaaggaaaaaaaggaagaaagaacgauagaucauggaguuuauuuuguggggcucauccuggagugugguugauguacccagugacacuccauuggaaaaccuuuuccuuuugcuagaguauauugcaacuagcauuuugguuaggagugguacccugugugcacuugcccucuuguugcugggauccugucuggcuugcacuugugcaguucuugugcauucugccagacucugugaguuccuguacgcaucaguucuguucuuucuggaguacacuguuuacuuggagucauccauccccccaagcuuagagggguugaugaagacauucauuuaggauugagugcuuccaagucucucauucucugcacacucuuaguuguuaauuuucauugacuucgugaaguuucucugauauugguugaacuguuaaguagguaaagcagauuauaauuaggagccucuuguauugcaugcucuauggcuuaggguauguaugaauuacuuuucuauuggugugaucaacacuaaagacaaagggaacuuggagagggaagggcuuugacuuaagcucuagagguagguacaagagucucucgccaucacagugaggaaguguggcagcagguggucauggugaagggagcauggagaacuuauguccugagccccaaacaggaaauagagacagcaaacucgaaauggcaggucuccagugacacacuuccucuagcaaggucacacauacaacuacuuagcagugccaccaccuggccaaguguggacuucugccccauguggacuguccucauucaaacucucacauuuguuugcaagcaucggaagcuacuuuuuauuucacuccaguuccuuugcaucaguguuuucucucauauacuuugguuuauuuuauaaucaugugaacuauacacaaaacaucccaacuguauaaaaguacuugggugggugucucuucucaagacaucacuaucauuuaugccucucuuguuaauccaauuuaauuucuccuuuaucuuuuuuuuuuaaacaaacaauuagacaaacauaucuuuucucaugacccuucuuucuucuacaaaagguaggauauucucuauaguuugguauuuccacuucagcauaucuguuggaaauuccucuggcaggagugcaaaggaaacuugaguaucuguugucacacucuugacagcgcuuugauccggaaaacuuaaaagggaaaccaacucaggaguccaaccuguguguagggcguuucuguuguaagcuuuacaucucuucuauucugcuuaaaauccugugaaugcucuaccaucacaguguguaaguucaguguguucuguguguacagugccguguggcuuucaucuuucagaacugagugucuguaccugaguguaugcaucagcugcucuuucccccucuccuucauuucuggcagcuagcauugaguuucugggaauuugacuauucugugcacugcguaucauuggaaucacagagcuuguacuuugugaccagcaagucuugcucagcauaaucuguuaaggucaagccaaauuguaacgugugucagaacguccuuccuccucaaggccaaacacuugcauugcugagaugcuaauguguuuguccacucacauguugacggacacuuggguugcuucuaggucauggcauggcaacaguguggugcuguaaacauuuucuuuaucguccuauuaggucuuuggaauguguauccagaaguggagaugcuggaucauaggaugagucuguguuuccgucuuuugagaagagccucauguuuucacugcaguuacacguguuuguucugaucaccagugcauaugggcucuguuucuucacacuugucauuuucuguuucccuuucugauagaagacaucuuaauuggucugagguuauaucugauuguaguuuuuaauuugcauuucccuaaugauuagugauguugagcaucuuuuuaugugcuugcugccuauuuguuugucaucuuugaaaaauguuuacucauguccuuugccuacuguguaauuggguuauuuguucucuuauuaucaaauuguguuucuuauuuuagauauuagcucuucuuuagagauaugaauuuccaguacuuucuuguguuugagaauagauugccuuuuuauuauguuggcuguccauuguggaccuuugcucaaauuuugaucauguuccauccgcccucccuuuuucgcauguguguauggugucagauguagggaaugcuugucaaaaacguuucugaggcguuuguccugucuucaccuacgaguuguaucauugugaucuuaugcuuuaaugcucugaucuauuuagaguaacuuauuguguauaguaauagcugaggacaugugucuguaguuuaggagguguguagagucauccuuuagcagaauaguccaugcuggcuucccauuaccucuguguguguguguguguguguguguguguguguguugguggggggagggucuuguuucucagcagccuuccuaacauaacacuugccaugcuuuucacuguuuuaaucuaucuaauagcuaaauaauccugcuuugagcagcugggcugaagucacccccugccuuagccuucugaguaccugguuccacagaccaugcugauauaaucugcuagauuuucguuuuaguuugagauauuuauuaguuucaccuugauauguuuuagaguugguuauuuugguuagauuuucucugauacccuauggccucuuuuguaaguuaaaaaaaaaauuaaagaaaguuucugguaaaaucuugguuuguaauuuuauaugaguuuguuuuaguuuuuguuucugucuuucucacaccaagguuaguucuuuuuuuucugccuuguuuucuuuuaaaucuacuuucucuuuuaucuuuuuaaucucuuauuucucccuacauuuucugaaucauuuuuuaugaaaugucuuuuuaauuuucucauggauauuuuaaaguuuuuuuuuuuuuuaaauaucugcaauaauugucuuuuucuuucacuuuuuucccugacuuuggucauuuuucauaucuccuuauauuuuucauguuuacauauagauuuuuaguuuuuggcaaaagguagcuuuucauaucuuuuaauuuuuauuugaguauaucaguugcauugaagaauugccuucuuguuuucuuguguaucuuuuuaaauuuauguauauucauguuugcugggguuuuugaaugucuuaugauaugcuaguucauacuccucuucucucucucucucucucuuucucucucucucaguauagaauacuuuaaagacuuuucaguucauuggcucccucuucuguuaguauaacaaaguccagauauguuauuuuuuuaaaaauuguuuugguaguuggaagguaguggaagaugauggacucuauagagucggccccuggcuuccacuugacaauauaaaggcaggguggaguaugagacaccaauuucuuggagcacaaauguuauuauuuuuauuuaugguuguuuugaauuuggagcgauuuguauuuucaagcuauuacauugguggucucacaguucacaaagcuggaagucuuccauguacauuuuaaaaaauauuuuuauuauugaguuuuuguauacuguuucauuuaauauuaaauuuauauacaacucugugagauugauaauaaaaauuucacuuuacagauaaaggaauagaggucaugaaagauuaagugacuugauggagaucauuagccugaaaguauagagauaaucagaccuaaaauccuaagacuuuguuuucucacacuuuugcugugucucgcugucuacccaaauaacugaacauaaagaauacugacaguggauugcaacccaguacauuucaguggcuaucacugagagcuaucaguuuuucuguaugccaguuuuaugucagcaguccccuugacggugacuucuggacuuucguaggucccuccucuaaauacguuaauaggcauuaagcucuguccaugagaacagguuucaaguagauaauuuuuuguuuuauuuuguuguaaaaaugcuuccggagaugccucagaggugaagagcauuggcuguucuuccagaggaccuggguucaauucccagcgcccacauagcagcuuacaacugccuguaacuccaguucuggggaaucuaacauucucaaacaugcaggcagaauaccagugcacauaauaaaaauacauaaaaauucauuuaaaaauauuuccuaccaucgcuuuaaacacacuuaccaucuuuccaacaguaauucuuaugaaaggacuggguacacucaaugcuuucaggucagcaggguggggaacucuucagugacuugagaucuguguucugucuaccuuacauagucucuuuuuaggcagcaucuuuucuggagugggguaauuuauugucuguagguuucuuuaagguaauuuaaucuucaccuuagggguucucagcgaacguuuuugaagcaccuuaaucaggauucuacacuccagggguaguuaguuaacauuugaaagacccuaaucaagauucuguacuccagaggcaaccagugugccaguugcugcuccccugcaccaguggguacauuaauuagaacaaacccuguaagaaguaauuuuccauuggcaaauggaguggugucuaagauauauacuugaccaagaaguuccacagagauaagauuggaggaagagaauuuagggagguucuguagccuucuagccaaagguaggagcuuaauuugauuuugggcuuguggcacccauagugaauggauaucuuaggccacuggagcacauuaaguauccauuaacacagaugagccaaucccagcuuucuucugucuuucugugaugagaucucuggcuccacacccuggcucuauucauuguuugcguuucuugucuucaguaguguuacuauuuugaggcagacuauuuccuuucaauuucuggcauuauauuuuauguguaguuaucuaauaagcaaauuggauaucuuaggaauaugaauuacagugugauuuuugaagcauacaaauuacuuuuuaguggcuuuuuuauuuuuuauaguuuucaaaaauauugucaguauugccagguucccaucugugguguagcuuuguagacagguaauuuguuugauaguuuaguggucuaauuaggcuuggcaacuuuuugaaaggcuccuuaguuuuucuuaucucuccuauuuuuugagaucauaauauaauuaaaucauuuucucugucucuuacgccucccaacccuccuuucucuguuucaaauuucuuuucuuuuuuuuuuuuuuuuuuuuuuuuugagacuggguuuugagacugccuguccuggaacucauucuguagaccaggcuggccucgaauucgccugccucugccucccaaaugcugggauuaaaggcgugugccaccaccacccagcucucuguuucaaauucuuuuuuuuuuuuuuucauuuuuauuagguauuuagcucauuuacauuuccaaugcuauaccaaaagucccccauauccacccacccccacuccccugcccacccacucccccuuuuuggcccugguguuccccuguacuggggcauauaaaguuugcaaguccaaugggccucucuuuccagugauggccgacuaggccaucuuuugauauauaugcagcuagagucaagagcucugggguacugguuaguucauaauguuguuccacccauaggguugcagaucccuuuagcuccuuggcuacuuucucuagcuccuccauugggagcccuguuucaaauucuuaccccucauuuuuauuaauuguuguuacaaaggcuccuuuuaauauugaauuuugcucaguacuggcagacaguucuuauauagagcuaauauuguuuaaauauaauguguaauucaaauuauauagauugaaaucuuuuacuguaugguaacauuacacaauuuguauauugugcauaacauaaugaaugacaucucucaagaguuucuauaguaaacacugccauuguaucaugccccaauuagcauguacaaacagcaguuucuaaguaguaugacauggcauauucaacagugaauuaaagggccuugucuucugcaguuuuauguucgugguaagccauggugcaaauugcugauuuuaucuuagaaguuuugaagaaagaaaacaucuaugaacucauggucuagauuguuuucuguaugcaugugcagagucauuaaacaaaaaguauuuagcaucaugaauagauuuuuuuucacuuuguuuacuuguucgcuuucguucaguuucuaugugguagugucuuucuguaugccccuggguugucucuaaccugugauucuuucagguguguuuaggccucaucugugguuguuuucuuuuuuuaaacaugcugucuguaguaugguauacagauagauggcucuaaaccauguaaccagaaaugcauagguaauguaaaugugggauucuagagcuugaaaaguucuuuguuuguuuguuuguuuguuuugagacaggguuucucuguguagcccuggcuguccuggaacucacuugguagaccaggcuggccucaaacucagaaaucugccugccuccgcuucccaagugcugggauuaaaggcgugcaccaccacugcccggcuuguaaagcucuuaaaaaucuucucucuaguucguucaucagucuagucaaguagaacccuccugugauuuugugcuugcccucaguuaucgcuauucauagccacuuagguuuguauaaucaaagagguguguauaauaguaaauacucgggaggcagcaggguuauagaagaaauaacacggcaggagucauucccauucuuuaguauguagcaguauccuaucggguaguaagagucuuaaagcuacauuugacucaucuucagguucaaaucuuuaacaaaauaaaauucaaagguaggagaacuggagcugaaaguaaaauauguuuagcuuaguaaaugucuaauaccacaaugggguauccacugugguaaaucaggugcuugggagucauguggacuucaggaguuuggaaaaaugcacaggucuguucugauuguugcuugaagcuuuauuggauuucaguuaaauuauuuuuguacauuuuuuccauuaauacucucugaccuuguagauguuugugaauauuaggcuagccaugguugauuauauuauccuuuuacauugucuuuuaauuuuagcugauauaagugaaauaaauacuauaaaucaguuaauauuauacuguaaguguuuauguucuaggagaguucaggagauaucagaaagcuaagucuuuaaacagauguucuguuuguggccauggcauuucauuauucaaaucuugcuucuguguuguuuuuuaaugagauaguucuacaguuagugugccuguaaguagcuauaugccgugucauugcaggccaaugucuuaaacuacauuuaugucaucaucagccacccuaggcuguagcugugauguuuagguagcacuuuguauguguccuguuuguggcucauaggugcacuuuuuacaaagagcauuuugagcagguaaauuuccauuacuuuucuuccugccugaagcucuucuuguaguucagcuucauuuccucccauuccacgcugaauugagguggcucccugcugcugagugcugucauagcuuugcugcaggauuggauuugcuagauagaauauuucuguggccugagguaucccacuucuucauguauaaaacaaaaccaggaacugaaauguauguuuuuauaucauuacauuuggaaguauuggugauguuuucaaaacuugucuuuagauuuucaucuuucaaggcuaaaccuuuggguucuacuucuaguuucauuaguauuaaacaguauacucacugaguacuguauuaucaaacacacucuguuguaaggaauguacuaugcauaugguuucucugacuuucugggcgccuagugagccucguaagacaucauggauaaaauauauuuaguauuuauucauaagagugagcuuguaugaguaauuauaucuuacuugcuacuaaaguaucuuugguucauauuuaaguguauaguuuacguuaaaauauaggcaucauuaagaugacuuuuuagucauuuaaaauauauagaucaguaguauuaauuauauuuauaguguguguagacaguaccuuuauccuucuguaugauucuuuucaccuuguaaaacucaaauucaguaucuauuaaaaaguaacuacacuuuucuuccuucuccuugccucugacagucuaccuucuacucugcuucuaggaauuuaaccacucuaaguaccucauuauuaguggaaugauaaacuaucugucuuuugugacagucuuauuucacuuagcaugauguauuccagagcuauucauauugcagugugucgaacuuucuuuguuuaaaguggaaugauaugccauuguuuauauagguuuaucuguuuaugugucggugagcaacuggggugauucuaacuggggugacuguggauaaugcugccauuauaguaaugaaagcugugaauaaagaaccuuuauggguauauagauauguaguugagaaguacuguugauaaaaaauacugguuuaguuuguggcuuucuuguguagcuuugucuugcuuugauaucuagggcuuacaggcauuugcagggauaucuaguuguuauauggaugcuggaacacagacuccaguccucaugauugcugagccuucuuuccuguccuauaugacuuuuauaauauaguuuuuaguagggauaaguaucuucagauaaucaccuaauccuuuuccccaaccacucacaggggcaagaacuacuaguaguuugaggcucuuuccuccuuuuuaagaccagaugguuuggguaaaggcuauaaaauaaaggucuauagggauauuuagcauauauaauuuacaagaagguuuucauugacuauuacagaugucugugaaagaaaauaacuacucuccccuccccccuacauucuauuuuugucuuacuuuuauaagcaaggucucauuauguauguuaggcugucuggaauuugcuaucuauuccaggcuuacuuuuaaauucuuagucucucaguagcugagauuacauguuguaggucacacacauguuuaaagacaaguaugauggcuucugugguuauuuaauaccucaucacuaaccuuuuuccccucaaacucuucucacauauuuauguugucuuacauauacuucuuuucauuucuuuuugcuugcuguagucauguucuuuugccccuacauauauuuauaacaucuuuuauucucaccauuuaucacaucucacuaaugaguaggaaguugaggcuuggguuugagucuuuaaaguucuccugaaaugccguguauuguacuuuagauacagcuuauaccauggacuuaauuuaucuacagacugggucugaguagucuguguacgccuggagauuuacaucuuccuauagaauugcuuguagauuucauuuccuacuaaaacauuaccaauugguuugaauugugggcuguuucauauuacuuuguaacuuaauuuaacauaaaaauuuccugauuccuuaacagaauaaucaaagcagugauuaucugcugugcuguugaauuaauauggaaacuggaucugauauuuagcuguuguuuuccuuugcagugagggagaugaaccugcaagacgucaaggaggacuuggagugugacccagaggagaacagcacucuuuucaugggaauucuuauucagggccuggccagacugaagaagaucccugagacaguuaaagccauuaaagagcgucuggagcaggagcuaaagcagauugugaagaggucaaccacccagguagcagacagugcuuaucagaggggagagagccucacuguggacaaucagccaagguagguauggguauagucugggguugguguuguuuuauuguauacuuccuaggguggagaguaaauaacuuauuuucaguugggcucaucuucuugaacugagguuacuauauucuauacauacccaggccaggcauuaucugucuugcuaucgauuuauugagaaguuuuagguuuauuguccauauucacugacaaggaaugagagauauaaaccuguuuguuauggagaguguuaucacacaucuuaauaaaucacuggcaagaaagaaugaagcaauugucaguuaccaagcugcuuuugagauaauuuauggauauuguuucauuuagcuuuuccuauuacuugugagcuacuucugagugucaacaucuuauaguuagaggagccgaggcucagggguagugauuagcccaagcacaugcuugccggcugacgagucuuggauuugaauacgagacuacuuugauuguaaagucugugcucuuuccacuguccugcauuuuccucaucaucaggugaugagauuugugaauacaaaaauaucagaaauuucugcauuuccuuaaaacaguagguaggauuugaauuucaaaauuuuuaguucacuggagaacauggcaauucuguucugauccuaagauguggcuauuauacugggaggauauguuuguucgaucagauuuuagggaacagcaguccaguauuguaugauaguauuugaaauuaggacuuaauuauaaaaaucagauugguuaugaagugauuucuuucacucuugccuccuucaguuuugccuuuguccccgacacacaccaggcacauaagacuggaacggcaugggagaaaaacaccaaggaaagguucgguuucacuggagaguagaaggcaggcagaugugcuggugugacuuguagucucagugcucagaagucugaggcacggacaucuggaauucauggccagccuagguuacauagggagacgcugucucgaagaacaagucacaggagaaaaaaaguaauuuucuccuuuguuggaguggaugugcgugggagaugguaaugcauaaagggugauaguuuucuuaaugugcuacuauggaguuucuacuguuuuuacuuaacaugcauacguuuuaaaaacagacauuacacaaaauuaaggaaaaagaguacuaaugcugccuagauuuuucucagauuuacuuuaauguuuuuuaaaaucugauauauucuauucacauuuucugaauucuuuuuauauaucuagauaacacuaauauugauuuaagaacucuucaaaaguaauucucucaugaacuuaauuuaaaaguacuauaacugguaaaggaaaagcaaaguaggaagagucucaaaccauuaucuacuugccugccaucauggaaugcaucgaagcagauggcugaagaguguggguuuuguagagaucugaguguugcagcuccugguaccguacagggauggaugucugcuuuagaugcgguuagugguuauaaugcuuuaguaagaacauagcacacaugcaugugcauacgaacacauauguuuguuagugaugcauucuccagucuucauguauuuuaucacucaugugguucugagaagcuggggccuaagucagaauugcacuucacguuucugcuuucuuugcuuggugccuggauuucugcaaagaccuuuugacucuuugcuaaugaauacucgaaaauucugcuuugcuauuugcucuguuguuccaagugcccagauggauagacugaacuuucauagggaaauaacauuacuauaauauauacuggaaauaaagcaaagggcacagaucaauaacuuuccugcagcucucauuauaguugcccuaaaaacauugugucuuucauaggauuuugaccucuuccucuuguauugccucagcuguuuccagaauucacgaaugcagauuacaucaguagaagcagaaagccagcuccuugccuuagaaaauucuaaauagcuuucuggaaggaaggagucagcaguagagggacuuuuuccuuccuuccuuucuucuccuucuuucuuuguuuauuucuccuccuuuauguguuuguuuacuuauuuauuuaguauuuuaaagauuuuucuuuucauuucuuucuuuuuuugguuugguaggcacgguacaugggcuauuaagcaaacaaaugguucauguuuuggcauuuguuuuuuucuuuuccucuuugacauaaucccauuuuauaaaagcuaaagucugcauuuuuuuuuuuuuggccaaaacuguuuauuaugaaauaaaauauuacagagaaaacaguaauuugggguaaaccauauuacuggaucaaacacuaaauucuuggacccagauuccaaaugaaugacaauucugagccgaccucugguauuccucaagaauuaauuccccugaguuaaccacagucauucagagaugacuagcauuguugcuuccagaggcuuggaacuuuaaaaaggguauuaucaaauuacuccuugaggcauuccugguuucucugugucugagauauuaguaauaucuguuuaagagggaguuaaagcacagugacauuauuagugccaccaucaguguucuuuuaucccuccaggcugcuauagcaggugauacaagaaccugcuucccguaagcacagucuccauccuuucccaacgugcgugcgcauucucuggccccacccuaaagaaauaacuuacucuaagacauuuuuaugcaaaugcaaggcaucaguguuguaaguuucccuagaaguuucauuguucaucuccaucuuguuaaauacauuguggcugugaugcauugcagccucuuuccauuugucuuaugcaaagagaguuaauguugugugguauuuugcuggaaauggagauugaauaaggcuguugaauuccaucuugcuuuaauuuauauaaagccagaauccuucuuucaucaucuuaaaacaaaacaaaaccaaaucucauuuugggggacuuuuuuuuuuuuauuuuauauguuuauuucccaaacuaccuguuuucuauucauaggagaaauauuuuaucuuuuugguuuucuuaguguugauaagcuucuucacacaguuuaggaaaaugcucaguaguuguuaggcuguuauuaguaauaugguaagcauuaauucaaggugauauaugccuugauaaccuagcacaaccauuugcuacccauuguuccuccuaacaccccugcaaaggcaaggcaugucuucaacuucagauggccaaugcagccucuguaacuuagaaccaauuucuucaaucuuugcugucuuauuauuuccaguaaucuagccaaugagauuuauauaucauuuuugugucaaagaagccagaagaaauucuauaguucauaaauaccaaaagugagaggaaacauugaagggaaaaaaauguucuuuuguauuaaaucuugucaugaauaaggacgugaaccaggggagggguggcaguuggcauagagaagacagcuacucuagucugugcaucugaaggcaaaagcccugcuauacuggaaaacugugggccuagaaaacuacaggaagaacgggaugagguggagccauggcugucagggagaacucucuccuucuaaggaaaccauuuugcaguccucguagaccuuuguuuauuuuugauuguauccagaaggaagagagaacuaaguugcccuuuuuauucccauuugacuuagagcaauugcugaaugaaagaaggacuccuacauagaguggguaucggcuaugaaccauacacuaaacuaaagugccaaacaagagacaugccacugcccucgugguguuuaaaggggaagaaagguucccucaaaucaguauaucguugaaaacgauaagguuuaguggauaagcagaagguguggugcaagcaugugcuuauuagauccaucacuguuuucugaaaguagacaguguuguuuauucuaguuguaguuguuaagcucauuuauuugauagcaccaaguuguuuuucuaguuaugcaguuagcaugacaucaacaucucaaugugggaaggaaaaguacuggacccuugccuuguuguuuucacgguuuacaguggccccgguggcuuauucaauuuugauggguacugccaaguauacucuucuuagagaugcacauuuucauguuauggauaauguuuuagaguugcuauguuuccuugccuacacuguauaucauuagauacuuuuauauuuucuaaucugagagguaaaaacugauacuucuagugugguuuggguuuguuuuucuuguuaugagugaggcuauaguuuuuguuuguauaacaguaacuuguugugauggccuggauuaugucuggaugcaaugcuucaaaauaagcuaaauuaagaaagugaagaaaacacagucagagaaaggauacuuccugcagcaggaggcugggcacggguaacucacuauuuguuauuuccaguuuuuugauguuuuuuucccuuguguauauacagaagccacacagauuacacacaccuacuaagugacuaaguuuuuaaacagaauagauauucuagaccagggaucuugcuacuuagaaaugacacacggauuugaaauucuuaaauuauuugucagauauucuauuuaguauuuuaggauugcaguugacaauguguaacugaugucagagggaaaaccaccaauagguggggacuacucuguuuacaugauucugaaggagggccacauagacugaaucagauccuauguagugugcugugucacauagugugcaguucacuccuuucaugucugucugcugugugucuguccuguaaccgaucuacaggaugaucuuugugcuugugaauaauucuaacacugaucacuauccacuuuauaguuaugguucuuuucaagguuaauauuugucccauuucccaccaccucuccuaucucucagccugcgaaggcuacagcauuuucaaaacugcauuggacuauuuuuuuuuggggggggggggaggaaaggguuuauucagcuuacacuuccauacugcuguucaucaccaaggaagccaggacuggaacucaagcaggucaggaagcaggagcuaaugcagaggccaaggagggauguucuuuacuggcuugccuccccugacuugcucagccugcucucuuauagaaccaagauuaccagcccagagaugguccuacccauaaggggccuuuuccccuugaucacuaauugagaaaaugccuuacaucuggaucucauggaggcauuuccucaacugaagcuccuuucucugugauaacuccagcugugucaaguugacacaaaacuagccaguacaauugaccccuugucaacuugacacacaaacacaucacugguaagccucaacccuuaguuucuuauucauccccgagaucuaaauaacuuuaaaaguuccacagucuuuacaaauucuuaaaauuucaaucucucuuaaaauccaaagucuuuacaauuaaaagucucuuaacugugugugggcuuaacuaaaaaaaacuuccuucaagaggaaaaaauaucagggcacagucacaaucaaaaguuaaaaucaaucuccaaccauccaaugucugggauccaacucacggucuucugggcuccuccaaagugcuugggucacuucuccagccaugcccuuuguagcacaugcaucguccucuaggcucuggaugccuguacuccacugcugcuugcauuggacuauucuuauaaaguuugaaaauguauaccuuuacaaucuuuuuaaggucuaaaguccggaauucaguagcaguaucuacugguauaaaagguauuucuuuuuauuuaggcauuuucuuauuuuacauuuaaaaugcuaucccaaaagccccccauacuauucccccccccacacacacacuccccaacccacccacuccugauucuuggcccuggcauuccccuguacuggggcauauaaaguuugcaagaccaaggggccucucuucccagugauggccaacuaggccaucuucugauacauaugcagcuagagacaugagcucuggggguacugguuaguucauauuguuguuccaccaauaggguugcagaccccuucaguuccuuggguacuuugucuaacuccuccauugggggcccuguguuccauccaaugcuuauccaccaagguuaacuucauaguacaacuauaguauuuguagaaagagaaagaaaugaaauauuuaucaugauuuucuuuagaccuuccaggcauguguuuccuuuuuaaauaauaacauuuucuuucaucucuucuuucgguauuaguuacucuccuccugagugucuaaaaugcaagacuugguagaaauuggucauuuuauuuuuacagaaaagucauucaagagcagcuuugaagcaaggucaggcaucuguccucguggcuucuuguagccauucccaggcacugcauguagcacuggacaugcuuggaaucgggaagggccucggugugauuuagaugaagaguuaauucaaaucaaagcaagcgggaagcaagucaauuuaacuucagugauuaugauuccguuugauugaaucugugcuuuugauuacacguaucagugagaacaugccuuaaauacacccugcuauuaaauauugaagggaaccaggaaaucgugaaaaaacuccaccauucuuuaacuagcauguauaacuuauaacuguauuuuuuuuuaaacaaaugaaaggaaauaauuguguuaaguguaggacuucuuguuaacuaagguggcuaauucauuaccauggaugaaccuacuucucucuacuuuuaguaagacuuaauuaagugaauuacuaacagcucuguaacagaugaaaugaauuaguaauagcaguaauuuuguaaaucuggaguugaagagcugucuuuuugcuuauagucucuggaaaaggggcuuauaauugaaugggcuggagguacuucucaauaauaaauuucuuaaagcuuuguuuuacuuuugacagaguuaauuacuaaucugcucuuucugucucucauguaucuggcuuagagauuggaccagcuaaguuaauaauguuuguaaucucuuucauggauuaguguaacuauuucaaugucacccucaugcuacaucaaggucaccuuacagacagacagacagacagacacuguuaucaagugagaaauaucucuuggugauguguagaagcagugccaggugugauggaaaccccuucacuuaugguuccucuagcucuuagccuacccacuuguuauagguuagugagcuuguaacuuugcguuugugguuuaggaucauacccaauucuucuaacaaauaacugugauaaaguggcaaagaaaaucguauuuuacuagcaagugggaauaaguaaucuggaguuuggguacagagccaucagacugugcgugugcacugauguuugcaaagcaugcugccaucugcucugucacucagguagucucaaaacugucgucaacauaggagggacauuauuauuaauccaagauuuguucaaggaaaugugaaaucuguaauaaucugauaguucagaaacucgcuggugguagauuuaauauuagaaguggcuucuuucaccauguaaguuuuucuuuggguuauuuauauacacugguuucuaccucuuuuucuggacccgaguuuugguuuuccucggaauguggaaaaguuugucauaauguacucauuuccuuucguaugcccccugcauugugguccaugguaggccucuaagagauuacuggacuaguucagaaguggauccugauuggcucacuugagacucaaauccaguuaccucaaaaauuccucaaguggcuuugcacauuugaaauaagaguuacacacaaguaaguacuaaaaaaccugaaaccuuaagguauguuaucacacagaaguaaguuuauggguaauuguuuuuaauguucuacugugaugaauacuguuuuggggaugggaaagaugccuuuaagagaaugguauugauauuuuaauucaaaaggaagaaggcuugaguuuguuuuuuaauuugguuacuaacuugccacaugucagaauuagaaguucauucaaggucaucgcuccugaauucagaagccuuauuuggugaagagggaagggaaagaaccuuccagagccagggccauucauugcuccucuucguucacuguguaccaguaguagcuagccccucuucuuucauagugcagagggagaguuaguuagcuuucuccaaauaguauucuuuuuacaugaaguaauaaguuguaaaaagcaucucucugccuuuuaaaaguagcuuuuagauaacuuugaagauuaauuggagacuaugucuuguuuaaaaugaaagauaauacuaggccaucggagcuuauuaagaaaauguuucugugagauacaggccagcaaagauaagaccaucuugauaggaaacaguugaugacugauuuguuuaaugcucauauaaaauauuaacucugagucucgagcauaacagucgugagguaaauacucugugguuacugccuuugucagugggaaaaugcagaacucugauauuaagauuucagcaaacagauaguagaacagaaccgauucucugcauucaugccuccugugugaccacacaaggcagcuucuuggcugucuaccuggguuucccagccuaauccgagguuuccaggauguuacauuuagauucggauagccucaucucaccauaaauacuggacguuauuugcagcuugauggagugucuuugugccauggguucuuguguucuagagcaagacugacaguuccuuuuuuagcccucugccuuuuugcacaguggcacuugaagaugggaaccacagggaugcuucagguaggaaguuaggagcagcauugggagaacgaauguuuucccuucauguugaaggcauuuuuaaaaccugccagguaauuguauauauguaccuuucagcucacagaacuguccuuccuuauguucuuguguucugguugauaaaguaauacuuuuugagaacacaguuuuguguggaaaacuuuauuuugggcuucuaaaauuaggaggcuguaucauagaucacauguuuuuauaucacucauugucuguaaugugccuuuucucacuccuguucuggagacuuaagguucucauacaucuggacaacuuugcugccugcugcaaacugaggaaagaucccagacuggcaucucgaguucuagacuugauaauauuccaauccuacauuagucauucucuuccuuaugauuucagaugccacaaaauuugaccauuuucuccugguuuucccaaagaaccuggacuuugggccauguguugacagggagguguggcuacaaagaagcacaaaauagggcucugcagucacuucuagaccaguguuguuaccugggaggccacacaugcaugguuuguuuguuuuguugggcggguuuugcuguaugugcuugcuuuauuuauucauuuauuuaguguauguuuaugcuuguguguguguuugugugugugugugugugugugugugugugugugugugugagagagagagagagagagagagagagagagagaugaauugguaaaugccaggcaucauuuauaaucguuuugucugcaguaaacagaggaauaagagaacuggguuuuauuauaugucuuauuuucgccaagugucagagaugaaauucugcugccuuaaucucuuugcagguagggaauuuugauugaggaaccugagagaagucauggcuauccucuagcuagcugguaggauauauacaggcuacaugcagggaagggaucugccuuuguuaugagccauuuacuccugaguuuaccuucccuguuucccugaaagacuggguaaccuguagguuguaaauuucucuuuccuguaucugaccucucaaaaccccuugacuuuguugauaacucucuccuccauugucuucuaaaaauggcucuagccuccuucucuggcaucuuccuaaucaucacccacccuuccacccuuccacccuuccacccuuccuccucccucccucccucccucccucccucccucccuuccucccucccucccucccucccuuccucccuucuucccuuccuuuguuuuuuucucucucuuucuuugugauuuuuuuuuaaacaggguuucucuguguaacagcccauaaucaccccuuuccaaugcugcuuuuucccaggaguuuuggcucuggcccuccugugcauaccaaacucugcaaaguaucucugccucauggcaccuuucaaauauuuauguuuuucacauuucuaguaccugcuugucuucugagcuccugacuugcauaucaaguaccuaaggacauggcccauuaaacuuagcauauccagaucucucccaacaguuuuccuucuaaauuuauacuuugacuuaauuccuccaccuccacuucucuuccacuucuucaucuuuuucauucucuucucuuucaaaagaaaauagcaucauuggugcugcuuaagccagaauaccagacagaggcuauggagcccuuugcuuucuuuauuacuguucauucaccuuggcuugcucuguguucugacuucauaccucaggcuccuagaucagguaggaauccaugacuuuacaguuggagacuuuuggaaaaguguguguguguguguguguguguguguguguguguggguggugugguguguagaauagauucuguauuccucaugugagacaacauauauaauaguugucuuuccaaaucagguuuguuucacuuaauguuuucauucuuuuuucuaaaaaaaugcauaauuucacuuuuuacgguuggaaaaaggaucauuguaggugccaguccuuuaauugaguggauucagucacuugcugugaaagcucaguaacauaaaacuggugggaacgaucuuuauauggcaagaucaugccucauguacgcgugugcacgcacacaaaaauaaaaaccgcuuucauuguguacauacaucaaauuuucuuugucuauucgauuguugaugggcauguauaacuuacccuugugaauacaagaaaugugccauaagaaaugugacuacaccaaugugguuugucccucccgcuauagucuaagucuagcuggaacauaugguugcuaguuaccuguuuuuuuugaggaaccuccguacuagaaacauuuuauuucuuuugugcuauuuaugaaagaaggauaaaaaguccaaaagagucaaaagaaaaaguuaauuuuucuccacagucagaauucagaggacuaaguuuucaguauaguuuuguuuugaauauuuagauuccauucuucacuguucuauguauuucuuauuuaccacaguagaacuauagacacucauuaucuguuuuacucaagacauagcugcugcuguuagagcuuaagcuauuuuggaauguaauucagaaagcuuacauuucacuucuugaauaaaugcagucauuaauuuugguuaaacuaagaaauaccuagacaacuaguaaacuaucuucuugauauacugguauuaaauuucaagaguucugacccgaacaauagauugaucucuugaugaauucauaacaugauggcauuguugggaggugaugcagccagaaaguggagcccaagucacuggauacaugucuuuaggguuguguuuuguccaugggucuuuucccuuccaaguucugccuaagcucaugaguccaaacaacuauuaggugaacccgugaaacugaaucaaaaaugaaucaacacauaacauuuacuaucaggcauucuguuaaugauuagugacauguuuuuauuauaaugacaggcuuugauugcugugguuccagcuauaaagcugucauuuuaugaguugauuucuuccuguucuaaaaaccacuaguguaucuaugacuuuuucuguccuugagauguuucaucuaaacaggcagucaucuucaacuuuuuuuccagaauauuuucaguuuguucuugcugucucauagauuguuuuguuuuuuauguacuauccaauauagugcacauuuauauuauacuuacacuuauuaguaaaaaaacauuggauuauuuugcuuguugucacuaaugguacugugaacauuuguauucaagcuuuugugugccuacguuuucugaucaauuacauggguauucuaaguauggaaucucuaguccauaugacagcucuguauuuaauguuuugagaaauuugagagcuuguucuauggaggaagugccaguuuauaaucugaggaaauuuguaugacaguuacaauacuugcuguuugccuuuuuuauuguuuuauucugguagauaaaaauauuuucucauuuugauuuugauuucaauucacuuauuacuaauaauguuacauaucuuuguguugcucaguugcuauuaacauguauuuuuucacaacaacaauaugcauuuacauuuuuuugcauuucaauuuuuacucuuuauuuaaaauuacaagugacacuggcacacuggaguuuuuuuuuuuuuuuuuuuuuuuuauagauauucuagguacacauccucuaucaagcugugguugauagcuuuuauuucccauuuuuuuuguaucaccuuuucucauucuucaugauaugaaaaaguaaguuuuucucuuguagcugcaggucuguuacuauuuaugguuguguuguaaagcaaggcugagcuuuccugcuuugaauggauucuuagcuccacauaggcagagcugccuguagagcugucacaaggcuggcccauagccuucuagcgaaugcugcacuuuccccucuccuuuguagcucugaugauuguacuggaguagagggccugccucgagacauugagccuacacgaguggcugaagcugguccugugucagguuuuauuuuauuaagggaugccauuuccucaguguaaacagaaacucuguaucugauaucccaucucguuucuucacugggucuuuucugagagagagcugcaccugcugauuaugcucuucgggagccuggcugauaggaugcacagcagcggagggcaguggucauagagccaaccauugcacugcuuuccuuuucauguucugucggaacugcaaguccuggaccacaguguccucuagacuucccagugccaucaauuguguuuucaaacaaugcuaaguacagcaaggccauuaacguuucauuuugucagaagggacauuuggucauauaacuaccuucaugacaaacaauaacagaaauauaacaaccuagagauuucauuaucaagagcguuacgagaaccaguuaaugaaagcuaauacauugcuuuaaugcuccuuguuuuacauauuguuugcaggcucauucuuuguagccauagucuacuguccuuaauagcaauuuuaaguagaaacuuggguugcccuacuauuuacuguguaugauugaguuacaagcauauacuaauauuuucuuaauacugaauuaacuguuuuuaacuguuauguuuacuuagccaacuuuucuccgcuguuguauauggcucuuuaaaacagaaaaauguggcacauguagguauaaaucugagcuaacauugagaggauagaguuuucuuucaaaagguacgauggcuccuguuuaccuacucaauguguuauuccuagauuaugcaaguauacugcagucugggagcacuacauaaauucuauugauucucucucauugaaauugcaaugucaaauagauauuagaguuuuaucauugcauaguuaugggcugucacauuggcacauuaauuaaaacaauugggcaauaaagaagacauaggaauagauaacgugcugugcguuuuugugagauuauaguugcagccuccacuuacggccauaaagucuuguuaauugacaccucuguaaagcaccuuugugcugcucuuuuacuuugcaaguuggcuuaucaguuuguucaggaucuccgaacauagaaacauauacugaagcucacauuccaagguuuuuaaucuucauucaugauauagucauuaaauguauucagcaaauauuuccuaaccaucuucuaaguauuguugaguauagcaauauauaguguagaauccaauuugaaaaaaugguacuggagaggggaggcagaauaccugcaaaacgauaacuguguccugcauuuguuaagguacauauguaagccacauguguaccuuaacaaauguuccuuaaaacucaguuggacuccucuccaaguuuaggggaggaagucauucugugucuuugugaucaguaaagcuauaaagaucaaugguagaggaauuacuuuguauccaugacaaaaaucucuguacuuuuuucuuaaauacacaucuguauucuagaaugguagugagagguagguggcuaaaugcacuagcuuggaaaucaacuauuguucugagaccagcugcuuggcaaccucauuuuauguccuugaguauauagaaucgauguaauaauauguguccagcauaucucacuuugauaaaugagauaaugugaaugccuaagcugcacccuguagugagagucagauugcuuagcaggugucuauuuucccccuacaccucaggcuaugcauuugaaugacagcaaagcacagcuucccaugacuaacaggauuaguguccuuaccaaagcccugcauuuauugcuacugaguaucauauucugugugccaucugaacugcugucugaaaaauuggccagaauucauuggagaccaccuaugugaaaagagaauaguuacaauucuguacucucaaauaugcuaaaaagagcugugcuuauuaggcugcuaguuuagggguuuuacaauggauucauaaacucuuaagucaucaucacuuagugacaguaaucugaguagauacauuuagaagauugcuuagaucaugcagcuguugcaaaucaaaucuguuggaaugugacauuugucuguuuaccuuggucugugcuucucacuagagcugaugauuuuuuucuugcaggccaguguaaaccauuccucugugaugguauggauuuaugugacuguuuuguucuguucuguuuuguuucuccacagguuacuccuagaacugcuggaacuguuguuugauaaguuuaaugccguagccacugcacacucagugguccugggguaccuccaggacucuguugggacccagcuaacacagcaggaggagaucaaauuauaugacauggcagaugugugggugaagauccaggaugugcugcagguaaggccuuuguacagaggcugccaucuugacugggacaacaguguagagaaauagaaaacagaugccucaguuacuaccguaggaagcacaaacuggauaaggaaguaacgcuuucagagaaaggggaugaugucauuucugucaucuuucaaaggacuucuaauguuguuauuauuguuauuauuuuacgggggggugucaggcucuaagaauaaucgcugauucucaauauauagcacucaaagauauacucuaugaauauacucuauauucauuugguuuuuuuuuguuucauugaaauuagucauauguuuagcuaauaagaaacuugcgugguuaauauaggaauaucaagaguuugaggccauucugggauuuauagagagugaauugcugacugugccuaugaaaugagaccuuguuuuaaaagaaagagaacagguauaugugggggagagauaauaaauauuaaaauguuuuaaagcuauuuuaugaacauggcuguucuuaauuuuaguauuuucuuacaaccaccuuuucaggcauuggguuaaugacaggucaggagcuuauucugagagaugaaaauaaguccacgguugcaagugcaucacucucauuuguugacagucaaagggaucgcaggacuguuugaugugguacugcugacauggcauuuagaaacugcauuauauuuuucucucugccgacaaaauagauuugauuuggcuagaugaaaauuagaaaugcaauuaagaguuagccaaaauaaguuugacauagcuaaauagaaaugguaauaucuacuuaguauuaaaaagaguaaguacauguggagaauugaaaaauguagcuguuggaauggaaucauuugcacagaaaauaggaauguuugcagugauaaauaaaucaugaaugcaaauuguagucauuuuugagaauauaugcacgcuccugguagauugaauaagauugauucuuaguaacucauuuucuagacuuauuuuugggagugaggugaugugcauuugcucaguuuaaauggauugaaucuacuuuuuuuuggauucuuuuuacuaauauaucaauuccuauguaccugaaauaggugcuugaaaaauguguguuuauuggugacgauaucucuauggguggagcugcuuauuuaacgcuuuccaugcugguuugcuuauaggaauguuugcuaccuagaaaugaaauguauuuuucauguuauuaacauguuaaagcaauuucaaauauugagggaauucuggcccuauaguucuggcuauguugaaauuaccuuuuguaguaaggaacuauaaauccaaauugacucagguuaaauaacagaaagcagagagcaagugagguuaguuccauauuuuucuuucuuccucugauggguauuuuucaagcuaucaccauagagaaaugaaguccaaaagaugaucuuuucagaggaaucggggauuacaguuuagggauguagaggcuuaugaaaugugugaagaauagaguuuggagagcaggaaauugcaugcagaaggagcccuaggaaguuaguguagaguugacugaucccuuggucaaacuuguucuacaagccuuagcaggaaacaaccacugugguagagacugaugauuggagauucugaaaguaugugcaaaugcuugggaaugaggagagaacaagccaaaggcuccuguggcucagaugugacuuuaugccuuaggaacauacauagcccuucuaaucacagaacaaagguuaacucauacaguacaccuccagagucccuccugaacugagcuauccccuuaugaaguaccugaauaacaucuaaacucucucuuaacuaguauaaaagaaucagauucccaacaaugaugcauaugcacaacgucuagcaugcaguuauaauaccauucaaaagugugacugcgugacucauaugcaggauaaaaauggacaaaaaauuguaucugcaaugacaacaucaccaguuggaauaaauggugaauuuuauacucuagagaggaucagugaaccugaucauagaucauuaaaacccauccacacagagugguaucagaccuaaaccaaaaaaugaguaaagccauuaguuucccugauacaguuucuuucaucuaacaauuaugugauugcagugguagagggagaagauuagagcauaacauugccagaagaaauaauggccaaaauuauugaaaauauagacccauguaucaagaaguccaccaauugcaagcaauauuaacacaaagaaaaucaacacuagaugucaguuugcugaaaaccaaaggacaaaaauguuaaaaauagccugagaagaaaaaggacauacuacuaugggggacacauaaaaauaaccacugacuucagugucagcauaagccagaaaccagugaaugcuaucuugaaggugccagagaaaaaaauugugaaucuagaauauuguaucaauagauagaauguuguaucaauugaaauuauccuuugagguaaagguaaaacagacauuuuaaaaugaauugaagcuaaaaguauuuagacuugcacuuaagaaauauagaaagauuucuaagcugaaggaaagugguaacauaugguaacuacaggaaaaaauauguggguaacagugaaauaucauuuuccuuauuuauugaauuuuuuauccuuugaugagcuuucuuuauguuuaaaggaaagcuauuaaucauauaugauauuuuuaucauauauauggagucaauuauauagcaauaguuuuagaaauauuuuucugguaaauaaaucuguguugauaaaaguuucuuacagcauacgugaagauauauaauguuuaggauacacuauaauaacuucagaauacaaaauuuaauuacuggugcacuaaaacaauagaauguauaaauagcuaaaaaguuuuccagagaagauaaaauugaucacugaaaaacuaagaaaggaagaaaauugaugucaagaaaggaagaaaaaagagcaaaggagaaagaaaagauaaagaacaaagccaagaugauauggcuaggaaauaaaaagguuuauacuaaguauacaauuauauuaaauauaaauaacuaaacaccucacuuauauggcagagaucauaucuuaaaaaaaggaaaaggaacaagauuuauguauuaaaaaauaaaaaaaugaugguaauaaugaagcaacuuaaauucaauuaggcauuaauauuggaauguauaaauuguuacaguaggcauuucuggguuauuaagugaauuauuccuuccaaaguuuaaaauggagauuuggauuuuguauuuucacaucacagagugauguauuuuagcggcgucaguggauugcagcugauaugcugcaauguuuacucgcuuaaagguacaggcuuuacugcuucucagacuguuggcuaaggucaacuguaaagaauaguuucuacaauaucuuuauggaguuguaaagccauagguguagucuaacuuugaaacaguguuuuuacuccaaaaggaaauauugaauccacgagguuccugcacauucuccacucuaacacagucacagucccugucugggaaaugucuugcucgcuggcagguuuaggacaaggaagggguuucauuuaguuuucauguagaguuuuauccauagagccaauuuaguuuucauaugcuucuuggaagaauggucuuuaggugaaaaauuacccuugaagcaugaaguaauugaaaauagcagacaucugcauuuaagcaugaaugaaaguaagauaacaugaugaauggaguuauacguguuuggaguuuaauuuccagcuuuuuuuugguauggaaaauguuugcugcuaaaaauuucaagauuuuuuuuaaacacuaaaaccuggagaaggaggaggaggaagaagaaaaagaaggaugaugauggugaggaggaagaggagggggaggaggagggggaagaggagggggaggaggagggggaggaggaagaagaagaggaggagaugauuaagauucuuagcuguaaaauaagacugcaguugcuuucugcuggaaccugggcuuccccugccugcagagcccguccuuuaguuagaagcucauuugucucagcauguuugugucuggagacagacagugagaagacagggccagcgcuaucacaguaacaaggugucagccccaugaccacacaccauugcacuccuuuuucggcuuugcacucuuuugaaacugugauaauagaaauauguguuuuuacccuuccgagcugcagaacucuccuuccaaaaugucacccacucggugauaugccugucauacccauggcugcacauuuucaaguguggaagucugggguccacuaaaaacaugaaagucuccauuucuuacccaauucugcauaauagagaaaagaagagggucacuuuaaguaaucucaucuuccuagcuguaugauucugaaaagauguaaguuuuaauaucugguuucaaaacaaaacuguauguuuuaccauuguuggcugacguguaucguccuuuggugaacuuaguagugucugagcaguagaucccaaggacucuguuuaugacugauggugacuccuggaauaagccauugcuuuucuagugucuugaugucauuuucuagagaauguaaaaucauuuuacuuugguaacugcuucauuaauguuuaaauagugauaaaauuaaccucauggagagagagcuaggaguuugcugucagggaagaaaaucuaugaaauuauugguccugaucaugaccuagaggggauuuucaaggagagauacuguuucuauuuucaaucuaggacuggaacuaaguuauucuuagguuuuguugcauuuaauauuuuagcuaagugaggauucccauccuuaaaguggagcuagccuuucaaaguauuuaagccacauaauuuaugagugaauuauucagaaauaguguuuucucauuucucagacuugaaaguuuuagcuuagugcuauuuuagauaguguggugaagcugucagccagagacugcuucuccaggaugguuuuucuuuuuaaaaguuugguucuguuuuccugugaguugaauggcauacaauucaauuaacaucugaaagacaauucacaaauuuuccucuaaauugcagucaguuugaauagcacauguuucacguuuacuacuaauucuuauaguagaagccaaggagauaucuuagggccuugcacagauguggcaaauacccaaggaaaguacuaggacauucaguaugcaauaaaaccuuggguaaauggagauaguuauuauacugagucauacuuuagaaaauaaagacuuggcaggggacaccuggauuugguagauuugguuguaagucuguucaugaauuucuagauacccauaaagaccuacuuuggcuagauuucaucuugaccuguagaacgacaggcagguaaaacaggucuuuugugccuaaaccacacuugucuacuuuuagcuaagauuuuuaguggaugaagcauuaaagccacacuguaucaagauccuguugguacaccuaccugauauaugcuccucaagcuuuguugcccaagcaugacugacugauaggaagagcugaacuaugaugcuauagaaguguaucugggauuuguaugaaguaugccaacagucaagauuuucacugacagugagcauucuaucagagaacagggaauuaguaaucuuuaaaaauuuuguuuuuuaauguguuuuuguuuucuuaaauuguugaggaaucauaugaaucugguuucuugacaguugugauaauuuauuuaaaaucugguuuucuguugaugcagacagaauuauuggcaaacuuuguuucuucaaucauccacauuuuguuucccacaauuuagucagucauuaugucaugaaaguauuccauggugaucauuugucuggcuguucaaaucugcaguguggacugauuagaaugagcaggauacuucaguauaugacuggcaccuuugugcuuccacacagccccuuccucuccuuccucuguaugacuuacaucaugguuauucccaccuucccauuccugauccuggaauuccccuauacugggacauagagccuucacaggaccaagggccucuccucccauugaugacugacuaggccauccucugcuacauauauagcuagagccacaaguuccaccauguguuuucuuugauuggugguauaguuccaaggguacugguuaguucauauugauguuucuucuauggggcuucaguccccuucagcucccuggguauuacucuggcuccuucauuggggaccuugugcucuguccaauggaugacugugagcuguauuugccaggcacuggaagagggucgcaggagacagcuauaucaggcuccuguagguaggcucuuguuuugccuuugccuagugucugguuuaugggguggauccccaaguggggcagucucuggauggucauuucuucaagcucugcucugaacuuugucucuguaauuccuuccauggguauuuuguuccucauucuaagaaggaaugaaguacacacuuuggucugcuuauugaguuucauauuuuuugcaaauuguaucuuggguguucuaaguuucugggcuaauagccgcuuaucagugaguacauaucauguguguucuuuugugauuggguuacuucacucaggaugauauccuccagauccauccauuugccuaggaauuucauaaauucauuguuuuuaauagcugaguaguacuccauugugugaauguaccacauuuucuguauccauuccucaguugaggggcaucuggguucuauccagcuucuggcuauuauaaauaaggcugcuaugaacauagcauguguucuuguuacaaguuggaauaucuuuuggguauauguccaggagagauguugauggaucuucugguaguacuauguccaauuuucugaggaaccgccaaacugauuuccagagugauuguaccagcuugcaaucccaccagcaauggaggaguguuccucuuucuccacauccucgccagcaucugcuguuaccugaauuuuugaucuuagaaauucugacuggugugauguggaaucucaggguuguuuugauuugcauuucccugaugauuaaggauguugaacauuuuuucaggugcuucucagccauucaguauuccucaguugagaauucuuuguuuaacucuguaccccaauuuuuaaugggguuauuugauucucuagaguucagcuucuugaauucucuguauauauuggauauuaauccccuaucagauuuaggauugguaaaaauccuuucccaaucuguugguguccuuuuuguuuuauugacagugucuuuugccuuacagaagcuuugcaauuuuauaagaucccauucgucgauucuuuauuuuuuguuuguuuguuuaauuuuuuucaagacagguuuucucuguauaguccuggcuauccugcaacucacuuuguauaccaggcuggccucaaacucagaaauucaccugccucugccuccugagugcugggauuaaaccugugugccaccaugcccgccugugcaccaugccugccugugcauucuugaucuuacagcacaagccauugcuguucuauuuaggaauuuuuccccugugcccauaucuucgaggguuuucuccacuuucuccucuauaaguuuaagagucucugguuuuauguggaguuccuugaucuacuuagacuucagcuuuguacaaggagauaagaauggaucaacucgaauucuucuacaugauaacugccaguugugccagcaccauuuguugaaaaugcugucuuuuuccacuggaugguuuuagcucccuugucaaagaucaagugaccauagauguguggguucauuucugggucuucaauucuauuccauugaucuaccugucugucgcuguaccaguaccaugcagguuuuuuguuuuuuuguuuuuuuuuguuuauauauauauaauugcucuguaguacagcuugaggucagguauggugauucaaacagagguucuuuuauuguugagaauaguuuuugcuaucccagguuucuuguuaauccagaugaauuuacaaauugcccuuucuaacucagugaagaguugaguuggaauuuugauggggauugcauugaaucuguagauugcuuuuggcaagauagccauuuuuacuauauuaguccugccaauccaugagcaugggagaucuuuccaucuucugagaucuucuuugauuuauuucuucagagacaugaaguucuuuuuuuuuuuuuuuuuuuuuuuuucaagacgggguuucucuguguagcucuggcuguccucaacucacuuuguagaccacgcuggccucgaacucagaaaucugccugccucugccucccaugugcugggauugaaggcaugcaccaccaugccuggcugagacaucaaguucuuaucauacagaucuuuuacuuccuuaauuagagucacacccaggcauuuuauauuauuuuugacuauugugaaagguguuguuucccuaauuucuuucucagcuuguuuauccuuuguguagagaaaggccauugauuugugugaguuaauuuuauauucagcuacugcacugaagcuguuuaucaaguuuaggaguucuugaauuccugaucuuuccaagacuuuuuuauuaugaauggguauuggauuuuguuaaaugcuuucucagcaucuaaagagauaaccaugugguuuuugucuuugaauuuguuuauaaaguagauuacauugauggauuucuguauauuaaaccaucgcugcaucccuggaaugaaaccuacuuggucaugauggauggucguuuugauguguucuuggauucgguuugcgagaauuuuuuugaguauuuuugcaucaauauucauaagggauauuggucugaacuucucuuuguuuguuggguuuuuaugugguuuagguaucagaguaauuguggcuucauggaaugaguuggguagaauaccuucuauuucgugaaauaguuugaggagaauuggaauuaggucuucuuagauggucugauagaacucugcacuaaacccauuugguccuuuuuuugguugggagacuauuaaugacugcuucuauuucuuuaggggauauggggcuguuuagauuguuaaucuuauccuaauuucauuuugguaccugguaucuaucuugaaaauuguccauuucaucaagguuuuccaguuuuguugaguauagccuuuuguaguaggaucugaugaugcuuuggauuuccucagguucuguuguuaugucucccuuuucauuucugauguuguuaauuaggauauuuuccuugugcccucuagugagucuggcuaaggguuuaucuagcuuguugauuuuucucaaaaaaaaaaaaacagcuucugguuugguugauucuuuguauaguucuuuuuguuucuacuugguugauuucagcccugaguuugauuauuuucugccaucuacuccuauugggugaauuugcuuccuuuuguucuagagcuuuuaggugugcugucaagcugcuaguguaugcucucucuaguuucuuuuuggcggcauucagagcuaugaguuuuccucuuaggacuguuuucauugugucccauaaguuuggguauguuguggcuuuauuuucauuaaacucuaaaaagucuuuaauuucuuucuuuauuucuucuuugaccaaguuaucauugaguagagaaauguuguucggcuuccccgucaacguuggcuuucuaguauuuauguuguuauugaagaucagccuuaguccgugguaaucugauaagaugcaugggauaauuucaauauuuuuguaucuguugaggccuguuuugugaccaauuauauggucaguuuuggagaagguaccaugaggugcugagaagaagguauauccuuuuguuuuaggauaaaauguuauguagaugucuauuaaauccauuuguuucauaacuccuguuaguuucacugugucucuguuuaguuucuguuuccaggaucuguccauugaugagagugggguguuaaaguaucccacuauuauugugugugguguaaugugugcuuugagcuuuacuaaagucucuuuaaugaauguggaugcuuugcauuuggagcauagauauucagaauugagaggucaucuuggaagauuuuacuuuugaugaguaugaagugccccuccuugucuuuuuuuuuuuuuuuugauaacuuuggguuggaagucgauuucauuugauauuagaauggcuacuccagcuugagauccuggugugaccaagcuccugauguccugggauccacaaaucauaagauccuggguauguuccagcuccuggaagugguuucucuucuggggaccguggggcugucugguguguucaaaaccaagguauaccagcacugaucagaaggaaucagagcugcuggucaggcaggguucccgugucuuugcuccugcuuucacaggcccgucacgacugguuuggaacagauguguucuacucaccagugauccuaagauccugggcguucuagagcuccuguguguggagaguccccgggggacagugggacuguccgcugaguucaugcccaagguggucaugagcuggugccgaccugaagggacugagccccuggucaggcagguuuccugugucccugcugcugguacaggccugucaugauugguuuggaacagauguuguguuucacucaccagugauccuaagaucgcaugaacagucguccucugggguccguggaacuguccguggaguucgugccuaagauggccuggagcuggugccuaccaaaagggaccuuuuucuauuuuucuacauuaugaaaaauuucaaauguguucagacauaguguaauggauuuccaccauccauucuccagcuucacacguaucagauuuuggucaaaauuguuucuuucuuucuuauuuauguucuuccucuauuuuugaaaggcucuuaaagauaauuuuguuuuguuucuguuucaauauaucucuaaaagauaacuauuuuuauaaaaguguaacccuagcuaaagccaaaauuucuuuaucaaguauucaguauuguuuacauuuuuuguuguucacaugugguauuuauaugcuuuuccauuugugugauucaggauccaaaugcaguugaaauguauguagguuguugaguuuaagacuuugaguguguacauucuccuucuguucuguuuuauuauucaugcccugauauuuaucagagaaucuugaucauucaguaugcagcacuuccuguagccugauucuguugauugauuagugucauuuacuguuuucuuuuuccuuagaacuugaagauaaaggcuugaucagauuuaauuagauuugaggugucacuauuaccucaucaauggugauagagacucuucuuuuuguuaaaguacuaauauggccaaaauaauauuuucuggaugauuaaucuggcaguaauguucacaccaaauuaguggagaagaaaaugggugagaaauaucagucauaagcuauguucagucaguguguugccugaaaagacugggcaguaaaaggagauagugauuagagaaauaugugaaaaacaaauggcuuuccacaaucuuuuuacaugaacccuaacucaggaagguccuggggucugggggaaauuuuaaccaaagugauugagaaucaggaucacaaagaugguggcuugcacuuguuuaaguugaaguauuaacaaauaaaccugcagaauucuuuuuuuuaauuuauuuuuuauuagauauuuuuuuauuugcauuucaaauuuuaucccuuuuccucauuucccuuccgaccgacccccaccccccaaucucauucugccucccucugcuuauuaacccacccacucucgcuucccuguccugguauacccuuauacugggacaucgagccuucauaaggccaagggccucuccucucauugauguuucagaaggccauccucugcuacacauguggcuggauccuugaguccuuccauguauacucuuugguuggugguuuacucccagagagcucugagggguauugguugguucauauaguuauuuguucuuccuauugugcugaaaaccucuucagcucuuugggucauuucucugacuccuccacuggugaccaauggauggcugugagcauccacuucuguauuugucagguacugguagggccuuucaggagacagcuauauuaggcucuggccagcaagcacuuguuggcauccacaaucuugucugaguuugagguguagaugggauggauccccaagugggacagucacuagauggccuuuccuuuaguuucugcuccaaacuuugucucuguaucuccucccauggguauuuugaacccccuucuaaggacugaagcauccacacuuugguuuucuuucuucuugagcuucauaugguccuugauguagaacucuuauaagcagcuugauuggccaugggaggcugggguugggagucagauuuuggugccugccaggggauaauagcagaaacuauaccgaugggaauguuggagcggaagggaugagugaggacuagucuuagaguagucuguagacucagcuuucugugguugucguagcagguacagucccugaggcuggagcuugucgggaaguuucugcaguuuccucucuuuucugcuacgugcuuguauccuugggaccgauguggaacauggauguaaaugccugucaggccaaggguggcaucgagcagaagcggguguuuuacuuggguaucuagacugaagccuuuugaagaaguaugugcccgguccauaagugagccugcaagugcuaagaagacagcaucuguaugaugaggcacugugccugggggaccggauaggcuucccuagugauaucuuuuugccuuguaauucauguucucaccugucugaccucccuaccgugaggaacuguugacagguuucuugauguccuuucuuguucuaccagaauuuagaaauugcgaaucauaaaacauguuggcacuaacuaaaaggauucuaagaaaacauuccuccaaaauaccucuuaagcugcauaagagugguagcagugcacaacagucacuccucugucuuuagaugccuuuugacuguuguagaaagauggcgcaguaaauguuugccaccaaucuacacauacaauucaaaguuuaaaaacgguuaucuuuuuuauaguuauguucaaguccaucuucacuuuuuuauccucauuaacauuauauagaaaauauuaugacauuuguaguaaaacuuuuuuucucaucuaauucugggcuuuucauaguuauuuguuuguuauuuaacaaauugcuuguaagagaguagaauacaacuuuuauauuaacuacuugaaauuuuuguaugguuuugaaaauauaaagugaacagcaacagaauccaugcuuuggccacaguuccaugguuagauguaggcugcagcagaaggaaaugaaacagagcagaugaugaaggcuuagcaccaaguacugagccucacaggguggcgagcagcagcacuuagauaggugcuagcagcgugauauggcagugaaaaaggccagcacuauuucuggcucugaugcacccaacagcugcuaugucaccacugagcugcugugaucaucccuuccuuucaguccucggagguggcuuccgugcagcugcauugagugugcaugugcgucccuggaagaaggcaaauagcugagucccagacagagcauuggcagcaaucgaggacuucagauaggaugcauuuucugucuuuuacaggaaguagcacauuugggagugagugugcuauuaaaauccauuaaccuuuucagugauagggagauacggguggcauagugucacuaaaaagcuguucacuaacgagaguuugacuccucacuagauggaauauauuuaauauagugacuuacagagaucacauauauacuucuagagacaacaaauuaugaaaaagggacuaguuuauggucagcucugcuuugguugggagauuaucagcauuggcuguguuggauaggaugauaagagggacacaaaacaauaggugauauagcucuuucuuagcauuuugaugcgacauuuaaauaggauauuaaacuuaugaacaauauggacugaauaauauaauguaguaaucuuuacaaagucagauaugaaauggagaaaucauuuaauucccacaauuggguaagccuguacagcagaaagaaauuaagaaaugcagaauauaaguggaaugucaggguguauuucugcagcaaaacugucggaccauaugauagccuccuguggaaaugcaguuggauuauguuggacuugugauuuugagagaacugauuguguguguagggaacuaggcugagugcucuccagggacccuuuacuuaccuuuucucccauuccuuguugaucacuuuaccuugugucuuuagaaaggaauuucacauccuaguuuucuauacacaaguauauucuacaugguuucccauauugacaugggcuuaaaaauaugaacuuucauugcuauuggguugaccuggcagcuuuucuuggauuuuauggagcagcucucucuaucuggacacaguccaagguccauacugaagguagcuaaguuuaauagaauggggugcuaauauuagacuagagucuuucucaaagauaguuuauaauccaauggggacugcuccccgcuuccccaaggugcuuugggauccagagaacccaaaggggagggaggggauugagacucucacuuucuucccuuuccccagggucuugcuuuuaggagaaaggguauuuagcagacuguguguccuagaaucuguccuguggaaauauggucauuuuacuuuucuggacuccuucccauguggugaugguguguauuccagacugucuguaguaguagcauugucuguuaaagaaggagacugucaguuccuaacugaagucuaguuucacugcuuccacucugcaaucuaugcagaaugcuuuguuuccuuagcucagcauuccguaccuccacaguuugcauaguuugcugucagauaggcauaccugcacuggccaagaaguacagcuguguucaaauuaaaucauucuuuccuucuauuacccaaauauagcucugucuucuguuuguacuauaaauguauccugcugucuuugcccucauccuugagcaucuuuucucuugugauccaguccucugguuuuuacccgagucauucaauuccuuucaggcacugugugaacuuuuuaccuuuagcaguguauucauucgacauacuuuuguuuccuuuccuuuaagcaaauuuagucagauuaaagacuguauccuccuccuaggaccaugguaguuuuacaucuuuuaauuucucagugcuuauguuggauggcuuuaugucaacuugacacuggcuaaagucauuugagaggaggaaaccucaauuuaaaaaaugccuccaucagaucagguugaggcaagacgguaaaguauuuucuuaauuagugguugguggggagaagacaacccauuguggguagggucaucccugggcugaugguccuguguuuuguaagaacgcaggcugugcgaugaauagugaucgggaaguguagacugaauaaacccuuuccuccccaaccugccuucugcucuuaguguuucuuugcagcaauagaaacccugagacaaguugauaccaggaaaaagggguauggccgugaugaccugaccgucuuguuuggggagcauugucgaaggacuuuggaacuuugguagagaaaagccauugcauguucagagcuuggugaaguauucucaaagagacuggaagauaagaauguuaagagcaguguagaugauagaggccugccuggcuugugaaguuucagagagaagcaagagucuacugggccauuugugugaagaaacuauggugucuggucagcuggagaugaagaaucagcugugaguuauaagagaccucaagcacuaaaaagaaaccauugcuuugcugggaccauggauacuggucagcuguuaauaaaucaguugguccuuugaaagaagaggauauaauuucuuuauuauguuucccaugugagcuugacucagguugugccaugcaauguacuuacuaaauacugaguuggccggugaggagcagaggcccagcacguaucugugauuggaugguuuaagauuuaugacaaacgauauuuuuauuucucuuauacccauaggaucaguucuagauuguaaugugaugguauagagagguggaggcuuuugugaaggacuagguauuugagaguaaagucuucaaggauggaaucacaggcccagagaucuuccucugccaucugcugucacagcuagaacauggcuguugugguccaggaagcugcuccuuugaucuuggauuuuccagcuuucagaacugugauggacuauauuucucuuguuuauaagcuacugaguauaugguguuuuguuauaguaucacaaacgaagaugaaauugaguuugaaaugcucuuuaaaugugaugaauuuuguagacuuaaaaauauguagcaccagaaucauaaaacugaaagugugauguguucucccugcuuucucucagacuagacugcaguuacguuccuguaagaagguucuaguggucagacagccugacuucagacugucacgggguuguugccauauaacugacguucagucauggguaagcaucacuguaucaugaugaugacaacauacuuggaaagaugguaaaacauuugguaguaaguuaggcuaaaauagcuauccacgauuuuccuuuauucuuuagaaaaagacauuuaaauuuuugauuuucuuacauuuacuguaaaauuuuuuucuuuaaguuuugccauaagugaaacucauuugugcuaaauuaauucuguuucuugcagugaugaauuugccuacuuuuugcuaaaucuuucuuuagaaccuuuggagacucuauuuugcaguucucugcaauaaguguuaauuaaucagaacaugcauuucacaggaggcauagcugcuggugagugguguggaggucuuacuccuuagcauguuuugaaagggguuuugugguccucugagaggucagguauuaugaaaauguaagaauuucauuguaacucuuggccaacuggaaaggucuaugcuaacaucauugaugguucuuuugcauagucaacgaauuaaacaaaaagucacauuaauuuucagcuccauuagagaugcaggaaucaaaaggauguuugccaaaugggaagggacuaaauugguaagagaaggaaaguuuaauuucaagcuucaaguaaauguuacaaaugaaauagcauaaaaaagcuucuacugaaaguguucuuucuaaauuugaguacggaggagacagggagaacugaaaaacaaauuguuagugugugaaaugaaacuugcuaggaacugaaucacuuuguucuggccacguguuucugaggccucaguuuaaagcugccuggcuagccuuuguuuauuaguaauuuugacaugguuauucugcuauggagaguuucuuguugcugugaccaaaaccuaagagaaguaacuugagggaagggggaguuauuuuggcucaugguuucagauggcacagucuaaugugaugagaaggcauggcagauggcaaggucugguucgugaccauaggagcuugcaauguggcuuauucacaucuugguugaucaggacaugguugcaagugacucuugaguauagucuccagaguccugucagaugugacccucauccccagccaugacaccugacccccaucccccaguucacaacuuacccagauagugccaacagcuggaccugaggaauucaaacaagugagccuuuguggcuguuuaacaugacagccucugguguuuacauuguugguggcuaagcagagguucgcucaccuuucuuccugacuuggcacugguugaagaggaugaaaccucuuuuuccuuguagauaggcgucuuagcuaggguuuccauugcugugaagagacaccaugaccaaggcaacucuuauaaaggacaacacuuaauuggggcugguauacagguuucuccuuuaggccaggagaaggccgauuuccagccagcuagggggagcgucucaaaguccacccuaacagugacacacuuccaccaacaaggcuacaucuaauagugcaacuccacggaacaagcauauucaaaccaccacagugaucaagggcaaacuuccugaauaguucauuuaagcacuucaaugaauuuucuaccaaccauauacaagcaucuuauuagugugugaagcaguuuauuuaagaacauucucagggucagagugaugaagauaggaaugcugugaggaacagggaucuuuggaaguaaacacuuauggacagcuagaagagcaugagaaaaucuucaucuucucugucauuuucuugguuuuauaucuacuguggcugggaugcaguuacagcaccaacacagcacaguaucuaaaggaauagguauuuggaaccccaggaugguagcucugaaaccacugagauuagguuuagcuccuugggaacucuagaggcaaagaugaaaaaaaacaggaaaccuguuuauaugaaacacacacacacacacacacacacacacacacacacacaaaauuuaaaaagggaaaggcuuccugcucauucugucugcauuucuguggggacuuaaucagacagugaaucauuaguuauccuuaaaaagaaacuuguacuaauacuguacuguauaguuuaaguuccauuucauauguaucaugguagauguguaguauauacuucuaguauucaacaggcugaaguaagaggaguccaugagcuugguaauaugggcaaaaggugagacuuuauuucaauucauuaggugauuaaaaagauuuaucucuaguggcucagucaucugcuccuuuucaagaaauaacauuguuuauguauauguucagauguauauauaagcuugggugccauuuuuuuuacuuaccuauaugugguaagguacacauauagaccuauagucagauaucauuacaccagccuuuucuugguauaguaauuucuuuuggucugcauccauacacuaaagaggucaaauacuacucagcuugcaaaaacagaggacauugugcauggugauggugggauggcuauagacuuuauuccuucugucuuguuaaacgacaucuugcuuucuauggaucuuugcuuuccuucuuuguggugcuagagauuuaaucaaaguucauggaaagucaggcaggagaugugcccugagaaguaucuguucugagucugggauccuagcacauuuauauauuuacaguaaauguucuucuaucuuguucaguuuuuuuuuuauuuuucauuucuuuuauucauuugaggcuauacuucuagguaguauacauggggaggggcaaaggauuauuuuauuaacacuuucuuuuuuuaaaucucuuuguuaauccuuguuaagccaguuuuacacagagaacuguaaucagaacuagaaaguugaauuuguguuauccuuggaauauuuuauuaaauucuacuucuugacucaauuuugaaagaacaaaaaccaaaggcaagccaaacccaaaugaaaaaaccaaaacuggaucaucuuuaguuucuuucaugcagccagcccuaacucagugauuugauuuccaaauggaaauauuuacauauauuuggguggaugccuuaugauuuaauuagcuucuggagacugauuagagaaugcaaagugauauuuaagugcuuauuauauuuuaauuauauuuuauaaagguuaauauauagguagcuccccacuaucaucaucauuuagaguuuguauacuaucuacauuuccaacgugcauuuauucauggaaaauagccaguccuguccucccagcuuuucuuuaaauuaaggcuguauuaucccuuacaugcugcuauuuucaacauauagcuaauauuuucuaucaguuuagcuucaccuuguuaaaagggugaagaaguuacuagcuuuagaaucacagaaagaagugcucuugaagguagaauagagugauagagucacccaagugucuaauaagucauuauuucuuuuuuagucuuacaaaaauggaugaauguucuaauuauauauuuucaugauuuaaaccuacaaauacaugaacacauaugucagaagaugacauaauaccagcaucuugaaggucuuugcucaguaauuguuaugcagguccaagauuccuuuugguaugcuagagauacagaaaugaacacaguagggacuauagucaucgcaagcuuuuauacucagacauugcuucucuuauggaagucguauguauacauuucauuaaugguaucuuaguaauuuuuauuuuauuuuuucuuuuaaauuuauuuauuuuuauuuuuuaaucuuuuuuacaguccagacuucauccccgcuccgguuugccacacccccuugaauaucccucaucucauaccucacccccagucuccaagaggaugacccuaccccaccaggcuuccccacucccugcgcccucaagucuuuugaggguuaggugccucuucucucacugaggcaagaccaggcaguucucugcuguauuugugucagcuaugugugugugucaggggcuucucaucagcugguguaugcugccugguugguggcucagugucugagaggucuugaggguccaggucaguugagacugcuguucuucucauagggccucccuccucaucuucuuccagauuuuccccaauuacaccacaggguucccaggcuuuuguucauugguuaggugcuaguaucugcaucugaaucuuucagcugcuuguuuguccucucagagggcagccaugcuaggcuccugucugcaagcauaccucagcaucagugagagugucagggcccugagccuccccuugugcuggaucccaauuugggcuuucucucauccuguucuccauuuuugucacuguaguuccuucagacaggaacaagguuagagcuuuugacugugggauggcaaccccuuccccacuugauguguuccuucacuggagguggacucuacagguuuccccuccacacuauagagugcuucaucuaagaucucucccuuugaguccuaagagucucucaacucccaggucucggguacauucuagaggguccacccacuuccuaccuccuaagguugucuguuccauucuuucugaagccucagagcuucaguccuguccccuaaucccaaccggaucauguuuccuccuuaguacuuuuuaaacuagcguugaauguugacaaucagagaugaacacaaguucuuucucaguagugguuuauagauaaaaauaugguauguaucaugggagagaaguugguuccuuuuggauauguuucacuggaugggggauuagaguuagacuaccuaccaaugauggcgaacuuagaaaaguaggacugaacagagacaauaaaggcacggagugggcugacuggaguaguggagcagggaagacuguuuuuuuuuuuuaugacuuuaauuuuaauuacauuucccuuucccuuuucucccuucaaaccuuucccuauaaccccuuuggucucuuucaaguacauggccucuuuuuaaaaauaauuguuauugcauacguauauauguauaugugcacacauagguauuccaaauauacccugcucauucucuauaauguuacuuaaaugcauguucuuagcugaacauuggcacugaaugaugaacugguguguucuucccuagggaacuauuuuuuccacucccacuguuccuuacuugcuuguagcgcuuuaugucugguugcggacgucuugugggcuuuucuuugucuccucugcaugucuauuguuuuuguauuugcucaguuuuuguuuaggcaguugugcuguugagacuuuauggguauagcuucugacauuauuagcagucacaaucccacagcaaacucccugaucaucugguucuuauaaucuuucuguccccuuguccauaauauucccagagccuuagguuuagcaguuguuuauaggugcauuuauugggacuaggcuucacaacuuugaauugauugguuguggguuuuguguaauagucucuguccauugcaaagagaaguuuccuugaugagcggugaagacugcucacgcaaguguuuagauuguuguuagagauuaugcuaacuuauuaaaguggugauuguuggcucucuuucaagauccaugacuugacuagcacugaauaguugcugugguuuccacugccuugcaugguugcccucuuguguguaucuuaaguccaaucagugagcuguugguugcuuccaaggucuuugugccucuagugccuccuuagaguuuugugccaugcaaccauugcugugguuuauaggcaucauggcuuggcaggacuguggguuguuucccuccuuugaaagcuuguguggcagcuucuguuuucgggaaagcucagcgaggcgacauucugguccucugagcccugcaucugcugaaugucaugucuucagcuaccucugagggcaagcaagggaaauagcaauaagcugcaugcuuuggaaaucucuuggacagcccugaccagaaaugcaaaagagggagucucaugucuggcuuuggguuuuuauuuugggugaucuuuggcucuuugagggaauguugucggccagauaagaaaaguucauuuaaacuguauauguauaccuauaugcagaauaauauaucuuauagguuguuuuacauaaauagucaauaauaugauuuauuguggcuuuuucagacauucuuauuauuauuuuauacuuccaccuuccuuuccugcguuucccucuuucugaggauaucacuuuuccuauuuccuugaucugauugcuugucuuccucuuugccuuucucccucuuuauggauuuaccucccuuccucacccuaaggacucccuuuucucuaugauggagguggugugagggaacaagaguagagguuugauguaaggccaguauuacuauucagaugugugagagguaagagaaagcuauaguuuuaaggaucuugauugucaguuaaagcuuuauagaaaguacuaguuauuuuuagaauuucauuguugggaacaguacuuguuaucugaauauguauuuuuguugauucuuaaguggguuuguggaacagagaucaauggcccugaagacacucagcauaggugggaacuggagaaggagagcaagcaugagaacaagcaaauguguggagugcuauuggguggaccaugagcauuuagcuuaggcuucaucauaagaguuuuaucuucagguacuugaagaccuggccccuagcaaugguucucagccuuccuaauucuguaacccuuuaauauucuucauguuguaacccucaacccuaccuccccaugggggcuagcucaugcaaugguuuggaggaaacuggaauguggaacuccuguuugccauaggcuucuaucauggucccacaauuauucauuguuacuucauaaauuuaauuugcuacuguuaugaauuauaauauaaauauuugaaguguaguauaccugauauaggaccccugugaaagggucauuccaguccgccaaugagauugagaaccucuguucagaggcuagacacuuugaugguuuugguuaaccuauguauauuccuuugauaauucacaguucuaauauaaguauucaauuggcauguuuuuauuaagaaccuagcauauauacaguuuuauguuggauuugauuggcucugccuagugacuuuuguucauuugggacaaccauuuaauaauuuacuuccugguguuuguauaggagcagcuauuuuagguauccuauugacugaagaugaguuuuuauuuuuaaaauauuuauuuguauuauuuuaaauuauaugucaggguaugugcacuugcgugucggugucugaggccagaggcauuugcucucccugucgugggaguuccauguugggaaccaaucucugguccuuuguaaaaccaguaaacacuauuaacugcuucgccaucugcccauccccugaagguuuuuaugaugcuuucuccuuugcuuuuguccuuaggaaguuuuuuauuauagcauuauaauaaugucagguaacugaguuuaauuuauaguuucuuuuugacucuuuuugucucuguuucagucucccacccuccucuuuuaucauuuuaagccaaaaucaaaagucagaucuccuugaggaauucaccuuuggcuacuuucccccaguguuagucuuucuuggccauaacaucuauccaagguucuucugaugugucggugucugaggccagaggccccccuuuuccuacgugucuucucugaagugucuucucuugcuucgugcuaccuacugguuuaauagaaagaaugaggagauaggcuguaguggauagaggggacggucaguucuggaaagggaauuguguaaaaggaaguagaggacuaaaggacagaagcagaguaaugaaacuuggaggcugaaguagguuaaaguguaagaccugagaguaguuccuggacugucuauagccaaagauuuuucuuuggugucaaguugguaaacucucucucucucuuuacuaaaauuagauguuuucuuuguuuauauuucaaauguugucaccuuuccuaguuucuccuccaaaaauccccuaucuucucuccccucuguaaacuuuuaauuaaguuauguauaaagcaguaaaaaacauaucaaaaugucuuaccauuuauuuucaauuagaagacuugccauuuuauuuauuagcacacuguucuguugcuagcacuugcucaccaucacuguucauacacaacacuguuuuuugaugucacaguccauaaguucucauuauuguuagucuagagagaucuucuggacaguggcucuuucuccaauagugauuccaauuuauucaguccgauguuuaauuucucugugauuuuagccuuuuaaagguuauggauagucuuuuuuuaguuuuuccaauaauuuauuauuuuuuaacaauaaaaaagauaagacaucagcaugaaucuuuuucauugaagauuuaacauaaagauaccauguacauuauguacaaugacucuugucaacuuuguccaaauuuugaauuuagcuucuucauuuuuuaaaucuauuuuugaaugucuuauuuuaauauaugugcuauuuugcacuuagaagauuaauuauccuuuuaaggcaauuuacuauccaaaacacauuaauuguguuuucuuuuaagaaucauggugacacauuuucaccugacaaagggagucggcagaaaauuagcuaaugaaauaguuguuccagacuaguacauaauuaagagcuuugcaaagcucccccaggaaaauaggaaauuagagaugguuuaauauauguaaucuaucaauugugcuucucaauaaauauauaaugguaaucauuuuuuucuuguaaaaauauuuaaagcaauaacaaaccauaguuuuagguauuuauuuuauuccaucuuauaccuaagaucccgcuuuacuggugguuucuuuuuuuuuuuuuuuuuuuugcuuguuuuauuuauuuauucuuuaauucucuucuuuucuuuuugggagacagaaucucucaacauagcccugacuguccuggcacucacuagguauaucaggcugaccucaaacucacagagauccaucugccucugccucccuauugugggauuaaguguauguuccaccuaugcuugguucugcauuccuuugugaugaacagcaguugccacuuaguaccugugugauugucuuguaugugguguauggauuuuucuuucauccauagauaguaaguuacugaaaaguuaucuaaauuggugcuucucaaacucccccaagucuauaagccucugggggucuucacauguaaauucuuguucaguauuuagcagauaggauacaaaaacuguauuucuaacaaacuuuugggugauaccaguacuuuggcaacauguuuaacaauuuaaacaguuuuauuucaggcauuuccauuuaauacagagugcauauugugugcaguguuauuuccucucccugugcacauuucuguucaaauauugauaaugcccuauaauuuauuguagcaucucaacuguuuuuuuuuuuugcagguuguaagauuuauuuauuuagcugcuuauuaauuagucaauuaaugaauuaauuauaccaacccuguuuucuuuuuucuuuuuuugguccucaauuuuuuuuuuuuguuuuuuauuauauuuuucuuuauuuacauuucagauguuauccccuuuccuaguuucccaucugaaaacccucaauuccucucccccuucccccugcucaccaacccacccacucccgcuuccuagcccuggaauuccccuauacugggcauagaaccuucacaggaccaagggucucuucucccauugaugaccaacuaggccauccucugcuacauaugcagcuagagccaugagucccaccaugugcuuucuuugguugguggauuagucccagggagcucuggggauacugguuacuugcucacuuuguguccuuuaaaugauuucccauggaucaaugcuauacuucuccauggacugacugaaucaacccauucaguggugggaccugaagaagcaccaccugagggaggagcuccuugaccagggaagcccgcauguguuccuucugcuguagauugauaaugaugcaggugcaaacuuucuuuaguucuucugguguucaaauccuuccuuaucugcaauuugcuucuuauccugccaacugaugaucauuacacuuuucuagauucuucacuuuguccuuaucauuaaucuugcuuugaaguuuucuuuuuuuuuccuauuuuuucuuuucuuuuguuucuuuuuucucauuucuuuucuuuucucucuuucucucuuucucuuucacuuucucccuuccucccuuccucccuuccucucuuuaucuaucuaucuaucuuucuaucuuucuuucuuucuuuucuuuucuuucuuucuuuucuuuucuuucuuucuuucuuucuuucuuucuuucuuucuuucuuccuuucucucucucucucuccuuucuuucucuccuuucucucuucucuucucuucucuucucuucucuucucuucucuucucuucucuucucuucuccucuccucuccucuccucuccucuccucuccucuccucuccucucccucucccucucccucucccucucccucucccucuccucuccucuccucuuucuuucuuucuuucuuucuuucuuucuuucuuucuucagggagucucaguacauccuuuacuguccuggaauuuagucuguagaucaggcuggccuugaacucacauagaccugccuguggcuguuuccccaguguugggauuaaauugucacuuuaauguugaaugcagagaccuccaaugaauccgugcaugauacuuugucacuucucaaguuuuguacuuuucagccucccagaccugggcucaguauccuucuugcuuaaucagccccugucauuagugguggugauacuguucuccuuuccuguacugugggaguaucauugaggaugcuguuugcaucagugucaaaagugacuucaaucugaggaacagcacagggugcuggagguacaccugugaguucuaacuuuuccaguagauuguuaucuuuagucauggaucuuucgccuucauauaucugaaugagcacacccagcugguugucagaguaaguagguuugugucugcuuggucugaaugauauuuuacgugaugaggacaggcaugauuucaccuuugguuuucauaccaauggaaaaaagagcgacguccaagagaaacaaauccuaaacauuuucagacuugucuucagagacugucuggauggacagcacuguaagcaauggcuucauuggggcuaaugcuugcauucagcuuuuguccauugaagaagucuugcaaagccucugaaucuuggggauuuuaguugaaccauaccagacaauauuguggauauggaucugacaucuagaaaguccuuuuccacaauaaccauagugccacagaacagguccaaaugcaguacuucaaaugcauaggagcuuggauaauguagauauagaaauggauucccuuauggagagaaucaguuucuacacuggccuggguacuguaggagagggcacacuuagcccagucacaagcagugugcagaugaugcauaccugucuccaucugacugaugcccauuuugcccugacauuuaagcucagcagugaaagucuucaccauccaagugggugucuucugcugucaauuugaccugaaaaauucuauccucaauagugaggccugauguuacccagugcauuucuuagggcuccgaccuucuugucuaguucacaagcaauaguagcaacagcuuuuucauugacuuuuaguacauggaaaccagaaaugguuuaaccuucuuuugaugccugcugcugcugaucucugaaguaagcuggcacugugaccauugacaucugucuucccaugauuggcuucuacaacuuccuuuauccuuauuagugcuauagcguaugcggucucuagguagaaacuuugguuaucaguuuuuauuguucuuagaccuugaggcuguuugcaucauucauuaccaugcagguucacugauucauacgucagacugaacaguuguaucaucagacccacaccugauuagacguucagcaacaaaaacugucuuguguucauagcaacucgaaucuuugcagaauuuccaaugaauaauuugguguuaguaaaagcaacauagcuugcugugauuagauuacaguugucauuggaaguucuuucuaguuuucaauguuggaaaacacucacauacuucaguagaggguacuaagguccuuagacaugauuacuuccauguaggcuugucuaugcuugugacaagaccacacauccccuugcuuucagggcaaucuaccuucauguucagugagcuuggccacaggguggauguuaguagcuugacuuuaaugccuguuuuuggaacaguauuccuguuauucauaggaaacauauaucucuuccuguuuccuauucuguagcauggagguucugggaccuguuuggcaucaagauucccaccucuuuagugucucucuuaauuucuuuuccauugcauuugagaaagaacuaucaguuggacaucauauuuggcacaacaugcaaauuuugaguugucaaugcugagugucagugcuggaaaggaugaguuaguguaguuaguguauugaucuaacacuugaaugauaaucugcuuucugaacuagugcugaguacuaaaccaagugcauugucaaguugagcagcccaggaguuugaguauccccaccgcuccaugacacacauauacagcucagcaaucacagaagucuucacacaucucaaggcuucuuccuuucuuccucccucccucccucccucccucccucccucccucccucccucccucccuuccucccuuccucccucccucccuuccucccuuagcccuuucuuccucccucaccuuccuucccuuccuccuucauggccacaacuuuagucccaggaccuuuucucuacauauaucauagcaucaucccauucauagguguaacucuguucugcuucacucuucacaucacaugcaggaccaucuuuuaaaauacaaaacuuuucuuaacauucaaacugcaagucaaguuacaguccuuggcaggcaaaaagacguuucucacaucucaccuaauuuccuuugacugaagauguauccuguuaucucauucucccaagauuuugugcuaaccuggcaucugcuucuugccuugggguauccaugcacuguugugucccaggcugggcuggaaggaaugaaguagguauguuaucaggguuucaguugguaggagugugggagaaauagccuucucuggagaugguuuucagugaaacagcucuccuuuuugggcauaacaaaggcuauauaaaccuugaggaguggguagggguuuugggggugaguauacauuauugacugacacugacaugcugggaaugcugcauuugaacgaagaggaaaucgagguagcuagcuggacauguccuuauagggagggaggagauuuaccuguaaucugaccaccaggcuacgugacuaccucgagggugguggagguguagaucauaaggcuuaagugcucuggggcggguagguccagagcaaggaggaagcagcccuccuccugccagucucaggaugagauucucaagguucaaauauauuccaaccucacucuugcuccagacugggcccccaagucacaaggcuuucuggccccacaauuuuguaccuucuacuaugaugcuuuuuauuaguaacuuguugugaccaaauaccugauacaaagcaauuuaagaaaagaaugguuuauuuuggcuuacaguuugaggacauacauguaacuguucacgguagggaaggcauugcagcaagagcaggaggcccacacacugaucauguuucaugagucaagaccagagucagaucuuucucuuuuuauucauuugaagaucccagccuauggaacagugcuacaguaggucuuucucagucuguuaaccuccucuagaaaagucccucagacauggucagagguuuacaguguuggauccugccaaguuaacagucuuggcauaauaaucaucauaucuaauuuuuucuggacaguucucauuuauuuugucauuucucaacuuugauaccaaguuuccuguauuuacuaaacugcuggaaaaggauuuggugccccuguuguagauauccuuacuuuuuuuuuuuuuuuuaaaucuagaacuucuuaacuugugugguuuuucugucuguucuggauagaaaguaaaccuucuggggcaagacucuauccugggcaugccugcuuuuguagagcauggcauguagauagauugacuguacaagagauugaaugugguggagggguuaaaacuuagguacuuagcuuugcuucaagaaguaucagcaacguuucugaggcuauaaaaacuuaauacuagguucauacaacauuuagcaaucacguuuuaaugauauacaaacagcaagugucaauaaaauaaaauuuguaauuuuguuuuaguaugcaggcaaugagccauauuaaauauguaggaggaaggaaaauaucuagaauaguaaucauaagauuaauaauaaauauuugaguggagauagaaagcuuuggaaauucugaauuucaauaucguuucucuuuagugguuucuguuuuagauuauaguaaaauuuauaaauauuacucauaaguauuuguauuauaauuuuuuaaaauguuacuuugcauuuuauagucaauucaccauuccagguauuauccguauuacaguuuacucugggaaaaaugaacuugcaccccaaauagacucugauuccaaaucucuccuauuuuuguuagaccacuuuguacugucuccaugcauugaguaugaaauaccuuuaugacauuuuugagagcacaguuugaaaacuccuuuaaagcauuuaauggcuaaaguccagaguagugccuacuacugagaacucaaaguaccuauguccacuauguuaccuacugccucuccaucuuugcagauacuagaagcagcuacuguccccuuaauguuucuuaggaucaugauuuugaguuaaauuuagagaaaaguugcuauuuuuuuuagguucuuccucaucacuuguuauaauuuuguuguuauguuuuuauaguguaaccugaaguauuuauaauuuuguuguuauguuuuuauaguguaacaugaaguauuuaucaugagaacagccaggaugauaaagugcaauucucaguguucacuuuacuugguugugucucauuguaccaaaaucuucauuuagggagcugaucaccuguauugauaguacugguggauaaaaaacaaagugugacuggcagaugugaaaugcuacuuaagcauagcugguaugucuagaaugucucugugcauagcuuggguugagagugagaggcagcagcgcuuugcugccagaauuugcagacuaugccacugugugcaggguguggcuugaccuuugcacucauuaagagaggcuccuaugacuuccacacguggcuugcuuacuccugaacuugacaaaaauauugcuuuggcaacuuagggagaauggcuucacacuugacauaugauaccuuuaaugcguaacuuagcaagaaucaugcuaauuuaguuuaguaaguugccccucugcaccaacauguccacugugcaugcuuuucuugccgcucauugacuguccauccccagcugugcaagauguggaauuaggccuggucucuccccaauacagaaguggucuccaguaaggauuuuugugcuguuuuaacaaguaucagaauaaucuuuuuuuucuucaaauggauucacauaggaaaacaaauucaacugauccauacucuuugaacacaaaaguuaaaggcauugugacccuaagguuuagcaaccauauuuaauuaagaugugaaagaauacuaaucagacuucuuguauauuuuacuauugaauggcagagcuuggacuugaacucaaauuagucauacaucaaaucucauaaacuucacauuacgcucuuuucauuuuaccagguguaaauucagaauauucucauaguauagugaggcuagcgguggauuauggcaacuaggucaaguugaagauaauugaacucauaucaguuauucuuugcaauuauauccacauauuuuacuauuuaccuguuuccauauugaaaagaccauuuggaaucucugcaaguauucuguguugggacugccuuguguuaacaguuuucuuguuggaagagucuggaguuauaaaaacagagaaauguaauguaaaucacauaaagguuccaguuguuuauuguauagauaaauccucauuuuuacacauaggcugugccuccauagugcucauaagaaaauguaccaugaaguugcuaauuuguaaauguuuugcaacaauacaguaacauaacaauuuauuuuucauaccacauuuuugaggcuuuguuuuucugccaguaaaauaccauuuuuuggcccauuaaaauguuagguguuuuagccaugcuagguuuccucuuuuagucuaauccauucugucucugucucuaucucuguuucucgcuuucuuauaaaagcacauuuaauugggccugacuuacaguuuccgagggucaguccauuacauuaccauuguggugggaaucauggcagcauguaggcagacacagugcuagagaaggagcugagaguucuacaucuugaucgaaggcagcuaggaacuugucucuucugcacuguguguaguguacacaugaggagcccucaaagccugccuccacagugacacacuucuuccaacaaggccacaugucuuacuaauugauuuucuucacuggaguuucuuccacacaagugggaggagagauccacaucuguccuacacaguagcugagcagugauuuuuaucccuaucuuaaagcagucauguggaguaugauugaggagagaugugugcuaauggcugaguuucuuuguuucagaggaguuaguugauuugcuuuuguuuccugaggauuuucaucaguaccuuuggaguucgcugacucagagcagugaacuggcuuuuugcucuccucauccugaacccugccuaaaugucuugcugugagcauuuuaaccauuggccuuauucagauacuuggcaggcugugguuguucaguuaaguccuucuuucuuuucuaucuguuuuaauugccccagggagcugcuauucgggagaauguuccuacucgauagcuugagaaguguuggaaauaauuucuuucuuagaguucugagucagucacccuuggaggaccaugaaggggacuguauuugaaguaaaggaauggaaauuauuaaggccuuauuuagagagaggccugguguuagugaacuuaaaagauccauuuauguucuugauuccuuauugucaguagcuuaccccaugauacuuuuaaggccguguucagauaauucagacuuauaugacacaugaagggcucaucaugaagguucucacagaguuuucuucugagaggggagucugagaaaugaaauuauagguuuuguuuauuuuuugacauuaauuuuuauuccacaucauugcuagaugucauugagauauguguuuuucugucuugaugaauuuagccaaaaguucuaaacagaucauguaaucucauaccuagucuuguaaagaaauuuugaacuucauauauucuguauucauuuuucacuccaaaggagacccuuucauaguuuaugaaauauauuuguugcucuugcugucuugccuuccuucucuugcucuauccucuuguuccuuccucccucucuccucacuccccucccccucucuccgcaugcucauggcuggccucuacuccucuacucucucugccuuuuuaucucuacuacccucucaacuccucucccuaugcccugaauaaacucuuauucuauaauaauaauaauaauaaaaagauauuuguuuaguuuuugaucauauaucgaaaccacugucuauguaguguguucugauaucauuuuuucuuuuguccucaguagcagaguugagaauuguuaucauuaaguagaauugcuauuggccauugugcaaguacauuucuugaccuuugucaguauacuuagcucauccuuauacuugcaggauucuauccauaucuugucacaguuugugucuaugcauguaaugcuuucaggguuuaucaucagccaaaguagaacaauuucaucucaacacucaagaaagucuucugaacagaaucucaggagucaacauccagggaaggcagcuccagcuacaagcuauaauuagacuaugaagaaguuauuuucaagcuccuuuuggaagacuguguuacaagaucaaguagaucgugcuggauuaugugaaucccgugcauuguuguugaugccgaaagacuugagugcauguguacuccugugucuuuucuuuugcccuuuaaaaaccgugaaguauaucaaagugauuuuuuauuuuuuuauuuuugaguuacagauuuguucaucucuaaugguguaauuuaguucuaaguuugguguuugaagagaaucagugggaaccugaguccuaaagugacucuucaggggcuggagagauggcuuagcaguuagacguacuucaugcucauguagaggacuggagucuguuccuauucuccaugucgggaggcucacaauggcccauaacuccagcucuaaauaauaugaugcuuccugguuucugaagccaucugcaguccuguguaacucccacauaguuacuaauacauaguacuuacagauaauuaaaaauaauaaaagccuaaaauauagugaggccuucaguaauaauuucaugccggcgaguuuguuuugagagcaugaucuugagaaguuauuccccccacuucccaccccccuaaaguuaaucuuguuuuguaguggacagccuuauuccaagucugggaaaggaguguagauuguucagaauuucugguguauaucuaccaaaucccuucagaauucugcuuuaaaauuggcaaauauuuuguuggcuagcauuggcuugugaaaauauaucguaugcuaggugugauggugugucuucuauaauccaagaaugugguaguggaggaaggaagaacaggaaagaggucaaaguuaucuuguccuacacagcaugauuaggccuucauauaucugugucacuuuucuuaaaaggaagggaaaggagcagugaccagaaaguuucccugaaucaucagcauucaaggggagagguaaacuuugagcguucuucccaugaaagcuggaugccaacuaguuuauuguuaugcuguugcuuuuggcgaaagguggcuugaugaagaaauacuaggcaaggacucugucuccuucuuaggggucuugaagauauugcuggugccuuguacaccuuuaauaauaacauuauucaggguugaagagcggccaguacaagaagguuaaugugugugcucuuaugagaagggugauuggcauuuuaaucagagucucugugcagaaccuuugugcaagugcccauuuuagcuuuucacauuuucuuacucagagacucagcaccaaugcauaggggagagcuccaccuacugaagaccccuuucagaaugcucccuucuguugaugcuggugauuuccuuuugcacaguucauugaauuuuucuucugauuuauaagcuccaaugaagauuauguugaaacuaguaauuugaucauuucaaacaccaauuccuugucauuugcugagugcuuaaaaucaaaggaguuaucggggagucuuccuaauucagucuaacaaauaaugguguuuuguuguguucuauguauauggaaaagacuuguugggaauaguuguagauguuuuguccacggucauccuuaucuuaacuuucuaauauauagucacauuuccaugucguaagagagauauugagugguaagcuuaagcuugauucucagucuucccaccuuggcuggcucuaggguauuguacaagggagccaaacgacuuuucccugggaagaugggucuuugcuuacuacauuuugggcaugguuggcaagggucauagaaucuuugaagaguuuuaagugggagaucaucccuuuuggugcccaagacuucagcugucagucccuucagagacugccaaaccuagaguggagcacauugcucugauuugguuuguuugcauuaacugaauaacaagggacuagaaaagcagguuaucucagacaaaugcuguugugugaacuuuuccugaagagacgaauaaauaucuauucaugccagauuuggcaccaaugacagaccaaagaaacaaguuuauucaaaucuagcuugcagaaacaaugagcauaauuagacucacaguagcaugggugagguguuacuuauacgaacauuaacaauuuaaaacggcuuuaccucagucucuggaagcaaacuuuaacuggcuguguguuguuagugaaggacagggccuugugaacucccuuccucuucuguuaguauguccagugucauacaagucuuguguggauaauuacuggugagaauucaagagagcauuggacaugucaugcucaaaggacaguguuuuuuaauacuguccaacuaugaaaggccauagcuauacaagauggugggaaauacauauaagcaagauccaaaaaucacagacccucacaguaaaggcaugcuuuaauacauuauucaaaaaaaucuuaaaaauuaaaaauaaaaacaaaagggaaagacagacuacagacuaucaguauauauuugcaucucuuguaaguaacugacgauuaauaaccaaaucuugaaagaugucauauaaaucaaugacagaaagacaaaggacucuuuauaaaacagguaaaggguaugacuaggcaguucacauaggaagaagauugaauggccaauuaugaaaguuguucauccucaguaacagggaaaugaaaaucuaaaccccggugagauuccauuuuacaccuauugauuggcauagcccaauaagcuugauaacaccaaguguuggcaaggauaggaagaaacaggaacucuugcauauugcuguugggaauaaauuacuaaaaccuuuguagcaagcauucuagaacuuucuggugaaguugaagaugcacagauucauaaacugagcuauuuucuuuuauguguuaaccuagaaaauugucacauugguggaaacaagaagaaaauguguaagggugguuaguauaacauuuuuuuguauagaaaagaaauagaggaauuggcaagggggauguaauuuucaaccaaacaguggaaaaauuaaaaacaaaauuuccacaugguuaaaucucagaaaaaugaugccacauaaauaaagagaguuguaaaagcauguaugguaugugugacauaaucuaauauguuggauauaaaguuguauugaaauguaguucuuauacaguuugcuacuucaaaguguaaaauccaauggcuuuuuacuauauuucacaaaauuguaucucugucagagaucuauuguuacuuuuugauguguuagggauugaacucauggucuuaugcauuugaagcaagugcuguaccagugagcuccauucccacaauuaucuauuuuggaccuuuccuuuaacugaagacagguguaauucggucuuugugauggccuucuucuagucacauaauguuuucagggugcauuaguguuacaguauauacaccaggggcuauuuuuccauuuguagagauuuagauacaucuaccacuuuguauuuauccauuaaucuguggugaauuuugaguuguuuucucaaaauuuaguugaagaaucauuaaugcagacaaaauauaagaguuuucaacaaugucaaauguugaaauguugaggagaagauauuuuccuauuauaucuaagaauuaaacuguauugauaagaaagagaucguuagucgucuaaguuugauuuuuaaaguuagguuccaauucaaauuguagaacaugugcaucaaauagauggccugugcacgaaaucaaagcguuuuuuuuagaguguuuucagugagcugguaaagagaagcagugcauuagguugaaaugagguaugggcccaagaacauugccuaguguauccagugugcuacggcacuugacuaucauccauaaauacuauuuguauuucaaaguggaacaccacggcaacccagcugugauuuauaacuuagagcagugacuuucuuauucauguuuuugaguguucuuuguuuaaaccaucauagaauuuccauacauggcugcuucuccuucuaguucuuaugauccuuugcauggaggaaaaauaguguauucacuguuguucuacuggcaagugaguacuuugcauacaguacaugcauaaauaauauucuuaauuaaaaaaagaaacuguucagcaggcagguucuuugugagggugcaaacaauaaagaacauggaaagauuaaguauaguaguaggcucaguguccccaaaacuaccuaacuaaucaauaaacgcaagccauuuccucauaguucccuuccuacaaguauaugagaacggucaauuagaaggcguuucaguagacucaaggauugcagaaaacagacaacucuacaguuuugaaagaaggaaagauaacucuuuucuugcagggaggguuaugaggugauguuggaguagaggggaacugaagagauguguguugagggucuucauauuguaaugaggcugagaacaaagaagggaaggaggagguagcggaagcaugagggugaggccccacugaugauacaaauagcaguuguggcauuaaagggaaggugauaacgaacauuuggaaauccugugggugggugaaugaaugcagaaacaaaaggcugaugguucagcaguauacaaggguuucuuaauuuaggugacaaggguguugaggucuuucgugaauuuuuugcuuuggauguuguuauugaagaagagcauauggaauucauacucuuaaggaaggaaccacuaaggaacacagagccacuaaggaaugauuugauggacucauuacuaguuucuuuaauugauuugaacaguucucaaguagauaaauaguuuuuaauagcuuccauagaggaaaaaccuggcuaaaauucccaaguaauauagauagaucccuuccuaguuuaaagagcugacuaaucacuagaccaucuaauguuggggucuacucuuuuaagagagggaugggguuucuagucaguggaaguacucaaagaagaggcuacaauguggaggcccacguaucuaaaugccuuuuuuaauguucaagguguuccaaagcuuauaaucagagcauugauggagaaagaccaucuaguuuguaaugagaguggaguaauuauagugacuagaugagccuagauaguuuacacaucauuuguaaccagaaaagagcugagcauuuuagagaauuaggggaugauuuaccccagacucugugcugucuccaucuuuucgcacauaggcuaacacucaggucuugucuguacuaucucucauguauuggccugauucucagccagcccaccuccucaguaucacuaggugucauguauuuuuacucacauaagauuuuauuaagagcgaauuaauauaauugguguuuugaaauaaaaagaauucuaaauucauuugcagugaagugugugaaacaaaacauucauucauccccccccccgcccuuuuuuuuuuucgguuuuucgagacaggguuucucugugcaguccuggauguccuggaacucacuuuguagaccaggcuggccucgaacucagaaauccaccugccucugccuccagagugcugggauuaaaggcaugugccaccacgcccagcccccccccuuuuuuuaaauuaauuuuuuugaaucauuaaucauuagaagaauuuuguguaguaaguacuggcucuacucugaaaaaguaaaaaaauuuucucauuuuuuugaagguuugcuguuuuuuuuuuuuaaauuagguauuuccucauuuacauuuccaaugcuaucccaaaagucccccauaccucuccccacccacucucacuucuuggcccuggcauuccccuguacugaggcauauaaaguuugcaagaccaaugguccucucuuuccacugauggccgacuaggucaucuucugauucauaugcagcuagagacacgaucucuggggggguacugguuaguucauaauguuguuccaccuguuguuccaccuauaggguugcagagcccuuuagcuccuuggauacuuucucuagcuccuccacugggggcccugugauucuugcugaacuguaauuuuuuuguaacuuucauccagucaaccuacauugccacuuuauccuccuggaaaauuuccaagcuuuccucauccuuugcagaguaugucaccagacacaucaggauauuuuagauaaagggcagcauuguauauuuuguucuuucuuggaucaauacuuaaaauacuuaguucauagacuguaaucuuacaugguuuuguacauaaaugccugagaauuuaguauugaucacuauagcuucucuuuccucaucuauuugagaaaggaguagagcuauagcuugguucauaauauuauucagugucuuauuuuucaguuucugugaagcgauacaacaaccaaggcaucuucugaaaggaagcauuuaauuuggguuuguuuacaguuucagagugaaagucugugacccucauggcagggaguaugacagcaggcaggcaaguuugauacuggaguaguaccuaagagcuuacauuugauccauaagcaugaagcagaaguaucugucuaucugucucuaucuaucuaucuaucuaucuaucuaucuaucuaucuaucuaucuaucuaucuaucuaucucucaucuauauaucauacacuucuacagcaguguucauugaaggaagucaggacaugaacuuauauaggguagaauccuugaggcaggccccgaugcagagggugugaaggggugcugcuuacuggcuugcuccccuuggcuuaaccagccuacuucuuuauagaacccaggaccaccagcccagagaugguacuguucacagugugcugcugagcccuccucaauugaucacuaauugagaaaaugccuuauagcuagaucucauggacauauuuccucaacugaaguuccuuacucucugaugacucuagcuugugucaagcugacacaaaccagccauugucugccugccuaucucucauacuaacugggaaugguuugggcuuuugaagccugaaagacuccagugucauccuccucuaacaccuccuaauucuuuccaaaauuucaccaacugugaccaaguacucacauacaugaaccuuucagggccauucucauucaaaacagcauuguuuacuuagcuguuuauuaguuuuagagaguacuaaauauuugcucucagaauuaccuucauucuauacuucuaagguauuguugauuuaaaagcauaaucauaaaaacuaaugugucaggaccuaccagacugucuaaaaugugucuagguugaugaaaucggccuaaggaacaaaagggugauuacauuuaauaucuuggauuuagggcaaggccacagucuuaaauggacuaugacagacucucagguuuaaacauuuuccaauuuauaggacuuauuucaugggguucuguggcgccccuucuauggauucuuuauuuuucuuuguuucugcuuucugucaauaccuauggaaauuuuaggauuauuguaguguauaauauugauuaaggauacaaucuuacuuaauucuuuaggaagagagauuuuuauaauagaucagguauuuugcaaugaacucuuugcuuguacugagauagcaucucuuguaccuucagguagcucucuacugcuguguaaccaggaucauagguaugugcaccugguuguaaaaaccuaauguagcauauagaauuagauaaagaccuuauauauaacaugcuuuuagaauuucaaaaugaaaaaguaguuggagaauuaugguaauauauuagauggaugacauauuauaacuuaaggcaaaagucaucuguguauuuagaagucagaaaauggcucaauauaaccuccuguaaaucaauuucagaaauauugcacagcuguggaaaugacagcugcuucugagcaacauucaucuuugaaggaggugguguguaguagagugaguacagguggaagccgauggugcaagaagagagcagggugguuucccuuuguugcuacaccagugagacguccaggaaaauugguggcuuuggacugauggugccggugcaccucugcugaccccccuugcaggacuggaagaaugucagggauagcaaagaaggcucacgacauggaacauuugaaauggucuucauuguuuguuauugaaaaaggaauucauaacuaaacuggggaaucaacauugaaaauguuuacuaccugacuguuuuuguuucucugugaagcaaauuucaagggaauaaaauaaaaauagaacaaaaccgaaagacagucuacauuuuaaccauauucugguuuaacugguauuguuguagauggcaggucccaaaggaguuauggagggagaggauuggaauggcuguauaguuuguuuuauggacaguguauuaaauucugguuauaagaacuuacccacgggcuggagagauggcuuggugagagguccugaguucagcucccaguaacuacaugguggcucacaaccauuuguaauguugucuggugcccucuucugguaugucugaagacagcaacaguauauucacauacauuaaauaaauaaauaaauaaaucuuuuuuuuuuuuuuuuuaagagcuuacucacaucauggaucuuaccguguucaccuccaaaccucccaauucaauguauuuugacuuuuauacuguuguaagauacuuuucugagaaacucugaguucucaacucugacuuuaaaaacauguuuuguuccccccuccuuuaacacuauuucauauuccauuuugcuguuggaaauagaugguaagugguaaugcugcauaguccuccccccaccccccaccuccgccuucuaugagagcagagcuccuuugggaaaguugagaaacuuuucagcaucaguuaucuuauguguauccuucuuauaggguuguuguaugacuugaaugauuuaggauguaaaaguucaugguugcugugcagugguggcgcacaccuuuaaucccagaacuuaggaggcagaggcaggcggauuucugaguucgaggccagccuggucugcagagugaguuccaggacagccacggcuacacagagaaaccgucucgaaaaacaaaacaaaacaaaaacaacaaaaaaaguucaugguugagggcaaaaccuuaauauuguaguagauuucuuuuauaaaugccuaauuuauaguggucggcuuuuguuaucuuauaaguagguaggcaugaccccucuuucucuuucuuucuuacaacaaaguuacgguagcccaagcaggccacaaauacacuauguggaugacauugaucuccugguccuccuagccccacuucuaagguuugagcuacaggcaugucccauaacauccagcuuuugauaguaucuuucugucuauaguucaugaaagaaaugauaggugcuuuuucucaaacuggguuagaaauuuggauuuaguguaugaaauauaccuuugaugauuuuauuacuaaaaaaucccucaaagccaaguacacuaggguauaacuuuaucccauggaauguaacagagaaagcuuauuguagacugagucuuacaucugcagaaggaaggaagcaugcauauacacacugagagagagggugagagauagagagagugacaaagaccgagagggacagaaagagagaaugaguacaaguguaaggaugagagagagcccaggagaguacuuucuccuggaggccugucugcuuccacuuccugcuugcucuuccugguucuggccacaguucugacuuugauuuguauaguguacagcuguguaucuguagaacaauggccuuuuuuguuguuuaagcuauuuuaaguuguuucuauuacuuucaaauggagaacugaaaugaaaaucaauggauaugguacuuugcauuuuuuaaaaucccuaaauacccauuaauuuacccucuaaugucuacuacuuuuuuuaaagggcaauuauaucuuuucuuuauugaacagucagugaguauuuuuucaggaugcuuuugagaugcugagaugaagaagucugauccuuguccccgagccguuucaucuuuauucagagaaaaguacaggugaaugccuaccucugaugugagggcaacagaugcgagaggaagucugcacacagugguuagaucuguaagguauucaugaucauucaggucuuugcuuucuuuuguccuugacuauuguuagguccucacauguuuuuugaccuaguaccuuugcuucugacauugcaaauaggccaggcaguuggacccgaggugguugccgagaauugaaauaauacaaguaaauuugaaacgagcaaacaagcugaaugguuauagcacauacuguuaauuccaguacucaggacacagagguagguggaucucugugaguuugaagccaaccuggucuacaaggcaaguuccaggacagcuagggcuaggccuguuauacagagaaacccugucuugaaaaaaaaaaaaaaacaaaacaaaaccaaaccaagcaauacaacaacaacaacccccccccaaaaccuaaaacaaaaugccagagauucguauuuuuuuuaaaauaaacuuggccagcaaggcaucuuuagauccuuaccugugcaugaucugaaugcucguguccacguuuaaccuuagaggaaguuuguguuguuucugugucuugugucauguauagaaagggcacuuauauguuucuguagagcuugguaugguguggcgggaggggugcuccggugggccuacacugaggcauuccuucccccugagauaccagcuauaggauggcuauaguauagaauagaguuuauuuagggcaugggaaggggaguugagaagggaauagagagggagaaagaggggcagggcagcuaguaacaaguagagagaggggagaggggaaagaggaagaaaggaggcagggagaaaagagaaucagagacagagaaggggcagagagagcgaagagacacuaaacaguuccuuuuguugccagguaacuauugggcagaggcuaaaagaaugguaacaguccuugcauuauauaaugaaaaugauguccucccauagguaugcucuguuuccuauacugugcaugauguaguggaauggugcuuagauggaaaccagccacauauguuuaacuggagaggacuaaucccagaaccacauuuuuuuaaaccuggagguuauguagguuacugguucuacgggcuugugcaucucuucacagugaccuaguucagaaugacaguuaccucuuagagagcugauggcaaugggcauugguagaaaaucccuugaggacuuauggaacaauuaaacuuuuuuccugggaaucucauucuuuuuaauaauagaaaaaaaaauuguuagaauuuuuggaaaaauauguaaagaucuguguuacugcuaagaaaauguaggacauauucuauuuuguaaugagcacagggaaacagucucauuugaggaagugaaggagucacccaaagauaggccaaaugauuuuguuuuguagcuguccuuuagauauuaacuuuaaaaaccucacaauauggugaaacuaauauuggcuuagcuguuggauuguauuacacccuaccugaagguacuagcuuuccccucacguauuucugcauauuugguguuuguugggucuaaguuaucaacagaaacacguaugaacauuuuuaaggcagcccauuucagguuauaaauucauugauguaccuaugggauugcauuuaucacucuguguccugcuucuagugcuguccacggcuguacgagguacuuggcugugcgagguacuuggcugugcgagguacuuagcaguuguugagugaaugaauaacuuauucauagacucgucucuccuuccagcuuuucugagaaaucgugcuggacaugcucucaguaacauuauuuguaggcuuucagagacauuuagauuagacauaaauuucugcaguauaagauauggccagaugaugaugaugaugaugacaacaacaauaacaaaaacaauaagauacauuucaauuggaccaagucuaaacaggaaaggaagucaguuguuguggcuuucauuuccaagcuucaaugcaugacacauaagauugccaggauucuuguaguaccuaggauaguuuguaauaccuaggauggugaacacacagacauuaaaggaguuugcaaggauuccaucuaaguccguggugucaguuguccacagagggagaaaugguauuuucuuaaagcuugagcacaggagcgcgagacauuguccugguguucuguugaguaagguauaucaguuaugggacuguauaugcagagagcacaaugaagacauugagccaaguagccaugaaagcuucaggggccuugggaagauggcagagaguuacagaagaaaagauggaggcauugggagcuggggugaauugucagcucccuccucccacggcuuugucucucuuguucuagacgccuuuggcauuggguaugucacuggcaccucgugccugccuugauagaagcaguguccauagaauucagccuugcauauggcagucucuagaugguccauucuuucgucacagcuccaaacuuugucucuguaacuccuuccaugggugggauccaccccauaaucagcuuccaaacgcugacaccauuucauacacuagcaagauuuugcugaaagaacccagauguagcugucucuugugagacuaugccggggccgagcaaacacagaaguggaugcucacagucagcuauuggauggaucacagagcucccaauggaggagcuagagaaaguacccaaggagcuaaagggaucugcaacccuauagguggaacaacauuaugaacuaaccaguauccuggagcucuugauucuagccgcacauguaucaaaaaauggccuagucggccaucacugcaaagagaggcccacugaacacacaaacuuuauaugccccaguacaggggaacgccagggccaaaaaaugggaauggguggguagggaaguggggggggaggguaugggggacuuuugggagagcauuggaaauguaauugaggaaaauacguaauaaaaaauauuaaaaaaaaaaaaaagaauucagccuugcaagcugcaugcuaaccuuuguuaagcugacaucacucccuaguuggggguuaugucacucagcccucaguuagagcgcuaguuaugccugcacauggcucugagucugucagggaaagaacaagauaaauauuuucuuauaaauaugaacggaauaguuaaacaauuauugucuagaaaccaagcugauaagcauauuauauugucugaggccugagaaauaagcaaauuaauuacaugcaaauaacuguugcgugugaagugugggauaauaauaguaucuaguuaaauguuuauggcaaguuuacuuacauggcacaguucugugcuaauuuuucuguggaaaauaauaacuauuguuuucuuuuuguuuuuuacuccuaaauguauugaaaacucauucuguuccuccaucuuuggcaugccaagaacaauuguaaagauuaugaaugacgaagaaaggauuucugcuguggaauuuuucugccuucagcacacaguugccaucauuaccacuauguaacccauggguucuuuuuaucuaagagucucacuuaguaguucauccucauagauuuucuuuugacuuuugcaugaacaucuucucaugucagcaucuugcugagccucauguagcuuucucucuuaagguaaaaacagacgagauacucacacagcuaccaugagggcugaugagcuaauguacucaguuuucagggauggccugacuuuugcugagugccugccuacccagagucagugguagguggcuuugcacucugcuguggaguucuuuuguugugucuauaugguacuggauguuauguuagagacagcgguuucuuuuuucuucuuugaaauauucaggucauucacuuggauuguaugccagaaacuucaaaagcuagggaccauuguaguugugaugggaaguaauuguuuuuauguacaacuuuguaagcuguguuuacucccugucacucuuccuccauagggugauauacuauuugauugaucagaauguugcuaggucucaggcacuuagcucaccucuaugcguuucaucaguaacccugacauuuacacaauaauuugcugaacauuauggaaugccagacaguaugauuaaucaucuuuugucaacaaagcaagaaguagaauggaaaugacuuuugcuuugauuuuugauguagccagaauuuuaaccuggaauuuaguaggaaaauaggauauuuguaucuuggacuuguuuguuucaucuuuucucaaacauggaaggauuuccuuaaaguugagcugucuaaccauagauagaccuucauaccuugucuccugagaucuuuuugccaguccucuucacugauugccauguggaacuuaguauucaggaugcuggcagucaaauauuucuuuaauguauuuucaaagggcaaguguaacuucuguuccauuguucuuccucuuauauaaguucccagguagagaaauuaugcuccuuucauauagaaguuccuagauagagaaauuauucuagcuauaaucauaauaauucugguuaagaggaguagaaaagucaguugguagauuuuucaggcgagaaucuauuuucuuauuauagaaaaaagaugggagacauaacuaccuaguguuuucauuauuugcuuucagucugugaugcuuucaagagucugagaaauaggguauuuaacuucucaacuuaugacugauaggaucaucguaaaagugcuccagucuaauggaagcuuaaaaugcaguccuuagaaguguuggauugcacuugacagugauuuguaugacuauggauuauuaaaccucagccuagagaauguccugauuuuaaaauucccuguuuuauucacuuggucugcugugaggagcagucaugcuuucuguugucuuaugugguagauuaaguucuaguuaaggccaacaaagcugagcuccaagggagccuuccuucuguggacuuucagacagaguuguccccgauuccuugcuuccuucgcucuugaccuuguucucuauggacaacuaagugcuguuguuucagcaggcauaagcaugagucuccaguugacaugugucccucugaaugugucccucagagaucagugacugcuauaugcaccauuuuauuauauuuaguaagugagcccucaucauuucuuaaaaaaaccuugugguuuaggcagcuuugaugaguuaugcacaaacuugguggucaaaaauuuacaggauuuauaaaucaggaaacuuugauuuucguaauuggggcuugaaaacuuguuuaacauaauuaucaaguuauuuaguuuuucuguaucaguauuugucuguguacuagucaguguucuauugcugugaagagacauccugaccaugacaacuguuauaaaagaaaguauuuaauugugggcuugcucacaguuuuagaggguuagucuguuaucaucauagugggagcauggggacaugggagcauuaaggcaggcacgguggugcagguugagagcuacaguuugaaucauacaucucucucucucucucucucucucucucucucucucucucucucacacacacacacacacacacacacacagacacacagacacacacacacacacagagaaacagagcgagauggagacagagagggagagggagaggcaggcaggccugucauaggcuuuugauaccucagagcccauucucauugauauauuuucucuaacaaggccacacuuauuccagaaaggccacaccuccuaaucuuuuaauuguuucagacaguuccacucccuggugacuaagcauucagauauaucagccuguggagccauucuugcucaaaccaccacaguauguuuuaugacuaugccacuugguguuuguuccacaaauacccacuguaacuugaauauauuuccuuguuuucuacaguguuuuuggacucaaugcuauuuugauaagauuacuugcagugauuauuauauaguccuucguuuuuguuuauccuuucaccuuuccugcuuucacguuacuguaugaacauuuugagauagcuaaaacuuaaauacuuuguguaaugaaucucaguuuaacugaagguguauugaugccccagaaaagcugaaggaucagggugaguacuaaccaagggagagaugacugcaggauaaauaucaagguuauuaauaguuggguuggaaagacugauaaaggagaagcggguaggauaaugacuuaauaaguacaauaguauugaaacaauggagucuuaggcuauuagggaaagaauugacagaaacauggcuuuuuauguugugugauaaucaauuuuaaugauguuuuccuuggaccuaaaauaaugaaccaaguauaaaacuucuuugcaauaaugguuugaacauuauuuaaaauauuucuuuaggaaauuaucagccuuccauuuguuuaugaaauuuccuuccuuccuuuuguuaguuaauuuauuuuauugaguauuagaaccaacauuuuuguauaauuuuaaauaauuugaaauuuuaaaaaguuaagauacaauuuaccuuuaguaaaauaucauuuuagaagauaguauuaguuucuuuuaauauuuuaauauucucucaauuaucaacacuuucuaaaacuggaauguguuugucauucagaaaggaaguuggucaucaacugucaaucaccaucaccagugucuccuuuuccuuuuucucaaccuuugguaaccaccaacuucccuuugacuccauauaucuauuuuuuucucuauacucucuauaaaugagauuguucauuacauugccuuuguguauuggucuauuauacaguguaaaguuuuuaagggucauuuguguaauagccuaccuaucucaguuccaguauucuuacuguuucuuauauuuuuaauuuuauuaauucuuugaagauuccauguaaugcauuuugauugucaucauccccuccacucaccucuccacauuccuuaaccauccaaauugguuuaauaccuuuuugacuuuuuaaacaguugguuauaguugguucugcacauauacucuuguguauguggacuucacuggaauguaaucacccauuuggucauguaccauuuaagaaaaacaccucacuuuuuauuagcuauuaacugccaacauuuuuuugucgguggugagacuuuaugcuuaccucccuucuucaugcuggauuugucuggccugagccagcucaggucuuguuugugcuagcucaauugcugagaauucauuggugcaacuucucugugguguuugaaagccacuguuuucuugcagucauccacauuaugggucuugugauccuuccauaccuuuuucugccacaaccccugagccuuaggauuagcacaugugaucuagaugcaccuucagcauggagcagucucaguuccucauucucugcccuuagaucacgugugggucuccguguucauuaccaucugcugcaaagggaaacuuucucugcugagaguuggcucuugcauccauuuauggguuuagcaauaagucaguggaagcuggcucaacacuauccauuuagcagagugauaguaguagcuucccuucuagggacugugacauggcuagccacauguucuuggccuuaacuucaauuggaaaauggagaguacuccaguggcauucuggcuacuguuguaccagugggccuguccugucaggccagucauuguagugacagggcucacagcuagguaagauugucgauucauuuuauccucuuguacuguacacagcaccuucucgcacuaugaacucucgccagugggggugaagcuucccacucagcaccagcuugaauucccucguucugucacuccagcaaacaguguuuucagcagugugggcuuacugacacauugugaaggauaaccaaaagcauuggcuagagccuauaauauugugugggauggguguauugaugggacuucacuugccaacaacgccaaaggaaguaacccuucauugcauuggcuuuuuaauuuggcaucuugugaugucuaauagaugcuuuguugcccugauaaaggguaauuccauucaaacuguuuuuauauguguguuuaauuuauucuuuuauuuacacauuuaccuaucuacuuaguguauguacacaguaaaugacaugugugucauagcacaugaggugagaggacuacuuggaggaaauggcuccuuccuucagcucuggguuauggggccaaagucagguuggcagcuuuguuggugagugccuuuaucuacugagccaucccauggaacuuugcauuuaacuuuuugaagaaacuaccuguuucuuaaguuagcccuacuauuuuauauucuuuccauuuuguucauauuauuugaaaucugaaagacauauuacagaaaaaugauuuuuuaaaccagucuccuuggaccucaugcaugguagauugaauuauuaugugaagcucuggaaagucaugggauuuuagagcuaaagaguugugacaaguccgucuuucuagucuugugcauuuuguuugcuguauuugcucugucuagugcggugcuguaaauaguaggugcuuaguacauguuucucaauuagugaauccaguuacucugccauaccuccuccauaaagggaaauagugccuagagaagugaggugacguccuaacagucauucagaggcuaaagggccacgcagucuaccauucucuucccccugucuuugccuuuagucaguguuagcucccgguucuuccugaccccuuggucuuugaugaccugguacaaggcugcaugauuguuuucuagcuguguuuugaggccuuauugacauuuaaugaguggucuuguucucaugaagucauuugcauguuuacugcugaguccagaaacauaaaaagcgagaaacauuuaaauaacugcauuuuaucuaagaaagauaaauuacaguuaaccaucaauauauagauaacuuucagagcugccaagauuauuagacuguagaacacaaaaaauuugugccuucccuugugagucacuucucuuaaaaaaaaaaaaaaagacaaaccaacaacaaaaacaacaaaaaacccccaaaaaaccucucaacuaaugaucugaaagaaagacagguuaauccaagccuguucuuuacuaguauuuguuccuaaucaccccauggacacaguaaucuaucuuuucagccuuucccccucauucucucuuccagaguaacauauguguaaauuaacuguagcacagugcaaguaucacccugugugggagaaguggucuuugaaccacauuuguauguuaaguggagguucgugcuagaacgauauauuauagacuggauguucagugaaguuaagauuucacuguguagaagcugugcuagaaauuuggagccuuggcguacaaugaacauauauuucaguuacuuuuuaugaagauuuaugagauauggaaagaaauaggcauuccaguuucuuuaguuaaaauucauuuugaagguauguagaguucccaauuuuuuaggugacuuuuaacuagucaguaauacugauaucaaaguaacagucuuuaaaguucccuaaauucugguuauacuuuuuccaaauuugugggaugcauccaaaagaggaucauaaaucuauuuauauuauaauuguauucuuaaucuauuccauucauguuguauguggguugacuguggguugacugugggagaauauaaaagaauuauuugcuuuucuuauugugugaaauggggcaucguuguacagacagcaugguguuauaaugaaaacaaauucccaugggcuuuuauauagauuuacauucaaauucugcccguguauuuacuuguuuaagucuuagaucuuuaucaaggugcaguccccuauuuguacaaugugaguaacaauuauuucuacuuuuuggcagauuuggugagaugauauaugggacacauaguggauauuuaguaguugguagugaacugugaggucuaaggcucauuugauuucauauauauauauauauacauaaauauauauguuuauauauguguauauauuuauauuuguuuugaagaguauauaacugguuauaugguugacaaguuaacucuuaaaugugaauagucagaacauuuaaacuuuauauuauauguuuauuuguagcugccguaaaucuccuuguuaagugauuucugugcucuucugguuucugcuaaugacacuacuauagcuuacauuauccaaauuggaacccuugacacaauguuucuucucaucuauuuguaauucuucugucuagugguuguucguaugcaaaacuuauauugcauaaaauauugugcuguuuuaaagcagacaguuuaggaaauacauagaaccaaacaguagauuauauaguuauucugaucacucugauuuuguaauuaguuguccuuuguuuucaugacuuuaacaugaucauaauuuacaaucauuuuucuuacuuaauuucuauuuucuagugguguuauaaugggcaaauuuauacagacauuuucccccaucccuguugguguagugacgauagaauuccuuagaauaucauuagugucaggcugugaguguaagccaguagacaccccuguagugcugugucugagacuguaguauauucagcacaugcuuauuuucuaacucagguccauaucucucuuuuauuuuccauggagccuuaugaguccuuguuccuuacuuuggguuuggacaugugccuuuccaugaccaaugacauguuaacagauuugcugcagcagaagcuagaaguguguuuaugcuauggccuugugcuuuguacuucuaucaguuguccugagugagcaugcucguaaauaguugcuaauugauggagaugagugaccagugcuggagcugaccuguagcuuuuuaccaaguacagcugagccugcccugcagcugaauucuagacaaccagauuguuguuguauucugcccagcauaggguaguuuauacucacuaauguuguggcuguagcuaagggauacaggaugauggugguguaaagguuguucccuggguccugauuuuggagcauugucuuuccauguaaaaucaaggucuuuacuguuucaaagcaccaaugcaucacaaaaccagcaucaaaauaggcccuauugagaacggaaaucucucacaagggaugagaacaguacagauuuggaagaggguuuuggucuucauuagcugauuccccaagccugucacuggcaauuguuauaggagauuaugguagugcuucccucccccuuggauaaaauaguuauauuuucuuagugguaacaagggaagugaauccacacagccucaauuaugaaaagagccuauuaaaauuccauuuuguuuuuuuuagaaguaaacauauaaaggaagcuggaggaggccaagcaccuuuuuaaaaauaaugauugucuugggcuaauucuuucacugugccuucagcaucauuagcugccaauccuacuguguggucucauucgcaaucaaaacugauuggaaaggaaaggccagggugccagagacuucccuaaagcaaagaacucagaaaccuggccaucgcuuaaacugcuuacccucagcaguacuuccauuuacuuuucuuucagcuggggugggguauuguucagcggguauuguaauacauauuucagaagagaauacuggaaaaagaaaaggauacuuugugcaagcucggccuguucucagcauaucucuuucuugcccauuuccuugugaucuuucccuuugcucugagcuccccccucuggcauucaugguauauuuccucuucuguaauugcaaauugcaaagcuucccucccaaaucauuuugcaaaugcuuuagauuguacaaugacugcaggggcaguuugcuagagagggaggcagaggaacaaccugcaacauuuacuuagagucacuacagaauaaaauaaacaaaacaaaacaaaacacuucaaaccaaaaacaaaacaaaacaaaacagaaaaacaauguaccauugauguugcuucaaagauccagcuuguuagaaccauuuuccuucccuccugugccaggucucuugugagaucauggacagauccaucuggcucuuugccauugcagucaaucuuuaucauuauccugauaugucaugcugucuuucucucugucucucacugucucacugucucuguuugcgugagacuuauuuugaguaaauuccuauguuguauuuucuuuaaaagaugauugguaaugcccaguucuuuucaauuaaaauacuguuuuagauucacauuuucagcuuaucucagauuuccacaagagagaauuuuaucuuuuaagcauaaacauuagaacacaaguucugauggaaaauuguaucaugugcauuuaucuuguucagucuuuuuguugcaauauaccgagaaccuucagauuuuucuauuuuauuauauauuauuuuauuuaacuuuuuuuccccgcacaauauauucuuuuucguuugcuuauguuuugagucaggguuuuccucuguggcccuggcucuucuggaccuaacucuguagaucuggcuggucuguaaaucagaaugaucuaccugucucugcaucugagggauuaaaggcaugugccaucacugccuggacauacaauaaauucagauuucuucucccucagauuuugcccacugucuuuccauccaaauguacaacuucuuucuuucuguuuagaaaaaaaaaaggcaaaauaugaaaaggcaaucaaacuaaaauaaaaaacaaacacagaaauacaaaacccagaaaccaagagagaugcagacacacaugcacacacauuugcgcagcacacacaaacaccaugaaaacauccagaaaccuuagucauugaugggcaccgucuugaacuugguagugaugcuucugcugagcuuucccauauuucccuuugugagugauguauaguaggcccaaggcuccuuucagcuacagagaggcaugcauaauuucagaacuaaccccccaggcuucuauuuuuuuaaucugacuuuuucugcuuuucaugccaucugucuucuuucccccuccuaugcgguuugguuguagaucauccuauuuagcuacuuauauuugucucauaggagcuuuuuauguuuuuaaguugcucaacuacugugagguaaauugcaaagagagagaaccaagaugguucucauccaaugaauaugcgaacagaaaacauucuauaguaucaagugugugagucacuauccauggacuguguagcauauauaaauuugcucaugagauguuuuuuugauuccaguuauucugaauggucaggcugcuagcaggaguacucauuguaaacccuuucuuguuaaguucuacugucuaguccuuucugccucuauugaaucaguuaagucuuauguacucuguggauauccauuuccgugaacaguacuccauuauuuuauuaauuuucagaacuaucaagguuaaauauauagauacuguuguuucuuuguaauacgaucuuaauuuuguugaauggguaaauaaaugagcgugguuaguauuuugccuguugcucugguaaaauacucuuaacaaaaccaaauuaaggggaaagggcuuauuuuggcccacaguuugaggauacccagucuguccugacagugggagcuugaaacaccuguucauaauugcaucuuuguaaaggaaaacaagggagaugaauacugguacucagcuuauuuucuucuuucuauucauuuugggacucuggcacauggaaugguaccauccauaguuaggguucguauucucucucucucucucucucucucucucucucucucucucucucucucucucucuguuuuucgagacaggcuuucucuguauagcccuggcuguccuugaacucacucucuagaccaggcuggccucgaacucagaaauccaccugccucugccucccgagugcugggauuaaaggcgugcgccaccacgccgagcuaggguugguauucucaggugaccuagucuagaaaauccuucacaagcaguucaaagcuuuuuucuugacugacucuacaucggaugacguugacaggcuggacugucacagugagcagugaugcuuuugacacugaagcagguacuccaacccuucuguaguuagauaucugauuagaauauuuuuacauuucauuauuucuuguugauuuuucacuacccauuuuugagaucauagaauuacucuagggaaaugauuugagauuguugcucguaugucacucaauguuuuuauucucacuuuugaggcagggagucucuacagaguauagucugccuauguucagacuuuuuuuugccaccucagccgaccaccccgauauugaaauuauagguauauacuacuauaguaggugucuugguuguuuuuaaaagauguuugugccuccucuucagcauuuauagaaauugacucuagucaauuucuauacccagucaaacucacgaugccuuagaccugcacuauccacacuuacgguuuuagcugacaugucuguacucaaccaucuauccaccugagcucugccuucuaagacaagauccuggaauaugauucaagaugucuuuuccaggccagagcuguuguuauugauacaaaugauguuauaugugucaucucccuuuccuguauaagaaucagaaacuuuugguauaacuugauugguauauaguauuaaugcauauuauguggaaugcacuguucaaaagaaauggaauccccuuacuuauacuuacuaauuugucauguacgaaauuccacauuuaguucuuucagcuuauguuuuuaauuauuucagaucugcuauggucuuucccugcucgcuuaaugcuaaccccugauagacuauaccacaauauaaccuuuuuauauuuaugcuacuuauaaacugaggacgaauuauugauaaauacauuagaguguuuuaacugaauggauuauuuuaaaaugugagacacuuauuagaucaaauagugaucaugguaaagaugcuuuuuagaguuucugccuauauauuuaacuuugcauguucucuaaauaguaguuuauuuuuaaacaaaauacugaaaauaguuguccaaauuuacauuuuacauuguaccuuuuuuggucuuuuaaacaaauauuucaauuuauauguaguauauuuauuacauauuauguauaaauauaaacauauuuauuuauauuauaucauauauuuucuuuguuacccaugccuuuauguguuuuuauucuaauuaugauuuaucuuuuaaauuauuuaccagauguuuaaguacuuugcccuuugccauuauguuuuuuaugaaagaacaaauaaacuauaaauucuuuugcucacuuuucugcagaggagauucuuagugccauucccauuucagcucacuauguuuacccauguucucucucgggucaugcauugccuggucuguccucuucugaagagggucagaagcacgccuguagucucauggaguucacagucuggguagaagugucaacgauuucacuacuaaaaaucuaaaauuugccuuguuuaauuuucccaaguuaagacugauagguucuuucuucuuucuuucuucccccaccccgcugccacucagauuuucuguuuucccuuuucuugugauauuuccauaaugaguuuaaaugaguccacaagugugugaguugaauucccuugagaggcucagcuuccuaucagccaggccucugauuggugugaguuuaguuuugucaaguguuccacaucugcuuuuugucagucgcuauuuuugcaaagucuucauucucucuaauuauacaaauaugucuucuucauuuuucuugucaaagacaaauuaaaaagaauuaguuucugagcuaguuuagucuucauuaauucugugcccuacucuguuuuuagcagcguuuuucuuuuccuagucuuucccccacuccuugauaauuuuaaaagcuugucuccucaugucugcucuacuugaguagcaugaauuaauuugcuaccucugacuccuuuuuuucuaaguuuuagccgagcagaagauacauuuuuacuuuucuccauauuuaguucagaucugucuuuguaaugucuaagagucauuugugaaacuacauuagguguuucuuguucauuaucauuugccccaagaggaauuuaauucugcauguguuaauuauuuaauuauccuaaugaugucucacaugguacuccuggucucuugcacagugauggaaucaguccuucauucauuccucuuguuucuugaucugauaaaaucagagguuuuuauucucuaauguuugugcauuuauauuuaaauggauuuuacguuaguuuuaaauuaaccuucaaauuuuaacagccaucaugagaaucaccuagaaugaucaaaguccagguucuugagucuuggcaucagauucucauucacuugguguaucaaugaaccuugauagcuucaauguuaagauauuuggacaauuauaacaccacaccauuguauauuucaacucgcugccuacugguuuuuuuuuguuuuuuguuuuuuguuuuguuuuuguuuuuuguauuuuggucuggccuccuuugcccucagcacaacaaccugagauuguuucuuguauauugucuuauaauuuuuuuaauuauaggauuaucucuaagauaacauguuagacacauaggauaucccuuugugccaaguguucggauucuaggucuucuugcaacacuucaucauacauugagguguuucuucauaucuucaacucaaagauuucuuuuaugucuugguauuaagccagcgaguaagcacuuuaaucccuucuccuuccccuucuuccccuuccccuucuuccccuuccccucccccucuccucccccuccuccuuccccuuccgcuuccccuccccuuggugcagaugacccauaauagcugacaucaaggacugggcuuugguguuugguucuaacuccucuucuuugucuuucugcuucauuugucagaugacuauaguuuggcuauaucacacaaggugcuuucagucaaugaacuucaguagucacuucugaccccaaaaccuuaaugcuaaguuuagagaaauucuaccauaauuaaugaguucuaauauaucagacucccuacaccuucagggaagcuaaaauguaauaugauaugcacuguucgaucuuugaaacccauugcauugauuuguguuuguguuauguuuaugagaauauaguaccacagggagcugccuucugauuacugacccaugagaccugggaccaaaaaagucucucucaucagucuuguaaucauaagucauuguguguguguguguacacacaugugcguguuuguaugcuggucuauuugugcuuguuugguggccagagaacuauauagaucacguucuccaauuguucuccauguuggguuuugagacaggguuucucauugaaaugugaaacuuacucacuggcuaagcugauuguccaggaagacucccaugacuuaccucucucucaucccauaauucuggguuuagggauacaugcccugaugccagcuuuuaugugggccuugaggauccaaaccucagauuucugugcuugaacaggaagcacuuuacccccugagccaccucccaggcucgucaugauuuauuaaauguuaaaagaaacuaagauuccaggagacagaauaucuuucucucugcccaaauagaccuuccuaaacuuucccuggaccuccuccuccccugagcuccucaaucauggaguguguaaagauucccagcaguaacagugggacuguaacucaguggaacucuucaaccagcacuggcuucugacaucuuugagaaaccaaauguggauuaguaaaguucuugugauuuauagccucauugugucuguguccuuuuaauuauucucacuuaaaaacauuuuagaaaauagguuuagugaucacauggcauagucaauugcugacacuacuuaacaccaguucaugaaugucaacuauuucuaaaccaaggccuagagugggugacuuuaccuccguuuuaaauguuuugugaacuauagccucugagaacuugauguucuuuuauuucucuucauauuuccaugggugagaggauggcuugccaagagcucaaaugcaagcagaacaaccagcucugcuuucugaagcucucacaccagugcucuugcuuccacuuccuucuucaagcgcuuuuagccuugggauuaaccucucaugcuacauuugguuaucuguguucaugaugaaucuauuugagacauagaggaccaagaaguuccaccuaagguuauuuuaaguuuuacauuugaaagaacaaggacuccugaagaagaauacggcucuucuugacuaaugcugcuaagucuuuguacaugcuuucugcaugucuccguguacacaagugccaauucaacuguucacugacucucauuccucagauggauuccuugagcagauuagaagagaagggucugcuguugcccaaguucucuuccacuggguauucauagauagagcugugugaaaggaaaggaaugugaccauaaggcucugaccagugacaaggcuucuugaaauauuggagguuauuuuguugucaguuguuuguuugcuugugugucuuuaaaauucauagcauuguuuuguguguuucuuuugcauuuauuuugaugucuguuguuuuuaaaaauucuuuaaaaaugauaggagauuacaguuuaggggggauguacuagauaugguuuucauaacgaaguggaauguaauaaaacugaaagccaauuuagaagcuuuucuuggaaagaauaguaugaaaugaaggguaguuuuaaggacagugaaagaaaagcgauauuuauuagaauaugucagggcaauuuauucauugcaugaacuuuucauggaauauaucauacugugauguauuaagguugcaacacuuugguguugugcuuuaaagagccaggguuugaaguguccacugccuguagucagguaggacuuucaguguagagagagggacaccaacucccccccaaaaccuucaacccaaauuuguccugccuacaagauaugcaaggauaaaaauggagcggagauugagggaauggccaaccaauuacuggccuaacuugugaccuaucccauaggagaaagacauaguauaacuaaccuccgagaggcuucaaccagcaguugaugagaaccgaugcagagacccacaaccaaacaucaggcagagcucagggagucuuauggaggaauugguggaagaauugaaggagccagaggggucaaggauaccacaggaagacccacagaguuaauuaaccaggacccaugagggcucacagaaacugaacuaccaaccaaagagcaugaguggacuggaccugggcccccuacccacauguaguagauguguaacuugguuucaugggcugucucugacucaggaucuguugcuugccuuugggucccuuucccccagcuagauuuccuugucuggccucagugggggagaauucccuuaguucugacuuaaugagacuugaugugccugggccaguugguacaagauaugagggaaagggguucucuuggaagaaggggaggaggaaugagaaaaagggaugguggggugcgacugagaggagaggagggagagggcugugaucaggauguaaaaugaaucaaugaaugaaugaaugaaugaaugaauuuuuaaaaagaugaaauaagaagagcuugccauauuugauauuuagagcagucaggucaaugaaugaccuuuuaguaggaacauauuguugcaaagcaaccucccacaccagaagcggugagggaagcagaauaaugaccuuauaaaaagaauaaaagucugaagagcugcacaguuccuauagcacuaaaugauuggaaacucugaaacaguguugauagagguuuuaaaggaaaaggguaugcuuuagaagcagaauacacccucacauuuuagggacuucagaaaacaagaaucccauguuugaguggucuauuaggcuccuccaauuggcauaaaaaguucacuaagugcccuaagacaaaaguguauccugcccauucuaggagccagacaucugaaaucaggguaucuguggggccauguuuucugucucuuagggacaaaagcuguuuaauuauuccaugcugucugacucucuuggggacgucuggucuuugagucucucuguuguggaaguugccagcaaagcuuuccaucucuuugcuauggaaauacuauuccacauucugccucuacuguuaaauagcagucuccucccguguuucuugucucugugaucaaauucccauucccauaaaagagcaggagucauuaaaccggguucuccccacaccaagggugacucaucguaaccgaguauaguccuacuugauucugauggaauaugcagaagaccuguugagcuauggcuacaugccccaggguagucuuccaacgaggaguagaaacuauaacuuuaaggauaaggaaguuauaagacauggaguccacugaugacuuuugccaggcccagugugaguaaacaaacuggauugaauuuggugaugcaugcuguacagacauaggacaaaauggggcgcagcaauauuccccugagcuacccagaaacucacaugcugagucacaaccagugcuggacaccaaagacaaaaccaguggcauuuucuuuaccacucaguggcucaacuauuugaacagauacuguagaguaguucagacuuaauaaaugaaaggugcauuuuuaucuuucucuaaaaguauaagauagaaaauauaagcuauaauuuaguuaucuguggguuuuccuugggaacuugagaaauaaucuuucacauccuuaaaucucauacuaaauuaucugaaucauuagauuuuaaugaauucuucucugguuuagguucugugacuguaccuuuauuaauaaugcuucaaaauaauuaggagaggaauucaguucuuuaaaguaaauaaacauuuaaauaaaagauaaagacuucccaggaguaugggcuucuggaucuauuucaaaugucuauuuuccaagcacaucuauaauaggaauguagcuacauuugcaaugagauaauagugaauuauuaaaauaaguacauguaauuuugccaucacaaaauaggcaauuaugugaaauuuuaaugaagcaaaaacuuagaaaaggaaaugcauccagauguaaacacaagcuaccccuaagugauggagacacggagugacuuuucuucucgaccuuuucugacauucucuaacuucuguuggacaggccugcuuagcauguaugagggaaguagccugccuacucuaagaucugcuuauccuagcugggaagagaagacagaagucucugguugcacaaaacggugccuaguggaaaagggucaacacuagucucucaacucccgagucucuggugcauucuggaggucccccaaccuccuauuuccugagguugccuguguacauucuuucugaugguccuuagguguugcggccuccagcagcucgcaacaugaacgguucgacugauauggcuacuugagcuguaagagaggaaucuagacggggcgaaagaagaaacuaagacaaauucauucugaucaaagcucaaauuuuauuguugcgacacuaguuaugaaggaagggggaggggacccgauuccugccgaauaaucucuguuccaguagaaaggugagcacguguguggcuccgaacagcaaaguggcagguuccagcagugggcguggcagaacgaaugagcaggaagcuccaccccugagcaagcagguuucaggcugggggaggggagacuacacucagggcuuugguccuuuucccucacccaauacccucaccucccuccccacuugcgauugcuuucuucucucucccaagugggacugagguguccucacuugggcacuuaagcuuguugagcuuuuugaguucuguggacuguaucuuagguauucuguauuuuugugugugugccuaauauccacuuauuagugaguacauacaucaauugagaaaaugucccaaacacauuguccuuugagcaggccuuuggagcauuuucuuaacuaaagauugauuuggaagagccuaacccacuaugggcaguaccuuuucugcagugcauaagaaaguacauugacgaaaggauggaccaucuagagacugccauauccggggauccaucccauaaucagcuuccaaacgcugacaccauugcauacacuagcaagauuuugcugaaaggacccagauagagcugucucuugugagacuaugccagggccuagcaaacacagaaguugaugcucacagucagcuauuggauggaucacagggcccccaauggaggagcuagagaaaguacccaaggagcugaagggaucugcaacccuauagguggaacaacauuaugaacuaaccaguaccccggagcucuugacucuagcugcauauguaucaaaagauggccuagucggccaucacugggaagagaggccccuugcucuugcaaacuuuauaugccccaguacaggggaacaccagggccaaaaggugggaguggguggguaggggagcaggggcggggggaggguaugggggacuuuugggauagcauuggaaauguaaaugagggaaauaccuaauaaaaaauacaaacaaacaaacaaacaaaaaagaaaguacauugagcaagccugaaagaaccagucaguaacacuuuuccauuguucuguuucaauucccgccuucagucuccugaccugaguccuagcccugacuuuccucaguaguggacugugguguguauguauguguguguguguguguaugucuauguguaucugggucucucuguguaucugugucuuucucuauguguauguagagagugugaggccuagacuuuaccuuaaacucuugauucucuugccucaccauuugucaugguguuuaucccaacgcuagaaacuuaaccaaggcuaauuccuauugccagaacuagcaguugacuauuugacuucuacaacuuuaaaauaaauuucuacucaagaauauuaucaccuaugcauauugacuuaugucuaugaaucgagcacagcagaggcugaagcaagaggaucaagaguugaagauaagucuaggugucauacuuaauacacaaagacacagacacagacacagacacacacacacacacacacacacacaagcaccuuuaccuaauuacuauuuggguaaaaagguaauuagcaccaucuuaauucacagcuuguaaaaauaucuaugagucauugaucccagucagaagccagaacacacagucacuagccaauugcaugcaggccaaaaauauugaacaauucaaauacucaucaaucauuagagaacauuuuacaaaauacaguuuugcaugaagaaagaaaaacauguucugugugcuaaacagaucuacucccuuaucaaguuuuauucccauuuuuggucauacaugaacugaguugcaagaagaggcuaguuuaguuucccuggccucagggauaggcagucaaaaugcuggugccagguaagaaacaugacuuccagcacagagccagagugggaagucauuacauguauaaauaaggccuuucugugcugcuuuuccuacaguuuuaacuuuuuguuaaaacagcauuaugguacuucauauguguguguguauguauauguauauguguauguguauguguauguauauauauguauaaaauguguguauguauauauauguguguguauauauguacauauguauauauguguauauguauaucuacucuguucauaaugaccuguccacuauguaccuuuguccaucuccuaccucuaaaucaucccccuucugcuuucaugccauguguauauacauguauguauacauacaugcacacauauauuuaaaucuagauuccauguaugagagagaacgaagauuuguuucuacccauguauuuacucucucaggcuuacauugcacauagcuuuagugcccuucugcugccauguagucccucaucugacuuucuaucauauauauguacauaugaauauguauuguuuggauauugauuucacaugagagaacaugcaugaugccugucuuucucucuuaucucauuaugauauccagguccauuuauuuuccugaaaaugguaaaguuucauucuuuugaauaagugcucauuuugccagaaaaggcugucaggugcuugcuccugacuaaggucauuagucaguauccugcucagcacaauugagaaaacuacagaaaaaguagcaugguacagcacagaaucugacagugucuccacacaguauaucauuuucuaggcuucuagacugaggcaggaucauguuuuuuguuuauuuuuuuucuuauguuuguaaacuuuccaagaugauuauaauauacaaccaaggccaaaacccaguuagguaauggaaaagaucuagcagacagaaauaaaaccuuacaauuuaauauggccuuaacagcuuuacugucuacaccaucacuuuguacucccaagacuucucuaacacaucugcaaagaaaaaaguccagcauccacccagggcuuuggaaccucagauguguuaacuggaaagcacuuuccacauguuuaagcaguccuuuucaaacaguauuuacuaagagagauuucgcagacucgauaaauccugaaaaucagaaacuuauaacuguauguacacaguugaguaaaauucuauaaugaguuuacagaauugcaacuuaccaggacaaaaguugaagacugugaaaaaugcugucuuucaguccucaaguguuuggcagaaggaauuugucaaucuguacgcauaagguucagggacauggaaauaaauacauaugcaaagucacacuaacaccccuaacggucugcuuaauaaaguugaauaaugcuguuacgcuuucuaaaucuguucuuugaugauucugcacauguagauaaugucaucagaucucucuuagcaucucacacuccacacaccguucucaacuacuccccccacucauccccacagguaccuuccccacauuucuguguuuuauuuugugacccauugaguuuaacccagaccaaccaugaggccauggacugguaguuaggcacugaagcagggugagcucaguagaggcucuacauguaaagauaauaacugcuaccuuuccagaaaccaacaguaaucaggaguuuuacagaauggcauaacaucuucugugcccugucugauacaugacuggcagacaauagggcuauucuuguacacauuuaguauaggcaaccacagaugcuaucagaucaugguugggauggcugugucaugccaucaacuaauucugaugggcagucaagaaauauaacaagaauaugauuguuuuggggaauaccuggggccucccugaccaccaacucauaacauaagcagguaccccacaccuggcauuuggaucaauagcuuucaggaguacuguuaucuagucauagaacauaucuuccuucuaacuucugauuuuuuucuuuuuguuaaaauuuaauuuuauuuuuaauuuauuuuuuacacuccauauuccauuccccaaccucccauccacccucugucugcuccacaucccacccccuccuccccaccccaccucaccccaucuccauguggaugcccccagcccucaccccagcugaucucuaaacucccuggggcuucuagucucuugaagguuagguguaucaucucugaaugaacacagacccguaaguccucuacuguauguuuguugggggccucauaucagcugguguacaaauuuugccuuuuaggccuggcuucugguuucaucaagggcuauucaguuggugucuaguaaacaaagauauaaaauuuucagacuacauauaaaagcuuuauuaacuggcuuauaucuauuguucauuuagccuuuccaaguucucaguccucaacugaaaaauacagcuuugcauuuaauacuauauauagccuuugcuaggaauaggcuccacagcuacauguaugccugagaucuaagaaaauacaaaacuauagaagaaaauuugaggcuacagcacugaugaagucaagccaauaccaacuaaaugggcuuaagucuuaucucuugcuucucaauacuuccuucacaaucccuggugccacagagauagcauuaccaccauuggccuauugguuuggguuugcuugguuugauuuaguaaacuaaauucaccugagaagaaggacccucaaggaauugccugcauuaaguuggugggugggcaugucuguggagcauuucuucaugauugauaugggaggguccaauucacuauggauggugcaaucucugggaaagugguccuugcuuguauaagaagacuaaccaguaaucaguguccuucuguagucagguuaauuuccagcuuccagcuuccuguucuugaccugcuuuccuucacgacaucuguaaccuguaagcugaaauaaacccuuuucuucucaaguuuucuuucaucaguguuuuaucacagaaacugaaaaagagaccgagacacuucuuuugggucaagggcauauuuuggguuaacauuaucaaccuccacuagaaucccacuagcucaaauuccaaugcauuuacauaaauuugugucuuuuugauguuguucuuacaaauugugacacagagccuucagucacacaaccugauugauuacucagucaaguuucauuucccccuucccaauguccagcaaaucuucaaauucaucaaauaccuggucuuacuuaucaaaauccuucuccuuccuucucucuuacuuucuuaaugaucccaauccuggauuauagauaaaucucucuauucuagauucuuuucuucagauuguaaauaaacagaaauaacagcccuccaaacugccucuugaucaccucaccacacucaguaaacugaggaauccuucuauccugcuucccuggcucuuuagcccaacaucaucaucaaacaaaaacaugucaucacuauuuacaugucauacugucuauuauauuccccugccgcuagccaucucagcuauggucaccccauauccucucaggagccuccucuguuucaugucucuggcuuguccuauagaugcacccccccauuucccuucucucuucucucucucagcccccuuuucuguuuuauucuuaacauuuccacucaaaauaaggaagcuauccucaaucucauucauacucccucucuuuccaucccugcucucucccacuuugucuuuguaguuuggaggcuaaaauccgguucucauaauccuccuauuuauuguccauucucacucuuuucaguguuaucccaugucugaaaaauuuuaugccuccuauuuuaugugauaucaauuauuacuaacucugugccuuuauugugauuuuucuuuuuuuuuucuguuacaaugggaaguuuuguuuuguuuuguuuuauuagcagucccuuuuuaacuuucccugguucccuuuaaucuuuuaccaauggcuuucuuugagccaguuuucccuugaaagguuuccuuugcuguugcaagagaccauuuguuuuaugugcugcccuggcugucaggauuuauugagaacuucuugcuucuaguuuguugcaguuacacaccccaacccauuucuuuuuuucuuguuuauucccucucacagaacaacucuauccagaccuacuguuggaauaggaagauuucuucuuagccuguugccuaaaugucuaggugauaauuaaauaaauaauuuccugaguuuuacuccuaaaaaucauuuuuaugcauauccagaaaaaccaugaauauucaaauaaaaaucaguuuucaugauugcuuuuuuuuuuugaaucuacaauauuuugcaacagguaacuguauccugucuucugcuuucaaguaacugcuuuauuuugaauggcucuucuaauggacauggcugaggaaaguaaacuagaagagccagcagccucucacaccagugccacugugguccagaauguaguucagcaucaccuuuuuguaguguaggaaaagaaggggaaaggcuuucuauaccuuuucuccacaagcagguggcauuuccuuggagcagcaucauuaaaucauuaugugaagcuuaacucucucccaucagccuugaacuuagugggaauucauuaaacauucuggcaguggcuguguuuggaucuagauuuuggcauugugaguuguuuuuaugucuuuuucauuuauaagucuuuuaauggguaugugggugagauugugggguacuacucaucaaauuacaucuuaacauuuaaacuuuuuuuauuuuuguuuguaguuugcuuauuaaguuauaaguaggagaauaucuucuuuuucuuaauuauaaaugggauuuuaaaaucuaaauauaugugguaaacgcggaccaacauauuucugaagucagaaaauucauaaauccuuuuuuauuaauauacaaaaaguuguuuauaaaaccaaauuauuuucugcauuucauauguucaggauauuuaauauuuucacuuuucuauuuguauauauccuacaucugcauuccuagacauggauuauucauaauuaaaacaguguauguaucuggguauuuugucagcgugcauguuucuaccauguuuguuccuuguacccauaaaggccagaagcagccaucagauuuuguggagcuagaguccgauguugugaaccaccaacugggugcuggaaauuaaaccuggacccucuggaauaacagccagcacacacacuugcugagcucuuucuacagaugcuaggcuuguuuaaguacugccaccagaaaaagaauuguaaggaagauuucaguguuagaugguuacuuagcucugguuuggucucagccucauguuaaaugaaaguguguguguguguguguguguguguguguguguguguguguguguguguguguuggagugaggcaggaauuuagacuuaucaucugcacuacgauccuaggaguggaugaaaugguucucugaugcugaugucuguucaguaagacuucuggcaugguguuagcuucuagucuguuguuaguguaaacguguaguucauaacucauugauguauagaaaaagguuaguuauuuuaagugaaaugacaguaugcuguaaaggauagagaguuguauucuucggcuauuacuuucuuaaugaaaauuuuugauugggauaaaaacuaugcagcuuagcuuaugauuuaaaucacuccuuaguagugcucacauuauuaacaugauuuuugccucugucuuccucacugagaggacccgagguucuggugguugucauccugauguucugacuaccuuuucugauggaaaaaguauaggaggcaggacaagaaagaaugaaaucauuggaaaagauaggaaaaugguucccacagcaauacuaucagcacauaucucaugugcacauuaaaaagaugacugaguuuuuguuagauaguuuagguugugagagaauuuguacuuuaggcuauagaaauagggggaugguucuguguugcuaauacaaagcaguaaauguaucugaggagaaaucugaugaccauacuggagcagugguauagcccaggcuucuaggaaaugcgagaaucuucuaccuauaccauucucugccaucuccauaucucacucaacuuucaguucucugccuguuguuucuguucagaauuacuaguacucauccauuuuugauaggcuuuucuacaaaaguuauuccuagauuuaaauuauuuauaauuaaaauauuguauguguguauguauauauguauguauguauguauguauguauguauguaugauauauguauguauuugccagcacguaugguauguuugcacugugugugcuccuuguguccacaaaggccagaagggggcuguagcuaggcugcuuugguucuuccuugcuguguuguauugacaguagcugaugguaaggaauguacccuguggaaacauguucuuagugauaaugacagaauagcuaaccaaauguuacauaugugaacuacuaaccuuccugcuuacuaucagcaaaugaacaauauguggucauuugaaauauaccuuuuaaaauucugcuaucugagcuuaguuguucacuucuaugguccauuucuauuccccccccccccaauaaauuaucuuauaaugccaucaccaguuguucaucagucuauccgauguguaaagucugcuguguccauccucugucaaucuguaagcuuaucaugacauauauacauggauaggauuguuaccuuuucuggaaggagaauaagccauaaauaugaacaaggcuuuuaaaaagccuaacauaaaucacuaagaaaaauauguagucaaccaugagacuacaaaaaucacugugaauuauaaaugaugcaagaagguuacagaaaucauuuucugugcaaacaaacguauguuuccacuuccuguaguaaggcucaguuauuuuaauauuauugguugacgagauuguauauggaauaccauauauuagaaauuugcauagaaaaaauucuuggagauaauugauaauauggagcacugauacuuacucuaacuagcagaggucugcauugcugugacaugaucaaaauaaaucuaucacuugguaauuguaauguuaugcauauauguauauacauguuuaaauuauauauacauagaaauuccuuuccugguaaggucuauuuuguauaguucagucugccuucaaacuugcuauguagucaggcuggcuucacauaucuuucuacuucagacucaagguccuguucuuauagucauguacacccaagccuagcuuccucuuuuuaauuguucuugguuaguaguauacagauaacucuucaaaaauuaaaaucuuuauugaaauuuucacaaccuuuuucuuugauugaguugaccucauguuuccccuuaaaguaguggugacuuucaugguauuugcauauuaagaacccaaagaguuuucuuaaaaauucauuuauuuuuuucuauuguauggauuugaguaauauuuucuugggaaauuaacugugaauaaauauuuauaagcuguuuaguauguugcaaagagaauagucuuuauuaaaacuauccuaauaccucuuggguagcaaucauaaccuuccuguugaagauuuugauuguaguauacaacuuuaauacaguugaagaguuguguguuugguauaugcauuuauuuugaaaucaggaugauuucaccuauuaaagugcuuuauucaugacauucugauggagcgacuucguuaguacuggcgauaaagcacagauguaagacgugggguuuuucuuagauagcugccggcucagaucaaacuaauccauuuuuaacaacauuggcauuucaaaauaauauaugcuuaaguucauagcucugugauucagacuguuuucaaaugucagucuuaaaggaagccagcgcaggcuacuguuacuuaccugugaccacucaaagucuccaaguauuccguuucuaagagagugggaaauguuccuuaaaacugaaaauuuuuuccacacuuaaacaaccauuuucuuuuucuuacauuuuaaauucauuacuuuuugguuguuucccaccguuuaucgugaagcuaaagguuaugaaugauaauauccccauuuacaacagaacauauuuauuucuaauguuaaccugugacauaguaagaaaacauacucuuaacgucuaacuuuggaccuguagagccucuuuuauugcagugaguucugggcacuuuguagcuauucaagaacaggaaucuggauguucacgugguggacggagacgcgcauugcugcucuuggcuaugggcgaguuagcauuugucugaauagauaagugcugcugacuucagcuuuacacugccugugugguaugcaaaauccacacuugcagguuuaaaucauugguauuuuaacuuaaaaagucagaugauuuaucuauaguuguagcaauguguuaaacauuaaaaguaacaaaauuuuauacaaacuaaaacaguuuagcuguuagcuuggcucucaucucccaaauaauaggcuaaagcuauuuauuaauugauuugagaauuauugauuuuaauagauuuaaccucugacaauauacauuacaauaaguauguuuuguggcuagucuuuuucuucucucuuggucuaagcaagaauguccuugaguuacacauucuguagucaagugaggagcaucugucuucauccacgauccuuuauucaaagauauuuuuacagugaaaaguaaauguaacagaaguugaggccaccugcaacucuguauugucuuuguucugauuguauguuauuagaacugaauuguagaaucaucauauuuaaauggguuacuacauucuaauggagguacauauagcuggaaaaguuugguauuauuguuuaauggguucagaaguaacaguaguuauaccaaagccaagaaauuaggcaauaacuguaucuacauggaaugaaagaaugccacucucaggucugauaaucugauuuuuucugaaguacagauucauaguugccauucacaugaucacauuuucauguaggcguaucagggcgauaucuucacaugagccacuuugguagauccaguuguaacuguguacuagaaccuauaguuuagaaucuguguuggauaugucagaaagcuuaagcaacuguguaaaugaaguuccacuggcuccuuuaaaugguggggauagucauuuagaacuaaaucauagaugugccuuucauguucauauaucuuagaucccaagaugaagaauauaauaaguacuuuguagaucugagucaacuccaccuuugcauguaagugacaaaucaaagugccuaccucauagaaaaauacucacgaauacuguuucgacuaaugaaugggauuauaggaauaggucauagaaaauagagacagauaagcaccacacaauggcugggaucugcugcugggguggcccugggguguguuguuccaugauuauuuguguacgugaacagagaaacaaaaugcaaugguuccuuugaauugaagaguccugaagagcucugagcacuucacuugaguguguguguuaccugguguacuaccgugcauauauguugcagaauggacagaaauaccagugauguauugauauuugugguuggccaugagaggagauugaaguugauuuaaagggaaaugaaaaaaaauguuaauuaguaaggaucuguggagugagcuagcuugauucggugagacagcaacuugccagucugauuagaguccuguuguacuuauuauggugaugauugguuaauaagacuuuuuucccuuuaaaauaucaauuccuaggaauuuuauguccccuacuccuuucauuuucuuuuuucuuuccuuaauugaaaaccuaucauaauuauuuuauuggguaaagcugauuuuauagaaaaagguuccaagcuuguagauuucaucuacguaaaaguauuguuuuaguugauagugaaaacucacacacauacacauacacacaggcacaggcaagugcaugugcacauaugcacacacaugauaaagcuuguuguaugagagaagaagcugggaggaggagagaagggagagaauggaaaccuuuuuaucuuguaggcucauauaaagagaaugugauucuuucauacugagcaauucuguguucaggcuaaucuccuaacuuugauccaugguauucuaguugcuguuguuucaaaaaggcucuaucuaguaagggguagaguggcaguccagagcacccuuguucugcuuagaccucaugcugagggagaaccuucugucagugaauuguuucucaaagcuuuauugaacuuuguggaauugaaucauccaacauaaaucucaccaaggcuguucucuagucauaguagcuguagcuccagcaguaaugcuaaaaacucagacuucaucaaacaaacaaguaaaaccgugcuguaggaaguuuauguugaacaaacacauaauuuucucaaacuuguagaaauccacguggggaguugaaaguauaguuagaggcaauaguuuccugaggcuuuuuuuuuuuuuuugugccauaaauguuuaccuggauuauuuauuuuucauggcuagauaguauaaugcaaauguuuuuugauugcuugagccauuuauuuauuuauuuauuuuauuuauccugggacaaaaucuuuccauuuuauuauugcaccaccaguuucugcaccuguuuucuauucagcuggagaacuggaaagaugcauuggaguuggugugagcauuugccugggacuuagugcuccuucauccuauugcagaacauaggcccucagaaaccgucugaugugcacuccaaagacaugauuuugcuuucaacugugaugacacuauaauugaucaaauauauucuuucuaggaaucauaaauucuucuuggaguuugaggagaugucacguucauuugucaacaugucacuccagggacacaggugcagugaauuuauaaggaagugucuuauguuucuccaaaucacauaaauaugaagcugaaggaaaaaacgugugacuuuggauuacuccucagauggagagcaauuaaaaucucucuguagauggcguuuccaugugacucuuagcauagaugaagacagcaugcaggaagacagcagaggaauuuuggagacuugcagauguuuucucagaaaagaauacuacaauacuaucgcguuucuucucuggcagagagaauauuccacauuuuagucaagugcaugauuaacuuugacauuuggaaauagaacgucauacaaaaauaagcuuggugguuuugcauguuuaauuaagauguuuaguucuugucaaggcugauaucgccccccccccccccgaagggcaauauauucucaacuucugaaauuucagaaaccuguacuuaaccuuuaaucguucuuccauuuacauggaaaucugauuaacaacuuuuaaaguucaugagcuccugguaaaugcaauuaagaccuuuuggggguuugcuauuaagagcuggcauuuaaagaagacuagaaucuggcuacuguugcugucuucucuauagcaggaugucuuaagcaauuagcagagaacaugaaguacaugaauuguacuguauugcuucugcguuaacaugguugcuauuuaaauaguuugcuaucuuuuccuucucucugacuugcuuucuaccaugagcuuauuacaaagugggagcacggugccaaggcuaacuagacggaggugcgggcucugcagcagugcaagcguuaggcauagcuccuccuccauguuuuauucuccaguccuguuuucaggcaugcagucucauguuguauguguucacauucaucauccuucauuauugaauuucuaccuuuucaccauuggggaaauuauuagaaauguaagucagguauacaacuauuuucaaaacucaggugcuucagcuguugcccuugaguuacagguacaggagggaggaaaguugauugguacaggggcauguaauauaauuuauaggcugacauauauguugauggguguaaauaauucaaagaggaaaggguuauauugggucauacguugucuaugaagcacaauuuguuuguauuucacuuacuaucagaauuuaguucucauugaugaaugcauguaaaaagguacuuuaugcacgucagugcacuacuuuuuaguauuuagagauaaguaaaauaaugaggucagauauagagagaggcaguuuagcaauauauauugcauauaucuacucuuaaagaauacuugcaccuucauauauuucaguauugugaaauuuuuaugauuagacauuguuuuugaguaagagaucagaauaaaguaaugaaguauuaaaaauaauauuagaugagaaaaugaaucuaaaauaauuaaauuuuaaucuagaauuaucaguucuccaucuuuggacccuagaguuucuaucuguacuauaaacuaauuuaaauaaucaauguagcucacuugauugaccuuuuaauuuguuaucaaccucauuuuuaacagauaaaugaaauaauuuaguuucauauuuugaauuaccauguaacuucuuauuauaaauaguauaucuaaucauaaaccuaauauagaugugaaauuuuuguuggagauagaauuuuucuugaaaauguaauucuacaagaagucuagagugagugauuuuaauugggucuuaguuacaaaaauuuuaaaaugauauaugagcguuuuaugaaauuguggauuacagaguuuuagcaaagcgcuuucuuaucaaguuauauaaggauguuaagugauagguaaaggcuaaauauccagcuguagaugguuaacugccaggucuggaaaaacagcugugaugguugcuggugaucuuggaaguacuuaaagguacagaaaaggguuuguggacaggaugggaacugguugcucuuacagaagcagaagaacuuagauauccaggaagaccuucccaguuagggacaguaggcauauguacucagagcaggguacauagggacuugauucugauuaaaccauuugagguuuucuuuguggauuccuuuauuuaucucuguauccagguauuauauucuuagugcuuucaaacuucauuaccucccagccuuaacaguguuucucucaaaccccuauaagacaauacuuagcauaccuccuagcauucuguagauacaaauaaauguuaauugaaucuggauuuguaccuguuauuucugagaucucauuuugaaugaauuauaagcgauuuuuaaugugugucaauagucacauguuacagauaaccaauaugaaggagucuuuaguaacuaaacugcuaauugaaaaugcugggucuuaggcacuuaauugaauaaacugucuccagagagcaauuuggcuccuuuccaaaaugcauuaacucuuuggggucauuaggguagcacuuaucgcauuggagcagaaauuuaauaaaugcuacucccaugaugugaguaaauuaauguaccugagaaagccugaaguuucaccgugggugcuguagcucuacccuggggagcucaucuguggauguggaacaucagugaggagcugcccuuuacauuagauuacuuucaauuuagguaaccuaaugcaagcagcugcacugcuucugaugccaugugaggugucagagauacaaagaaaagccucggcuugaacugagagagaagguuguaaaagccuggggacaggaaacagacaaaacaaaacacaaaagaaggaaaacaaaccccaguaggaaaaaaagccuuggagaaacccccuugccacauagguuuuaacuggagugagacaguuguguccauagugagggcagacaggaaucuccuagaaggcaggaucaggaugucucuacagaagcuuaacucagauuucuuaucacaauguacuauguaggcaauauggauguauguacacauauaugaacaagucuguaaauauauguaugaacuaugagguagauaaacaaaaagcuuuuuuaaagugccauuuucuugaauauuucauuucauugccaugugaauauggaaaauuuaguucugccacuaaccuaacauucagcaaauggccagcaagccucuuuuggaaauaucuuacauuuggcugggaggcucuugaugagaaauacuaaucuguucuacucaucaaagugcuaguggcaagauagauagagcuaguuguuauuauaugacuaaggagaagucacauaaaaaugcugaaaagaagauguagguaauacuaccacaagaagccaaaaucucaaagcucuuuuuccuuacacaugaaaaggcaucuuccucuuacauguggagucauguuaauaauaagccuacaaauuucauauugaguuuuagaaaacucuguaugcauaacuacaaacuuccuguagauaauacguuaaauaaauaagauuaaauggugagugaagaguucauucagaaugauguuacaguguuucaggaauuuauaaauuucagaauguugucacuuuguuacaucauggaauuucuaacuuacacagcggcaacugcuuauccaagaguacaguagcaggccugccugccuucauuuuaguuucuauauucuuuuaugcuguguacguccuugcuuuguugagagagccacucagcacucuagguccucaagccuaacguugaauuguggugucguuugaagauauauagauuucaccauucuuuccaacugugucucuguguuucugccuaguucaauguaaaacacucgugaacuguggcauuuguuuuugaagucuaaaucaauuaaaaaaacuuuucaauauuuaaaaguauaaaggaaaucaguacccgaaauaggaaggaauccagagcuucaggaauguggcauuaucuuguauagauuuucuuugauggguaaauuuuauguuaaauguaaugaucuuuguuccagaguugauuuuuuuuauggaauuaauaaaaugaaaauuugaacauacauauaugugcuuaaaauauguaugugcaguuugaaagauacccugcacugucuaccaagauguagaauaaucaugaaauuauauaacuuuuuaauuucauuuuaguuugaugcuugggauugagcacagucuaccagugaucuguucuccaugcugcuaguuacauuuuacugccaggcaucugauguuuguaucaagacuuuuauuuuccuuuuuuuaaacuagauauuuucuuuauuuacauuucaaauguuacccccuuuuuccugguuuccccucagaacucccuaucuucucccccuccccaugcuucugugaggguguucaccacccacccauccacccauucucuccuccccgccuuggcauuccccuacacuggggcaucgagccuucacaggacuaagggccucuccucccacuggugcccuucagagccauccucugcugccuaugugacuggagccaugagucccuccauguguuguaucaagauuuucauuuagaagacucuacuuacccaauuaagucacauuuucagcaguuuaugaauagggucauucauaauucuucuuuuuuugagauaucuaaaacuguaccuguccuaauuuuuuaucuaaggaaaauguuacuugauuugaaagaaaguguuuuuaguuacccauaaaugggguuagaaaacacaauggagcaaauuagugccacagccauuucuccuauggucuagauuuugccuuucccuuuuggguucuggucgguuuacagauuuguauauugaugacuaauuuauauauuggauucacauuauuuuggaggcuguuuucaauuuacauacagcagccucugcuaaagaucuuaucacauguuuuaugucuuaauauauagguaauuguguuuguuguauggcucuauaauagaaauaaauaaauauaauguuauaagaaacauauaaauuaagggcuaacaguauuagggaauuuuugguaacuacuuaccuaccaauguggaaaauguuucuuugaguguguccuccaaaagaguugcugaagagaaaauacugguacuucucuugggaggauuuaucuauuagggguaggggugaucuauucuaggauuccagaaaugauaaggcaaauauauacccagggaauaauugcaguagguagaccugacuggaguauugaguucacauugcugggggaauauaguacaauucaaaggaaauauauugugaacucagaugaaucugucacugauguuuggaaguacuggaauaguaagggaagccaagauuuguugaggaaaacuauauggaugagcuaauuuguuaggggggacaggaaugucuauccauauaaaaagguaacagucauuaaucgaugagggcagauaagaauguaucaaaagacaguucuuccgugcaagaauuguguucauagauauaucaguuggaacugugcaccucacaaucuuuaguucucuauacgugaucaguuaggggauccaaugauaccuauuuguuucaaagagaaauuucugugaugagagguuauaguuagacuaauugugggaaaaggauaaauauuuagcauguuguuagggauuauacugguuuaguuguuguagguucucuuccaagauccauuacuucacuagccuuggguaguugguuagguuccauuacuugccccaagaucauauauacauacacacacauauaaguauaaauauauacacacauauacacacauauauagcuuacguuauauggaaaauuguguuuauggauucaggaauaucuauuauuauaccauauucaaauucauauagagaacaaggggucacuuaguaaguguuaggggggagaaaagggaagguugaaaaugauuuaauuauauuauaauuaaaaauuauuaaagcaguccuacauuuaaagcuaguagguaagugagaauaaaaaauguguaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaauggcuaagaucaaaaauucaggugacagcagaugcuggcgaggauuggagaaagaggaacacuccuccauuguuggugggauugcaagcuuguacaaccacucuggaaaucagucuggcgguuccucagaaaauuggacauaguacuaccggaggauccagcaauaccucuccugggcauauauccagaagaugucccaaccgguaagaaggacacaugcuccacuauguucauagcagccuuauuuauaauagccagaagcuggaaagaacccagaugccccucaacagaggaauggauacagaaaaugugguacauuuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaggauacccaagauauaagauacaauuuccuaaacacaugaaacucaagaagaaugaagacugaaguguggacacuaugccccuccuuagaauugggaacaaaacacccauggaaggaguuacagagacaaaguuuggagcugagacgaaaggauggaccaucuagagacugccauauccagggauccaccccauaaucagcuuccaaacguugacaccauugcauacacuagcaagauuuuaucgaaaggacccagauagagcugucucuugugagacuaugccggggccuagcaaacacagaaguggaugcucacagucagcuauuggauggaucacagggcucccaauggaggagcuagagaaaguacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacacgcaaauuguaaaugccccaguacaggggaaugccagggccaaaaaaaaugagaauggguggguagggaagugggggggaggguaugggggacuuuugggauagcauuggaaauguaauugaggaaaauauguaauaaaaaauauuuuuaaaaaaugugcaaaaauaaaaugucaacugaaggacuagcugcuuguaucugaaaagaauuuaaguuuuagcaaaucugauuuuaccuuugaaaugugaguaacguuaagucaagcauacacuuacacacgggagaauguaauuuguaagagacaucagcaauaaaccaagucauggcaagagaaacaacagaugugaaggcuacuauuagaacuuuggagccuaaagacaaaacggaauuaaagauuacagauagcacacaaugaccaaagguacauuuuguugagaagauggaaguggaaucuguuuaaagauagugauaaacugguggagaaaagucucccuacaaaccgagcugcaaggcaauaauucagggacguuagugauguggggcagggaacacugaucuuaagauaccugggucugggaaugcuaguuagucaugcccugcuuggccugugaguuauugugcaaggccagcuauucaguccugugacagcaagcaacgcuuuacaguuucuugguuuaguguaagcuuauguuuuaccuggcgccgaucucuguugugcugguguuaaguccaacacuugaugcugugaauuagugaaggucuuucugugcuguaucccuuuggaauuauuuccgaguuuccuagcuuucuguugaucagguauagcugaauuuccuucuagcuucuuccaguccacagcuugaugaaauuccucagcugaccuggaaauggagacucaaaucagugucucccucauacuagauggcugagugaugcuuaucagaagguauugguuauuauauugauuacuauugguuuaugcacuugguggauagcgcuccaacacucccauacagaaguaaagcauuuccccacucaguguuuuaugguuuuuccugacauccugguuaugaacaggauuuggagucacucggaccagguugaaauugggccguuugcaauuuuaaaaccuaauauuauuucuacaucuucaacuacaaaauauagugagaaauucaaacuucauagauuagagacucagaagaaugcuaauguuuauaaaacuucugauguuuaaauacugaguaguauguuugcuugcggccgaggcuuaaucacccuuaaacuuacuaaauaguguucguaggcuucagaagggcuuuucgaugacuaugguauuuaaaauaguuuaauguucaaugagugagcgaguacauaaucagaugagaccuugucucucugaaaagcauuuccuugaaucacagaauugaauuuuuuuuuaaaugauaugaaugaguucaaccgcauuaguguuauuagguauucuuaggaacuauuaugcuuucuguuccagauuucuauuuuucauggauguguuuagaauucugguaacuauaguugauccuagcacaggcuucaauccuuguggcucuguggugaguugaucuuauaaggaguaucuuuuguaaguaguguaaguaguuaaucacaaaacaguugcuuuuucuuuucuuuuuucuuuuuucuuuuuccucauuucaaggaaauuagcaguucuacuaagacuuugcaggucaggaguaccuuacucagccccacucucuuggccuuuauugauaggcuuacugucaugcuuauauauagugcuggcagaaugaugaagggucucagcauggguccugucauuaauucaccagggaccacuucgcuucugaaccuuucugaacccacacccuaauacaucuaaacagauaaugucuugccuagagcacaguaagugcucaguaaauauuaggccauugcugcuaaugcuguuguacuuuggaauaaugaggauuacaugcuaaguaaagauggauuuugacgaauucacucagcaugcuaccuggcauauuccaaugccuauaaacucacguucccugugaauugcuaacagggauauuauuuuaugguuguaauaaagcuuuucuuauaucuuugaguagaagaaugaacaucuagguuaauauauucuggaagucuaggaugacguacaauaaauugaacuccucauugugcuuauauagaugcuguugacugaguacuuggauaugaagaacacacgcaccgccucagagccaucagcccaacuaagcuaugccaguacuggacgagaguucgcagccuuuuuugccaagaagaaaccacagaggccaaagaauucucuuuucaaguagguaucacagaguggagagcuagcaugcugugaugagccagcucugaaaaggugggacccuuccccacccuccacagccacacauuuacuagcugaaacugccuagagcaauuuguaggaagugaacauauuuuauuuuuguaucccguugccuucugucagguaaaguggcuguuuuggaauggcuaucagacugucuauaacucugaguacauuuuuaaagcuucuuuuuaggaguuuuauacaaaaucaagaaaagugaaacuuuccaaguguuucuagagaauuuuauaugaaauuaaaggaaaugaaauauguuauccuugaaaaggcccaagugccaaaaaacaaccuuuguuuuuaauacagaaacaauccaaaaguuuuuacuuuuuucuuaauuaccaucuuagugaauucugccaagcugugugcucagaauguacaucucuuggugacaguuaauaguucauaaguuaagucugacauuaauaauacggauggcgggugcucauugaguacuuccuauguacaagauucuaugcauguggugaguuuaucaaaaugauuccaaucaagcaauuuaauuugguauuaaccgaauuuuagcaacuguaagcagcagaacguaaccuuuguuccuuacuaaguaaaacaacaguacucauaaagaaaagcugacaugugagaacaauuaaguaaguuauguaaugucacagagccagcaagugguugugagaauacagaaauggagagagaagccgcucacccugaaaucuaguucaugucuccagcugguugagaguaaagagccguaacacagcgacaaaucgcaguagccugcagacacuuuguuuuucccagaggugcucacauaaguacaugagaaagcacacacgaacuccacuugccgaggguccguauguccaugaucuuugagcuuaacaauacccauauucuguuucaucccuaauuugagggaugaucuucagaagccaucauacaauuuuauuuguaaaaggaaaaaagaaauaaguaugugguauauuuuauuucauauuucuacucagcuuuuaaacuuuugaaauuugcuucauuuuuaaacuugauuauaaauuauauuuaugcagcaguuuagcuccaaaagccacaagaacauauauauguguuuguaugugcacacacacacacacacacacacacacacacacgcacacgcacacaccagugcuauucucucuucaggcuugcacuccuguuuugcaagcauacuacugucccuuucuccucucacucaguuucucucuccuucccucccuaguucuuccccauuugcccuauguacuuguucuuucugugauaaauacuaagaucaaaaacacguuguggagggagggcauauuuggcuuagauuuccagcuuagaccauuacugaggaacucgggcaggaacugugugucaggagucaggauaacacugcuuacauauuugcucucuuucuuugggcuucucagccaacuuuuuaauacagugcaggucuacuugccuaaggauggugacacccacugugggcugagcuuuucuacaccaauuagcauuuaaaacauauggccaucuugucaagcaaugcuguucuuucuuaauguuuucuuuuuccagguugugucauguugacaacaaggacuaagcaguauaacuuucuaaauuccagcacaacagugccuucagggcuuucacaugucagcugucagccauugcugucuuugcuccagcaguguuggcuaaauuguuggauagggguauggguugggagugugugugugugggagucccuaauugguagaaauuaaaauuuuaaauaauucuuauauauuuauuauuauuguguagaaauaaaacucauuauugucccagauuuggacauuaaacagaucugcucauuuuaaguugguuucucuguuagugagccaugcaggucugaguaggucucaugucugcacuugccucaguggcuuuggcuaucaaauaaggaggugagacuaaagaaccucucgggccucuuuugcuauaaaauuaucucaguguaugacuuguugcaagcauaaagggaauucaugaauagcaagccugucaagucauaaaggccucagauugugcagagcuguaaucuguuucuagcuaaucugugaaggacuuuauuacccucuuuaauugcccuuagccaagguuaauuguguuuaaguucucucuuauuguagacauuuacuucuuuacucuaagcuugagaguuuguuuuuuccuuugcuaacucugaucaauagcugucagcaugcuuuuuggaggucaguggcuucuuuucugcacuugacuggcagguggcacuuuugaaguacugcacacuuugccuugcuuccggcucuucgugccucuuaguucuugguagggugcggaaagcggaucaaguaacugaaguguuuccuuccuaggcugauacucaucuugguauucauccuccuguagaggacuggauaaaagggacaugauuaagaaaaugaugcuccuuucuuguuguugccagucacugaguccaccgacuuucucccuaugcuguugacccuuuagaggcaaaauucuuagaauucuuuugucagcuucuuggcuuugaaaaucucagcuaugaaauggaaucuguuacucaugaaaggauuugcuauuugauauagucaucauuuuacuugguuuuauuuauaccugaaagcuauuuuuaugacugauuuguuuuguguuccuuguuuuagcuuuuggagacccauucuguaccauacauaagucuguuuccuauguuucugaccuuuguaaacaauuccuggagaauacuuaaauggugcuacagggcaggcgaaaccuagcagccauuuggaaaaaaucauuuuagacauuuagauagagaccagugaugccuugcuucuuugauaucgguggucuuuuuuaguauccucugugcauuaaucuuuuacuucaucaguucaggaagaaaacugcucugaagagccauuaugucugcugaggcagugguuaggcagugauggguuuugauuugaguaauagcauaauuggaaugacuuuguaggcuacucuuguugcuguagauguggucacgcucgcucuaagaugaugaugacaacaacgcugaugaugaucugaagguaacuggaauuggaggaggucagaggaacacuagcagggauauuauuuauaaagcaaggauugggcaacuuuucauguauagccaaaaugucacaauuguuacacaccagggaauguuauacagaccagaauagacuagaacuuuuugggagcauagagauggauggauggcaccuaugugggcuaaccaugugguauucugugcuguauuuuagguuugaaucauccucccaugcuaucagcaugagcgccuaucuccgagaacaaagaagggagcucuacagucggaguggagaacuccaggguaugugauucucuagaaaagucaguucauggaggauagucugcaauguguauagcaugugaguuuacggucuacauucacaaaguucuuuuuagacaacaaauucuagugaauucguaguccuuuuccauuaucaucugaugauuccccaacaucugcuaucaagcuucuaaaacuaauacuaagacuaaagaaugccuugccauugagguggaaauucuaagccgauguauugaagacagccugaguccaggcacauuuaaauacaaugcuagucuuauguuggccauuaugguuguccuuuguuuguuauuuuuaaagucuucuggaguauggcaggugggaaaggggaagcucagccucugucaugaaaagaguccacggauguucuggauagugugguuuaacauuguaaauugauacauggauacuugggacccauuugugguuacuagcaaguuuaauuugcagaggaaaauacuuugaaaauaaauuauaauauaaauaaaauaagauuugagccaacaauauuaccuuucguaacaacaacaacaagauacuaucuuaggguuucucuuacugugacuuucuucaccucaaccaaggcaacucuuagaaaggaaaacacuugauuggggauaacuugcagguucagaguuuuagucuguuaucaucauggcaggaaguauggaguugcacacauagacauggugcuggagaaggagcugagaguuguauaacuguaucaacaggcagagagagagagagagagagagaaggaaggaggaagggagggagggacugauggagggagggaaggaaggggggaggaaagggggaagagacagacagacagaagaccugccuugagcauaugaaaccucaaagcccacuccccagagauacccauccuccucugagacuucacauucuucacaaggcuaccccuccuaauuccugucaaguaguaccacucccuaaugaccuaauucaaguaucaaauauaugagccuaugggggccauuucuauucaaacugccacacuggacaugguaaaauauaaaauauaaagaaagauuugugaggguuuccuaagcauuauagguguuagaagaaauggaagucaaauauaaagaaauuuaagauagaaauuuaagcuccagguaacaaagugagacaugugugcaugccuauaugcacagucagcccaccuauccguacaaucuuuaugaagcugcaucuuugcugaacacauguauggcucuuuucuuuauagccuaaauacuuuaauagggcaacuauugcuauaguauuuguauuauauuagucauaacauagagaugauuucagguagcaaaagugaauguuuguaaguuauguguagauucuauacaugaguauuacuauccaaggcggaagaacaugcaaauacuguauacagauauuucgacaauagcauggggauauucauauuaauaacuuugguagaucacauguauagacuuacuagaggaguucagagaacagagugauaaucuuagaacuuaggacuuuaaaaauaaauggauaugaacacuuuuacaguccuuuaugcauugugcuguuuugauuauuuggcugugaauagccuacauaggcucuuauuuggucagacucaucauaguucuuucuuagaacacuauguaguaacuagacagccuuucuggguuuuaagacuuugucccuguaaucaucccaucuccaccuuuuuuuaucauccuauuaacauguaauguuuuuuccaaagucugcucuauucucacauaucucauuacaguaguugucucaaagagcauacuagccagaaauuuaaggcucacaacacauucugugagcauuggaaugagaguggcaucacaacauuuauuuacuugcuguuaagguguugugcauccugaucugcuucauggaggaguauaugguagaaaugaccccuucugucaggcauggagaggaacacaaugcugaccccagcucuagaagauggcugcuuccuaggagaagggcucuccuugaguggaauggagugacaguaguagugacauggcuuuguaggguugggaucuuguguaaggugcaguuuuuggacauaucauguauuuucaggcuaguggagcauuuuuuccuacuguccuguuuggcuugguuugaugguuuuguauguauguguguauuuacuugaugcuuuaaauuugacccuauaauuuuucugcaucugccuuauauuaaauccuuuuaacacuuacaagacccuccccuaaaguuaauuccugaucauuucauucuauuuaaaaaaaaugaaugacuauuucaaagggcaguuauagguugacucuauaauugaguaguaauuauagaguguguguaaggaucucuguccucagcagugucuuccaacaucaucgugcaccauagcagaaaugcucacuuagcacuucuagguaaaucagcccuuagauguaaucagugcagcagcagagucccugucugucacgcagguucauguuauuagugacuagugccacaagcuguuucugagacaguaagaauaguaagaacucagccaggcaugguggcgcacaccuuuaaucccagcacucgggaggcagaggcagacuuauuuaggaguucaaggccagccuggucuacaaagugaguuccaggauagccagggcuauacagagaaacccugucucaaaaaacaaacaaacaaacaaacaaacaaacaaacaaaaaagaauaggaagaacucugugguggacccuuguggauggacuuuucagguccucucugugguccaugaucucuugagagacaacauagcuagcagccaguucugagccuaaagugccuacauccaaaaucuagcucucaccacuagcugaucagccaggguaaguuauucuuccucuuugcucuugcuuuuguuuuuuucuucauggugauccugugaaggugcugugagaauuuggcuuuaauuagugcagaaggcaauauuuaguacaucauuaaugggauauuguccuucuaugcuguaguguucuuucuuguacugugacuccaaaucggcuucucuccccaucucuuucucucugugucucucugugucucuuucuuucuccauuucaguaucugucucugucucucccauacacacacacacacacacacacacacacacacacacagagagagagagagagagagagaaaaagagagagaguuugauucuguucuuucuccugcccccuuucuuaugcuaaaccuaaccugacuuccaagguaaacuuauuuguuacuuauucauucuagugagcucccuuccuuuccuuuccacucccacucuguuucauacacacauauacucuugggucuuggcuugcuguuugguguuuuacugccauguguuuucuguucucuuugugggugugucccauagcgcaccaugcaccaucauuaaccuggcagaguuuaugacaaagcaguaagcacaacacgugacaugccuuuauuucuccugcuuguuuacaguguuuguuagugcaaaugugcccuaaacaggcucacuguuagugaaugugugcggauaguugaggucugagauaggauagggauugccuuaguaggaggaagagccccaacaggagguguggaggcugacugccuuuaucuuuagguagguuuacuugcauuuccaaguuuaaggaggaaggaucaugcaugcauuuuuguccuuuauaguuuucuuacacauaaccauuauuaaguagaaacauuguucuugaguuaccaaccaccggaggaaccugcuguacauaaguggggcacaaauagaaauguuacaagauaggaaauggaagaaucacuauaaucuaacguucucuucccucaaaacguucccugaaauacugcacucuuuaccagaagucuguuuuacugaguguauucagagugcuuucaggaaugucuguggugacaaacagaaaugguuguuagcaagugcauuauguugauaguagccaugugcuuggggaggcaguggaucagcugacuagcguucgugaagcuuggaggguguuugguucaggagcacaaguuucucugaugagugcuuuuaacauuucagaggggaaaaaggagaaauuauaccuagucucuauuuuaaaauggcaguuucuuuucaguuaucuauuaauauaacugucccaaggaccacagcucacuuuuggaaaagccuaauugauuaguucuuccaaauccuaggagacuggccaagauuucugucucuucuuuuaaggccacauggcuauaggcuugguucauggggucagcuuuccccccauaaugugucaguacacuagaguuccuuuuaauggcuacuaucagcauguguggaauaauauaauugauaaacacauuuacuugugagauuuguugcuggggugcagcaaagaaauccaucauaaugaccaucaaaauggcauuaaaaagcucaaguuuuacaaaguuaaguucuugccagcaugugauuuaucaugcaauuaaaaaauguugcuuaaucuaccagugcacuaggggaaaaugaauuuaaaaaugagauuucuuugguacuaucagcccaucucaauuggcuuuuacuguucugauacagaugguucauuauauagccugccguuggcagucggacugaggagguggggugcuacuucagagugugugggauaacagguggaaauggaacuuguguaugcgucuauucaucacuggcuuccuguugcucugagccucuccacugcuucauuguacugcuuagacagcguuguuguagguagagaugaagcuuaguucuaaugaacauuuagcuuaccuuacauguccugucucgguuuuaacguguaaauguguggaauaauauaauugauaaacacauuuacucgugagauucagaaaaucaaaauacugccacucgugggcaagcagcucuugguugacucacgugaacugggccucagucuucugauauagcaaauaaagcuuuccaagucuggcugcucaaguagguguuaggacuauuaaguuucuuuugcugugcgacugagcucucaacucucguccacugagcugucaccuccaggucacagugacguccaugauggcagacuccugugucugcucucggacauuugucacacuuguccuuuccguugcuccuugcaccuuuggcucccccugcuugcgugaggguucuccagagcauguccucucagcauuugguccuagggugucuacucugcucacucuguaacucuccucaguuaccaucaguccagacaaagcuuccugagugccuaggaacaguagaucauugugucugugucuccugcccagauugcgcuaagguuuucugaccucccacccccgcuccucauccuguaauuguuucacacaacauuaaaacauuucugucauaauacucuucuuuggcaugccuugcuuacuuguuaacuuguuaaucuauaccuccuuccacccagaauacaaaucauacuauuuauuguugagguggaguugcccagauaaaaauguuauccagaauaaaguuuggaauaaauuagguucuuuaaaauauaggaugagaacuugugacauggagcauguauuaauauacacaagcaugcacaauuuuuuguguguauaugcucuuacuauucugccuacagauauauacacuuuacagugaagagagucuuuuccuauuuucugguuuguaggcauauguagaccuauuugauaaauuuuuauaauagguuuaagaaaccagagucagaauccugugauucaucuucccucuguuuucaagauaguaaggcucaugaguagaguuuauuaauggcuauugauucaggcagaaauguauauucuguuuugauuacaguuuuuuccccugucuuagggcuacuuagcuuucuguaugaacuugaggaucuuacuuuggagugcuagcuuuauucuuaucacuuggaugaguggcguuucucuaccucugacauuaaaagacuauaaucuccaacuccuggagaacugccuuugcuaaacuucacauaguaaauauggaaguacccaugucaggggaaacugggcucuuggacugacccagacuuccugaauuuuccuucugagggauuucaaugacuggaguugugaauauauaaugacacuguauguaauuaauguccuuguaggugcuuugucuucagguaagaccacauuugauauauauuaaccauggggauaugauccuuucuagaaaaggauuuauaauggcagucuccaaagcugcaaacugcucuguagugcggagcauuucgcagguaucauuugugugcaccuuuucaggggccuuugggauggagugaggugugguauucauugcagugacuuuauacucacacugcacauuuguucuacauucuuaaaugcaagaagcacuuggagaacuucauauccugaaauuugauuagaaaauucuuuguagucuuuuaauuuuuacuuaaugacuuuguuaauaacuaacaauaugcagaguacaugaaagaaguuccuuuuaugaaaauuacauauaauuauuucuaaauaacuuuaaucuuuuauauuaucucuucuguuuuagcugguaauauacuguaaaaauggauucccuuuuguguuuuuauauccuugcuuauaaaaagaaugaucuuaacuuacuuaugguaagauuugucaaauaaugaacuuauaauagaguuuguauaaauguuaauuucuucauuuguuucuaagaaguacuaagguauaaauagauuuuucucaaguuauggacagacuuaaggcacuaaugaaaucauuuaggaaauaaaaacuuuuuacucccaauuuuuauuaaguuuaccuaauguguuacccucuuuauguaauagagaaauuuauuuuauuuaaaaauguuugccaguuuuaaauuuaauuuacaaaaucaauaguuuuuuauugaaagaugcuggguuuauaugguuuccuauuuucacaggauugguuggggauggggcucacuguuaguugaaucaugugaaagaggcuggaauucaugaaaauaugugucuagaagguaaaagacagcugagugagaauuuugguuucuuaaaaacgcagaaaugcuguaagaauguauuauuuauuuauuuacaucccaaaugcuuccccaugcccaucccccccccauccccuucucagagucccuucugccuucccuucucugagaggguguggccucuuauguauccccccaccuugcuacaucaaaucuuugccagauuagacacacuugucucucacugaggccaaacaaggcaucccuggagacugagcugcaugucuauuccauaagagcccgugugugguuuuuuggcuaguggcucagucucugagagcucccacaggagcagguuaguugacucuguuggucuuccugugggguuccuauccccuucagguccuucaguucuuccuuuaagagucccuggccuccauucaauguuuggcuguggguaucugcaucuguuucagucuguugcuggguagagucuuucagaggacaguuaugcuaggaagcauaacagaguaucauuaauaaugucagggauugauacuugcccaugggauuguuuucaaguugggcugguuauuuguuggccauuccuucagcuuugucacugcauuucuuuuagacaggacaaauuuucggucuaaaguuuuguggguggcuugguguccccuucugcugggguuccugccuggcuacaguagguggcuucuuccaguuccugucaguacuguuaagcaucuuagguaaggucauccacauugacuccuggguguccucccccaucacaggucuuugggacuuacuauagauccccccaccuccaacucucacacuugauccuaccgacauucccccucccccucaccucuuccgcccaguuaucuccuacccccugccuccuaugacuauuuuccucuuuuaaguguuauucaaauauccucacuuggccuuccuccuccucuuccuccuccuccuccuucuuuuuuuuuuuuuuuuuuuuuuuugagacaggauuucucuguauagcccuggcuguccuggaacucacuuuguagaccaggcuggccucaaacucagaaauuugccugccucugccucccaagugcugggauuaaaggcaugcgccaccaccuggcgggccuuccuucuuguuuaacuucuuuggguuuggggauguaucaugggcauucuguaauuuauguuucaauccuagguguaggauaugggguugcuuuagauuguccacagcagcuaugauuugccuugugcuuuagcaggggugugaauaugccaguggcacauaguuucuaugauugugugauauuuggaauucuggggaguuuuccgaggauauauaaaugguagggcccuuagagguuggugggcugcuaguuggaggguugguggaaggaugcuguuguuuuguuauguaaucaugcacagagaagaaacaaagauugaaagaacagguuagauacccugauggcuaagaucaaauuugucccaaagaacuaaugcagcuaaucagcaggaaauacucuaaggcuauuguugcccccuuuccuaccucugacuuuaugucugucugucugucugucugucucccccccccccccaauguccuucuuucucuccaccuaguauugggggaagaagagaaguggagaagagaaaaaaaagagagaaaaagaagaacccacaaaguagcccaaaaucugacaacagucauuacaaagugauguggauauccucacuuguuauaagaacuuuggucauuauuaauagccuugcuuuaaaaccacuccauugcauucauuuauuuguugaauuacaagaaaaguagagauguuaauguuuccaaguuuaaaagccauaugugcauuuauacuauacuuuaauggcucucuuuuuuuuaaaagaaauuauaugaaaaauaauaaauucuaauguggucuugcaugauggcuuuuuaaaagaagauaaaaacaacuccugcaaucuaauuuucugaggugucauuugagguugugcauggguuucucucgcccgcacuggcugugagguguggauugcucccucccugcuuucuucagguugcauuuauuuuaugcaacucauacugaguugaauauuuuuagaaaacagaaaagaccauaaguauuauggcagguaaugaagacuguauuuauuaggauuucaugaggauggccaauaguugucucauaagacacaacucuuaggacuauuuuacauuuucaaaaugagguuucuauaagggagaaauuaccucauguaaccuauuaacaaaauucaaaagaaauugauauuaacaugcaggugguaguaucaauuauuuuagaaucuaaaaaauaaaauaguucuguuuguugauucagagcucacuaguccacugauccugcucgugcaaggucgaacaguccucuaaguagagagugaggauguuuauaggagagauggaaacgaagucucagagacaaaaguuaguaauugggagggcuauccagugaauacuguggcagccucaaguuuaauuugcauagucuuuauauacuuuacaauaucaugggaaacaaagucaugagcuagcagagacaauggcugacauacauuggcuaucuauacccuaucuggaugccucucuguuccuuccuccaagauuaacagaacauuaagccccuugccuugagcuucaaguguauccucucuuaucaucccaugcaucagcaggucaggaaaucugccaguagacucuggccugucuugaaucugccugacaggcaggcuuuucagaagcaggcuaaauggcuccugacaacuaguuagugcuuuucaggacuauucuuagcuauagaacacuuguccuguuuaagucugauuucacaguucagaagagagaauaaauuaaaguggacauaguuugaugagaaggacuuggguucacuggcccaccuguguaggcucuuaccgcuccuguccuuugcccuuuuuuguuguagaugccuggaaaaccauugucagccuuuauagacagucagaagcagauaaaucgccacacaccuuaaaacuuaauacacagagaggugacauuacagauugauaaaaggcagaugaaucaagaaacguggugugauaauugauuauccauauagaaaauaaaauugaauuugcucauuguaccauuuagaaaaauaagauuguaauggauugagaacucagauaugaaauguaaaauguauuaagaagacuuuucauagcaguacuuuucaaauagcacaaaccuagaaacagcucucauguucaucaacgggaggaugguuauguagagugcagaagguuuauacagggugcaguguaguggugaaagugaaugaauuauuguacagugacucaguuauacacaacaacauaagaaaacucauccccuccccccucccuugccccccccaucuuuguuucucucugucuguugguaugucuuugucuucacacaaauccaguaccuacaaaugaauuuagauggcugucagaagcggauagaaaugaagaguauauuacuuagguggccaucuuugagugauaaaauguacagaagcuaagcugaggaauuacacacaaacucagaaauauuccccacugaagccauagacucuguaggaccugugcugucuuuuuuauucuuuuuuuaaaauggugcaaaugucauaggcacuauuuuauauguuauacucucacauaaaguacagaaugaacaaguaauuaaaaaggcguauuguaaggccagaauauaacaucauguaucuuauuugauguuuguaucaucaaaucuggacuuuccuaacaguagggugaauuuuuuggccuguaccaucucauugaaaccugauuccccccacccccaaaucugugacuuccuccugagcucuuaacuaacuuaacuagcuccccagaagauaaugucugugucagguacuuuccucgugugucaccuguguugcuuucccucaagcuccacugugcagugguuaccaaggcugaguuggagucacuggcuggaauguguuuacuucuuauauuuuccuucccuguguauucauugguccuguacaacuucgugauauguuuacuugugcuaggcgcuuuucuaaauggcaggauucaauaaugugugaaacugagauaccaaagcuuuuaaauucagacuccauuuuagagaaccuggccuaacuuugaacucagguagacuaacaggcugguagcauuaguuuccaaguugccucccaacaaaaccucuaggcuaauccccaacaagaccagugucuccaggucauucccccaacaaaccugcaccccagguuauaagcccaccucuugccuauugaccaccaagguagaggggaaccgaaguuaaguucccagcaccagccaauuguguuaaaggccgcaguagcuuucugauuagcugcacagauauuaccugcuugcugcuuacuauaaaggcuugccccgauagacauucggggaucucccccgcccccaaaaccauccugaugguggugugccggggggggggggguugguguggauggaugcgagcuagcucaaauagaauauagacccugcugugaguugcaucagauuggcuuuugucuguuuuggggggaucaguagcauuuuccuggcacaacacagccaguuuuauaaacagcuauuguauaauucuacugugcuuuauauaaccauccuccuguguguguaaaagaaaagaaacagacuguucauaacccagacugacauuuacagccagcguuguuuuaccucaguucuguucucauacagucccugaauuuuacauaauuuuggggcuacauagacuaugaggacuucaaacauugucuacaucuagccacagguauaugauuuauuucuugccauaaguuaugagaaaagaauuguguguuacuucaggucacccauauaagagaagaaacagcaucuccuccuccagcccagcauguaugugaagacacgcuuguauuggaauguggugaggagcuucuuagauaaugcagaugagaguguacuauaaggacuaagagcuaagaaauagaaggagcucaggucuccuguccccugcagugcagcaccucugauguacucagcuggaggguuccaugcuaccccagagaggauagguucucuguguuguuucaaguuuucuguuuauuauuacuuccaguucuacuuagacucuagguucucaugccaaaacguaauggcaguauugugacacucaggguggaguuguauguuugcauaugcaaauguuagaagaggcagagccucccauccaucuggaaggcuuuucauauaaaaagggacaggcauuuccauugcugggcauaaauccgugaagggugcuagaggaaagcugccccucuuaacccaagguucagagugugaugcagacucuuucauuaaucagggagcuccauuuguauagauugauuuauacuuacucuaauuuguuacuuugggaaacagaugaugcagagcacaccaaaguaguugccacugcuuauccuaacauccaugagauuaacacacaguucugcagaagugaugauagggggauaaaggucguuagcaugugaacaaaugauaaauguuaucacgcacugacuuuucugaauauuggugaaguuucauauuuguacaacuuuauaaagacccauguagaaaauguaacauuuuuauauguagccauuauagagugaccuacuuggguauguuagaugaggcugggcaggacguaucuggagggaccauaucaugaaggaucagccuaacccauuucuaaagcaccuugauuuaaaaauagaauguuuuguuaaguugaaauggugguggcagcuuuguacuacauagaguuuucagaauucuucauguucacaucugauuuccaguuugugauuauggugugaaugaaaauacguaugaaguuacuucuggcuuccccacaaauuuaaacucaaaaagccauauuauacuaauauaugaaaugcuacaugaauauuguaauagucauaauauaggauguucauuccuagaauugugaugacaucuacugaauugcagccaguucauuugcauauucaugcccacuuagcucaaagaagucccuguuuguuugcacauuaaugucugguuucugcaucaguuaacuaauuuacauaucccuguucaguugguuagugauguucauguguggagcgcugguauagcucugugcuuugaguggcuugggaaauguuauagcuuaauggaggagcaccuaugucucauacuuuuacuucauggaccaguuguuuuacauguaagcuagauugcuuacauauuuguaauaugauacaagaaacacuuaccugcccauuucuaggguuuguauccauugccacauucacaguaaggagguagcaguaacauuucgagaccaguucuauucuggacucuacuucuggagggcuccuugugcaucucccguguaagaaggggcgguagguaugauagaagacaaaguucuaguaagugacacaacuuccuuuguagaucaaaggagaaaagacaauauuuucuuggaaagucauagaagacauuauagaggaaggggcuguaccucuaagguuaaaaaugagauaaccaccugaccaaggcaguuugagugaccaaauguaguuaauuggcuacacucuggagugguuguaccugaguccacagauaugggacugcccugcaguuauaaacauuuuauuuuggucaaagugaguguaugagaaggauuagaccuagggaugggaaaaaaaugaguagaucuuaaaagacuuuauaauauagcauaaagcuuguauuuucuccuaugaaugauaaucucugaggucucccuggaggagaaggagguagucaacuuuucauacuagaaaagugcucgaugucuguguggagacggaugugagcgcagugaaagcagugacgucacaaggugggcuccuacaagacuucuggcccucccaggacgaaugggaacagugucagaggcugauuugaaaaugcaugauuugaaauuccaguuguacauggaauucuuuguuguguuugaucuugagauacacauuuuggcucauuaacaguuuugcaaucuggugacuuagguacaugugaugucauuuguuuaagaaguuaauguaaguaagagagaaauucuccuuaaacuuuugucugucugucugucugucugucugucugucuaucuaucaauugaucauauaucuaucauuuauuauaugcauaugugugcauucauauaugaguguuuguaaguauguaugaaacuauauauguucauaagugucucaguguguguauaugacacaacauuuguaugaaugagcagacagcuuucaggaguugguucccuccucccaccauguagguguguauaucucgugggcugagaagugggggcuguauugagcuccaguugucagguuuggcaagugcccuuaguuguugagcgagcuugcuaggcuaggagaguaguugucaaugugauguuagauuaguaugaagauagcuaguguuugucaguuuguuuagagcuaucuaaucuagucacuagacugguacuccaacuuguucaaauguucacacugcuuuuagcaguuugugauugccuacaccauuuuuacucccaaguccaaagugagggagugauggcugucaucucgcccuuuuccuuuuuuuuuuuaauuuuaaaauuguaaacaauccccccccccuuuuuuuguaagcuuugauugaccuauuauuugcaggauagauuuuaaucucugaaauagauaaguuccuuauuuuuuguuccuagauggauucuguauuauuguauuaaaauccaguuuaccaauaucuuuucagauaaaauucucuaaaaucuugugcacacuacuuaaccaauuuucucaguugagaaaagaaauaaaauuauuccugaaagccuuguucaucuggaaaguuaaauguuuuuggacucuaaaucauuuguuguuuguuccucaaauaagcaucuuaggacuagucaaaugucuagaauaugguucuggaucaggcuugcuacaugguugauguucaaauuaccucuucucuauguugcuucauuuccuauacaaucaaaucagggcuaaaaagaaacaauuugaaauuguuuuaaaagaacauaaaaauuucagaaaagauguauguauauuuaucagaauuucucauaaaagaccauagauggaugauggauagaugggucaagagagagagagagagagagagagagagagagagagagagagagagagagagagagagagagagagaaagagagaaagagagaaagagagagagagacacuuagauauauaauaaguauaggcuagaagaauugaacucauuuaaccaugaagggagaaaagcccaugacguguaaacuggagacccaagaaagaaagaccauggugaaauuucauuuuaaacugaaagcuggagaaacaugggguagugauguaaaugccugucgaggguguaggccccagaacuagagcgauagaggaguagcuuagcuucugguugugguuguaagaagacagugcagugccagagacugggcaggaaggcacggucaucccagcaugagcaugcugccauggccccuucucacugaucugauauggccuccauggauaugaugcuuccuugauuaggaagguuuucuuuuccuaguccagggauucacaugguaauuucuuacaaaacuacucucacagacacucccagaaauaauacuuuaguagcuaucuaccugagcaucguuguacauuaaaguuaucacugagacagucaguuguauuuauagcuaacgugagauggaagguuggacuuuacuugggacucaagcagaauagacaucauuccuuacaagcaugguuguugaaggaggacugauagaaacaaaguuguuaaugagacaauccaucacucaguuaguuauggagacugugaggacccggaacucuuauugagaaccaguaauucuccccuucguaggccucuuguuaaucacuuaacaguuguaauauuagauguauugucuuaacagauguuuaacaucugaauuguggauaaguucaaucaugucuaaaacuauuuaaugugauaaacucaauagauauagugucuguaauggaaauggauuugguauaacaucuauggaauuaaaaucuccucuugcucacauguaagucaacauccuuuuuguuuuuuguuuuuguuguuguuuuuuuuuucauuuuuauuucuaggacauuuucuuuuuaaaagcagauauauugcccaaggggaagucuuaguuuauuuuaaguaucuuauguuuucuauauuuuaaaugguuuuugaguaggcucaaauuauauuugcuguguuuuauacuuugagcuaaauaauugcugcaaauauauuauaaguaauaguucaaaagguauuuuaucucuaguaagcauaccauuuauuagguaaaugcucuuuucugagugcccuccguuuaacuauucuuuguugauauuguuaucauuuuagauaaaaguacucguaguaaaauguuugaaguagucagugauagagauuucuccugcuucuuggcaguucgaucccugcuguuggcauauuccuuauuuucuaaugcugucacuucauuuugccuuuuucuccccuauagugaaauaauguuuguccuuuuuuacuuagcaaaaacucugugggauguauuuguuguuguauacguuguuuucuauuauucuguagcauuuccuccugugacugcaggagaacccauucucauuucuguagacuuugauuacucgcacuuggaguuucagguuauucugcuaaggaaagcuucguacuucguguucauuucucuuggguacauucagggguagcacugcugcaucuagaguuagguguuuagguuuaaaaaauacuaacacgucugauaaauacacauuuaucagacauuguauggaaauuccaauucuauauuuucagugccugguguuuuuaguugugcugggcaucugucccccuugcugacaggauuuccuuuuaaggaaucuaagcacccucuuguauuauucuuuuccaucucauucugacaacuuccuggauuuauuuaccuuuuagacuacauaucaauucacugauuuccaguauaucuuuccauaguaacuagauguguguccugauugugucgaagugguuuuauccagcguucuuaggaagcccuguuuguuguugcuugcuugucuguuugcauguuuauuugagucagggucauguuguauagcucugcuuggccuagcacuggacaaguagagcacuuuccucauagguaucacuuauuaauuucucaguaacuuugagguugaugucaauggcauuuauuuucaucucucuuggccauuacuuguucagugauguacaauuuugaauuauuccucuaaugcauauuugccauagguaucucuacaguugguaggcauauccauaaccuuguguaauuccuuucccaguguuggcaagaaucuguagcugugauaaauggucaguccuaugauuuucagacauuauauaaaaguaguggaagagguuugaauguuauuaagaauuaacuacaagggauguucauugucucuaacugguuuuguuaucagggacaguugagguuccuguuuuggguucuaaguauccuuaauaaauuaauuuuuaaaaggauucugaaggaaacucgagcucaguuuuauucuuuaggaagaaaacaauauacagaagcuguaauuugcagcauccucuaggaggaugggggauggaagaagaguggugacuuuauauuaguugugacauuaagagaaacugagacugccagagagucaaggagagcaugauuuggaaugcugagcugcagauggggaucauucacaagacucuccauucucucgauagaacagaagauugugccguggacacaugaacagagauggagcuagcacuuaagaaaggaaugaauuccacucaagaauggaagaggguugguggcuaaggaaagagcuccaugccuucagaugcuuggugcaugguguauagccuuuuauagucucugccuccccauuuguuuuucuugggcuuuuucuauucaagcucuguuccuuagauggagcccagccaagaaaaggcuucaagucuuccuuugcaaaguggcuucuucuauauugucauuuugguguuucaauaaagucccuauucagccauagccuuauuaagcaagcaagcuguuaaaggggacaagaaacaauacauaggacuuuuagaaguaaaguuuaauaaaaagagugguucacauuuucagggauaggguaaccaccauguaacauucacagggaaaacauggcccucaguucagaaccacaggaacugaauucucccgcaacuggaacaauuuacugagagggcuccagaacuuucaugagagugugaaccugaaccuucauugagauaugaggcucucuacuagaaucagcuugucugcaacaguauuuauaaccuguagaaauugugagaaugaugcacuauguuguauuaagcucuggauccacaguacuguguuaucuaucuguaggaaaccauugcacaauccaaucuugauacuacacaguucuuccuuugggacuccaagguuaauggauguuuauaaaugauuucucuuacuuuaagaaggaaaaugugaaccuguuuuuucuuuuccuauuccaaauugauucuagcucucagucuuaacaguuucucucuguauuucuaauucucuaugacuuuuguuucuuugggaaccuauagggaaaauauaugggguaagaaguuuucugugaaauaacguuugaaaaauauuuauagaauuuuuaaauguacaaguaaaaccuaaucauuguaacuguccaagaaaggguaaacagauuguguuucuuucucuuugguaucagucuuaguaagggauuuauuguuggaaagagacaucauggccacagcaacauuuacaaaggaaaacauuuuauuggggcuggcuuacaguuucagaucauuaguccauuaucaucauggugggaagccuuccauuguguaggcagacauggugcuggagucugagcugagaguucugcaucuugauccucaggcagcaggagacugugugccacacugaguguagucugggcauaggagaccucaaagcaugccucuagagugacacacuuacuucagcaaguucauauccauuucaacauggccacacuuccuaauaguuccacucucaauggccaagcaugcaaacauauggaucuuuggaugccauuccuauucauaucaccacaguaccuaacaaugaacuugucuaauuauaauuacucauggacuuccuugguugccacugccccaacccuacucuucuuuaauuugucuacucauuaaauagcacucugcacuggcuguugagccuggaugucaaccuggaggaacaucuuggcuccucuuuugccuccccugaauccaucaccagauccugaggaugcuucccagugcuuuuacaaaucccgauuuugagacuugcugcuuuuugaacuggucuuugcaaugaugaugcaguccucuggcuagcugagaggacucccuaugcuuucucugucgauuccuggucuuguaacaugcggcuugcuagcuucagaucauugagaaacaggugcuuuaagugaauaaccuucacccucugauaaaugaguucauccaggaugccgcugcuauaaucauaguugagugagacuuguuugaauuucuucauuugccuagcauacugugccauucaauuuuaauacccaccagcuguuuucauugaaaguuuagacacaucugauccagugcacuuauauuucauugaccaaguccacgugugauguuacaaucauguccacuucaaauaauauuuguggugauaggagacagguuaauagcugugaaaccaaaaggcuacuauacagaaaugcucagugucccaugauguugaauacuuggaaauccaucuaggaauguuaaucugagggcugcucuuacuugucagauaaaaaagaaaauuccuucccuucuugauaaguaugggauuuaagauauaaauuccagagaaugaaauacccuacacgaggauguugcugccucuuagaaauuagaccaaugauuaugaauauuagcuuuuagugcuuccaauggaaucuauucaucuuagauuuuucacacaugaauacacuguauuuauacuauuuccauaacuuccucuuuacaccguucaacuauuccugugccauuggcaucauuccuucucaaauucaugaucucaaauuguuaauaucucuccucucuccucuccucuccucuccucuccucuccucuccucuccucuccucuccucuccucuccucuccccgccccuccccuccccucccccuccuccuccccaguccccuucucuccccucccucuccuucuccccacauauacacccucccccagacacuuuaaugagucuaguuaguauugacuuuauuuauguaugucuagggcugaacaguuaggauugggagaccuaucaggggcccugcaccuagagaauacugauucccauucucaguauucucagcaccuauucacugccugaugcuagucaccagggguugggaccuugugaaaauuuacuccaucuacauuggcgugugaacaggugugaucuggugcaggaggcauauuguugagaguuuauggguauagcauuccugucauaucuaacagacucuugcagcuaugauccugguccucugacuuuuauagucuuuguagccugcuucucuuugauucccugagccuuagaaguagggcuugaauucugcucagcugggguuccuccaugcucacuuauucucuccauguugaccaguuguagaucucuguaguagacucucugagcugcaagaaaaagcugcuguuuugaagagugagggcuguacugacucagaaaguaguugcuguugccaguuucuauuucuuuuuaauuaugugucugggugugacugugugcaaguccugguggcuagagaggcgagaagaugguguaggauccccuuuagcuagagguauaggcuguccugaacacaaaaguggguccugguuuccuuacagcauacugaauuucagucccuguaaaauugaagagccuuuacccacagagccaucuuuccagaacccaagaaucuuuaauuuugauuaauuuaccauuugucacucagggaccuuccauaucugacauagauuaucuuuuuauuaucuucacauuuuaguggagaaacuccuuuucucauacuagauuagcuucaauuauaguaaucaucuuucaaauaguuauuugaaauuauuuguuuaaaguguggguuuauuguuuuuauaccaugcagcuagaggccaaguucuuguguucuuuuguaaggcugagaugcuuuaugucacagguuagcaugagauuucuagauggagugaaaucaucuugucuacgauuuugugacuggcuucucucucucugucucucugucucucugucucucugucucucucucucucucucucucacucucuugcucucucucgcucuuuugcucucucuugcucucucuucccuccccuuccccucccccuccccucccucccucccucccucccucccucccucccucccuuccuucuuucuuuccuacccaaugauuugaccuucucuugaauaacuggcugauucaggguuuguuuccucucauggaugaguaguacucuguugugugaacaugucacauaguguuuaaccugucaguuguugauuugcauugauucugucccucgguuucugacccugugaaugcuauguuacaaacauauguucacauuuuugugugagacaagcauuuuuaaauucauuaggaauauauagaaguuggauugcagguucaagcaugacauuacuuuugcuuaacuuuuuaagaaaccaaguagguuuccaaagugaguguauuuuauauuccugccugcaguguaugccaaaguuugauauugucugucuucucaaugugagacauccaagugaauaucuaguuguaucauugugguuagugugucucuuuuuaacguaacaucuuagagauguaugagacuauagagaugcccauuugauucuuuuauuuccaaauuagaauuggcuacuaauccuuuuuauuucauauaauuaguuuaaaccccuaauuuuaugucauuuccuuuggaauacaucauauauaccuucauuaaguuuuaaaaauauaggauaguuauauguauuuauauuauaagccccuagaaaagcuauauguuaauuuacuuauauuuuaaaaauagugcuuacugaaacacuuauuccuauguauauaucugaugucauaauuaucugaaagucugugaguuuguucugaagaaguccugcucuaaagcuaagccuuuagccaaugguuuacaguaaccacagggcucauguaaaauguggcuaauuaagauucuucauguuugagcgccaccauguagguacaugguaucuuacacccacuagcuguaaauuaaaacuugcagaauaugagccucagcccaugcaaaaugaaguuauguauaggugacuugcucuguuugaauuaaugaaggggcugcugguaucgaccagcugugcucucugaugacaaaaacgagucuugacauuuuggguaaugaaaauucaguucagcaccucuuagagauauguaugauaauauauugucagucagaaaagacagaagagaagcacaaaccuggucuuauuaaaauggugugacauguggacacugcucgaucucugcuuucuagggggaaugugucaggggaaaccucuuuuuaagaugauaggaauaacucucuuguggaacgggggagaggauuugacuuugguacaugaccucuuugauaguugccuuuguucaugauuccuaguuuuguggcuuguuuuacuggguacagggugagacaugaaagcucuggaaaggauacuggccuuuuuggcuugacaguauuaaugcaauugucuaguucauaccuuguaagcccacucauuauuuccucugcauguguuucucuaguuuagcggauuagcugcacugucucuucaaaggcuauccaaucaaggagggguuauuaaaaccagggcgauuuaugacugagaauuaauuagagaagcauuuucaugcaaaacauccaauuuuuugauuagcaguggagcagggccgcaauuagcacucuaggaagcuuaaauuuccagcuuuuugauucucaggaaaugagauuaucaaaccagggucagacacuugacagcaaagcgagagugggggagugugaaauuauaucuuaaaaaaaguucuuugauuuugauucugagauugcuauucaggaaauaaaaaauucagaagaggagaaagacaagaaaaucucagagugcaagggcugcaggccugguucuucaguggccuguuuguugugcagacugucaguuauaaaugugugugcagagacuugauagauguaaacuagugggcuuugucucuuuauuauuauuuauuauuuaaucccccuuuaauaaguuucuuuugguauacaaugucugaaccaauaucuaaaacguuuguaugcauuggagugaagccauuuuucuucuauuaggaaaugacacuuaguuucuaaaugauggcuugcuaauuuaaguaucuauucaauuuuuguugguguuuuuaauuauuucaaaucgcuucugaagugaggcauaguuuaaguagugaguaaugucaagucauagacuaccacuuauugauaagugaccuuugucaagccaggugucugagugagauaaagaauaaggcugcaucagaccugcuguaaaccaaaguauauucuaucauuaauauaacugguuuuuacuagggaggugcaacauaaugaaauucauuuguucuauaaaauauuugucaccuuuugucuucuuaauuuagacuucuaauuuuaguuggaaauagaagaacaauguaucauuugucuuagcccaguguguaguuaaaacucauaugucucuuuaaucauuggguuuugcgcuccucacagaaacauagagacccuuaucuguuguuucaauacucaaccaucucuucacugcccugucuuucguaguuaccaugcccuuaaaacucuaugcguaguuucuaaauacuacagcccauuuaguucacuugugugugcucuuauggauugcuugcuuugucauuugcgggcaccauuaauauuauagacucagguagaacacugguaaagaagccuucuuuggucugaauggggauggugcugaccauuagugggucuguuauaccagccuugcuuucuccuuuuauugucagguugugcaguuauuuuuaaaaccagcuugguaagcauauuccauacccugcuaaccaugacuagaagagacagacacacagcucuuauacaaucagagacuucuacuauugcaauuuucuuccugaaacauguuauauaauuuuugcaauuucacuuuugauucucagcuuugugccucauucuugcucauuucuuuucuuuuuuugaagaguaucuaucacagacuaguuagauaaaaauuagcuguuguuuaaucuuguggaagaagaacugccagucagaggucaaagaguagacaauguuggauuuauaacuaucagguugagugcucauguuuggagauguugaugaauaugcuuuuuaguguucaauaaaauauuuguuuaaaacauguuuuguuuuauauuuauagcuauuuucuuuguugaagaaugacuacauauuuccaauacugagagagagagagagagagagagagagagagaaagagagagagagagagaugaauuagauaaucuuaacuuuuguguuuaugugccgggguaaacacuaauguguaucauuccgggagcccaugacacccugcaguauuugcagauuuguggaugagaggccaguauauugcuuuuauuaagcuugcaaaaugcuuucauuauuuuugcauguaugauuacacacaagcgaccauccaaauauguauccuauuugauuucuauacugaguguuauuacuuguagaagaaaacauuaaaacaacuuaagucaaauguaaaauaauauaauuuuaaaaauuagcaauauuaauauucaagguaaguagaaauaauagcauuuauuaauguucaggaaaauuuaaccaaaauuguguaauaauuaaauaugaaucaguuuuaaaauaaaaauaauuuguuacuuaguaaaguaggcaagccaggcuaaucuaaagauauuuccucaguaugaagcuuuuuaaaauuacaguuugucauagcuuugucuauuaauuaauuaagaaaauugauuugauuuaagagacauauaguuaguaauauacacauuauauggacucuccaguggugcugugauaguguugggugcuguccugaaagcccacugcuuugucugauguacguuauguguagucuauauggugauguaugguugauguggaccaaggcuauuucaaaacaugcuaauggugaguagaaaggaaugcuuuuaagccuuucaaguucauuuaauuaacauuuaauaauaauagagguguguauguguaugauuuaguaaaaaaaagauccagcuaauuugccauuaauuauacaaauauuuauuuggugagauucucugccacggacuucugaaauucucuuuagucuuaacuugcuauugaaguccuugaauugauagggcguccucuuuuagugaagauaauguaaggaugaagaaacucauuuucuuaagcauauaaucagucuaauugauguuuuuauguguuuguaagcacaugguacauuuauaggccuuugagguuaggacucuagaguucacauacuagguugggagagaaacacacaguauuugaaauaggugaacagucuauuguggugauguggaguuguuaagcuuuuuaaguaagaauaaguggaaagaaauauugaagacuaacuaaagagaauaaacugacagauggccacuacuugacuaaaguagauacaagucucaggagcgucaggcauugcucaagcggaaggguaggcagguagacucgugagucagagccauccacuucagcuuuuaaauaacuuaccugagugcauucuuuccagagcucgcaaccauauuuuucauuuucuuuaaguguucaucugccaguuuuuauaacuguaccucccugagugucuuaugugcaaauuuucaguuuauuuuagugguuuccuagucuguuguugcuugccagauaccgaauuagaauuguaaccuuuuguagccauuauuuaaaaugaugaguggaaauguuuuguuuucuugguaggaaaugaguuagaacuaugaaaguuuuccuaaagcaacaccaacagugacugucuguaucuccuaugagcuucucuaaacuuugaccugcuaauaucagcaccuaggaaaggagugaaagagcccaccuacauucugacugcuaacacugcagcuaccguaguguuucagaguuaucucuaacugcuuuauggcaaaauaacaaaagcuugauguucuguagcuggauucccuuaaauaauauaaaagaaagggcagggguuaaaagugacuaguagcuucuaugacuuugcacauuccucugagggcacuuuaauugcuauaauuuugugauucauucaguuuaauuguguuaaguauuucugaggucucuugcucauuccuuuugcaguugaugcccaucagcagcauuaaacacaugaaguagaaacuaucuccugucuauaacgucaaugggauagauaaauauauugaaaagaacuacuuuaccuacaugucuuuaaaauguuacaauggaacacaugcucaagagauauuuuguuuauuuauuuuugucuguuuuguuuguuugauuguuugagaccuggucucucuuuguaacucugacuguccaggaacucacucugucauccaggcuggccucauuuagaguaacaucgcucugccuccugaaugcugggauuaaagguuucuugcuuuacucaagaaauauuuucaaaauuacuuuuuucuauaguggcuggcugugaugguuuguauaugcuuggcccagggaguggcauuauuaggaguuguggccuuuuuggaguagguaugucaaugugggcaugggcuuuaagacccucguccuagcugccuggaagucagucuucuccuuguggccuacacaugaaguuguggaacucucagugugcuccccugcacauugcuaugaucuggcuuuaaugauaaugcauugagccucugagccuguaugccagcgcuaauuaaaugcuguccuuuauaagacuugccuuggacaaggugucuaugcacauaguaaaacacuagcuaagaucccggcuuauuguauuauauauguaguuaaugauagaucauauuuuagaauaucuaaauacauuaugaaaauauauuucuugguauugauacuugauagauuuauauuuucggugaaaguucuugacaucaauguaguuacugugauguacccauauacauucuuaagguuugaauaaaucucagugauguggggucucuugaaaacauuguauucuguaucuccacauaagacuacgaagcaucuuuugagauaacugaaucuaguuuuaaaacuuagaaagccaguuucuacuaccuagugaguucugugccagucugcgguacaugagauugugucucuacuucucccuucuccuccucuuucuccucuuuuuccaaucccucauccucuuacagcaguaacaacaaacuacuguccaaagcacaugcagugaaaaguguaaguauuguguaagugcaggcacaugugucucagaggcaaaugcuaugagcauuugcgaaugagcagucccauucuccugaaagcugcauauaauaugauuaaguucuucauuuuuauguauuugaauuuuuacauacuucaacuucuucuauuuuaaaaauguuacagcgaacuuguggguauuccuuaaaaguauauaucuagaagggacuaacaagauaauccuaaauaggauuuaauuugggauaauccuaaauuugguagagucugaauacuuucuaaaaucguucaucagccugaauuauuugcaaaagucuauggccauggaugauuccuuucauccuucacaccgcuuuugauaccuuaucaguuuuacaauuguaagcauuuuuaaguuuucugaauuccccauguagaggaauuuuaauccagcaacauggcugcucuggcaugggauuacauccaaagauaugaucugccugggauacagauaugcuauggauuauaguaugauauggauggaguacagacaugcccuuaguacauaccuuuaauuccuagcagugaagguaagcuuauuuuguagaaggaaacaccuauguuugagagcgauaucuaaugaagggacaaaguaacaaaccagagaaagauuugacagaaugagucagagauaggauacgcccaacucacaggagaacagacagaaagagagccuacuuaagagcagagagagaaaaaauuuggugguuugguagguggugagguaugucucucucucugucucugucuaucugucucugucuuugucucucucucuaauacacacacacacacacacacacacacacacacacugucuuugugaauuuaacuuggacaguuuuacagugguaaguuacagagugaauaaacuaaacacagguaaagacagaaugagccagagaaagagaaggagccaaaagauuagaacauauugccaaaguuaguaugugggcaggcagagcaauuuagucagaagcugagagaaaccaaauuauaucagucagcuuguaagguuagauugcauggaggcuagaagcuugcaggcauaggcaugguuagaauagagaaggaaaugcacugggcucugcccuagugcuguauuuacucucaucucacuguuucaucugaggaaauaacaguuacauuagguuagauugcauggaggcuagaagcuugcaggcauaggcaugguuagaauagagaaggaaaugcacugggcucugcccuagugcuguaucauucucaccucacuguuucaucugaggaaauaacaguuauauuuacacccccaacuugauaggaauauacuuuggguuauuauuuggaaaagcgauaaaauucagauuguaaacaggcaggauucuuuaucuuuacaagaacuucauauaccuguaaagccauuauaauaaagaccuguagacggcauugcccgaauccuuuuacuuuguauaucuguaaauuagcauuuccaacgucuuccugaagcuguucccccgauacaaggaauauacuucaggaacuguauaauaagucuuagaguaaaaugagggaagacagagauagccaggauaagcaugccugccuccucugacuacuuuugcuucuucaacacuuuaguacccagaaaguauucaauucccuuguaguauaucgaaucuaauagaaucaugcaugugcauuaccagaucaucugaauuacauccuucucccuggguccacagcaauuugaaaagauacacccccaucaaaugacauaagaccuguaucuauaguaacaaauuaacaauuuauaauugcaaguuuguauauaucuccuucauuugaguuuuauccaggaaucacacaacugaagaugaagaaugcucaguauaaggagugaagggcuaguugcuaagcuuucauucaucagagauuucagacuaauucugaaucaaaaguaaggaauagcuuuaguuauuuacaaagcauacucauucuugaccauaauaaaauccuuucagaauauauuaucuuugcaauagauuuuuagcuggacuauagugucaguuuuaauuucuguuguuguuguuguucuuucuuucuuucuuucuuucuuucuuucuuucuuucuuucuuucuuucuuucuuuuuuuuuucuuuuuuuuuuuuuuuuuuggucuaagcaauaguagcaaccuuucugugacccguccugauccuugacaguaagucaucaacacagccucagauaaaucuacuggguucugagguucuguggaaaagacaugagaucuccaauggaugcuaagaauuggaaggagcaaaggcagggaagucacaaggacugagucaggacagagguuaggguagauaagggagggaagaaaguagguuauguugaagcaagauccuucaacauugucuuaccagucauaugacuuggagagucaguuuuucuaagccucugguacauuaagagguuauaauauguuugacuaguugggaagugggaucuauuaguugggguucucuagaguaaacuaguuaugucuauuuuuuacuugaaugacuuccaugcugaacucuagcuaucccaaccuugacugacuaaacaaaguucaagaaucuuuagcuggucuucaauguguucuaaacuccuaaagaagugcucucuagugacagugaaggaauggaugugguagaaaagugaacgcaagcagagaaagugcaaaauauuccuuuauguccuaauguaagcuuccagaagaaagugugacaaagauuaaugccuucccuccuaaagaucuagauuaaaggugugucuuuacaccucauaaguccagacuagaaguggauucacucauuuuaauucaagccaaagugucacagcuaugcccuuuauuucuggauuguaguuuauuccagauauagucaaguuggcaaccaagaguagccaucacauagagcuuaauagaaucuguagaaucaggaagcagaagucacuauggaauuuccagagaaugucagauaagaagguuuaaacuucuuaucugagaggaagaauaagaacaacaacauuaaaagucaagccaagggucaaugccugcugcuacaaauuaucugcuauggucagaaaacaaaacaagaaugaacauucuacaucauauuaccuguuuaagaagauugagcaggucauaaguuuugucacuguauccaaaucucuguguuagaacuuugaaucuugccgggcauugguggagcacaccuugaaucccagcacuugggaggcagaagcagaggcaggcggauuucugaguucgaggccagccuggucuacaaagugaguuccaggacaggcagggcuauacagagaaacccugucucgaaacccccccccccaaaaaaaaaaaaaagaacuuugaaucuuccuuuaaaucaguuugaaaucaaauagcaguuaguauuuuccuuugcagauguauauauuacuauauaguaggcugcuccaaagaucaucaaacaucagauauuuauuauuguucauaucuuucuauuaacugguucauucucaggauuugaaccacucagaugggauuagcuguuguaagguuguguccucugguauaacugggaccuugauuuacagugccugccauuauucaagaagauagcugggucuucuucccaugacaucaugucuccugugcuuaugugcccaucaaguauuuuugagucacauuugcuaauaacucacauuugaagaauugaaaguuagggaaauguuuauucucuuugucugucugucugucugucugucugucucugucucuugucucucugucucugucgcucucucuguguauguguguguguuaugggaggcaguguagaaucauaaagucucacaagucaaguaauaaguuuggcuuucauuucuuauauuaccaaaucaaaaaauuuuaauuaugaaucaucucccuuuuagguuuccaucuugaguaaauuguaugaaauauauaaaauaaaaaauaaaaaaacacugcaaauuuguacucauugcaacuccagagaauugcagauagggacuguaacaugucugcacauuuuuaguuagccacauugcucagagugcagugaaaaaguagcaucuacuucaauguuaaagaggaaguauagguaaaugaaauuucaugaggcauuagagaacguuaggcaguaauuuaaauguuuuauggagauagcaagaggaaauacuuaucauaaauaaaaaucagggcaugaauuuaaguagcacaaccucaaagauauaaauccaacauauagaguagguagguauucauuaucuauaaaccuugagaaaauuuauugaaaaaaguaaucaaaguagaaaaauagccaagcagaaaggguauucaugagauguugucauagaaacagaggauauuucaggauauuccugagaaucauaguuuagagaaguugggcauuuguaggacaccacaucugcagccauuggcagcagaugcgguuuccuaagacccuaugcaaaggaagggaugguguccgaggaaucagauacacucgaauuagugcaaaaccaacuuuaaaaucuaccaagcuuccucccuuuuaugcaacaaaauuaauuauggauggauaaaauauuaagcgcaaauaaaacuacaaaauguguagguaagcauaaacaugucucagauguuugcuauacaaauucuuguacuugagcauaaugaaaaaucucugagaaaccucaaaccuaccauaauucaagcauuccuaguuaauagucaaaauuaaauugaacaaaauuguaaugaauuuggcucccaaaauuuauucauuacgagcuuccauaaaacuuuuucucuauuuuuuuauugaaaauagguuuauucauauaauauauucugauuaugguuucgugccccaugacuccuguguuucuccaccuucucucucacuaagauccucacccuuucugucucuccuuagaaaaucaccagauauuuaaauaauaaauaauaacaauaaaguacaguaugauaaaaccaaaccacacacauuagaauauuacaagacacaaggaaagggggcagaaaaucauaguaaagcagaagacgcauagacgaggagucaugguuagaccuggaaguuauuaaaaaaaaaacccugacaaaaacuucugagacaaaacuugaaggcugcccaugcauuuguuguuuuagcccuucucuguuguggaugggacaugcucuuaggagugauuuguaucccugugaggcucuguuugggaagauucauuuuucacuugugagugguuaucaaguggagauagguucugaguuugggaugggggcuugugucuccacuucucucugagagcugagccuccaucugauucagaccugugcaggcuguguguguacucccacagugucugugugugugugugugugcacugcucuggcuuuguuuaggcagccuugagucuuugguguugaccauccguucuucucuuacagucuuuccagcauguuuucugcaguguuaccugaucccugagggcagagauuugauggagacaucccgcauaggacugaaagucgcaagaucucucccuguccacacguucugugguuguagaccuuuguauuugucacaucuacuguaggaggaagcuucucugaugaagucugagcaaggcacucaaucauuaguguaguagaauguugucaggggccauuuuauugcuauguuccuuuagcagaagacugauauuugguuuuccucuaagucccuggccuaucuagucucacauucuuggccacaaggguagugucgggauagauaacugcucauugagggagcuuuaaaugcaaucagauuuuuuuucuuuuuucuggcuauugcuacaagcuuugugccacuguugcacuacugauuguuguagacaggucucacuguaggcugaaggguuccuuccaguaucaugaaugguagugcagaggaacaagggcacuaagucggaaccagcccaauuacuguguucaguaaguuguauaguuguauucagcaacauuuucaacuuuacuaaccauuuagggagaacaaucaauaguguggguuguuuauuggucacaugugcccacuuuggccuucaacugauuuacauauaaccauuccaacuuuacauguguuauagccucauauuuaccauauuauuuauaauacuuuuucauuuuuaaauuuuaacgucauuugggauauaguguauguguguguuuguguguguaugauugugugugcccaugcauacauaugaccacauuuguggcuauaauuuuuaaauuuuugucuuuuuaugaacaguuuagcuuauacaaguaaccugguaaauauuuaaauaugaaugcauagauucugagacuccuguuuucuccugcucugaaauucaguugaugaguuuguugaugaagaaacagauugggggaaaaugggggaaagugcuugguaaauaauagugcauauuaaauguuuuguuauaaaaauauuuaaaaaucugaucuuuauguuucacuaaaaaaugaauggccauugaagccacaauaugcaguguauauaaugaguaauuucaguguaaacuaaaguuaauaaaccauuugcugccauuuuaaauuuucuccaccuugauuugcauuauaugucuccuacauuuucccuccccucuugccuuuccuuucuuccuuccuuuccaaucuuucuccucucucccuuucacauacucucuccuuccugccaacaaucucagcuagugugaagguuuugaauuucauuuauuauuuguccuauuuagccauaaaagucauucaguuguuuauuugagaguacacuaguguggugggaauguguucugaugcaggcugcuuccuguuaugaggauguguugugugggauagugacuccucagggcuuugagugcuugcuacauagucucuguagugaacugagccagugugaaauuagauagugcaacugauaguguuuccaaauuuucaaaaaggcauuuaaauaaaccaauuuuugacuuuuauuguguugaguacaccucuacucauuuguacaguaacuucuuaagcuguuuccuaccaugggaaauacuaguugaaagacuugaaaucuugaaaauuugcuugauuugaguguguguuuguguguguuuguguguaacaauuaaaauuuuguuuguaaaucugucuuccauccacaaagaauaacauuuucuuuaaugauuuucucuuuucaaguauucaauuuugcaaacuucaaagauuuccugguuacaaauucugagaguauuuguuugcauuuauuuauauauuucuacagauuuugaaguuccuguguacccccaaugcauuucaacucuauuggggauaaacaagcauaacccuagaacaacaccuccaggguauauccauuguacuuaugauugguuaaauauuccucuuuugaguaucuauaucuauuucuguaacuuuguuacaauaaugcaguagguuccauuuaacuaaaauuggauguaauuaucuuaucuuaggaccuuuauugauuaaaauaaaaguuaguaaauguguuuccucaaggccaauauucccuuuuugccauuaguaaaucucaagagguaaaaguaaaguuuacuacaauuuacaauuuacaauugagugacuuguaaucacucuaaugugcuaauuuuuaauuucuggagcuagcaaaaguucaucuaagccaaguccugcagcaaagccuuccaaggcagguguaggcaucacuguaucugucuucagugugcacugacgcucuucagggugcuuuauauguguuauuuguuugaguuuuagccauaacuuuguaguaauuuuucuccauuauaaacauuaccuauaaugaauuucaggaaacacaacaauagcuucugcagcuuguagacaaagacaguaauaugauggaaugaucaaauacaaaugcuccuuuaauuuauuuuaccaagacauuuauacauguuuuauuuauaaggcaauugaagucauuuauuuuguauggaauucuucuucuucugaauaacaaauaauauauuaucauauauaccacauuguaggagggaaugaugaaagccauauuugaaaaugaaaguuuaauauuuggggcucauugggcacaauuauaguugguacucucuuuuuuucaaggaaaucauaauuccaugugcagaguuuucaaaaauagaaugacaugcagcacagaggaauguauucaagagggaaagaauggcuuucuuuugcuuauucuucccucccuuccucccuuccucccugucuuccucccuuucucuuccucucccucuccuuuccucucccuccccuccccuccccuccccuucccuccccuccccuccccuccccuccuuuucccuucccuuuccuuucuuguugcuuuuccuaucuacagaacauuuuaaauacacaaaauucuaugguaucccccuaacuuaucuucaguuuaaauuccagcuaauguguauaaugugcuauaggguccccauguucugauugcuugaaagucuagcacaacagaauuuuuaaagcgggaaaaaaucaaacuugaaaaaaguuaaaacuucacaaccucauaaaauaaugaccuugagcuuuuaaaauagauucuaccacauuaaguucaguaaacuuuugaauaugcuaaguucuauguacuuugguuuggugagagucauuuaacgcugauauuccuuuauaaucuuucuauccuauuuuugucuaaaacaagauuaugagucauggagcccuguguacuccucaaaauaacguuuuuaaguguauuaaggaguccaucauauagaaagaaccgccuguauucaaauauacuuauaauaaauaacaaauuauaauaacaugucuaauaaucauauaauuacagcacuguguuauaaaauuauuuuuguuuuuauuucugagaaauuguuauccuaauauaauugcuuaugauugugaucauaguuaaauaguuuauauuugugcucauacauuucaguucuagccuuauccuucagcuugaaaagcucucuuucuauaagaagaaacucugccucuaucacacuuccuuuuagcuguuccucuagggauagacaaguuacuuugguguuauuccugaagggcuacauuggcagaagaggucugauuuuuugacagaagugacacauaauugguguauuauuuuuucauuccaauaacuggcacaugcuucccucacaaggccagaacauuauuguuacccagccuguugaaagguuuaaagguccuuucccucccucccucccucccucccucccucccucccucauucccuuuccucuuucuuucuuucuuucuuucuuucuuucuuucuuucuuucuuucuuucuuucuuucuuucuuucuuucucucucucucucucucucucucucucucucucucucucucucucucucucucucucuuucuuucuuucuuucuuucuuucguuuuucucuuacucaguauguagaccaggcagaaaacucacaacaaucugccugccucuaccuccucaguguuggaauuaaaggugugugccaccacuggcauugaggaaguucuuauuucaaugagauugaauagaucaaagcauaagugaguuaaucagaaauccuuacuguucuuuucaauuuauuuauaugaauuaaguacauuuauaauauuuauuaauuauauauuauauauuaauauuuauauuauauuuauauuaauaggggcccauuggucuugcaaacuuuauaugccuauguacagggguacgccaggguaaagaagugggaguggguagguaggggagcagggagcggggaggguagaggggacuuucaggauagcauuugaaauguaaaugaagaaaauaucuaauaaaaaaugaaaagaaaaaaaaaaaacaucugacacaagucccgaaaggguaaaaaugugcauuggaauauuaagugcauuucuaaauauugacucucuccuuccaaguugauaucagcuaugagaucaucagaagacuagggagauauggcauuggguugacaaaguguugagacuuacucaaagguaggugaucauuuaauauuuuuagucagacagccucagagcaguacugagagucagaggccuauugguaccuacuguagaguccgguuaguugucccuaaccagaaacuugauacaaaauauuuucaaacuaaaaaagucagagucagugugguuuucugaacuaaagaauagagaaaaacgugaaugugacauggaagaaaaagaucccgugugcacaaguguguauuuaaauuccaauuuuuucagauaugcaagccucagcagauguaugaguuagcauuugcccugcaccucugacucugaggucugcagagauuuuugucuguauauuuuuugcugcagugaacucugucguugugaacagcugggaauggaguguagcucauuaagacaggaggucuuauccaggccuccccugcauccugaagaguauugagcaugucuugcuuccccagaucugaaguauccauuuucuuaccaccuaguguucgccugcacuuacugagaaacgcugugggccccauugccucuuugaaugaugggcaugguguauaccagcuguucccuuuuuacccuccuugccuucuccucuggcuuuuuguuauguuuauggcuuaucugugccuuuuauuuaaaaaauaaauaaaaccccaguguaauuagaacuugucauuuguuuguguagcuugaagagucucaagagcagguuuuucagaguaaaucccugucucugagauacugcugcaaagagggcuguugcugaaagcgguuccucuugcuugcacuuaaguuuucaugucuggugauugcucguauuccuccauuugaugguagugguaauuuauaaucuuauccaaaaugcaguuaguagauuguaggucaugauucaagcuuugucuuuucaguagcagcagcauggccuaguauauauccagccucuuaguggauuacguaaauacagaugucucugcucaguuugauguggcaucgcuguuuguuuauaugguuuaauuauucugaauuuuuaaaaaagagaggucauacuaaccguguuaccucuuuggagauucagacucccauuuaggcgaucaugucuguguuugaaggcuuugucaguuuuacacaggagcuaugcaagaauguccaggagauuccacguggaccuuccuguggaauuaguugggcacaggaaaguaccagucucugcuuucauggauguugaaaaugcaauauguccuggacuccuaugcacacuguuuauguagucccaauggaagcguuagaauagaugaggucaauuggguucagaagaguuuccucagugcuaugaggcucacaagcucagcugugcuagagacaauaucugauucuaaugcacaggcucuaggccccagcuucaugcuuauaagcaacgagcucuacgagcugagauggcgugcccuaacaguuuagaaaaggagaaugaaaucauuucaauagcuggggauauuuccuuuacugucaccaaacuuuuaaaaaaaauguacuuuguguaguguuuauugauucaagaaaguucugugauuucugaaucauucauuaggcacaaauggaagacacuguuaguucugaggaacacauaggaaaaguugaaguccagaaagaugaucuuucugguuaccuuuucuggauaaggaguguuaucugcaugacccugaguguggcugaaaggucacccccccacaccccccccuuuuuuuccuauuaaagcauucuaaggcauuugacauuucugacaugauagcaagacacagaaauaguaugugacagcaucauugaauauaugaauggagugauaaacuccuuguaguccauauacauacagauauuucugaguguauauguauguguguguguauguguguguaaguguguauguguguguuucuuuagcaaagacaaacuauagguuucaagagagaaaauauuuuuaauuaaaauagcaauauaauguccaccauugugacuggaaagauggcucaacaguuaagagcccugacugcucuuccgaagguccugaguucaaaucccugcaaccacauggugacucacuacuguccgaaacgagaucuggcauccucuucuggagugucuaaacacagcuacaguguacuuacauauaauaaauaaauauaucuuuuuaaaaaauguccaucauuaauaauuccuuguaaaauauuguuggugguaucuuuuaaaauuuuaauuagcaguuaguuauauaugaugggcuucauuaugacaaauuucauaugugaauauaauccauuucauauuuauuucucuccccaauugccuguguuugauccauuugcacugaucaccuuuccuuaucaacuaguccuuuauaaaauaguuuccuccucccccucuccuccuuuccuucuguuuucuuuggauuguccaaagugaguuuaauuaggguugcuuagaagaauauggaugagagguuguuuauagaagccugguaccuuacuagugacuauaucaaugaagacaguauuucuuccucccccagcaaccauuggcuguauuuauauacucagguguugcccugcuaauuaaggaugaagucuacuacugucuguauaaccuucugaguucagccuaaacugguggacucccuuuggcuucuucucugaccuuuucuagggaguucaaaacuccccacacaucucucccuuuggaaugucaacuaaccuugguuagaguauagguucagcauccuuucucuugauaagaacccaaacagcaagcacuggagaucccuggaguaucccccccaccccccgcaggcuaaggaagcaucucagugccuuagccuucagccuuugcccaacccggauauuccuaccccaaaucccaaagcuguauaacccagagucaccccaaguaaagcugaucugucucucugaagcuggccccaaugugucauuauuaauguucagauucacuggccaucugaaacccuguuccucuagucugcucccuuccugcuaggggagaagggagacuuacacucagggaagagucuagccuuguaagcuucugccauuuccaugauaggaucuagugcagguaauuacagcugcugugaaguucaagaugcaguggacaugcggugcccaggguucagugcgccgcgucacucugcuucuuccuuugaccgucucuguacacugucaauaugguuugcaaaccugaagagggggugguucugauguccuauuuaugguugggugccacugauguuaauuuuugugagaugcuaucuuaacuuauuuaauugauuaaaaauguacuuauaagguauuucuugaaccauauaucuccaauuuuuuuuuggaaucuaaacauucagaaugaauauaaucaugcauuuacauuuacuuuuuacauaaugaacauuucauguuuaugcuuuaucuauaucauuauaauaaucuacucaguucuuaacuauaguuguaguaacagaauuuauuguuuauuuuugaauacugacuaauagguugcauagaacaaggacacagugcaguauuauaaugaaauuaaaaaagaucuaauuguaggcaggagaugugacagcaucauucauuuauuuagagaaauaucagaguugagagcaaauauaacaaacuuggagcucuaaguuuauaggaaaaaaaggccuuuaaaaaaaacauguuaaaagcugucugguaguccuuagggagaacagucccuuuuaguugugguugagauucaguccuucugccccuuuguggucugccugacuuagaaauauggugucuucuauaaagaagcaaguugcuauugaaucgcuuaggaccagaguacauuguuauuucuaguuugggaguacccaguaucuuuggaaacuccuccuuuccguuucacucugugacccuccauaauuuaguaguuuuguaaaaauaauaaagggauaaggggagacuggcuuggucuagggucacuuacuuccguggaaucucucaggaacgccugggcuuucccucuaugcugggcuuggacagagugugcccagaguugcgccgcuuaguuuuauagcugaguaauuguccucaguguugagugcuuucugucacgugaucccgugguagugacuacaugcagaaaacaaauuugagaagcaaaaugaaaacggaagucuaggaaaaagauaguaauacuguuuuccucuagacaguaggauuugggagcgacucaccauguuaaaaaugggccacaucugacuuuauauuuggaagucuuugaaaauuaacaaugggggagggcacccaaaauuauuuauuuaaugugaauuuguuuguagacugcaauaauugacuuacuuaacagcaauaagguaauucagauaauuucagaaaauuuaccuucaagaaggaauuuaauaaaggauaauuuagacaauuauauuaggcaugaguaagggcaguuugcuaaaaaugcgguuaauguuaaaagcuagagaucaucucugaauguaguuucuuuucugagauuucaguaggaaaauuacauggauggagcaugacccagaaacaggccugucagugauugccagugggaguaauugaagauuugugcauguugauugacuuucaguaucugauuacagacacucagggcagugcaucuuguccuuuuuaucucuuuuguuaccucuucuuagaacugcauguacaauguguugugcuuaucuguagauuccuagauccauagaaguuuuaucuguuucucuugagugugugcagaggggaguauuucaaucaauuucauugcuaacacacagcaucugaauucagcuguacuagaauacugagacuaauguuugaugugugaauacuuuauucucauaaaguuccaucuaugugaguguuugaaaucucucaugaucuuggguucugagcuauuguagcugugagugaccacuuuuuuuuuuuccuguaagauguauuuauuauauauaaguauaccauugcaguauucagacacaccagaagagggcauccgaucucauuacagacaguuauaagccaccaugugguugcugggauuugaacucuuuuuuuuuuuuuuuuuuuuuuuuuugggggggccgaaugacaccuucugccacauugaaaucuugucagcaggguagaauuuuguagcucagguccagcaugcuuucucuguaucucuuacuaccauucaaugcagagaaaggcuuuuuuuuuuuuuuuccauuuuuuauuagguauuucgcucauuuacauuugcaaugcuauaccaaaagucccccauagccacccacccccucuccccuacccacccacuccccuuuuauggcccuggcguuccccuguacuggggcauauaaaguuugcguguccaaugggccucucuuuccagugauggccgacuaggccaucuuuugaugcauaugcagcuagagucaagagcuccgggguacugguuaguucauaauguuguuccaccuauaggguugcagggauuugaacucuuaaccgcugagccaucucuccagccugaauguccacuuuuuaaaaaugccauuuuggcacaguucauuguuuuaagaaggcuaucuuuaagaacguauaucagagcugggcagugguggcucacgccuuuaaucccagcacuugggaggcagaggcagaggcaggaggcaggaggcaggaggcaggaggcaggaggcaggaggcaggaggcaggaggcaggaggcaggaggcaggaggcaggaggcagggaggcagggaggcagggaggcgggaggcaggagaggcagguggauuucugaguucgaggccagccuggucuacaaagugaguuccaggacagccagggcuauacagagaaacccuguauccaaaaaaaaaaaaaaaaaaaaaguauuucaguacugucaacagagagucuguucauuaugugugugcaugauggacuuuuauguuuuaagaauggaauucuccgcaccucuaugucagaaucgacuuucugcuguagguuuucuguugcuuuuuacaaagcuacaguagugcccaguuuugucuauacuauuuaguauggacuuucaguuuguguuucauaaauuuuuuuuucugauuuuaaagccguacucugcuacugcaaacauugguggauacauuaccugauggcagaaaacagaagugugcuauuauuuucuauaagaguacguuuucucauguguacuagcaucugagggauucuucuguguccagcugcugcugagcugcugagcugcugagcaggccuugguggcacuggaguaggcgguaauuaaaggaaagcaagggaaggugagguuaguguucugaaagcuguguuuaguuguuugcauuuauugguuugguuuugcuuuuguuuuuguuuuuugguuuuuugagacaggguuucucuguauagcucuggcuguccuggaacucacuuuguagaccaggcuggccuccaacucagaaauccaccugcuucugccuccagcgugcugggauuaaaggcaugcgccaccaccgcccggcuguauuuauugguuuuuuuuuuuuuuuuaguguguaugugcauauguguguaagugcauauauuccacaguauaccuguagagaucugaagucaauuuuaagaguuaguucagucuuccaacuauguaggugaucaaacuaaggauggaccuuaaguuuggcagcaaggcaaguacccguacugagacaccuugcuugcuuuaggguuuuguuuguuuguguaguuuguuuguuuguuuguuuuuguuuuguuuugagggaaaggcuuggggaucuggagcaauaguucagucagucaugaaugacacugguucagucaguccucaauagugcauacuguuuuuguaggguuuguuuuguaguacccaagagagguggcucaugauugcuugcaacuccaguuugagggaguauaacaugguccugugaacuccauuggcaacugcauuuccgugcacauauauccccacccacauaugcauaauuaaaauaaaauaauucaaaaaugcuuuuuaaauuaaaaccacaauugcauuuauuucuuuguguauguguguuuuccugugcacacacauacaaauauaugauguuaccaugacaugaguggauuggcuuugguucuguguauucaugcuuuuauuaccauuuuugauuuuguacaagauuugauuagugacuacacgcauuuaaaucaugucacaacgaaauguauauuuggugagauucaugucuuaaaggaaaugugugauuuugguguuuguacucuuguuuuggagauauguguuggcuguaguuguugacaaagcccuuccauuuuauccuaggucagagaaccuaagcuaauuuuaaucagccugagcugucauucgugcucaucaaugucacauuagcaucauuccuguucaucacugucacauuagcaguaaaucugaacuugcugauuagcaaaguggauggaaaucacagcucuguguguguccaaauaacuacucaucagcaaggcuugugauggggucugaugguuuaaugcagaccuuaaucaagggcugagagauguuuccucugcaguuuaaccuaguaguauugaauuauauuaacauguauauacacucccauacacauacacacacaggagcaguauuacagcaauguucaaagucaaucagacccaaucaaacaaaggaagaaaauaaauagacuuugaauaugacuuuucuucuauuuuaauucuaccaauucaaauagcauguuugucuuuggucuuauuuauucuccugucugaccaaagaaguacuugauuaauaauaccuauauccguagacaugcuuuuuaaaaaugugggaauuacaggauagguuuuuuuuuuuuuuuucauuuagagaugacaaaaucccaaaugguagcacuuguuuuucagugacauguauauggauguaugugcauaagugcauaagagccaguauuuuaagagguaauguaauuuuaagaggucuauacccauuauguacugucuugccuggagcacauaaacaacucuauauuauuuuuagaaucaaucuuuuuguguguuuuacucagcuguuauauauugaucguuuacuacagagucaaaugucuuuguagcccuucaacucugauaaacaguuuuuuagaaccuaguuguggaugguuuacguaauuguaguuacauuucuacaaugauuccuuagcauagauguuuauagucauaucagaaugaccgcagcuggcugugugauuccuaacgucucucaggauaagagaacuuggguguacuguaagacaccaaaauuuacagcuuccuucucugaagaaacuguaggauuuccauucagaacaaguguaucauuuggcauugagauucugcaacuuuugauggaauccaauuuauuggauuuaaaaaauuaauacccauuaugucauaggaguauauuuugaaaauucuuuuacacucauuuauuauuugcuucuuaugcaucuauguauuguuuguauggauuucuauguauguguacuaaugcuucuguaugauuguuugcaugcacagauguuaguaucagaggacugcugugggagucaguucuuuccugguauuauggagguuuucaggaucaaucuuagaaugugaggcuuggcaagugccauuaccugcugagcccagaauauaccuuuucuuacagauuuuuuucuugagggagauguuugaguguguagagaugugcucauauguauguaagccuuggaagcaugugcaugcugggaccccauuggccagaagauagcaucagaucccagcucuuuuaggaguagguugcagaugguugugugccucuuaaguggguucugaggaagagcagccagucauaacucuuuagccccacucucauagacuuuuaaguuuuuguuuuauauauuuuaccuuuggaaucauauuuaccucuucuccauauauguucucacuuccuuuucccaaaucuaguggugcaugcucaaauauuuccaccaucccucucugugcuuguagaagguaugaauaaacauucauuuucuuccaagguuuuugguuacuaucacaucaguuccuucuuguaaggcucagaguaauauaucaguaauacucuguuucuuuugccuugugugcuaaucuguccccaccuccucuucuuucuauucugagucaagaaggcuuugcucugaaauagaagugugaugcaucagagucagguagugggaagaauauggguuuuagguacuaaguccuggacuuuaauucuccugcaccucccucuuagucaggguuucuauugcugcaacgaaacagcagaguaaagagcagguuggagaggaagguucacuuggcucgcaccucuaucucaucauuggaggaaaccaggacaugaacuuaagcagggcuggaaccugaggcaguaacugacacagaagccauggagggaugcugccuacuggcuugcuucacauggcuugcucaguccgcuuucuuauagaaaacaggaccaccaaccugggguagccucacacacaauggacugaguccugccccauugaccaaaaaagacaaggagugacacuucauacucaucaaagguaaaauccuccaagaggaacucucaauucugaauaucuacgcuccaaaugcaagggcagccacauucauuaaagacacuuuaguaaagcucaaagcacacauugcaccucacacaauaauagugggagacuucaacacaccacuuucaucaauggacagaucguggaaacagaaacuaaacagggacacagugaaacuaacagaaguuaugaaacaaauggaccugacagauaucuacagaacauuuuauccuaaaacaaaaggauauaccuucuucucagcaccucacgggaccuucuccaaaauugaccauauaauuggucauaaaacaggccucaacagauacaaaaauauugaaauuguccaauguauccuaucagaccaccauggccuaagacugaucuucaauaacaacauaaauaauugaaaggcaacauucacguggaaacugaauaacacucuucucaauaauaccuuggucaaggaaggaauaaagaaagaaauuaaagacuuuuuagaguuuaaugaaaaugaagccacaacguacccaaaccuaugggacacaaugaaagcauuucuaagagagaaacucacagcucugagugccuccaagaagaaacgggagagagcacauacuagcagcuugacaacacaucuaaaaguccuagaaaaaaaggaagcaaauucacccaagaggaguagacggcaggaaauaaucaaacucaggggugaaaucaaccaaguggaaacaagaagaacuauucaaagaauuaaccaaaggaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguuguccaucuaaacagucccauaucaccuaaagaaauagaagcauuuauuaauagucucccagccaaaaaaagcccaggaccagacggguuuagugcagaguucuaucagaccuucaaagaagauguaauuccaguucugcacaaacuauuucacaagauagaaguagaagguacucuacccaacucauuuuaugaagccacuauuacucugauaccuaaaccacagaaagauccaacaaagauagagaacuucagaccaauuucucuuaugaauaucgaugcaaaaauccucaauaaaauccucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguguuggaaagaucaggaauucaaggcccauaccuaaacaugauaaaagcaaucuacagcaaagcaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauucuaccagagaacuccuaaaccugauaaacagcuucggugaaguagcuggauauaaaauaaacucaaacaagucaauggccuuucucuauacaaagaauaaacaggcugagaaagaaauuagggaaacaacacccuucucaauagucacaaauaauauaaaauaucuuggcgugacucuaacuaaggaagugaaagaucuguaugauaaaaacuucaaaucucugaagaaagaaauuaaagaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuggaaggagcaauuugcaaauuugucuggaauaacaaaaaaccuagaauagcaaaaagucuucucaaggauaaaagaacuucuggcggaaucaccaugccagaccuaaagcuuuacuacagagcaauugugauaaaaacugcaugguacugguauagagacagacaaguagaccaauggaauagaauugaagauccagaaaugaacccacacaccuauggucacuugaucuucgacaagggagcuaaaaccauccaguggaagaaagacagcauuuucaacaauuggugcuggcacaacugguuguuaucguguagaagaaugcgaaucaauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacaacaauggcuugugcuguaagaucgagaaucgacaaaugggaccuaaugaaacuccaaaguuucugcaaggcaaaagacaccgucaauaagacaaaaagaccaccaacagauugggaaaggaucuuuaccuauccuaaaucagauaggggacuaauaucuaacauauauaaagaacucaagaagguggacuucagaaaaucaaauaaccccauuaaaaaauggggcucagaacugaacaaagaauucucaccugaggaauaccgaauggcagagaagcacuugaaaaaauguucaacauccuuaaucaucagggaaaugcaaaucaaaacaacccugagauuccaccucacgccagucagaauggcuaagaucaaaaauucaggugacagcagaugcuggcgaggauguggagaaagaggaacacuccuccauuguuggugggagugcaggcuuguacaaccacucuggaaaucagucuggcgguuccucagaaaacuggacauaguacuaccggaggauccagcaauaccucuccugggcauauauccagaagaugccccaacagguaagaaggacacaugcuccacuauguucauagcagccuuauuuauaauagccagaagcuggaaagaaccuagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaagaaacucacacaauauguauucacugauaaguggauauuagccccaaaccuaggauacccaagauauaagauauaauuugcuaaacacaugaaacucaaggagaaugaagacugaaguguggacacuaugccccuccuuagguuugggaacaaaacacccauggaaggaguuacagagacggaguuuggagcugagaugaaaggguggaccauguagagacugccauagccagggauccaccccauaaucagcauccaaacgcugacaccauugcauacacuagcaagauuuuauugaaaggacgcagauguagcugucucuugugagacuaugccggggcccagcaaacacagaaguggaugcucacagucagcuaauggauggaucauagggcucccaauggaggagcuagagaaaguagucaaggagcuaaagggaucugcaacccuauagguggaacaacauuaugagcuaaccaguaccccggagcucuugacucuagcugcauauauaucaaaagauggccuagucggccaucacuggaaagagaggcccauuggacuugcaaacuuuauaugccccaguacaggggaauaccagggccaaaaagggcgagugggugggcaggggaguggggguggguggauaugggggacuuuugguauagcauuggaaauguaaaugaguuaaauaccuaauaaaaaauggaaaaaaaaaaaacucucacugauaaguggauauuagcccauaaaguuagaacacccaagauagaagauacaaagcacaugaaacucaagaagaacgaagaccaaaguguggacacuuugccccuucuuagaauugggaacaaaacacccauggaaggaguuacagagacaaaguuuggagcugagccaaaaggauggaccauuuagagacuaccauaucuggggauccaucccauaaucagccgccaaacucagacaccauugcauacacuaccaagauuuugcugaaaggacccugauauagcugucucuugugagacuaugcuggggccuagcaaacagagaaguggaugcucacagucagcuauuggauggaucacauggcccccaauggaggagcuagagaaaguacccaaggagcuaaagggaucugcaacccuauaaguggaacaacaauaugaacuaacuaguacccccuggagcucgugucucuagccucauauguaucagaaguuggccuagcuggccaucaguggaaagagaggcccauugguagugcaaacuuuaucugccucaguacaggggaacgccagggcccagaagugggaguggguggguaggagaguggggagacuggagucacuuuugacuccaguuugucauguugaugugcaaaaccaaacaguauaaccugucaguuuuguugguguucuggcuggcucucgucaugguguacucugacuaaaaugagguaugaggguauuguuggggagaccgcacagagcaucuccagagagcucccacccugacuucuuacugugguauguuuuuauauuucugagauuauaauuacaucauuuucccccuucucuauuuuuucccccucgaaagucccacauaacuuuuuuugcugucugucuaauucauggccucauuuuuuauuaauugcuugugugugugugugcgugcgccuaaauacguaaauccaaccugcccagucugucuguugucucuuguauguuuauguguucagggcugacccuuugguauuaggugaccaaucuuuguguucuucccucaggaaagcuguuucucauuccuuaguugccuacaguucuuugugugugucugcuguuucugacacucuccccuauguguauuagcaugucuguugauauauuuuugauggauuacaauucuccuuuuaagugcauuggugcuuccaaggcauuuuuauuuguuuuuuuuuuguuuuuuuuuuuuuuuagauauuuaucuuuguuucauauucucuauguucaugccuuaaagguuagugauucuuaagguaucuacccuguacuuugaaguucacuuuuaaugcccuggucauuuuucuuagacaagcaguuugucgguauugcuuuucagcaaaguguugaugaucauuuccauugcucacccccccccacaucauaaauauuguuguuuauaguacccguuucaccugggccguugucucuuugugaguuuguuuuaaaguagccugucaggaucuuuauccuuguuguaggaauagguuugguuuggugugaacugcacaaguguaaauaaaguucagcuuuauuuccaaguacaguucugccagucaugugcuguaugggguuuuagagccaaaaucaaagacaacuucuauccuaaugcaccacuguugguauggucuccuugugugacauggauacuugcacauccccuuacauacacauguuggcgaacggggauuagugguagcgaugccaggccugucccacagagaaugagugcacagagaauacucauuugguuugcuucacuuuuucauaugcugaagaaaggauaguaagggaacagcuaucagcguguucacagugagacaugcugugccacugaauaaaguaucaggaaauuaaauacuuuuaccacauuuagggggcugcccuuuucuucuuauuucauaucuaaguuauuucugguaauagagggaguccccuuuguauucuguuuuguuuuggcagcuaaguggauucagacauugggaagcuguucuacgcuuacuuaauuaaugagcugcaaguuggcuguaaacucagcuccuuuucuacuuuggugcaugagcuagaaaauugcagaaaccuuuccccugcccucgaugcugaguguuugaaauugccuugcauuuucagaaugggcuuuuguuuuccauggaagagccucuauuuuaccauuauggugaaccagugugguacuuuuuguuuuguuuuccuguauuucuguuugcuacuuagugcuuuuccuuuucaauaucugaacaguguuuucucuagcuuuaaaauccuuuagauuuagcccauuuuucuuuacuuuugugauuuaauuuauaacauauagcuacauaagaguguguccauacacuuaguaacacaccauuaguuuagagguacauaaugccuuugugaagaaaaggucauauuuuuacuuuuaguuaguugcuuauguuucauguuuucaguccuuuuuaccguaaagugaugcuaaccugucauagucuauucuggagacauugucauauguuucucaucuuuugacuguuuccuuuuaccuaugggauauggcagacuguugcccuccauuaucucuguugaagaauuauuuagguuuaugcauccacaccuccuguuuuaucaucccuugauuauaaaaguaaaauaccugaccacaguaauguccccuguugccuggcaacggucauagugucagucuuuuuauuuuguccuccuuggcacucuaauacuuucauaaggaaagagguuuguugcuguuugccugcuuguucuucugucuucuacugacacaaucaucucuccuguaucucauuuuucccugaaugaacugcuuaggcuauaguuuuccauuuuccagaaccaacuguguccaucuguuauaagucaccucaauuaugcauucaggaaccagagcuuuuugagacugacuuaauagaauuccagaacucaaugcuuuuuuguuaguuaagacaguguggcuuuguuccuguuagacucaagcaugaaaaagaaauauugcuuguuacaaaaagaacaggcaagagugaaaccacccaaaaucagaugugugguuugugugaaagcuaccaagaugauauuagaugauuuaauaguuuagacucugucucucucuuguauguaugcguucuacagguuuuaugaugaacuuagcugucauauuaaucuuuagaaagaagauuauugcuccaugcuguuuauggaucacuagauuuacaauauuaacuuuuaauuuuauuuaaccuaaugggauacacuauauacuagaugauucuaugguggaauguuuuacgggcaaagauguuguccagauaauguguuaggaguagacaaaucucauggaaucucuucuuguccugugauucuuuaacuguucaggggugugugcgugugugugugugugugugugugugugugugucugugugugucugugugugucuuuguauauaauaucugcauuagcaaccuugaacaucugggaggauggcuagcuauuuccucuugguaguuuugaguacucuggaaggaaaggaucagguaaacauuaggcauuuuuugucauuacuguugccauuacuuggcaucauuuuuguagcaccugccucacuaaugcaauugcuuauaggcgcuccaauuuuauuccaaauggcuacuuuuuugucauuauauaaucugugguaaaccacauacuauguaaacauuuucaguggauuuuuucuugaaauuccagccaucaaauaauguuucugcuccagguguucaugaaccccauaguggaaguuucuuaagaacaugcccuuguaaguacccaagagaagaaaacauacaacacuuuauaacuccaacugauccccccucauaguuaucauuacccaagggcaauauuaagagaauauuaauacguuuccuaugcaugacucuuuuuauauccaauuuuagaguugcuuuuaaaauucauuuuaaauuuuacaaacauaaucugugcuuuauuuccuaaugcauagcucuuuaauuauacgugugcauauuuuuacgaguuuugaguuuauuuuucagauuccugccaguaguuaucaguuugcaugucacacaauaacuugaccugguagaauuuaccuguaucacuuguaaagcuaauaguuccauaauaaaauaaagguauauuaucuagacagaguuauugauuuuguauuuauccugauuuuaaaauaccuguaaaauauuuuguuuugaaauuaggaaucuuuugaugugagauagauugcagaaugaaaugaaauuguuagcaauuuucuuuuucugacauuauuagaaaucguauuuguuaauucuaagaccaugaaagguuucucauuaggacagauaguauuaagcaacauugcuguccaucggcugaauacuuauaucuacaugaaaaaguuuuugagcuuggauauguuuuuacucauuuuuauuuauuaucaaauauuauuaguuuuaauuaaguuaacuauagucuauuuauuuuuuuguauugaaauuuuuuccucuaauuuuucuaauccacuugagaauuuuugcacuacaaagaguagcucucagcaccugagaaucugagucuauagagccccaaauuagugcucuugaguggaacagacccaaaaaaguaaauauauuuuaaaggaggauuuguugguuagaccuuucaugauguggccugcagcaauggcuuccgcuguagaggcuggagagcacuuuagcuguguguuguacguguccgguugccucaguaguucugaccugucacuaaaggccugcaagauucccagagauccaguagauugcaguucaugugguuagccugaagaaaugguagucuauuggugaaggaacgcagcagcagcagcaggagcagcagcagcaggagcagcaggagcagcagcagcagcagcagcaggagcaggagcagcaggagcaggagcagcaggagcagcagcagcaggagcagcagcagcagcaacagcaggagcagcagcagcaggagcagcagcagcagcagcagcaggagcagcagcagcaggagcagcaggagcaggagcagcaggagcaggagcagcaggagcagcaggagcagcagcagcagcaggagcagcagcagcagcaggagcagcagcagcagcaggagcagcaggagcagcagcagcagcaggauagauggagugaaccugccagugagagugaaagcaagcucaugaauugaagcuucuuucuuggucuuccuuuuacuucagcugugcaugaguggugcagccuacaucuagggcgugucuucuccauucagaucaccugaccaagaaagcccauuacaccugugccuggcggcuugccucuuaguucauuucagauauagucacauugauaacugagauuaacugucacaaguuuuauuuucauuuggcauuuuucauuguuaucugcccauuguguucgauaucccugacaccuuuggaagauuuugaccauaagcuuuauggaauauugguauauaucaugaagcacuugcauaaauuuuugcuuuuaagcaugggucuugcuaauuuuaaaggaaaaaucuuacuagagcauaugggaccuaggcagaaguguaagacaaguacuuccaggcacuaugugaguaauuucgaaugaggaguguuuuuauguuauauaugcagaagucuucugggaggaaaacguaagguccuuuuguugguggucauuacuccuuaauagauucaaguuucagaaauguaugaaagaauuuucuuuguaauauacaguaugcuugcauuauauuuauuuuauuuuuaaaacuguuaaaacuuaucauagaaggguaugauuaugacacuuuuuuuaauuuauuuuuuuaaauuagguauuuucuucauuuacauuucaaaugcuaucccaaaagucccccagacccucgcccccccccccuccccuaccuauccacucccacuucuugacccuggcggucuccuguacugaggcauauaaaguuugcaagaccaaggggccucucuucccaaugauggccuacuaggccauuuucugauacauaugcagcuagagacacgagcucugggggguacugguuaguucauauuguuguuccaccuauaggguugcagaucccuuuagcuccuuggguacuuucucuagcuccuccauugggggcccuguguuccauccaauagcugacugugaacauccacuuuuguguuugacaggcccuggcauagccucacaagagacagcuacaucuggguccuuucagcaaaaucuugcugguguaugcaauggugucagcguuuggaggcugauuaugggauggaccccccuggguauggcagucucuagaugguccauccuuucgucucaacuccaaacuuugucucuguaacuccuuccauggguguuuuguucccaauucuaagaaggagcaaaguguccacacuuugaauaauguguuuuaauagcuucuccuuccuuuucaucuauccaauuuccuccuucccugaaguuuccucaucacuccgaugucccucuuccucuuucaggacccauguguucugcucauucccugacuguucucaucgcucauuuucaucugcucaguuccauccauuguaccgaaaauuucauaauuuuguuguucuuugucaguagauaaaauuccauuuuguuuauguuucacauucauuuucauuuaauggacuuguaggauucauuuccuucugacucacagugauuuacaugagugugccgugucucuauaguaggauaaggagucucugcccaggaucaauauggaaguuacauuugcauuuuuuagaagccucuagacuaauuuccauaauguguguacuaguuuauacuguuccaggcugugaagaaguuuccucucaucccacauugucccuaccauuuggugucgguuaaugacagccacucuaaccagagugaggcaguuucuuaugcuagguuuacuuaguuguguggugacuauugauagugaauacuuuaaagaacauacucauugaucauuuguuuucuauacaaaugcaauuuaaacgcaucuuaucauuuuuuugccucaguacuugcuaaacucaguauucuaagggaggaagauuguaaauuugagaccaguauaggcuguauacuaaaauuguuuuaauaaaacaaaauaaaaacaaaacaaacauagaaauaacaaccaaauaaaaccaaaacaagaaauaaaggaaggaagggaaagaaggaaacaaagaaaagcaacaaaaggaaaauguuuguggaaaaccucaauuuaagugugcuagcaaaugaguugaaacgauuugaagcagauugaaugaaugggugacauucaauucuucauuucauaaucagggccaguuuauuuuuuuuuauaguuuuaggaaaaaaaugugcucucuagcgauuacacuagaagaaaaguaauaaccaucacagguagugaccgcucuggacuuguuuuuauucaugauauaauaaaacauaugggcaggagggagggggguugggaaauaugaaaauuuaguuuuggaguugaacucaugguuggcuuugcaguuuauuuucugaauagaauuguaaaaaauugaauauuuuugauauugauuuugaaauauuaugagagacuguuuucauuacacuucagacauuacuguguaugucaauugagaauccugacuaaaucuucauaguuuaggauuuccccucaaugccacuuaaaaaacaaacucacuuaauguaaaauuuucuucgagucuuagauuacuaugugaguuaaaauagcucugugcacccccucaggcuguucucagucaguguucuccuguacugagauucggggguguacuuuucugucuucagugucucaugcuuaugccuuaggcauaauccuguucucgcucuaccgggugccuucauaauguuggugcuugaguugcucucugaaacagauccccucuuuucaguccuucaggcacuaagcucacauuuguguuuagugaccauuccuuggcuauccuuaugcugucuuuucuccacccacaauaaucucuguuccuguaggcuucauuuuuguacuucuuugucuaggcuuaaugcuuuuaguggcuucuccuacuucuuuagaaaacuguagagugagaucaugaauugaaccuacugcuagaaaugugguugucaguuauccuuuguaucagucaaauucugagacccucagacugaagccuccaugggaacauuuauuauuaguucaaauauggccauaaaaaucgacuuugcaaucaucuugaguccuccugacaguugcugugagugacagaaacuaaucuuaucugcuggcuagcauuuuaaaaaugauaaauggacccuaagucuuuaguuagacuguaaaugaaauuaaguuuaucuuauuucucagugcaauaucguuacguagaaaauuuugaaauauaccuuucugaacaaaguuaaauagcaaaggccaggggcugcguuuugaugaguauuguaugugucuuuuuuuuuuuuuuuuuuuuuuuuuuuuugcuuaguuuuuaucaaaccaaaugauggugcuuugagaaaaaucagaguguuaagaacucagcaucuaguuccugaacagaacaaagauuccucaucauuugugccugcuccuuacuuuaaaaauuguacccagguagaaugcauaauauauguucaaaguaaauuuuaccagauauuuguacuuugauaugucuguuuccgaucuaaaauacaauuuaaaaucuugaaaucacagcuuguuuaagauaaucuuuucuuugucuuaucugucuuccuugugauugcuuagucauucgaagaucaaguuacauugaaauggaguacacuccuaacaggaagugacuuuagagcaccuuccaccacucauuuaguucccagugggaaacugauuuaccuuccugucccugagauuuucaugucuuuauuuugaaauugucuuuucucugucaguuagaaucaaggacauuagaacccacuuugcaaccguuaugacaaauuaaauuagguuacuucacacugucuaaugucuuuuuucaucugcauuuuagcagauauuucagaaccccaacuuggucauuuuuuucuguccuuuauuuugauauuaagggccucauuaauagcuuuguuaauuuuuuuaagugagguuuaacuaaauugagggcauuaaagcacuaacuuuuaagguuguguuucuaaaggaacaggguauugauauucuggauugauuugcugugggaaaacuuuacauguguagacugcuuuucuuccaauuccuaguuuccuugauugagaacacaacuagauaaccuuucauuuuuguuuagagacagucuuuuauaacagaggcuggccuugaacuugcuagguagcugagucuggccuugaccaucugacuaacccgccugcagcuucccagugcuggcauugccaacaugugccaccaggucaaaagcuguuuuauuuugaauuugugaaaguaaaggaaaauaugcuuguuguauuugaaaguuugucaaugaugacaaaaagguuggggauuuuggguguuuuugcuuguuugguuuuguuuuuguguuuuccagauucucauacaggagagauucuccucuccucacuuuacugucaagauuugauauuuuaaaugucuaguaccagcugucuugaaauauugcugugguaucagucucaguccuucuuucuguguucaguguagauugccuaggucauauuuucuuuuucacucaugaacuguuuucaguguuaaaggaacucaaaugcauagaauuugacuuuauuuguuauguuauugcaugaguuuugucugcaucauucuuccagauugcuuuccuacuguauuauugcuuccacgucuccuuuguauucugauccugcaugaaaaccacaggcaguuucuagucucaggcucccaugcuucauugcugauuagugggaauggcccccguguugccagugaaucaguuguuuccuuaagcaggagugcaggaucucccaugguucucugcuucuggugaucuugacauuccauuuguuacucuuuacuguuucagauuuuccuuccguggauucuguauucuaaauaugguuuacugugucagaguagaguuggauccuuguucuccuacuaauacucucuaaugcuauuccagaggcguuuguaacauucacuuuguuggaucaucauaauuuccuugauucccugguucugauauuucuaacauguuuauaauuuauucuuuuugauaauuuuugaguuacuuauguacaguaaaaauucucuauuuucauugguuucuauugccaugcaaguacuggaauuauugcaacucagcauuuccuucaucucuuucauucaaccaguuuucagauugucccuuugaaguucauaccugggguuggacaagcugacuucagucauaacuucgaauuguugucauccuucuguuuuuaaauggcuguuuauucuacuugucacagaaguuuauuuucuuuuaauuuuuuuuaaaccguagcuuuagacuguuugugugaguguauguguuguguuguuuuugguuuuuccuccugauucaguuucuauugucuuccccauuucacagugugugugaaaccagaaagaagugugguugcugcuuccaaauugcuguaguagugcugaugucgaccggcgcagaggacagugcgcauguuuugcaucagggcacauuucuccaugggugcauccgccccacuaccaaucucuucugugcuuccacucuccugaguguauugucucugcauuuuggcucacagauguauuuuaaccaaggacagcucaaggugacuucacagaagcauuauucaagacuggaacacauagauuggacaugaauuuuuauuacagaacagcagaguaaccuuuucuuccuuccaacaugacuuucagacuuucauaugacccauucucagaauacacacuucuccagauaguuuuguucuuugauauuuuaaauuuugagauuuauuugcuuucuacuuuuucuuacaauaacaugaacucaacaaauucuguuucucaauuggcuuauugcuuuugaaucaaaacucuauaaaauaugucuuaauucaguuuucauuugaauuaaaguuaauuuguuauaggccaguuuuacuagguauccaauaaccuuauacuaucagguaagagguguuuuguauuaaguaauuuauauuuaauaaguaagcacuugucuacuugugaccugcugggauauccugaccaaacagaaugcauagcauagcaggugcuuccugaauuaucaguucuuucaucaugcguaucaaacaguaggccacacuuuugcuugcuucuuuaugcauuuauuacaauuauuuacaauaauaauugauuugccuguaggaauuuuaguaauauauuuuauucuagcucuaguaugagaucauacauucuuucucugagaucuuauauagcauauaaaaaucuaaccuguaauggcaucuugccuuuccuugagagaauuagcuuuuguuuuauuuauucuuacugaauuagucuuauuaguauaggcuuuuuauaauuccccuuuaauugccuauucuuauuguuuucuccaaauuauaaccaaaaucaacccaaaauuaaaccuuaaaaaucaagcauaaacaacaucuuuguugagaugcaacugcaaucccuuuaucaccuguaaaggaggcaugggaacagauuucccaggauucccuguauggcuuucagguguguuaaccuugucaggccacagucuccugcgauucaauaaagcacuggcugagacauugcugcaaagguauuuuauauauauuuuguuaagacuuaacaucaguugacuuccauggaaaugauucuauaucaucuggguguguccuauucacucaaugaaaggccuuuaacauggagcugaagaugauauuuugucuguggauagcagcuuuccucucgcagagucagagccuugcuccccaacugccuuuccuauggauucuuuagaggccugguuagugccaaccaaccauguuugugaucuauuccuuuaucugccucucccuaauccugucucucugcuuagucucugacuauacacgaugucagcaguaugcugcuuccugauaacuuuauaagaaccaggauucuuaacuauuuuuugccacuuauuauagaugacucuuucuguuuggugaauaucucuuacccacucuacaguuccauagcuguuaucaguggugcucuugagcaucagucauguguacuuggaaacuuucuucacuuuuuucuggcccagaauauagagaaaucauguuagguaaauuuaguugucucaaaaauuaauuguuuaccuauuucuucuuuuuuuuucuuuauuuuuaaagagagaaguagcugccaugcauuuugacuugugugucugguuguagcuguaggauauguuagugugaggcuugaaauguguucuagagcacagagcuuugcucugaaguugucuuccaggauucugucacaugcugauguucugccagagcauauggcccuccauaugguauuucuuugggguuuaugccaccuguaaucuugcugauuuucauucauuuaaauuuguccaggagguaagcaaacuaaaccuggaugugaaaauaaugcaucuguuuuaaaauucuaaaauuugggaugaguuacuauuauuacaguaauuaccacgaaaaaguuaauucauuaaacaagugcauuagucauagagcaauauugcuucuaucaccccauuaacagcagggaacaguguauccauuucuuacuugcagcauggagaggaaaauuguuuuauuuuauugugucuuucugugaagauggaguugcaucauuuuggacauuuuaaaaaguaauaauaguaauggauuuaaauauguuuucauggucugcgaguaaugguauugugaauggcauuuggcauuuugauagaauauaaaaaguaauaaaaugguuguaucgugacugcaugauauugaagauguuuuauaucauuaagaaacuuugauuucagaaauaggaaagaaaaagcaagguucuauugaacaauggguucaauccucauaaaaaugugucucuaagcucgagucagaggugcugguauaagugucagcugguauuguuuuuuauugcauuugaaaugcuuuagucucuuuccaaagcaguuguuuuauuagacaggacagaaaugauuaacaaugaacaaugucuuuuuguuaaugauguuauguaaaaaacaaaaggguacuucuugcuuccauugaacagcucuuuuauauuuauuuauucucucaucucugucucucugucucugucuaucucuguauauuuauauguauaugucucucucucucucuauauauauauauguauauguauacauauauauauguacauacauauauauauauauauguguguguguguguguguguuuguguauguauguguguguguguguaccauucacaguaaauauaugggagagagagcacaucuugcaugaguugguucucucucuuucuaccaugugggucuuggggauaaaaauucauguguucaggcuugauugcaaacaccuuuacccauuuugccaucucacagucccauuugagaccuuuaacucagguauuuaacugauaacuaaaccugcugggaaaauagaggcauaauuauuggauuguuagugcuugagaugacauugauggucauauauucagugguauccacccaguggaguaaauggcagaaugggcaguucauuaggcucuuuuuuacugggguucuuuggggauuagaauaaagguagaagaggaaugggaagaaguuaauguaaauugaauuauaauuacauaggauaaaguaaguucuuauguuauauuacauaguuauuaauauaaauaauguaguguacuuuuuagaaaagcuacaagaaagcauauuuaauauuguacuauaaagaaaugguaguauugaagaaguagauagguuuacucuuauuuuaacguugcaaauauauacauacagacacacacacacacacacacacacacacacauacauauacauauaaucucagauccacuccauaaauauuucauuuuauaucagugaacaacaggagucuaucagggagugaugacuuccucagacagaagugaucauguaauguauauauaguugguacagucagccuguguggauauaucuucagcuauguuccuagcaccuggcagaguauuucacacuguuaacacuguaguaucuugauaacaagaaauuauuuuuaucauauuugaagguauucacagcugaaguaccuccuaguauuaauucauuuuauuauuguacuuauuucccaggauuuuauaaaaugucuaccuugaauguuugugaauuaauaaacaaagaaguaaaaaguauauucugugccucagauccacccacguuuuguguaguugaagacugugucaacaugcacuaagaucugugaugacuuuugucuuuugcuaguggaucuacaacauugcgcaaguugucauauccucugcauugauucuguccuauucugugccuuaauuuagaagaugguuaagacucaaacaacagaguugacauggaguacucauaacauuauuagauggauuaagauagcaugucacaguauauguguauauuauuuauuacucucacugcccuaauucagaccuugcucccucagauugaauuaugccugaauuauccuaaaugaauucucaugucuuuuacugaauguguucaguauuccuaccauagcucaucuuuucucuucuuuucuuuucuuuucuuuucuuuucuuuucuuuucuuuucuuuucuuuucuuuucuuuccuuuucuuuuuaauuggauauuuuauuuauuuacauuucaaauguuauccccuuuccgguuuucccucugcaaacauccuauccccaccccuacccugcuucuaugaagugcauccccacccacccacucaccaaccuacaccaguuucaccgccguagcauuccucugcauuuccagacuaguguaguaccaccugucuacccugcagcucuuauccucugcauacagcucuucccucagcuaucaccuguuuguccucuguauucuuuccauuggugugcuuugguguaugcuauaauauguauagucuuugcauucaugugaccuguugucucuauucaauaaaauuugauacuucuaucuuucaagacuugaguaugacucuguuccuuaguuuucuuuuauagaauuuuuucuuuuauaacaauagauaauagacucuaaggauaaaagguguuguccaggagagggaagguacugaccaggagacagaggaguuauccaguuuuauuccuguugugucuuuuuuugcugcugaagcacuuauucauggaggguaguuaccucucauguguccuggccccauucguuccacacauguccuuucugcuuccacuuuucacaugugcucuguggugguucaauuuuauuuuuacccgguaaauagauuuuauguaggccuauaaucaccuaauuuuuauaauagagaaacuaaaaauugacaaauauaauauaaauuccuuaggaaauugucuauuuagaggaauguauugaugaacuauauugaaaaugaagauuuuagcuucacacuaugauauaaauuuagcaacuuccaugauuaucuuuucuuacauuaaucucuacuuuuccucauguuaggugauugauuauauaaauagaaaauggaaaaucucacuaggccuauucuaaaaauggaaaaucugcuuauauuauaauuuauagauuaaauauuuuaaauuuuaucacauuaauuugauaauuuaauauuuucucuuaaauguuucuugguuguauaauuugaaauaccaguuuguuauauaacagcacucuuaucacagaucaacagaaaugucuuauguuuuuauauucuaaguuucugagcucucugaacugaaacuauaauugcuauauccuuuuuuuuaaucaaaucaaaaaugcacugaucaauuuaaauaaaaaugguggugucuuacuugaaccugacagccuucauacaaguacuggcagagugucugugccuaccuuuggaucugugcuuugaaauccaaccaaauuaucuuuucuguuuagcagaaccauucuguguuagcugcuuuugugcuugcuguaucccaacacccgauaagaggcagcucaaggagaagagugagcuguuuugcccuugguuugagaggacucauuccaucacggugugaaguaggcacauuggcggcaucuccacacaguagacaugucugcucaggacuguucacggcucauguggccagagagcaagagagugagugccagaccugaccuccuuccuucuuuuucuuuuuguuccuucuauaucaugacaccggcugcucucuccagaugucuucacagauacacguggaagugugccucaguaguggcuuaggcauuucucuagccagucaacuugucacucagcauuaaccaucacagucagacacuugacugcuagucacaggccucaacucagguuuuagguuuuguggcccuuaucaucucuuccucaaguaaccaacuuccucacuuuuauuacuagaaccucuucuuuccuacuccuacugcugucagcuuccgcccgccauuuucaccagugcugaugcaccugacuaccaaucuucaggucuuuccucucugauuccuggagcuccguggguagcaaccacuaucacuuuguauuagaaucuucugcucacucuuuaugaucuuuccagugcugaggaucaagagaauuacaucauucuuauuuuguauaacccuguguuuugcacauuacauguaguaauaaauguuuguagauuuaaaggauggguuauugaucauaagauuuuuuucuuacuagcuucucuuauuauagcaguguaucauuaagucuagaaaaacuuccaagauugcuuuggagaagaaauauuugugauaccaguacauuagacauuguuggaaaaauugaaucuugccuccaguuccccuuuggguauggauuaauuccuauaggacagaggagccuaaguaaguaauuuaucuacauaauaaugaacaaguuuuuauugaguucccaccagccuaagggacuguacuagaccugacuaugccuuacauagacugagggaucucaauggauugcuaaauuagugauaauuaaauugcuggcugcuaaauauaugaaaguuaaaggaaugguggugcacuaaccuaugcuuccugucuuacuagaaaagagaguuccuggcucaucuucagaaaacugaggacuauauucuaauuucagcugucucucuucuauaguguaaugcuuguaugucuuugcuuuuguuuuauucauuuaauacaauugaaaggcccuaaccuucuuucuguaugagcuuaagguuuuacuuagaagaccuuguuuauuugagaaauagauacuauaacagcauagacuuaaaauccuaggacacgaguuuacauuuucucuuugcuacucuaguuauguauuuuaagcaugcuuauuuuaacauuuuuuaccaguuuacuauguauagaaaaggguagugaugauaccucucauaggguaacuaugauuacaugagagagugagagucuuaccuauuuuauuagcuuucucaauauacuguauuugauacacaaauuccuaauuaaccuauaccuaguaaugagcaauuauauuuuuuaauuuuccaaaauuugaauuuuccccuuauaaguaaaugcauaaaguucagcuucuugugagagaaagguauaugcguauuguuuuuuuuuaagaguugugcauuauuugacaauuguaauuacuuuagguaacuuuucucugacuucacuuuucugucaguuguuguucaauaguuaaguuguuucauuguagcuuuguaccuguccucuuuaacuugucacuagauauguucuaaauggauuguugaaccuuuaaugaaauccagucuugcugaaucacuaaaccugcuuucuacuagcaagcucuuuacugggaccugacagaucaccucuccagagcuuccagacguccuggcccuguaauucuucuucauaacgaguuuugugcugcaugauaaaauauucauguuaaaauagguucuaaacuaauuaucuucagccaacaguugccaccgcagucauuugcuguuagcuuggcucaaguuaauggcuuguaguucaguacaaauagucccuuuuggcuguuuccagauacugauucuuauccuaaguagaauuucuauacauaucuaauguucuuguuucaagaggagauuuuuuucccugccuuugccuuucucuuuauauugaucccaguguuccugucuuugugcuugccuccaucuucucccugugucacuuucuaaauucauaacuucuacacuacugagagcaaaacaucaguuacaccucuguauuucauugaauaaaccaugaauaucagacuuuuaaagaagcaaaagcaaagugucacauuaaggacaggauccauucauuagagaaaccuacuaacugaguuaugauagauaugaaccacucugggaaggugaaugguccugggcaugagggagauaaaauaccaagggaauauuuuccuguuggcguuaguagaaauguuggacuauuggacuugggaugggcaggcucaagaguagaggauaaggauuugauuuuaggagagauguaaggucagcaagagaggcaaguuggagguaaccuaggcagcagaaauuccuaacauccaggggucuggccagucucccugcauuaagaguucuuaaaucuguucuugcuuuuguuuaaaugaaugaggcccccaacauucauauaguagaggacugccuggucuggccucagugagagaagaugcagcuaacccucaggagacuugagccccaaggaguggggaggccugugugucuguguguguguguggggggggcaucuugaaagaggggagaggaggaaugggaugaggaacuguaguggggugagggaacggagggaggugauggcuggacuauaaagaaauacuacuacuaauaauaauaagcacuuaccaccaugcaugacuacagcuuuguuucuuaaucuguuauaaaauuuaaauucuaggaaauacuuaaaaggaaaaauauuauaaaauauuaaaacuauggucuugaaauuaggaaauuuucacacauacuaugcuuuuauaauuuauuuucaagguuuguagccauaauucauugcuuuaauuaaaugcacaaauaauacuuuaaguucaugaaggucuucaggcaauaggcagacaugugugccaaauauugauuauuguaguaggaaaguauauuuaaauuguccucucuugaugaagaacauuaaauuugaaaauuauaaauauuuaucuugcauauucuggagauagcuuccucauuccccuuuucagugacacacacacacacacacacacacacacacacauacacacacacacacacaaacacacgaacacaugcacacaugcaugcacuuaaagugauugucaccuaagcucugaugaugcucguugaagcaguacaaauuguauucaaugaaguccugauaaucaaaauaucuaagaguuaauaaaaugucuaagaaauuuuggguuguuuagagggggagcaggaaucugcccucgagcagaaugcccagcaggucaaucaacagcaggguacuuuaugccuuguucauuuuuagagcuguaucugacauccguucucauggucuccuuaaagccaacugacaaagaggugaaauaugugacaauaccaaguacuuccacucagcacucuuugaauugagauuucaagaaguucaaccaccacucaggucucuggacuugcacuuuaguuugcauuuggcuuauauuucaguuucuauuuuucuguucuguuuuuuauuuuuaauuaucuuucuuauuucuucacuguuuucauauacuucuugauuuguauauaauuguaguaugacuauccuuucuuuaaggugucaaauugcuuucuguuuguggcuuguuuuuuaaacuuuaguauauguuauugugcaaaugugugcuguuuuguauuauuccacuaucuuucuuuagauacuugauucuuaaaguuuugauaaggccuuccucauccauuauuuaaaauaaaguuuugcccuagcaucgauaguuuaacucuuuuguuauuuacauaucuaaugcacauggaauuuauuuuuguauaauaugugagcuagaacuugaaguuaauuuuuaaaaauauuagucagugucuaaguucaauauaugggggaauuaaugcccuuuuccagugguuugaaauaucaaaugugcauauaguauugcuugauuucaugugaaaauguaccagccuacugauccuaugguuaaaaacagagggugagcuuuuccucagaaucacaugacaggaguguggcugggccucagcagcagacagacaggggcuugggugcucuggagucuuguuucuacuuccuuuuccucucugucccacauuugcuuccuucuuuucacucuggacugucccuuucuggacuacucugacccuuucaucuguucggcaagaggcucuccuuggagcaccaguuugcauucucaccgugggccaguaccuuucacuguauccuggaagggcacuuuuagggaagcauagucagaccugaccagggagcuucuuggauaaaugacucgccuuuccugugccuuaagugcaugaauaauuauguuugucuuugucucuuucaguuugguacugggccaguuaccauucgaguuccuuuuguuuuuguuuuaaauuccuccuuugugugugucuguguugugucagagacuuugcaaaauugugugcaagaacuuuuuuauuuuuuuauuacuauuauucuuuuaaaaucuuauugccuuggauuuauucuuccagaugaaauuuagaaugaacaugucaaguuccauuuuacaucccauguuuuuuuuaugggaauagauugaauucauagcuuuauaaguggaaaauugguuuuccucuuugagacucauuuuguagaaucacaguguguuuuuuuauuuucaaaguguguuaauguauaauaagcuggccauguuauuguuaguugucuacccuguacuaaucucugcuuaaucaaacagaacuuaauggaaaauacggaaaacacaguuaaguuaaagaagacaacaaauguuuucuauagugcugccugcuauucauggaugacacaguguuguguggugguaauucgugggugugaaucaucaagaauacagaaauguggcauuuuuggagcaugugcacuugugugcagcagagccggauagcacuuugcacuauaguacucauaacugaagaacucuaagugcguugucucggccauggaagaaaucugaauggauucaguaaaggcuuuuuuacuuucucuggugaucaaagaauagguccugcugaaaagguccuguucacaucugagaggaaagggaggcaugagcuaugcagcucugcccauguugguagaaggaaacuuuucucaaggcagcucuguuugcagcuguucacaugaccacuuucucauguagguggacaaucaagugucuagcuguuuggucggcacuguggcaaaugggguugugguggccuuugcaaaugaaguguucaagcaaaguauaauuagugcuucucugugccuuuauuuuuccuccauccccccuaauuccccaucgaaagauguaugagauucuguuuucucuuccuaccagccacucuguucaguccagaaaaggguccuagaaacuggaagucacuuccauggugaaguaaucaucccuagacugcuuaaaauggcggccuuugcccuuucucuuuucacuguguugcugccucuuugagucucccgugaggaagcaauggaaguccucugaagguucacucugagcuuccuuuaguuaauccugcccuggguuuggccgcucaugccaacacuuguuuucagcugugaggaugggccucuggccauggcugcccuuggcguagacucuggaggcugcagugauuccucggcucugcagugcuauguuccuugguuuuccugacuuccugaguuucacuaaucuggcacuuccagaccuuucaguuuuauuaggauuucuucaacuuaggggauacgccuugacaaauagaguucuuuuauaagaaagaacuuuacccugaaaaaaauauucacucuaucuuaacucugacuguuuucacaaaugugcgaagagcuggaaaauuacaauuauucucagagaagcacagcugaaauauucuuguuuuguacuaaggcaacaaauuaaaagaaggauugagggcaugaguccuugaaguuuuugaugauauaguuugugcauuaugggguucauguaucacugugggaccuuguuacuuacggaauccacgggaaaauauccuuaaagucucuucauuccucuuaagaagagcuuuuaauuuccaguccugaagucaucuuuuuauuuuuuuuuauugcuauuccuccugugaccaaaccaacuacuuuucuaauuaauuuuaauaauaggaagacucauuaguaaugcacugggcugcugggauagacuauggugacacuugaaauugugaaaacagaaugaaaugauguugagcauuucugugucauuuuaaauuuuacaugguuauuucaggccaagcaggaacauuguacucagcauuuggaagaaugugugcuaauguuuauaauguuauauuucaauuuuuuuauuugacuuguacauugucacagccuggcauuaguggucauuuuuaauggccacaguuaauggcauauuaaguuaaaagagacugaagguuagaaggaaagaagauaguauauuuuaauuauugaaauauccucaauggaaacaauuaacucucaagaaguguaugcuuaaaagucugaaucaaaauuaggcaaauuagauucucucuugaacaucuguaaggcauugaguguaauuggccugcagcugcuacugacagagaucuccagcuucguuccucucauucucuuccgucuucacaugucacuuaacuuccuuuguucaguugcugucuaggucagaugcuugugucggcaaauuaagaaauucuaguuguuuuuaagaaccuaaagcaugucuaucugucaaaaucuuuuucuccaagcaccuguuaaccgucagauuuaaugugccucagcuguagcagaguugcaaguaacuccagcaggacguacugauguuaucuggguuuugcuccuguucaacugcuucaugaaauuagauaacauuauuuaguuggaaaaauuuaacugggucccagaauagaagaaguccuuauaaaacaagacugcaaacacauuugacaugaauuucaaaaugggugaaaauacaaauuuguuucuaugaaauugcuaggaauuaaauuccacaugaagacaauaccuugugacauuaccacauugucuggguacaauuuccugcugaguuauuuuuugguguguguguguguguguguguguguguguguguguguguguaucacucuagagagaaguguuuuauucuugcugauauaugagacuccuucagauuuaauuuaaugggaaagagcagcugcuucaagagaauucuuugaugucaucuaccuaucuagcugcaggucaaagucaaaacccagcuucuuacaaugucucucuacuuaauucuaauaugaaauuaaauuauauguguuauauuuauagauauacuagaacauuugaccaaauauuacagacaacauaaaaauaguuuuuagucucauagucauuguacacauagcacauggcuaaguauauauuaaacauuuaaaugucccauaaaauagacugaggauuuaaugaaacaccuccuguucaugucuugauucaugguagccaaaccugauggauuuauguuuugauagaaaguaucacuaaaucaugguacaguggaagauuagcauguguacuuguuuauuugaucugaugucuauuacauuguuagcuucauaauagcagaggcucauuuugguuuguuguauuaaccuugcugggaaaaauagugucuuuguuguaguuugcagacugaauuaaggaugacuacuauuggcaaacacuugagugaacuaaguuuaaaggauuguuugcuuaugggugaauugacauuguaagguuguguuuguagugguauaguguuacuguaaaaacagaauuucauacaucacagaccagaugaaucauagaaaucauagaaucauagaaaauauaugggaaaauggaaagauucuuuuacauacuugugcauucauuacuguacuuuugcaggaauaaauugauuaaacccccacccuccacuuuuugccuuuuuaacuuguugguauggcuuuuucaaagccaauuuaaauauguaauauguucacaugcuucaggauucagaagaguagaaguuuauaugguaaauaucuuucuccaagauacccuguuaucuuucucuuaggcaacugcuaaucuucauuucuaauaacuuguaagacucuaugcacauuuaagcaaauauaugcauauuuccuuuuauauaucucccuggcugcuuuugucucugcugugauaaaaauccacaacaagaugcacuuuaaggugaggaagguugcuuucguuuuacagcuagagaagacauuuuucaucauugccgagaaggcaugauagcagggauaggaggccuauugcaucucuaguuagguagcuuagagugcuaauagaagggggccaggauuuaaaaccauuaaagccuucauuuagcaaggcuguacuuccuaauuuucugaaaauuugccaccagugagggacuaaguguugaaacacaguaaucaauguuggggugugugugugugugugugguggaauuucauauucaaacuauagcaacauuaaauauuagaaauaucuuucugaacauugauugcuuuuauugaauaugucaugaggcuucuuuuauugcuuuuuuuauagauagaagguguuuuauuauauugauauaccauuauuuauauuauuaaucuccaauuacauuguuucucaucuucuauuaucagaguaggugcuaaagaugacauuucacacauauguaaauuuuauuacaagauaaauuuuugagcuggguuaccuaguaugcauuugcaguuuugauggguuuacucaagaucacaaugacuauguguguuaauuuguaugugcuuauacacacaccugaguucuccugcauauaaggccagacauguuagguacccugcaguuggagcugcagcugguuuugagccauccaguguagaugcugacauuaaacuauaguucucugcuagagcagcauacccucuuccaacgccaauuuagaagucauauggcaauuuuaucauuuuuguguucuuaaaaacacucuuaucagacuuaacuuacacuaauucuguucugaaaaauaauguuuauuaguucaaaucuauauuuuccuuuguugugguacugaacuguucauauguuuaaauacuuuuuuguaaccucucuuauuuuuauuuugaagaaauuuaauugucuuuucucuugucaguuuggaaagaauaaagcaugaugauaucugugucuccauuuuucauuuauacacugaccaucugucuuaaaauaaugcaaguagacaggcagugguagcacacgccuuuaaaucccagcacuugggaggcagaagcaggugaauuucugaguucgaggccagccuggucuauagagugaguuccaggacagccagggcuacacagagaaacccugucucaaaaaacaaaaaacaaaaaacaaaacaaaacaauaugcaaguagauuaugguugauccagcauccuacagaaggaaguggggcugaguucucagagggcagagugcauguccugacugugcuaauugguaacaugagccaagugcgcaagacuggcugcuuuuguuucauuuuuaaauaaaugaauauauagaauaaacuaaggaaaauagaugaauuaacuuguucucccuggauaacagaauaggaaugaaccaacauuucuugguuuggagacucaaucuucaguuauguauaaauaaagucaaaagcacaacuagaacccaaaaggcuuagaugacugaaaagcugacagaacaaaugcacacaugauaauggugaaauguauuuguguggggacuagcuaacacuuggaacauuaaagcuuguugaguggaauccuaaguuagcaugcaguaaagacaauaaacaaacaaacaaacaaacaagguauagacaauacacacagaggaaauaacugaggugaaaauaacuuggaguuugaaaguaaguugaauuuuuuuaugguuuaaacauucaaaaaaaugaauaacauuccaguguaccagcuagcaguuuaaucuucguuuucauuaucauuucccaagucucuaguuucgcagcugcuuuugugucuguccuguugcacauccaauggccugaaucucugucuuuucuaagaucuguguuuuugagcuccucauuaccuuuauugcauagcuuuuuuucccccauucacaagggauuuuuauaaaagaauagcaagaugaaauuaaacaccaaauaguagccucauugcuucuuuaccaaauggaaaugcugcuggaguucgauuuuaugcuugcagaaaaugccugugcaguauuugggcauauuugacagugcaagguagagaagaguccauuuaguagugucauuauaaauuguguaauagauguagcuagaugagaguuucuuugucagugagucauuguaugaaaauaaagaaugaaggggagaaucuuauucaaacgaccuuagaauuaugauggagacuugaagugacaguaggcauuagggaaagcagacaaugaaaugaauacccauguuuguacuuaaagguacucagaaguguaccacuguaaccauuuuuuguuuguuugucucuacaucuuauaaacuuauuuaaauaucuaucauucucaucuguaauaaauucuaaauuuguucuccaaauuuuuagcaacuggagcaauaaauaugaaucauaguugugaauaaucaaguaaguacauuaaaauaugaacuuugcugaaauagaaaacugaacuugaagaaucaauaguuuagggaugaaaacugcugcaaauucagucaauguaaaaauagcaauaaaucaauaauaauaaacauuuaaguugcuuagauaaucauuucacuuuaaacuuaggaaaaauugauaauuucucugagcaaugugaaagauuucuugcauuugaaugugccucaaugaaaccaagaaauagaagaacaaaaauguugagagaaauuucuucugacauacacaaguaucaauuugguaaauaagagagaaacauuuaguguggauaucucacugauuugaggaaucuuugcggauauguguuggagucacugaaauauaaaguugugguuacugagcuugcagugaauuaaaagcauaaguuaucugggugguuuuaggaaauggagucauaaauauuuuuaagugaauucuaauuuuuuaaguccaagggcccaucauguauauaggaaaguggauuaauauuuucuaaaacaauuuuugacuuuuguuguagauaucuuccauuugcuggcagugcuagucugcuucugauauuuauccauaugauaaaaauauuaggauauguaaauauuugaaacuaagacaaacaaagggugugcccauauucagcuucgauaauacaugaacaaucaagcuuugagucuaguguauaagaugacauugaagcuaucagaauaauaagcuaaauaaaacuuauaaacaucuagaauggcuaucauacuuaaaacuuuauguauguuuagauuugugagggacuucagcuauacagaaugacuaaggugauuagucuccaauugucagcaagacuagacuggaaucacuuaggagacauaucugaguccaucuuugaggacauuuccagagaggcauaggcccaacccugaauguugacaacagcaucucacaugcugggcucccagcuagaaaaaaauaagucaaaaagucagauaaacaccagcauucaucccuuugcucccucacuguaaaugcagaggaaccagcuacuccaugcuccuacccugccuuuccugugauuaggaagcagaacuuccaaauugcaggcuauaucucuccuuuagguucuuuuggaguuaauuaaaguuauucaucaauaauuucauacauuaauguagcucauuuugaucauccuuagacuccaccauugauuguacuuaaauuaucuuuagacucuuauuucucuccuucuuuugucaaacuuaaugcccccuucucuuuacuggacucuuuugcauauucaugucuuuuugauuugcuuugugacuugcugaauuuaacuagggcuauuucagaccauggguauguaacuaucuauuggauucuggugaucgcaucagcaaacccuuuccucuuucaguugcauuugaaagcugccaaaucuuaauuuguggaugugaauuaauuauuguuagaaacaaaugggauccugaguuauuuggucacguguccuuaaaucauugagauacucagaagagggaugaauggucagcucaguagcacuaguacaucugugauaguacaccuagccuucuucacacucccuggaaggcaugcuucuagaccucuacugauacuugcagguagaauuuccaaaggcagcuccaguaauugugaaucugaaaucuuuaaguuugauaauauuuccugaacuauacauuccuaaagaacauaauuggucaguguuauguguucuugugggaaguguaaacuaguaguauugaagauuuuauuuauuuuuauuacauauaauauauuuguacauuacugcuauauauaaauaauauauuauauauauauguguauauauauauauauauauauauauauauauuugcaucucuauguauuuguacauuaccacugaguaguaucaucugguaugauuaaauagaaaaaugaguguuuguauaaguggacccugugugcauguuguguauacaguauauaugugacuuuguuauuauaugcacagauaaucauucacuuguauguaaucaacauauuccuuauauguauaucuauauaaaucuuacuaagccauauaaauaauuuaaauauauguccuuugcuagaucaugcgguucauguaauugucauucccagcaauccuuucuuuuaaauagauagauuuuacuucuaagauggaugucauucccaaaggaaaaauuauaaccauggugcuuuugcacauauguggagaguccuuuugugucaauagucauucaugugccagugauaacugccuuggucuucaacuauuacacauuucacaagugaagugaaugucugaaggccagagcucauggucagcgcccccuuugcucacauuaggucacugccacccuccuuucacuucccaugcugcucaugcuggcugcuguccucucugggcaucaccuaccuccuuacuguaaaucucccuuuacccuuugcaccuauauacacucagcauuguucccuacagggaugcucuauagugaaaagcugagggccucauaagaauuaaaauugacuuuuauuuucaauggcgaugucuguuauccaaacacuuguuggaagaggauauuagaauuaaaaugauagcguuuuuuaauggaugguuuguuuauuucauuuuccuauauuaaauauauuuauaauagucuguauguuaucuauauugaagaaagucuccacaaaaucaaauuauuauguacacaccuauuaacaagggaagaaauauccuuacuuccuaguuaagaauauuuuaaagugauuucucuucacccaguaaagucauuauguguguauuuuguuauuuccuuuauuuuuuucguguuccuagguucacugcuacuacacuguccacgugcauaucacugucaacucaguguguuacagacuugcugguucuguuggcuaauuuugauccaucuguacacuucagggaacauaugcauacugugguagcaaaagugaguguaagcucuuaacuguacauugaaagugauugugaaccccacagagaaccugagagauacuggucuauuauuuguaaccaugaguucauaugaugccuccucaguuugugaccaucacauagacaguacugauucugaaaauacuuaaugauuaucuuuucaguugaaacagucuccuagauuaaaaaccugugcuuuuaugguaggauucgguaauggaaugccuguagagagggcaaaauucaauauguucuuugcccaaagauauuaauucuaggaguaaacagguuauuucuugaaaugaaccuuguaauaaaugcaauauagcaaagcugguguaagucauaauagagcauuucuccuuucauguugcuuugcuaugaaugguuuccaauuaaaaauaguauauauuuauagcaguccugauucucccucccuguuuuccguucuuuacuuucaaguuuaucucaaaugaacuucucuuggucccauaaggcuagucuguuuuugcauuccucaguucugauuucuuuuggcaggaggacuagaugugguugacagaucauaucugagaggggcuuugguaauugcuuguucuguucggcgacugugcugcugaacagaugggcacagugaauauugaacguguucuggaccuccgcauccuccagcucgugagcagggagcacugccagcauucuccuuauugucuauuagcaaacuaaaaaaaaaaaaaaaaaaaaaaaaaaucacuuggguucucucaucauuuuuggacccauaacuaucucacguuugugguggguucucuccaaccucuugugcgccccacccccacccccaccccuguguccuuuuugaaauaaugaaaauucucaagauguuagugcaugcugccaugaaugggugccaacaauucuuacagacuuguuaaaagauguauuuuuugccuaagaacuacacauauggccuggaaugauaauauuagggucuguguugguugagauaauuggcagaucacaccuuaagacagugauuggcuagcuugucucuuucauuuuaaucuguuguuuccaucacagccacauucccauuauggugaacauuacuacaccuuaaaacugucacuuaacccauuuguuaagagguaucuguucauugaguuugaauuguuuaaagcauuuucuuauauugcuagcaaaaucaaagugaacaaagguaggagaucccagaugauugcagauccacaaagcugguuuuccaagggaggaucagguccuacaagagacucugagcacagacauauacacuagaaguaacaaauggaaucuugacaccaucgcagugaagauucaccauccacauggugacagagggccgggccucuauggguggagagguaccgugaggucuuuacugucagaugccuuucugcacaguucugaauaaaacugcaaaggugugcucaucuucuuuacugauaaaauuuacauuaguucaacauuagccuaaauauccauuuuuuuuuuuuuugagacaggcucucaaacucugucuugaacucacuguuggcccagcuggccuugaggucacaaagauccccugcaagcaccaccaagccaggcaauaucagucccugucaagcauucugcucucuaacacccaguuuuuaugauaaugaauguggacauuuauuuaugcuuucaaaaacaugcuaagguugaaucaauuguuaccuuuugcuuucaggucuauuguugacugugugaacgugugaaaaaacauggcuaguguuggauguguguuuucaugucugguugcaaggaagaaaaggcuucuauaugucaggcaugaaagcuuagauuagacagucccuugcagagguagcauauguuauaauugaaaaggaguauguuacaaaaugauggagugggacagucuccuauuaaagcucucuguuucucaucuguaauauagguuuggaaaagagaacguguuauuucugcuugucuaucauuccuucuacuucauguacucacuggauauguuaguguuagcaaauaaaugauaaaguaaauuuauaucugcccuuuucuccuuugcuugaauaacauuguucuuuauggaaaacucuacaaugucacuuuguauguucccuggaucaucauagucauuuucauccuucccucccuacuaggacaaaugcgucugguaaguaucucagugauuauuauagcauuaaaagaucucuuggaaugacauuuaauccaauccaggggagaaauaacugagagccaagaagggucagggauuuaugcucguuuguacaagucaauugaaggacuggaugccaaggacuagccucagcuugcagagggguguguccuggagaagagaaacagagaccugucaccuuauauggcuucuuuguccuuguucaaauccagcaauggugcuagaugauaucuucccuggccaaugaacagccuugacuuggagagggguucucaggaaggggugucugggaguggugaaaaccaacuacugggagucaaauucuagggccaagcugagggccuauguuuugcuugagauugcuuuucagauugcucccucucgcucucucucuaucucucauacacacacauacacacacacauucauauucucucucucucucucucucgucuccuuucucucucuuccuccccccuccuuauccccccucucucuagguuuucugaugcuuuuucuaaaaacucucugaauuguucuucucuugaagaucacaaucccagucuuuuauuuacauauccauucagucauuaccccagcuuuccuuuugauuauuccaugacugcauccuaugaccccaacccuuugauucuuagaaagagacaccaagcacagacaguaagagagcugagugggaccagccaugaaauuaccauuccuacugugccuaggcuucugucccaggcugaccuugaacucaggaaucugccugccauuguaagcauaaacaaacaaacaaacaaagaagcaaaaccucaucugggugggaucuugcccugcuaucaccacuuccucaguaucuuucugacaagcuagcucauagggcagcugccuguguuccuuuggauuaugcagcuccuuguccaauucauauugcauccuucuauuuggcauaguugaaaaauuaugcuucuaacucuuguuuucagaguuccuucucucaguuuuaagggcugucuugaaggucacaacauuguaccauuuugcugagacauuagauauacccucaccuuucaaacuuauacugucucugauuaucauggaguuauuaaccuuggcagagaggacauuccugguaggagaaaugugaaaauauguacacuauuauacaaacaaacuuuucgcccacagcaaccaucauacucauguaggcccacacccugcuggcuugguuccagugacagaaacugugucauuuagucccuuacaugguccagcaggacucagucacuggagaggaucuagacccuccuuuuccaucuucauugucuuuacugucauacugccuccugucacagacucuaucuggaugaauugccugggaaaacucacaaauauucagucuaguucaguugcuacuaucaauguuuucauacagguuuuaauaauagaauuauagaccucuucuuuauucuuuaagccauagauuuuacaaguuccauaaauauuuauugaaugggugaauuaaccugguaguucaguuuuacauaugcaguauuuaugacuuacaaaaaaaaguuaaaaucagaaaugaaaucaagauagauccaucuguccuuuuggaaagcccuuguugcauaaugaacaccggcacaguuguacaauuaaauacaagucaguguucaucaucagaagcagaucaugugacaaacauuagagauuuucagaacauuaugggugcucauuuuguagcccccaaguuuguagaugcagauuuuugccaacacacacacacacacacacacacacacacacacacgggggcggggggggagagagagaaugugagagcaagagagacauacacacaaaaaaauuguuuuuuuuucuuuuuuuuuuauuuauuacguauuuuccucaaugacauuuccaaugcuaucccaaaagucccccauacccuccccccaacuucccuacccacccauucucauuuuuuuuggcccuggcguuccccuguacuggggcauauaaaguuugugugucugaugggccucucuuuccagugauggccgacuaggccaucuuuugauacauauguagcuagagucaagagcuccuggguacuguuuaguucauauuguuguugcaccuacaggauugcagaucucuuuagcuccuuggauacuuucucuagcuccuccacugggggcccugugauccauccaauagcugacugugagcauccacuauguguuugcuaggccccugccuagucucaccagagacagcuauaucuggguccuuucagcaaaaucuugcuaguguaugcaguggugucagcguuuggaagcugauuaugggguggaucccuagauaaggcagucucuagaugguccauccuuucgucacagcuccaaacuuugucucuguaacuccuuccauggguguuuuguucccaauucuaagaagggguuuaucauugcuaaauuuauucauuuucuauaauguuauugucaccuaagaauugaagacaaguaggcuucucauuuugcauugcccuuuggucucaucuuucccuuuuucuauagguuucaucucuuaaauauucuagugguuuuuauuauuucccuuuagauuuaccuuaguagauauaaggaaaauuguuuuuuguguuugaugcaaaaccaugauuguaguucucagguugcuaauuagugaucaccuauaugucagguccucauucuccauuugcauauagggcuuggaucuuuguauauuauuuucaugucucuaaucaauaaaauauauuucuccuugacuuuaccauggcauuucucaucaccauucacaacaugaaauuauacuuccuuuuacuaauuauaaaguauauacaacauugacaugcuaugcacuuuugauagcucuuuuaaauuaguagguuaguuguccuauugcauagaaaagaguuguuucaccucaggaaacuaucuacuugguugcauauauauaugugugauuaaaaacugaaguagugcacuauuacuuccagaaaauuguuggccugacugucaaaguucuuaacauuguuugaauuacaucugaaauuuuccauagccuugaaagaacaagcaaauaaacaaauguuuacuaacacuacauucugacucuucucuuggauucauggugcagaacagguguuguguaguguugaaauuagucuaaguggcuggaaaauaaaaggcaacuuuuugagauaucuagggcaaaaugauuuagcaauaccacaauuaauuugcucccaucugagaaaaugcuugcuuguguucaauagcucuuguuaaccuuaaaaagucuaggauucuauuaauaaugaauaggccuaaaauucaucaauguuuuuguaauguagaugaagguaagaugucaugucaguacuggaauuugcauauuagaauaauuaaguuaucuuaucuuguucuuuaaagaaauaaauggcuaugcauauucauggucaauuaaaauauuaaugguauacugauacuucaguuuaaguuuucauuuaaacuugauuaacaguaaagggauacuucagcacacaguauaauguuagcuuuuuugucucugaaaugaaaacauaguaccugacauguauaauugauuuguuuauuuaugcaauucaucauuuuuauggagaagaaaagauucuuuuuguguacagaguacguaaggcaugggaaaauauagaaagucauuguauucuaaaauucuuuucuucaauuguagucuucaucuccauuauuugucuuucauuauuugucuccucuccucaacuccccucuccuuuuuugcugggaaacaacuccugagcauugcaccuugaguguucccuugaguaacauccccagcgcuaucuuacauguucuaaauuguuguaaagauguauaauacggaagguggcauccuucucuuuuuaacuuguaugguagaguauuuuaaacugcauugccaguacuguucaguucucaccaucccgucucuggaauucuuuaugucuugugaaagucaaacucauuuaguccuaacccacguucacucaucauuguggcccugucaaccaccauuguuucuaucucugugaauuucuccuuucuauguuucauaugaauaaaacaaacaacauuuguguucuaggccugcuuuauuuugucacaacugggagaaaaccaccuaacucacagugcuaccuucugcauccucaggaauucuucuaaaauuuugcagaccuauacucaggccaaacagagguguauagcuucaagguagaaaagaauuccaguacuaccagggcuaauaacuauagccuuaaacagaggauuauggagaaaaggagacauucagaaagaaagauauacauauccaguauagaauagaugacuuuccuguucugucugaagguuuaaguuucaguagcugcaccuucagucuugaauaaauaaguuuauuaaauauguaucaagcagaaguaagagaacagauguuaauuaacagauagcauaaccacuucaaaucuggugcuuauaauauccaggagaaaugacagaggaaaccuuauugaaacagccagcuagaguuucugauggagaguucuguguggaauccaguauucccucgaggaggcuuccauguaaaaacaagcaaacacaagucucaaacaaacaacuagcaguuagauaguaacauaggaucuagugcaccaggaacauuggagcaaugcugcugcagcucccgagggaccucugcacagcagagcugucaugccauggaacaggucuguggaugaaguuuugccccuacugugcacauuucuuauuauggcacaaacaguagaauguugaucaaaauuuuucuuauagcugcuaagugcaaagguuuuaaugccauuaguuguuauucuucuauuauugauguucauuuuauacccccaauuuguuuguagaugcagauauuucucaccacacaaaccacacacauacacgaacuuguuauuaucauuguuaaaaauauauuuauguuaaaaauuagcauaauauaaaauauauuuauauauaauggcauugucacccaggaauugaagaaaacuaggcuucuuguuuugccccugggucucaucuuccccuuuucuaaggauuucaucucuuaaauacuagagggauuuucauuauuuucucgcauuuuccuuaguagauucaaggagaaucuuuuuucuguguuugcuguaaaacugugauuuuagucauuauuguaguuguuauuuuuauuggagugucagaagccuagccugcucuugauagggagucuuggcuauaaaccugcuuucauguucugaguucccuaggaaggaaccauuuccccaaaguucucccuuuuucucuucagcuuuauuuagcauacaguccucaguguuccuccauguuguaggacaugugagcuuacuuccuacaaggcugcguaguauucucucaugcauauguaccaccuuuuuauuaaucuguuaugggguuuauuguuguuguuguuguuuuuacagauuuugacucuccugagauagaauauggauugugaauacauguuugaaacucuuccuuuucccuggguacucccagcguagucuuucugcaucaugugaugcaucaaauuuuauuauugggauuccuuagaauuuuccauagaccagcacuuuuuuuuucacucuccauccagugguacauauggcuucuguccuguccaaauucucaccaacacuugcuauaaugccuuuaguacauaguuuuuuaaguuguagaagucacauauacuucuuauggcaauuggaauaauuucuacaguauaaaacaaaauugaaaauccuucauuaauccucauagacccccucaaauuguuacuuacacugacuuaggucucagaagagguuccauauuuuaccaccguccuuccaagauaccccuuuccaccaccuguacuucccucuuauggcccauccuuuagcaugauuccuucaaaugagugcauggcgcagaaugcugacuugugucagggacuguguaagucacaugccuuuuucccuuagugguacuguuuccccccacaaguuguauugaaguaaauaccccugaacagccagccagaaagcucuaaggaugcaauugaggccucucuccuccaggauuuccuggcuucaaucuccuccagaucaugcucugauuguauauuucuaaauuccuccuuugaggcagaugccagcuuaugaagacuauuucacguuuuaauguugcuuuugauguuagaucagaaaauguuuguaccagcaaugcugacuuguuaaugcggccuggaaauuucaagugguuugaaagucugagaugauccaacaagaacuuuaauuuuacagaugagaagacugauuugucaaauguuuuuuaccaguguuuguagugaacagcacuucugaaacacaccucugccauccaggcuucgaucacuucgugggguggggggaggguuuugagagccaucagcaccaggagggucgggucgccuuauucagggagcacugccuggagauaugcugugccagaaacuuaagccaaauaauuauuagugugacauuccucccuucauaguguaaguggcuguccaugaggggucaaacaguaucucaauauuguuccaaacuuuucccaggaauccaacaucuagggagagcacagacacccugguuauauugagguuggcuaucuucucccuuaccaccacaaaggguuuuuuaguauucuaaccucaguuacuugauggaguuggggaggaaauucauaacauugaaagcagagggaacagauauggcagaucugaccuugaacuccugauccucccacuuccgcauccugcaugcuaggauguacugugcagacuugugcacccaugcuugugcauauggagggcaaggucagcaucagaugucaccuucuaaggcucaccaccuuauuuuucuaaggcaaggucucucacuaaaccuggagcuugcuuuuuuaggcaacaaauaugcacuaaauaaagauagaauauuaaaagcaguaagggagaaaggucaaguaacauauaaaggaaggccuaucagaauuacaccagacuuuucaccagagacuaugaaagccagaagagccuggacagauguuauacagacacuaagagaacacaaaugccagcgcaggcuacuauacccggccaaacucucaaucaccauagauggagaaaccaaaguauuccacgacaaauccaaauucacacaauaucuuuccacgaauccagcccuucaaaggauaauaacagaaaagaagcaauacaaggacggaaaucacgcccuagaacaagcaagaaaguaaucccucaacaaaccaaaaagaagacagccacaagaacagaaugccaacucuaacaacaaaaaugaaaggaagcaacaacuacuuuuccuuaauaucucuuaauaucaauggacucaauuccccaauaaaaagucauagacuaacagacuggcuacacaaacaggacccaacauucugcugcuuacaggaaacccaucgcagggaaaaagacagacacuaccucagagugaaaggcuggaaaacaauuuuccaaacaaauggccugaagaaacaagcuggaguagccauucuaauuucgaauaaaaucgacuuccaacccaaaguuaucaaaaaagacaaggagggacacuucauacucaucaaagguaaaauccuccaagaggaacucucaauucugaauaucuacgcuccaaaugcaagagcagccacauucauuaaagacacuuuaguaaagcucaaagcacacauugcaccucacacaauaauagugggagacuucaacacaccacuuucaucaauggacagaucguggaaacagaaacuaaacagggacacagugaaacuaacagaaguuaugaaacaaauggaccugacagauaucuacagaacauuuuauccuaaaacaaaaggauauaccuucuucucagcaccucacgggaccuucuccaaaauugaccauauaauuggucacaaaacaggccucaacagauacaaaaauauugaaauuguccaauguauccuaucagaccaccauggccuaagacugaucuucaauaacaacauaaauaauugaaaggcaacauucacguggaaacugaauaacacucuucucaauaauaccuuggucaaggaaggaauaaagaaagaaauuaaagacuuuuuagaguuuaaugaaaaugaagccacaacguacccaaaccuaugggacacaaugaaagcauuucuaagagagaaacucacagcucugagugccuccaagaagaaacgggagagagcacauacuagcagcuugacaacacaucuaaaaguccuagaaaaaaaggaagcaaauucacccaagaggaguagacggcaggaaauaaucaaacucaggggugaaaucaaccaaguggaaacaagaagaacuauucaaagaauuaaccaaaggaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguuguccaucuaaacagucccauaucaccuaaagaaauagaagcauuuauuaauagucucccagccaaaaaaagcccaggaccagacggguuuagugcagaguucuaucagaccuucaaagaagauguaauuccaguucugcacaaacuauuucacaagauagaaguagaagguacucuacccaacucauuuuaugaagccacuauuacucugauaccuaaaccacagaaagauccaacaaagauagagaacuucagaccaauuucucuuaugaauaucgaugcaaaaauccucaauaaaauccucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguuuuggaaagaucaggaauucaaggcccauaccuaaacaugauaaaagcaaucuacagcaaagcaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauucuaccagagaacuccuaaaccugauaaacagcuucggugaaguagcuggauauaaaauaaacucaaacaagucaauggccuuucucuauacaaagaauaaacaggcugagaaagaaauuagggaaacaacacccuucucaauagucacaaauaauauaaaauaucuuggcgugacucuaacuaaggaagugaaagaucuguaugauaaaaacuucaaaucucugaagaaagaaauuaaagaagaucucagaagauggaaagaucuuccaugcucauggauuggcaggaucaacauuguaaaaauggcuaucuugccaaaagcaaucuacagauucaaugcaauccccaucaaaauuccaacucaauucuucaacgaauuagaaggagcaauuugcaaauucgucuggaauaacaaaaaaccuaggauagcaaaaagucuucucaaggauaaaagaacuucugguggaaucaccaugccagaccuaaagcuuuacuacagagcaauugugauaaaaacugcaugguacugguauagagacagacaaguagaccaauggaauagaauugaagacccagaaaugaacccacacaccuauggucacuugaucuucgacaagggagcuaaaaccauccaguggaagaaggauaagcuuuaaaagagaggaacucacauuaaaacguuuguauuugagagcugugagauaauuggguaaaaccuagagcucaugggagcaaucuggaccaggcguggguuauaggauuaucauuaggauucagaugcacuugacaaugugaugcugaggucauuuucaggaagcauguugagcacaaauuauugagaacgaaauauuagggaccugagcauauuggccauguuggaugaagaagaggccauacuuaucugaagccccaccauauugucuccaaacuucugcauccuuuucuucuguccaaggaagugggaucugacugggaggucucuuuggcaguaucuuugacauguuggucaacaaacucuuucauuuuucuccuacaguagcugccaaauaugcucuucuuuguuuuaaccacgccugucacuguauuuuaagcauuuuuaaugauggcguuuuuucaauucuuauuuuacuuucaaauuuuucucauacuuuuauuuauuaaauauauuagaguuccaaauaacuuuucauauaauaaaaguucuguuaaaaaaacaaaauaaaacauuugaaacuaccaacuuaugaagaugcuucauccaaggcuucagugucuauaaauuuugaauauacgccucaucauaaauuuuagauuccuucuguucugcaguauuuccuccuuguguuuaaaauuauuguguugauugguucaugugcacguguggaggugagaggacaaguuaguaggaggagggccucuuuccaccacguggaaggagcguugucucagaucggcaggguuagaguuaagcucccucaccugcagauccagcuucuuguaauuuuaauucucauguuuucaugucugccuuugauuaauaauguuuccuuugucuucacauuuuugaugcaugcaaacaaagauacucuuuggaaauacugugauuauuacauuuagacuggcaaauccuguacagcuacuuuuuuagugaaacugagauaacuuuuaugaauaucaaugcuuuguucuucugaccagacagauuccugcacugauauauucaugucacacugagugagggcgccuugucagcauagcagacuguagccaagacacauaggacacaagacacaucagucaacucucaugccucaccccccugaacaccuggacagauuuuuaucuuaauguuucuaaaacaggcgaccuauaguuuaaaggaguauuauccagaauaauaaaguaccaugcuuagcacaguguuauauuuuuuucuagccaauguaacuauguauuucuccuuugcuaauuuugcucauucaacagguauugcuuuuucacuacucugaacauuuucuucagggaaccaaacagauacaaagaucacuguuaucaugaagccuguguguaagcucauaugcuggaguaucagcuuaaaagaugauaugaugauaucauauauugguaugugcuaggcauaagaauuaaaggggguacaggagauauaaguccuccaaagggagaggugggaguuuuaggcagauccuauggggaugugucuuugauacauguucucugaagagacucaguaccacgguaaguccucucuuucccccugacaaccugggcuuucuucaucguaccugcuucacuggcuuucccuuugcuccauaagggcucuuugaucugagggacaauuuuuguuggcucuguaguccucauuccauuuuuauugaaguagaaauauaucauaaugacaagaauugauacuguaucaaaauauacagauaguagugauggaaaggucaaggucuucacauuuaauaggaaguugguagaauucuucggaagcuaaauauuuaguucuuguuucaucaaauuuauauuugcuccgacuuucaugaugugaaaaugaaaacccgaaugucuggaggaaguugccaggaucagauguuauuauugucacauggagauugagagucaucauggcccugccuuugaguuucagggugaaaaugcugcacuaagugccagccaaguaaguguuccugugccaggaagccagcccuggacuugugucaccuuuguaggacagugccaucagccaacaucauucacaucauuugcccuucuuauaucaugugugcaugccacacuaaacaugugucuaucauguagugaacuguccgaguuaaguuuuugcaucaauguuauaugucuaucaacaaaaucagguggguugagcacauaauuagcaguuaaauuuguggccaagauuuuuugagauuucagcauaccauccaggaaguugaagucagagacaagagcuaggauguaagguucucacucacucuucagguaccugagaagaguuaagacuucugcaggggugacaugaaagcuguguucuuucuacuuccguuauuuugaacuuugaaggaaaaauaaaaaccugcaccaaaugcaaaauucugauuaguucucaguuuuuguuuuuguuuuucccccuuaggggaugcuguaaacuaauuucaucacacuaaaaaaaggaagaagaaaaaaaaagcucuaaccaaaguuugcauuuguuuuuccuuuggggauuugacauuuucuauuucuugacauuuuugccaucauuagcccuacaucucuguaugcuugcccuauauccauccccaggagaaauuauguauuuuaucuacuggaaagcaaugccuucugccaaggacaagccauuuguuuguuuacauaaauagauccaccuguaguguaauagcccaaucguugggaacugggccaugaggcagcauuuagauucaugacacucagguccuauauucacuccaagaacaaaaguuaaauacuauguaaacaaagugaacucuuugcuuuucuccuccuuuccucuguggccuuugcugccauauccuauacagaucuuaaauggcauccuacaaauggauaaagagcuugcuuaugauuuuauguuggaggaguaauacuuuacaggcucuugguucaauauuaacauagugcuguccuuuauucuccacuuauucauaugaaaucagaugacaaaaaauggaagaccuagagcuuucuuaaccauguuuaggucuuuuugaugucauugaauuuuaaauacaugcauagguugccaucagccacccugaaacuuuacuguuauccuuagcucugaaaguuuguguaaaaauuuuguucuauuacuaaguggcugauagaaaaauuuuaaugguccuauuuaaccaccucuuugcaaaaguaaaugauucaggugucauauaagggaccuaaauauaauggaauguucagugaaugaugaagucugaccauuguguuucagggauuaaauggauguaggucugagaauugguuuaggcaacuugacuguccuuugcuguagccauaagacagagacagacaugcuguaguggcggauuuuguaauccugaguguguacugugagccuguuacagauagcucuugaauuuuuccuauucauaacacugauguucuucuacaaauauuuuuggaccaaagauaggaucacuaggucuagacuugaguauucaaaggcuacuuguaaaacauuuucugugagcccuguggugcauucaugaauacaccuaggacccuguggagauccacugaguggccguuaaauuaagauaauguuaagacuuaaauguguauuaaaaaugagaaaguauuuguuuucaucccagugaaucuaguaauccucauuuguuauaaaaacccggaagaggaaaaaaaaaugcugugagcaguuaucacuuaaagcuguagcaagcugugggcccgauguuugucucauuuuuacaaauaaugcaggagagcuaaacacaugggcaggaagguauuuguuaaggcaagagugacagugaaacuuuauuguucugauuguggacacuggcagguccucauucgcuucagcaucuaauguuuucuaucugaaacgaauucucgucauccuuacucagaaggcauagccuucagguccuuggaaaauccaguuccaagucuauaaaccgucagccaucuuccuuccugugucacucaugugcacgccauuuugaaagggaauggguuuguuuggggggaagcacacugaaaagaggagcugaggaagcuugucagcucuguugguuaaugaucaugcugggucuucauggugggagcucucaaacuuucaaaauuucuucugcuccuagguuuccuucccuucccugccucccacacacugagaggauucuuguuguacacuugcgcgcugcauuucuaaaaugccuuuugaguggacucuaaauuagucuaagaucauauuuugaacaaacauaaugaaaaagaaaauauucuuuaaaguaauacacaaguauuuuauuaagcaaauaaaaacagauaaguuucguacaucauuuuaauuaaguauuuaaaugacaauauguacauucuaauuucagaaucuauguuuuauuugguuacauaaguauauagugaaauuuaauagcuuuaaauuuuuauuugcuagcuguacaguacauaaaaauaauguccuuggagaaaguauagguguagugcauuaacuuagugauugucuauaaaccacuguagcaagacuaucccagccucugcaaagaaaucucuuagaaugaauagucagagccauuaaagcagaaccagauggguccaagcuucuucccuuccucccugagucaaggaggagacgcugagaguccucuuaggcuuuuaggcaaaauuauauacaaugcuagcaaacuguguauaauguacaauggaagaaaacaaguuguuuaugagaaauggcacacagaaagaaaagguuccugcauuugaagagcccuuucuuccuuccuuccuuccuuccuuccuuccuuccuuccuuccuuccuuccuucaguucuucccuccuucauuucagcaauuauucucacagucucaccaugugcuagacagaauuucagacacgagggauaagcagcacgcaggcagagaguuuucuguuuuuguggagccgacauuuguuuuuauagaaucugauagacauggauugagcaagcagauuggguugugggaagaacaaaugagaaacaugagucaguugaagggugugcuuuuuagcuuuuuaucaggaugccaaaauuguugagaaaaacagcuuuaagaaaaacagacgcaugauuucagagguuacagggaccaguuuguccuucuagucauggauucugacugacuggcccguggucucuuuugguuauggucguuugucuuugcccugaaugccagauguaguuccauugguguugccugcugccuccaccuccucgcuuugcuccagugugauugccacacaguucuccucacaagccucccagugcuauuguuuucuucuguuuguuuucugucuaucucuguucuuucuuaucccauacaguuuaaauaauccauuuguuggauccuuggccuacuuuggauuuuuuuucuccuuuagcugcaauagaaaaugguauuuggguauuuuauuuucuauuguaaaaauaaaauguauaaugauuuuaugagaagcacuuggagagaaauggcuauuuucugacgugaaacauuagauugaggcuggacaaggcagccuaguaugggggaaauuggucuguaauucucucucuuuguugaauucuugugugguaucguuaucagcuggcuguggccucauaaaaugaguuuugcaauauuccuucuguuucuguuuuguggaauaauuugaagaguauugauauuagcucuucuuugaaagucugguagaauucugugguagaacugucuggcacugaaagugcuuuggguaggagacuuuuaaugacugcuucuauuuucuugggcuuauagguauauuuaaacuguuuaucugaucuugguugaacuuugguaaaugguaucuaucaagagauuuguccauuucuuuuagauuuuccaauuuuguggaguacaaguuuaugaaauaugaccuaaugauuuuugggauuuccuaugugucuguuguuauauucccauuuuuguuucugcuugugcuaauuuggauauucucucucugcuuguaauuaguuuggauaguguuuaaauaucuuguugauuuuucaaagaaccagucuuuguuucauucauuccuuguguucucuuuguuucuauuuuauugauuucagcccugaaugugauuauuuccugucaucuacucuucuuggguguguuugcuucuuuuuguucuagagcuuucaggugcauuguuaaauuccuaguacaaaaucuuucuacuuucuuuaugaaggcacuuagugcuauaaacucucaguaucacuuccauucuguuucuuaaguuuggguauguugcacauucauuuucauugauuucuaggaagucuuuaauuuauuucguauuucugcuuugguccagugaucauucaguagggaguuguucaguuuccaucauuguagugauuuggauagguuuggcccuuauagauucaccuguuugaaugcuuggucauagggacuauuagguauggccuuauuggaguggguguggccuuuuugaagguauugcaucaaucagagucuccuccuggcugccuucagaucaagauaucgaacucuuggcuccuucagcaccaaaucugccuguacaaugcccugcuucccaccaugaugauaauucacugaaccauugaaacuguaauccagccccaauuaaauguuugccuuuuuaacacuuuacuuggucauggugucccuucacaccaauaguaccuaagacagaaguugguuccaaaaguuugguauuucuguaauggaccuaacuaugcuuuuguuuggaggaauguggauuugaggacuuuggaaagcaguauauaaugcuuuaagugggacuuacugagucauucuaguaggaacauggaagacagugguccuaagugugauuugaacuguggaggccuggcucaagagauuucagaauaagaggauuuugguauguugcagagaucauucuugugauauuuuggagaagaccguggcugguuuuuucccucuuccaaagaguucucugaggcuaagguaaagagauuuagauuaauugcaucgacaaaagaagucucaaaacacccuaggauagacccuguucugugguucacuuuuccgaagagcauuuugaccaagccuaccaagcuuagaaaggacaaauacaaaguguacaaguucaacauguaaaggagcagcaggaagggcuaaauccuuucuucaaggauauuaagugacauuaagcuuauuuaugcgcgugcaauugaacaggaccuagaaguccuggagugguggcugacaccuuuaauucaggaaacaaaagcaucucuacauucaagguuagucuacagagcaaguucuagggcagcuuaguuuagauagugaaaaaguuagaaaacagaaaacuggugauguuaauaaaacaaggggggaucacauucuagccccagcaaggagcagaacuuggccauuuggcucuagauuuagaguaaagaauagaggggguuacuuggacgauuguugcugaugagcuggagcuaagaaacuagcugugguuaggaaaaguccaggaucacuguggugaauucuucuagaaaauguuuucugagcacacaaagaagcuguguuccagagauagauaugugguggcagcuagacuuuguaacauauaugaaucacccagguggaaccuguuuugaaggcauagaggggacauggagagcagcugaggcuuagcaauguaagagaccagguuaggccauugaugaaggugcagccuccauuguauuugaugagccaagacugaagggauagugcagugaguugaggcuuagcaccaagaagagaacauaugaaaggcuaugugaaaggucagcacacuugcagcaguagaccuccuaucauuuuggagaugccaguaccguggaaugacuaccaagaacagccacagcaguagagcagagucaaccaaaguuaucuuguagagugcuacugagcagaaguaguaaagugaccuaagcccuuuccaggagcucacaagaucauguguggagcccagacauuggaacaugaagcugcaaaacugaaguugccuuggaggcccagaauguuagagaugccagagccauaagauacuugccuaaaagaucugcuaauagggaguggaaccaguccacaagaaaagaauuguuuugcagucaacaaagcugacagaauuuggacaucaggcauggagaugcaaaguuugguguuugcccagcugguuuuuuauuuuuucauugguccaguguuuucucacuaugacaauuucgaauaguaauauauaucuuaugauuuuggaaguaugugaucugcuuuugaauuuugauuuuauaggaauuacagauaagagagugcauauaucucagaagaaacuuugaauuuuguacuuuuaaacauuguuaaguguuuaaagacugugauagacuauggggaccuuuguagaugaacuaaauagauuuuucauuaugaauggcuagaauccuguagggggcagggaguggaaugugguaguuugaauagguuuggcuucauagauucauacauuugagugcuuggccauagggaauggaacuguuaggagguauggccuuauuggaggaaauacauuagagucuccuccuagcugccuucaggucaagaucuauaacuccuggauccuacaguaccaugucugccuacacagugccauguguccuaccaugaugauaauggacuuaaccucugaaaauguaaaccaagccuaauauguuuaucuugauaagcauugcuuuggucauggugucucuuuacaccaguaacacccuaacuaaauaagacagugaguuuguaagcauucuguuguuugugcugcuguugaaaucuacuuuaaauauaugauggacugauaagauacaggagauuauuucuuuuuucuuuucuuuuuucuuuuuugguaucuauugacacuguuuuacaaaguaaaaggucaauauuggauaagguucugugaggugcuaaaauguauauucuuuuguguuugggugaaauguucuguagauaauauauuuuauccauuugauucauuucuuuguaaguuucauuauuucuccauuuaguuucugacucgaucuuuugucccugagagugaaguguugauuaaugugugggguucaaugugugauuuaagcuuuaguaauaugucuuugauaaaugugggugcccuuguguguguggcauagauacucagaaaugaggcgccaucucguuagauuuuuuuccuuugaugaguaugaaguaucuuuccccaucucuuucaauuaauuuugguuuaaauucuauuuuguuagauauuaggauggcuauaccagauuguacauuugcuuagaaaaucuuucucuaacccucugaagucauguccaucuuugauguugagauaugcuuuuaugcaucagaaagauagauccuauuuuugcaacaaccauucuauuagccugugucuuuuuauuggguaguuaaguccauugauauugagagauauuaaugaccaaugauuguucauuccuguuacuuugugguggugguugugguaauaauaguguguguaccugugugugugugugugugugugugugagagagagagagagagagaaugugagaguguguguguguguguguguguguguguguguguguguaguguaaacaaucuguuuuccaagaccaaugaugauuuucaccuuaacuuccugauggcuaucaacauguaacacaucacagauuucauuauugucacauucauuggagaguucuugagcauuaaaagucaagguccuuggaucuuuuuccacauuucauuagccuaaauuauuaauuugaucuaaguguagccuuaaggagaguuauagacucuccuuuauaacucaugguguuuuccagaacaaagucaugguucuuuagguaaaaaaguacauaaugagaagguguccaguuuuuuucacuuauauuguaugugagauauucuuuucuguacuagauaagucaucugcaucaauguuaaugaguagugcugucaguugagcuccucagaguucuuugucagcaguuggauuagguuuugcuguaagauauacauaagaauggacacuccugcaguguuacucccccuaccugaaagacuggaugugaaucaaagcuuggaugauggccuugucauaccacccucuugugcgguccauuccuucaaauucuugucaccaagaccagucugugacagaaugaugauccauugucacuguagccaccaaauugcagaaaggacaaaacaggaaugucauauaccaguuauuuuuuucaggaagauuuuaaaauggaagcgcauuguuguguaugugguauuggccaaagcuaacccuaucuaacuucagggcagagccauauauacaguuguaauucaaagauacucaagcaacaagcaaaguaauagucucuguuccaccuuccccauuuagucaucaacaaauucuuuuaguagacagaagaccaauuacuuaauauuugaaauuuauuuaccucaacuugaccuuuugaaagcugugguauucucaguagauuaauguccaauauuucaagacugcagaacuuaaugugcauggcuguuugcuuagcauuauagccguggguuacacaguguuauugacuacuuaaaaugucgcugauguacugacuaacagaauuugaaguuuugcucaguuuaaaauaucugauucaaucacuagaaaguuuuuaucauuucuggaacaaauuuagcaugugacuaauuuuuaaacuaaauuuuauggaauuuaaaaacagaugaguacuucugaugaaaauuuaacaucugagucuauuuuugcuuuaaguauaaagugggaauugguuuuuaaaagucauuauaaaaguauaaucucucaauuuuuaaucuucaacuacaguagauuuggucauuauagguugaagacaauacucacuaauaaaauucauuuucugcuucuauucagcuacugaaaauuuaaaauuauauguggagcucacaucauauuuccaauagucaguacuuuggaaagcuucacauuuuuuaacagaggacuugacuucuuagcauauuugguuucugaggcaccaaaaguuucucuauuuuaaaaucuauuuauuuauuuauuuauuuauuuauuuauuuauuuacaacccacuaucagcccuuucucuccuccuaguacccuaccaugcaaguccuuccccgauuccaucuuccucuucuuuuuugagaaggggaagccccucucugggugucacucccccuccccccauauacagaucaaguugcugcaggucuuggcacauccucuccaacugaggccagacaaggugguccauuuaagaacaugggguccacaggccagcaggcagcaggcucagggacagcccaggcuccaguuguugggggacccacaugaagaccaagcugcucaucuguuauauaugugcaggggaccuggauucagcccguacuugcucuuugguuggagauucagucucugagagcccccaaggguccagguuaguugacucuguuggccuccuguggagucccugaccucuucuugucccuuaauccuucucccaacuccucaguaagacucccugagcuccaucuaauguuugggugugagucccugcaucucuuuccauuggcugcuggguggagccuuucacagaacauuuaugccagguuaguguaggcaauagcuuuaguagcgguagucccugcucaaauuguuccagacucacaugaagaccaagcuguacauauaugugggcgggggaaggccuagguucagcccauguacgcucuuuguuugggggguucagucucucagagcacuaaggguccagguuaguuguuucuguuguucuuccugugaaguuccuauccccuuugggguacaauucucccuccuguucuuauauaggaguccccaagcuccaucuacuguuuaccucuggguaucugcguaucucugagucagcugguggguggaaccucucagaggacagccaggcagcaaguuuuaaaugauagaucugccuuuuauguucuuacuauauugucuuauuguauauuauuuucccccacauuuguuucaagagccuuuucucuucccuugccaagauagucucuccaauuucucuucaaccuuugcuagccuuaauuaauuuaauaauucuguuugaaagcugauuauguuguuucaucuucauguucugaccucagcgaauauggugcuucucugucuuugaugcuaaaucuauauuagaccuucugacguaacuuccacaucuacaguguauacuuucuggauacugguucauucuaagguagaaugacagaaacgaaauauuuuccuugaaauuugaaguaugaaguaugcuguguucaaaacacacaaaauauuuaacuuucauuauuuugguguaagugaugagggagcaagggaaagagauauggguuuuauuuuguauagugcaaauuuauagucaaguugacauuaucguccugaacagcacacaagcaaauuauagagcaguuauaagugcaggacuuuugugaucgugaaauagcccaggaagugccuaccauuucuagccacagauugauucugugcccuugcuccccuuugggcuucguguuuucuguauaaaggcagugguaagaguugcguuaccucaguucuuguggcgcucccugagagcgugauuguaaaggcaguguggacagugagucccugccuuaccguaaaggacucccuuuugugaggaaaugauaacggaaaugucuaccacuuuccugagugccaguguagaagucccaggaaugacuucacgaaggagaguggcaccuauuuuucgaguuuaaaguagaggcaaguaaauauuaaauagauuuagaaaauaugucagcauuuuccuuugcauucacaucucucauggucuaagauuugcaauuuaagaaucaaagguacaaaaaguaaaaaaagaagaauacaucuaguagacaguaaaauaagcuuuauaauuuugugaugaauuuuccuuauauuuuaucgggcagaaaagugccaucccuuuuuuguaguguagaguucuuguuuuaaucacuguuuacuuagcuuccuaacauuacaaugcucacucugaaaucugagaauagcuucuuuagaacauauuaauuaugacaggaaauacauaauuaaacuuaguauacguuaguaaccagauuugcuauaaaccauguaucccaauaauaaccaccuaaggauuguucuggcaugagaaauauagaaauacauaguucauuuuuauacuuugcuauguuuauauguuaucuuuucaagguugauaaaaugaugcagaucacuggugguacaugccuuaaauuccagcacuuggacgcagagacaggcagaucacucugaauucaaagccaacuuggucuacaaaauuccaggacagucagagcuauacagagaaacacuauuucaaaaaucaaaccaaaccaaccacccaaggugaugguaguggugaugaugauguugguaauagugaugauaguaauagaugaaaacugguuucuuuguguuguucuuuuuuccuuaaccccuuuaugauugagauuguucugucacaaguauauugauucuauuucuuguuuugaaacucaaagauuaggugaaauaaucauuuucuuuccaaucuaauaguuuguaaucucuaaacugugaucuauggagcacuucugucuuccaugcagacaucuauaaaaaucaaccaaagcccuugcuacagccucuuucuuucuccccucauggcccccuaccuucucuucuuuguuucuuucuaguugaaggaacagaaaagcugugugacuagggagccugugaaggggucucucuuccuccuccuccaugaugagaacugcuacacuaugcucucuuguaacaagcagcugaagcagccucugugucuuaaggucucaucguguccaguauuuuaccaggacacugccuaaaaauagaaguaguggcagaauuaagucaagcugccuaguuucaugaacaucugggauuugugucuauugccagccaagacuuggcacugaaaauggucugaacgaaauuuuaguuuagaagaaagucugcacaccauccucugaggcccagggcaauucgaugcagauccugcaccugcccacacagcuggcuaccaguuccuggguucacauuuuccagugugcuuguugacaaacaguguuguuagugugacgccaugcccagacauggggagugaucuguguguacauggauaucuaucugugugucaguguaacugaaugcauucacgcucuccuauucagaggugcuauuuggaaucauaaacaaauuuguaguuauugaaaguguguauauguguacauauaaaugguauguacagcucuuggagcucuucuaaauuagaugcagcaugaugcugacacacugacucuuaugaaauugguuuucauuaaagucugcagguuguucuuguacuggcaauggcuuugauuaagcacuguauuagggucauauccuggaauaacagcauuuugaaaucccuggcuguuugugaaagaauugugauuaaaguucuggcuguuuucccgugauuaccgaugucugccgaggcuugaguuuccugguuguuauugggauugaguuguguggcagccccuugugcuuucuugccaauaucaguggcauucuccagggggaagugauuuugcauugaaaugcgagaacuaaaagcuguaacaaaauuaacacaggguccaggguuucugaugugacuccagagcuagagugggaaugguuccuaaagccuaauucaucugugauugaauuucagacgaaacaaagcugccaugaugagaagggagagaaauucaucucagagagauuauggaugaagaggcugaggaauucgauagaucagggcaaagucuagggacgcauccauuuuagguucaguugggcuuuucuuccggagaggcguagacugugcuuuggcagugaauaucuagggaaaccccaguguuagaauggucccuuugccugcauuuucuguaacgugaaauagguguguauauuuguguguguguguguuuguguguguguuggaaggauuguucuuuaguuuuugagaauuauuauagaguuaugacugccuuuuaagaaauccuaaugauugaauaucuacagauacuccauuuaauaauaauauauuccacauugaguaaaaauaccaguuuuuaaauauucuuuugaguguuucucaaauugcuacagaauuaaaagaucauaauuuuguuauugaacuugcuaauccuuuugauuuggacuuuuuuaugcaaugauuacaucuuuucuaaccuugugaguuauaaacuucucaguuuggcaccauaccuugguguugguuaucuuucacuguuccauguacaaaauagguuuguaaugccuaucuggaaugauguagaauauaccuuuugugcuuuacaaaagauaauuuaaaaacuaacuccaguguuacacaaauucugaaauaauugaaguuauuuuaccuugccagagcucugaaucaaaaacuugaauucuguaaugcucucagccagcuccagucccauguuuacauuaacaucugggacuguuuuuaagaugaacaaugggcuucuggucuuaccacugcauuuuguccauacaucauuagauuuacugcaugaaaaaaagaacagaaaaauaguaggcgaaugcauauguauggguuugggggauugauucgucagcucucaaguaggcauuuucugaguguccacaauugucaggaauuauguuagaugcuucagauacagaaacaaacaaaaguucuuccuaucuuaauguuuuuauuuuauuuugaagauuuauugaugcaaaauuuacaaauaauguucuuuaucauauuuuagagcuauacagccaucccugcuguguaauucuagacuacguuguuccuuuuaaaagaugcaccccauccauuaguaaugacuuccuauaccuccuucccuuagccucgggaacaaccaaucuauuuuccgucucuguggauuugccuaauguggacauuaagcauaaaugggaucauauaccauguggccuuugugucuauuuuuuuuuuuugccacuuugcauaaugcuuuaaagauucagcccuacaguaaugugaaucaaaacuuuguuuuuucacccccagagguaagugugacugcuaggaaguagacaaagagggguaugcuuggauuugguuuuguuguaggaaauuacauuaguagacacugaauuccggggaaaguucuaaguaggcacuuggacaugcuaaucuggaguucagcaaggaggucuguacuggagauauaaauugcaaagucauuaucauauagaugauauuuaaagccaccaagguuaaacaaagucuucuguagagcauagauggagcagagaaagggugaaaagguugaccauggagcacuuaaaugauaaagggucagaaaaaugaggggaaggaagagcucuggaaaaggucugcgucuuagggggguugaaagaguguaagguccugaaagcuaugugagggaagucuuuuaaggaggggcagugaacuuugucagucagugcuacuccuuuagugagggaggugaugagugauaaucauaauuguuccuugcucuaccacugucaugaaggggaaggucccagagccaggcuugcugccuuaucuucccaauguuucucaauugcuuagaucuucaacagauuuguuuuauggucaguuucgucucaucugccuuuucuuuauucaugccagcuaccacaaagaauccaggacuaccuauuuguaguuuugcuuucugccacuauaacaaaauaccugagaucaucugcuuacaaagaaggcggcuuuguuuuucucauucuuuuacugauuugaauacaugcuuaggugagcccagugcuuuuauucuuugaguuaggggugauauauguuaauguuaggaagcacgucauagaacaaaaugaucucgucauguucaaagggggaaaaaaggccaaagucucauguuuccugagaacauaucuccagguaucauggaccucuugcuagcucccaccucuucaagguucuuuucauuccuauuuguacacccugugacuaaguguuuaacccauugucuuccucgguuuaaguagcuuggugucagugugcauccuacucugugggaagcauggauuuggccccuggaacuauauuauaaacaggaagguauccaaacaucugagcugcagcgcugcugauccaacauuuucacgucccguggccauccccagucuggcccugcgccccuucuccaccccaugccucacacccagccucgucacuauagauccuuucauuccaaacaucaucacugaaugguccuuuacauuuaauaagccacuggaauggacccugauucacccaugagagucugcuuuccuuguuccuguuuaaaugaauauauuaagcuucugcuaugcaggccuggucuuggggaaaaaguaugaauuuugugugcuuuauguaguugaaaagagaccuuaccaugugaacuuaacauucucaugcuagaauuucaugaguuuguuuucugcagacaagcugauccacugauaaagugaaaaacuugauccucagacuuuggggcagccagugaaugugaaacguauccuguggcuuucggaggugaacagaaagggaccaacuagucaauuagguuuugaaacauugaaccacaacuuauuucaauuucugagguauuggauuuuaaaagagacuguauuggagucagaauugcccagaccucauaacagugucugagcacugucagcaucuccuagcacugagcuuagagauuuagucaguuagugacuacagugugcucgcaggagcuucagcuuuuccaugugauugcguugagugaagagagggacaggccuagcaggggcagcaugggcgccuuucuucaggcugauacugcuccacagugcuuucagucagucagaugccagucacucuucucaugagaagcaucagcuguacacagucagcuucgcacauucugcacauuagcgccagugcacccggccacuccuuccuucuuugguucaauggcugguagaaagcaaaccacccauauaacugcaggauaaaacagauuucauagaaggaaaagcaaaccgccuuuucugaugauugugucuacuguuugccaaaugcagaucugggaagugaaacugacuuuauuaagucauuuuauucgacuauuuacuaguuuuuugaaauuacaaaguaccuuuguuaauuuuuucaauauuuacuuuuacuauguuuaugcauauguauuuuuauauacacucucugacucugucuuccucccucuccucucucucucucucucucucucucugucuuucugucucugucucucccucugugucucucucuguuucucuuucuuuguguguguguguguguguguguguguguguguguguguguguguugcccauggaggccuaaagaggguguugggcuuucuggagcugggguuaagggguugagaucccagcacagguacugggaacagaguuugcauccuuuacaagaaugguuaaaugaucuuaaaugcagaauccucucuucagauccggacuuuucucagggaaaaugaaggaaauaaacaguaaauaaauuuuuaauagauacaguaugcuuucacuugaagauauucagacucugaugcuaguauuugcugugguuuguagucugcugcugcguggggucuaguuuuaucuguacagguuuaucugagaucaggacugacuuuuauugaaugaaagaagaagguuaugggaaaacuuucccugaaacaaaagggguaugaaucuaaugagcuucaucucaaaugcuuuagauuuucagaauauauauauauucuugaccacuuagaaauuuaggccuuuuauggaagccugagauaaauagaccucuaaaagauuuucauagucccuggggaaggggaagggaacacauucaacuccucugcaaaacucugaaaaugaagaggaaauaaaguauuaaaaucugagauuuaaugccuagcuaaggcaggcaauguucccccccuccccccuguggccagaauuuaaaucuuucuccauuuauaauaaauuguaucuagcugcuaccaacugcaaagcuuugucuucagcgugcuccuuauuuggggagcuccuaugcacauauagaaaucaggugaguccauuacuuagguuccucugagacuaucaccugccaacucuaagcuacucuuguuacacuuaaugcuucagagcacagacacaggcauucuaacauggccuucugcuucacgugagccauggcucacuugguaugugguauuugccagcuuuaaugucaggaguuuaccugaaggguguuacuuucguagaagcacaauggauauugcacauaauggugcucugugucucugcagggucauaaauggcuuuacauaaauacuuuugauuagggggacauuuuacuuugggcccauuuaguuaaauuuucuuaccauucuucauuuguugaauauugauuuuuuaauauuaguguaguauuuaaauaugcuauguuacaacauguaugugacuuuauuaaaaccuuuugguuuuaugaaaaauaauagcuauuaucuguguaaacauaauuaugcauuuguacaagccuuauuuguauauauugggaagaaauucauaguuagcacugccuguguuuccugagugcugggauuaaaggagucugaguaguaguaugcaugaguguguauguguuugcauucauaugugcauguuuggguaagugcaugugugugacugcaugaaggcauacaugugugugcaaauguguggauacaucuguguuuguuauacuuuuauauauucauccacauuuguuuaccaaaacguucuaauuacucuauuucccacuguaucaauucccaagcuuuauggcauuuuauucuuuuuaucuaaauaugcaucuuuaaaaauaaggccacacauuuagauaacuuuaguuuuaaugcuuauuuaguauuauccuaaauaucauggaaguguuggacaaugauacauuuugacuucauuuaugauuuacugauuaaaaauguguggccaaaaaaugaauuuuguuaguaugaaagcuauuauauauuaagcaacacacuagugguaaaggucuaugaaaaucuuuauuuacaagagagagccuuacagacuauuuuccuuccuuuacuguuuggccuuuaaaaacaccauuuauauuucuuuauaaucaccucuacuuuaaugugugaaauauugcuuuuuuucuugacauaauuacauauaauuagauauguugugaguuuauuucucuuuuaguauuuuucacugugacaaaauaauggugauagcuuucaaagagucuacaacagaaccauugguaauaauuuuauuugcuaauuauauguggguguaacggcaucuuuaggaaauucuagaaccucaccauugaaauugaucucgcuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguauggagcugagaugaaaggauggaccauguagagacugccauauccagggauccaccccauaaucagcuuccaaaugcugacaccauugcauacacuagcaagauuuuacugaaaggacccagauguagcugucucuugugagacuaugccggggccuagcaaacacagaaguggaugcucacagucagcuaauggauggaucacagggcucccaauggaggagcuagagaaauuacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccgaauuaaaaaaaaaaaaaaaaagcgacacacugaaaaaaaaaucuuauuuccuuugucucacaagaccacauuaaguguuauuacaggaauguaaacaaaguuccaaguccacaaagacaaacacagcagaaaaaaaaaaaaacaaaaaacaaaaaaaaaaaaaaaaaaaagaaauugaucucgcuuugaccagugcuuugccuguccuuaagagaucaugacaaaugggcuccuagcgucucuuaggaggaacgggauucaguuauaaaggaaccgucuuccaagucgguuguuacuguucaauagcuuucuaagccauagcaaggcuuuccuuucauauggccaagccugccuuuaacaauuuuauuuugacagucuuaaauuuuaagucugucagaauauuuuuaauuauguuuauauaaauauuaaguauguuuaugauaauuugguacauguaucacauauguagugaucaaaucaggguaguucucauuucuuuaucuucaaauagcauuucugugguuguuaaccuggauuacccucugcucuuagauguaacuaaauauauaaacuuauuugucuuaauucuguuuuucaaaagaccauagaaaagaaucccaauguguuuucauaggguaguauuucuuacagcugaaggcauaacgaugcuguucccaacauuuccaugcauauagcuuaaauacuucccaguuuccauaugaaguuuuucaauuguagaaugaaccuguauuaauuaaaccugcuuuacucugaguauucgucucauaguuucuuuauaauagagauuggcaaaauacacaagaauuauuuccauuuugcuguaacuagcuuugaucauguccuuacaaaaauauuaaaagauuuucauguauuuaaauguuccuugaugauugcaaauuauuauuuuccuguuuauagauaaauuuuuagugauaggaaaaguuuacucucugcuccaaggacagacuggggaggaaacagagcuauugagguuuuauucuucucccagccuuuccuugauucuuugugaguuucccauuguccaucccagucucacucagcuccccauuccucacaucugcccucugcccuugcaacucccccccccccaaaaaaaaacuaaaaaacaaaccaagaaaacaaagcauagaaaacaucugguuauggaagcugcaguguggcacagugugccccacagcauauccuucuguccacacugcuguguggcguggcagcaggagggccgcugucugaaggauuaucuacaagcuaguccuuuacaggcagacuuuucauuaauaaaugaaauauuuggcuuuaauauuuccuuacuuguagaguauaucucuuauugaauucauauaauugaacagacauuucuuuuuauuggcugaacugucuugcuguauuauaugaauucaaaaugcuauagacaccacagaauacaauguugaacuccaaccaaauguauauguguguguguguguguguguguguauauugcuagaaauacaguuaucugcauguaugcacacacaccacacacacaaacccacaacacaccuauuuguuuguuuguguagagaauauauguagcaguacccaaguaaucuaugcaaauugaucccagcuggggcgugggauuccuugcuacugccccaauguucuguguucccagauaagacaccuacacagagacuauauuuauaugccuuaaacucacaaggcugggccacuuccuuaccuuuucaugacuaaucuaccucacuacaguaguccuuaguaaaaucuauaucucaucuuugcugccugggccuacucaggcagcccucuuggagccaccccugcuccuacauaguggcuaugcugucugaccagcaccuucucagacuugcauugcuucuccccaccuucuccuuuccuggaucugccccuuuccuucucuugucugccccuagcccaggaauccuaaaaguccagcucuuguccgcccugcucagccauuggcuguugcaucuuuauuuaccagaggcagggucccucacugucuuauauguuggauucugcaugagaauacauguagcuacaaauguauuuuauuuuuugcacauauuuuauuguuuuuccuuuuuaucaaaauuuaagauuaucuaauaauuuauuuuuagcuguaugaggaauuggcaaugauuuuugaaauagaaaagcuuuuguuuugcaucugucuuguuucuauaggcuugcaucauuaagugaaauugauuucugucacuuuaauguaucaauucuuuucucuuggauauuuugagacagaauuuuucuuuccacacuauauguucacaucuucuaaaaagcuucagcaucagcuuugacugggaagcccugucugaaguguugacguucaagugccuuccaauaaagccuguuuaucuagaaacagggauguaaaggaugucuuguuuacugauguccguuuucuuuaagaugcccauuuuuuuuccuaaagcaaauugcccagaugagauuucagaugugcagucuaugacuugagucuuuccaacuuuauuuauuuauuuauuuauuuauuuauuuauuuauuuauuuuaacugcuuguugaccuacauggaagacugccaccagccugauucaucaggggcagacagguggagggagacuuuagcaucacucacugcagcugaugcucacucaguggaaagaaaggaggcuguuggacaagagacuguccagacuuuuagaagaccauuuaagaccauaagugcuaauuuaagucacgucacagucuagauauuaugcuuuugugggaaaaagcaguaaaugggaaacaaguuuaguagauguaacaaaggaugguaggguguuacaguacaaaggaauggauggaugcuaccauagcaagauugguauuuuuaaaaauaccauucaaaugauaaagcugcuagacuaccuucuccuugggagugaggaaauaucuagauugagacuccagugaaaaaguauuauucauaggauaaaaccaguguauaacugagagugguuuuaaauacugucaacaagcugcccugaaucaggugcaagacuuuugagaauauugggagggccagauaggguagcagcagcuuuguagugauggagguuagccauugaaaugcagcucugggcgugucuaucaugugagaagauugccuaccuuacucugcuucaugguugcugcagaacugcagucuccuggcugguuugugggcuuacuaguguaggggcugugcuucagagcagauaggaaggcacaugaaacauuccuauguguggguaaguuaaacugagccuugggcaagguuacucugcauuugcagacgugguaguauaguuccagccagucguagcuguuccuguuguuuuuggaugaaaaagaaguuguucuuugaauggccugcaggcccucugugaccuggcucucuucauccuccuuuccuccuccuuuacugcacacugaauauucuccaugcucugugucauuucccaguccuacagccaccuccuuccauccuucagugcuccagauaccacuccuaaggugugggggaaagcuucucuucuagccuagaaauaagucaucgcuaauauuacuacaaauaaagguuuuaccuucaugaucuuuuuauuuccuaguaccuauccuagugccuggcauauaguaggcuuucuaauaauuguuaaauacugaauguuuuccuuuacccuauaguacugaccagauucauuauucauuuucuuaaaaauuuuucaugacacaagaggaaaauaaguaucaugaucagugacaucuauaguugucuacuuucguugguuuuguuuguccuugaguuaugagaugguaugaauguuucauuuugguagaguuguuuuccaugucaucucuuccacugacuuacaucaugauggcuguguuucuggaacuuaguucuaaaaauuauaguuauugauauguggaaacgugagcuuaguagaaaaugaauuuaacuuucauuugagguuaacuguauugcauuuucuuguccuauauguccagaaaggacuagaguaggagauaauugaggaaagauguggaguagguaggauagugaguuugccaguuccagaggagagcaccacuggacagagggaauauacuuauuagggguucuaagacagauggguccaugcuauguguaaaacgacagagucauucugaugggaacagacugagacaggagaagacugggaaaugaauuuagaaaauuuuaaggccaggaggaguggaccuuuuuuuuuuuuguauagaucauuaaaaggaauuuggcuuuuauuacaaauaagaaaggaaagcuuuggagcaucguggagaagagagugauuugcagagauuugcauuguuacaguaccaucgauguuuccacgccauggaaagggaacacggaugguguggcugggcuugaggguggugagaagcaccaguguuuuuguuucaaaguaugguuugguaagguaucugguggaucuggugagaaaauguaucaagaagaacagaaaauaauguccagguuuuauacagaagcaaccaaaaguggacauucuuaccauccccacgucccugugauagguacauuguugguauuccuaauaaaccuuuggaauaucaucucauuguaguguuuaguuucaaccuuuccuuggcucuuuuucugggcauguacaugacuguuaagcugaaaauguuugcaugaaagcuguauuccuuggaccauuaacuucugggcugaaguuccuuugugugguucuucagagcccuuuuguuguuaaccucuaugugucugcuuccccuggagcuaaauugacaaguaguucuuuugugcauucuguuuuaauaaaagcuauuucuguauuuuagacuucugaaaaauagcauuuaaaaagcagaauaaccaaucuuuaaagaaauucaaaggaaaagcacuuuuccaggaagggguuguaauuuuaugugauguauuuagaagauguugauaaguagguccuuuguucugugauugugucacuauuuuugaucagacaaaugagguauuuccugaaugccaauauuugaaauuccauauuguguacuauuuggccaaucucuucucguauacuguuaauaucggcuguauuaugcgggagcaaugucauauguuuucucuaugaagcaacuguaacuuugcauucccccuuuggcuuuuguuauucuuuuguaggcugacccuucuguaagccuguuucaucuguuugucauguuucauuauagcuuuguaaccucuaccaugcuuuucuaucuauucuagucauaauaugaacuuauuaaagucuuuaauugucuuuaucucauguugaauuuuccacagguacacccuaggcccaaagauacuguuauugauuauaaaugcaaugaaauuguauuuucuuauuaaucauauuucuucugaaaccauuggcuauagugauuuuuuucaacaccuuaaaacuuauuuuagagugaauaauugagaaauauuuuugaauaaauauacacuaaccagucaguauuuuugccuauuuuguuuuacuguguuggagaauucuugugcuaacuauggcaggaacuuacgauacuucuuauaaaagaaauaaaguauauucauaauuaauaaauauauauuaaucucauaaaaguaucagcgcuaaaugguagugaucauuuuuccuguuagcaccccaaauauccuaaagcauacauucacauauucuucucauuuaaacugucaagaaaaucacuacacaugaugcuucaaugauuauaauaauugaaauaaauuucuuuuggacaacaauugcacuuuacuauuuuauacaguuugaaggaaaaaaacaguuaauagaccuaauuguaauggaaauuuuauaauuuuggaaaucaaaauucugcuagaaguuucuuaaagaacacaucaugguucauuccucuuauuuuuuuguagagauugaagauucaugcucaguaagcagacugcuuauugucacagagcuauuuguuauuaaaguuaaaaagaaaacuuuauuccuguaagggcuuauuuuauaaucuguuagcuuauauuucauuauguguucauuuauuuuaucauaucccaauaacugauaauacuuaaggcaauguucuauuuugaucuauuaauuuauuauuuuacuugaauugauuagaauagaauagacagauucuauuguagcuuguauuuccaucagugugacuacugucuucauuaauguuguagucaauguucuguugcuaugaagagacaccaugagcacagcaacucuuauaaagggaagccuucauuuggggcuugcuugugguuuuagagguuuagugcauugucaucaugguugggacugcgauggugcucaggcagacauguugcuggggaaguagcugagaauucuaaauccagauuugcaggcaucaggaagagagugaaagcugcugggcuuggcuugggcuuuuaaaaacucaaagccccuaacuccaucauuggcaaauuuccuccaacgaggccacaccuucuaauccuucucaguauuguaacuucccccacaccaagcauucaaauacaugugucuauaggggccauuuuuauucaggccuccacuauuaacuuugugcuagggcagaaaaaagcaacccaggauaaaacuuuaaaaagacauuaaauuuauuuuaugagcuaacaggaaaggauuaguggaaacaaaacagagcaacuuggaaagguuugagaaaguuguguuggaugugguccuugaguuggaaucucagcucuaggaacuaucccugggaggaaaagagagaaacugccagaggaagggagggaggccuggagggaagaugaagacauagccuuaaggugucugucaaccccauuaaacaagagaccaagaaaaaugcccaagauguccucuccuuggaagucuccuugugaacaguguggauuauuucuagauuccaggcccucccagucucuacaccucuccugagguuaugagaaaauuaucauagaggugauggagaggaaaaaauucccuagaauguuuauaacuuuaagugacccccaccccgugugugcacccacaugugcacgcacuugcacucggugcacaugugugcccauguauauccucugagugguuuccaaacauuuccaaauguauguuuaauuuaaaaugaauuugaaguuaguuaccuuuucucuuuggucgcugacgugccugaauguuuuugguaaaaguuuucugaccaggcuuugaagaauugguagagauaaaauucugugggauauaggaaccucuagauaucacaugcaugacgugcacacuggggaaaaugaaccagauucaacuaaggugaaagacaaacaaaacguaaagacuucaaagagcagguuucuucuuucucuggugugauuucaacugaugaucuaccacucccuggcaggcgagggccguggggacugcggccuacccucuugccucucauuuuccuuguuuccugaccuucuuucuuuuuuacuugucuuacacuggccugaucuguguguguauuguuaaaagugauuauuugccuauuuagguucaucuaacuaaucucguuuuauaugaaaauguuucacauuccauucuuuucaugaauggcuuuguugucaaacugcaauuucucccacauuacuaugucuugcuaaguaagagagcagaccccugggaucacacauaagaaguggaacauuagaacuucugccaugaacuuuguaauaauuaugaccagucacacggaaaaaaaucagaauccauauaucaauguuucagauaacuguuucagauaaaauuggaacuuuuccucaguggagaguagagcuuguacuuugaugcacaggacccaaaccuucaacuacauaaacuuugaccgucccuccagggcaguugucacuauuagaauuauacacagaaagguguaugugugucggggugggcugaauuuucucuuuauuccaaguugugaaaaagucucauuuuacuuuaauuuaauucauuauguguguuauguuuguaugugugccuuuucauauucaucuguguacaggugaacauaugagguacaugaauguguguguaugugaauuccagaagauaaccuugguuguuguuuucucuguacauccugaguccccauaguuacacagcaaacauuguaccaacugaguugucucccuagguucaaaacuguaauuccaggaaauuugugaaauuugcugucuacagcgacuggaaaguugacuugcuaauugcacgauguaguuacuguggguuuucagguacuguuauuuaaagccaccugucccucugugaugcagaugcuuccagugagcugugguacugcuccugcucuguggaugccaguucugauuaucuuccucaggaagcuuagcaaugcuguuaugcaacuguauuuugauucuuaaauuuuuuuuuuuuugaaagagcucacuaucuguccuuuuucucucagucauguaaggccauuauucuucauaccugucauguugauuucuucacauuaauuuccuuccaacuuagggaguaagaauauucgaguguuucuuugaguacuaagccaauggaagcauuuucuagcacaaaagcuuccaucggaacuggaauucaugcaguucucagucccaaugaacuacuuuguagaugacuucacaggccaagccugauggucaccuuuuguuuucuauguguugguuuuccuugucauaaaaauccaguauagucuguggccgucauuaguggccuuuaguuggccacacaugcacgggagauuggcaaugagcuuugccuaugaaaucaaggcccucauugcacucugcugucuuuuacaucuugcuugaguuuaaucaggauuccugagcacacaguaaaauaccccacauuccaaacuucaaucaaugagagacacccucuuucaguccuacguggcaaaacaguguuucuccuuaauuaagacacuauagauagcacacagagugcuauuugguauuucaaaaaugcugcuggacucaguaucaucaaauguacuuuguaauaucuucugaaacaggggagauaaacauacacagaugaacaugaaaauacacacacacacacacauacacacacacauacacauacacacacacacacacacacacaccccacugugaagcgaaugcagcaucccaccgugucuuuaucuaauucuaacaguaacaacagccagggugagagggucagugaggcucaggaguuggcugugaugggaagggagucaacaggagaauaaauuacugauauuucguuugcuuuuuaaccaacuauucucaucucuuuuccccauaugcauaguucuuucuguuaaucaacugguuauuugaaaaaagaaaacaaaauagaacaaauaaacaaaaacuuaacaaacagaaaaccccaagcaaacaaagaacacuaaauuauuauauuaagguaccauaggaaagaaucuggaaauuucuuuaaagauuaaacauaaccuuugauuaaaagaauuaaaaacauucuuucucacagauauauauguauauggauguucauaucuucauuguuuguaguagguucaaaguggagauccccggugaucaguugaugaauauugaaaucaauuaaauaugccaugccuguacaguggacuauuuuucagucauaaauaacaauguagugcuaauauaugcuauaccauuaaaaauacacuuuguaaaugaaguccaacauuugauaugcaacagaguuauuuagcuucaggcauggaccucugaccugguagugcccaagugggcacugcaaugagguaaaauauucaagaucauuaaaacuaguuggaagaaugggaggaaaauggaucgaugcaaucuccuauguagcuuaaaauaaagugaguuggaggauaaugacacuaagacagaaguguuccucaaagauggucaauugaaguucccuugugccuuauugaucaggcauuuaaaaagacacagaguggcuaguggucauuugguaagugacucaccccuuuguagaaugugccauuucauuuucuauucuaaaaucuccaguaccaccacagcuggauccuagugacuuugucccugaaagagcucuaggugaccacauuuuucaaaaaugacuuacacuuuuuaauuguaagugugugaagccagguggugguggcacaugcccuuaauccuagcacuuuggaggcagaggcggguggaucucuggacauuugaagcuccuuuucccuucuauuugucccacccacucuguuccccucucucugccucccuuccuccauccauggaagcagaaaggcgcuguuaugaaagucuucaucagucuuucuuguuuuucauccaucacugcuuaccuuaauccuuuaauucugaagggaaauugaauaugaauuuccucaauuuuuauaaacuuguaaucuuuugcuuugucacuccucuguuguucuuugugaugaaagcaagacacaaaaauuucaauauagcuuuuuguuuguuuguuuuaggcauuugauuauauuauacgagucugauucuugauaaaggaagaacauuauacacauacaaaauacuuguuuuccugggauugcagguuuuauuucucaguaccuguugugacuguguauuacacaggagauuuugugaugugugcggaaaugagugcugaugccuaggagagagaagaguggcuucuugagugaaggaggacacccacauaucauucuguugaccgaagugguaacccaccacacuauucauuuuacuucuagagaucaaguguccacaguguuagggcugacuaggacagugaacagcauugggguuggggaguauuuccugaauaucagccccaaauccaucuggugauucuuaaaaguuacccuugagcacaaaauagagagauaacgaaggaaagaaggacagaaggagaaaggagaagagcggcagggaaggaagugcaugccagggccacuccucuugccagcaacuguacgacucuucagacugcaucuuuccugcuuuaucucguucccucugguuuuaaaucaugaacugacacuucuuaaguauuuuaaacauguagauaccccaugaaaauuaacagcauuuuucucuucacagggacucagauguugaacaaaauaauggugauagauccaugaggugauaaaucauggggguagaacacucauauuguuugcuuguuguaaggaagccagagagaagauauucugagggaguuuuauggaggaaacuagaagugugguaugguggcccugaucagagccugugaaggguacauuggguuucuuuauuuaaaaagaaaaauagaaaaaaaccugucucuuuaaaaggcacagccacuuguugucuucugcucuuugcaacccggagagcccuugccagccacuugaguggcugcggugcucaucauauuccaugcuggcagucuggagagaugagaaagcauaucgaguuuuuccuguugggauuguguuagaagaaaaagguauuucucacaucaguuggauaaugcaaugugcuucuaccaaauauacugauuguaugaucauuuuauagaaagaaaauacguuuuuuuuguuguuguuguuuacuuguaucuuuaaucaaugagacuuuuuagauauugaccugaauagccaacauauguuuggucuugauuuugugaaaaauucauaaauguaccuaucagcucaucauaaaguuggacgcaauguuguuuauuuuggaauucuuaugcaacaccauuuucuuauucaacaucugaguuccuaugaagagaaaaugaugcuauuaaauaguuugauaauauuuauauaugguuaaaauucuugggaggcaucaaacugaagugugaauacugagccuaccauaugcauccuggagcaggcccuguacuuuugauuccccaaaagaugccuacauuucuuaauuguugugcuugguaauaguauuucgggauauuguuaaagucaagagagggaguuuuuguaagaagucuaucugaguaucccuuuucugguagcuacuuagugacugcaucucuuuuccaucccccuugccuucuuuauuuauaucuaggguaacaguagcagccuugaucacagcaguggaagaaaccaagaauaaauguaugugagcuauuaugagaaucuuggcaagguguuuguucaacuuaggcuggaauaaguagcuaauuuaggacaguguugucuacaauuaauauuuuaauucauuuaacucuuaaaaccuggauuccugauugaacauauuucuucuaaaaauauaccaguaguuucuucauagggaguuuacaaucauaauucacuucuuccauagaagagaguuucuucauuuuguuaaugaauauguucauucaacaaaugguaaguccaaugguugguugcaaacaucugccucuguacuugucaggcucugggagagccucucaggagacagcuuuaacaggcuccugucagcaagcacuucuuggcauccauaauaguguuugggcuuggugucuguauaugggauggauccccagguggagcagucucuggauggccuuuccuucagucucugcuccaaacuuugccccaguauuuccuuuagacaggagcccuucuggguuaagaauuuggcaaugaguccccaaccagggacuaugccuaaccucuggauauggucucuucagguucucccuccucuuuguugggcauuucaguuaaucucauugcuguuggguccugggagacucuugcuuuccuggaaucugggacuugcugguagcuacccccaguuccccacgccccuuugcuacacaccucuguucaauaucaucaucccucugaauaucaucccugucuccucuuauaccugauccugcccuucuuuuuccccucccccuccucuauuccucccacuaccucccaugaguauuuuguucccccuccuaagaaggacugaaucauccacauauugaucuuccuucuucuugaacuucaugugaucugugaauucuaucuuggguauuccaagcuuaggggcuaauauccacuuauuagugagugcauaucacauauguacauuugugacuggguuaccucauucaggaugauauuuucuaguuccauccauuugccugagaauuucaugaagucauuguuuuuuaauagguggguaguacuccuuuguauaaauguaccacauuuucuguauccauuccucuguugaagggcaucuggguucuuucuagcuuauggcuauuauaaauaacacuguuauagacauaguggagcauguguccuuguuauauguuggagcaucuuuuggguauaugcccauuaguaguauaguugaaccucagguaguacuaugugaggagcggguguggcggcagucccaaaggcgccagggacugcagcuaagucauaugacuugcaccugacuuccucacauaagccacaaacaucuugagagcugcgcagguguaccaggauaccggugaauccauuuugauggagauaugccccugcugcccugauuaucugaagcugcgugccuggugagguggcguggccugcugugcguggaugggaacugagaguauaaaagagugagaggcccaggguucggggaagauauaaccaagggagauauaaucaagggagauauaaacaagggagauauaaacaagggagauauaaacaagaagaaacaggauugaauaaacgugugcagaaggauucuguugcagcgucguucuuccuggccaguugggcgcgcgcaagaguacuauguccgauuuucugaggaaccaccagacugauuucccauaggaagaagaacaauaucaaccaaccagagcuccuaaagcucccagagcucccagagacuaagccaccaaccaaagaguacacauggaggggcccauuucuccagccgcauauguagcagaggauggcauugucuggcccuugguccugugaaggcucaauucucuaguguaggggaaugccagggcggugaggugggagugggugggugggaggggaaacauacucauagaagugguuuuuguugauguuguuguuuguuuguuuguuuuuggacuggcuuuucuuccuaguucuauucaaaacucacccuuuagcaagaguccuggcuugcuuuucugaaauaguaaauuaguuguggauaaggauauucugcuauugcuuucucuuugcuucaggaccauacuucaaggcuguguucaggucccuuuagaagcuucagggugauggcaucaccaggcuaagcugugagaauagacccauucugaagaacuuagucuguaagacugccuccucugucagcgugacacuccaguucaggaaacucugaccacucagcuggcgccuaaacccaauuaaacaugcucuuuauugaugcaaguaggcauuccauauuuguuauucugcaugucuuuuccgagucagauauucauuguaaaacacuccauccucucuguaauucuuugcaauguugaaacccaauuugguacccaggacacauucagaaugucauuugggacaugcaguuuucuguaacuuaauggaagucaccacuacauucuguucuauuuuaauuuaagaacucagcacaagauauuuguucacagugccagcauuuauauuuugauauugauuauuuuagcugaaaaauuaagagucaagaacaguuuauuucaucuugucacacucugaguguuccuagcaauuuucucagucugucacugcagugauacucacucacaagaguguuuuauucaguuauuacacauuuauuuguuacaaauucauuuguugggcucauuaacgauauugaccauuuuguugccagaguaauauggaagcacauccuuggguguguguacuggauaucaagcacugugcugaaugucuuuguguacaguuucucauuuagacauucacacauuagcuucgaaggaauugaccauaauuccuauuuuauaaaggggcuagguuaagcacagucuauuuuaauaaacuuaucauacuuaaacuaauaucaaguaaaaggucugugauuugacuaaaauuuacugauuguuccuaucuuaccaucaucauuucaaaggccaacauuuuuuuccauuuuuucugaggcauugguuuucucugucugcguuauuaagaugacuguauucauuauccgugacaacaaaucucagcuugaaagagucaaagaauagguaaauuuagcagcuaauuucuuccaaaugaguucuaaaggaauggacuagucuguuagugcuaaaauguugucaucccacaguuguucuuggcuuugggguuuguugccagucgccugggagagcuugucacaccauucuccucauugcaaaaagcaggaaauaugacuggggcauucuuccaucauccugugcuguacagccuacuuguaaucccacugucaauuucuuuuucauuccaaccauccaucaucauucacuguuuucucuggugcccaucccagcugagauuagacugcaggcauaaugaaugaaggugagagcugccccugccuggucagcgcaugucacagaccuugagcagcuugcuucuuaauggucuugacagcaguucccaggcuacuaggcugaaugggagggcaugugaggagaggugaguucuauuucucacccagaauacugaaaugccaggcauccauuuuuagucuauuuugaugguaaagacacucaggauuccuuucuuuucauucugguagcuuauuuucaaaaauaguucuuuggaaugcuguuucuaauuuucuuuaauugguaauucaauaccuuugucaauuuuguguuauuacaacagaauaucacagacugaauuaucuguaaugaagacucaaugguguuuagauuggaaggacuagcaguugaaauuaaggggcaaaacuaacuuuuuugcauaucauuccauuauagaagacauagaaagguugagagaagagagggacucagguuucuauagucaucguguccuuggaaguuugcuugaaacacucaugagcaugcauccucauugcaaaagucuuagaccucaauacugugaacuggagguuaagaguccaauacaugguauggggguguguguggcaggguugcauuuauuccauagcacuugcuaaccuagauuuaaacacuugauuuauaaagaggguaaagaugcagugaaggugcacguaagcaaagagcuggaagaauacacaaggcucuguagguagaauuuugguuaaggcuuaaguagacagagcagagucuuuuucacuuuuaauugcaucggcacacuucaugaggcccucaucguuucccucagcucccaggaguuuugagcagggcacuguggcuaagguuguaacuucaugcgcugccuuccucccuuuguugccacagcuuccugucuccacagacuuaucuauugccuccagucuucauuguugcuauuguuuuuuuauuggcuccacuucuucuucuucuucuucuucuucuucuucuucuucuucuucuuuuuuuuuuuuuucugguuuuucaagacaugguuucucuuuauagcccuggcuguccuggaacucacuucauagaccaggcuggccucgaacucagaaauccgccugccucugccucccgagugcugggauuaaaggcgugugccaccaugcccggcuuggcuccacuucuuaauccauugcuauaagcacacauuuauuagguauuucuacuaccuguaaggcuuuaggaggacagauugaguuacucacauuugcucagcuucaacaguugacaauagauuuucucaaaugcuuuuucauuuaaucuuaaauuauuuuggccacguagguuuccauuucuuuuuccaucaaaacaacauguggaugcuugcuuaaccucuuuagauagagauaaguuaugugaguacuaaugaaaucagguagugauaauaaaaguaacauauuuaaagcuuguguggguuguuuuuauauaaaauuacuuuuaauagaguuguaggcuuuggaagacaagauuggauuuuuuuaagcuagauacuuaaaguaaauauuuccuguacuuaaaggauugguagaagaaaugcccguccagaagugagcccaauacgaccaaggcacacagauuaggcaugcaugccaggugugcaguguauaugaagaacuagcagucuguagcuugcuuagucuaaaaguugggagcccuuaaaaucguagcacuugauauuuuuagaaaucauuaaaaguuaccugcuucaauucauaucacuuugagauaguacucaugcugaacuucuguggccuucagaguguuauuuuuguauccaucucauauaaaguuuuuuuauuuuguuuuguuuauguuguugcuagagugcaggagagaaaugaccuuguuucucacauacacaucuccucgguuacuccauucuguuagguguuguggucuuagaaagaaaauuguugauucagaggauaaaucuauuccuagugucuuuucucugucuguaacugcucaaaugcucuguugugggagagguugguaaaggaguaguguuuccacgagccuauuccaggcucucucuguugaucuccgugucuucuuugguccugucuauucauugaaccuaggaccuugcacaugcagagagcguacucacagcugagcuacaucccuaguccuuguguuagucucgguguugucaucuaaguuguaaaacuuagcaagauaucaauaggccugguucagauuguguugugaugcaguuugagaaugugaagaagcagggcauaaaaucugaagaaagagcugaaccuuccauuguauuuuagaauucagaggugugcuuguacgguuuggggaaacuacugguccaaacagucuaaugcugcugccucuaggaagugcugacgccgcuggauauagacugcuggcgcuccacaugggcucucaaucucuuagaugccugagaccaccaagauggauaacaaagcgucaucugauagcaugcaaagaauucugaucaagaaacguuuuaaaguaaagagaaaaaauacauaaguggagguaacuuagauauuuugaagaaaaccuuuaaauaacaugcuguguguguguguguguguguguguguguguguguauacaggcgcacacaugcgugcaggccugaauucugaagcuuaugaagaaaaacaugagguaaaagaagaguagaguaccagugauacacaaaagaaaaugaugagccuaaaggagaagcccagcuucagaggcaaaugggcuugcugacucaacaugggagauagguuuguuuacuuauuaguggaagcaguuagacgacuuuauucauugcuuucuuucuuuuucuuccuuccuuccuuccuuccuuccuuccuuccuuccuuccuuccuuucuuuguuucuuucuaagacacaucauuuauagauaaacguugcugcucccucccuguauuuaguauugaaccaugggucuugcgcaugaucuguaauuauccuguccuugaacuccauccagagccauaucaacauaaaccaaacuacauuuaccaccuguagacauuguggcuuuucaaggaauacggugcuuaccaggcuccguaugcccugauuccccccuccgcccccccgccccaccccuucccaauuuaugccaaucaaaagaauucacucuuggaguagcauaacauggauagaagcuggugaugguagcaguugaauuucauuuaaaacaaccaaacaaacaaacaaccaaacaaccaacaaacagacaaaaccccaaaaccccacuaggguggugcugguagaagcauauauuccaauuucugaaguaauauccagcuuucuauauucuaaacucucugcaacuaauucucucaacaaaacagugauguuaacuuauuagugccucagcaugugagcuuggggauuacuuccugcacugugacccuuugauauuucagcuaauuaccaauuaagagccauuugaggaaggaauguaaguccaggugggcauugcaaaaucuacuuuaagacuugugauagcaucaagaaaacagcaauuuuguacuuugcacaaauaugugucaguaucuugaaauaaaauccugcuagaauucugguauacuccuuuaagacaauuaucuucucagugacucaguagcgcuuaauggaaaacaugacugcuacuagcuucaaaccagcuauucugagggcuggugugugugcauuuuauaguuugaugaguaucuuaaugauuuucuuucuaauguuuuuguguguguaugucuuaccuguaugucugucuguggguuauuugugggucuggugcucuaggaugccagaagagaacaucggaucagcuguaccuggaguugcaaaugguuuugaacuaccuccugguccucuagaaggagcaccuagcccuuucauauacuaaccuuuuuuuuuuccucucccaaauuuaguuuucuaauauuuguuuauugaauguauuagagauauuuuugaaaauauucauuuauauagccauagauuuuuaaaagauuuuuaaugauauauauauauauauauauauauauauauauauauauauauauaugcucuaacuauauguauaccuuccugccagaagaggacaucagauccuauuacagaugguugugagccaccaugugguugcuggguauugaacucaggaccucuggaagagcagcucucaaccacugagccaugucuccagccccaaaguuguauguuuuaauaaccaggauucugucucccaguguuacauaaguaguagugugucuuucagucaguagguuuuuuuuuuuuuuuuugacuugguaacaauauaacaaauaggauuuaugucuguuuuacaaucugggaugcuuuaaauguaacuucuuccuucuccaugugcccuccucuccaaagaagacacuaaguaaaagaaaaguuuuagccucaacuaugcuauaaccuugagccauuuauucuacuuggacuuuuauuuuugcuuuugcuggguaauuaaucuauacacucuugaagagaaagacuggaucaugucuuuuugcaauaacuuuaaauacugugguaauuuugaggcagcccuugugauuaugcaacacucauccagauaagcuugguuugcuuauucauaaaacuucuaauuagcuaaaucucaguuuucauuuuuccuugaaggagguccugaugacaacuuaauugaagguggaggaacaaaauuugucugcaaaccuggagccagaaauauuaccgucauauuccauccauuacugagguaagacagcuccuaugauguacuuaucugugaucaauauucccauuauuuaugcugauguucugugugcugauaguucagccagcauucagucaaaucauuaggacaaagaaacuuguuccguuuuguaagguuucacaaugaaaguuagucaauagaccagucaaugucagccauauagcuccuuguucucaggaggacuagcucacagacacucugauuugauuuucuuuacuuccuucuguaguccugcccauccuguccauuccuccuccugcuuucuuggaucucagugguuggcaagcccaggcccacuguuaucacagaggugaagcaucacaguauaaacuguggcccacagccugugguauuuucucuguaguucuucaggagaacaagaaguuacuggcccagggugugucuucuccguuuacacugaugacuccuuuacuguuccuugagaaucaucaaauccaucccugaacagaugcgauguguauuaaccuauaugauauuaagaguaaaauacauggccuucuuucuugaaauaugauuugauggugagcagaauaaaaucaguuacgaauucucuuuacaauuauacuagauugcaggaaagaaaaauucaugauucuuucacaaaaaucauucuaggcccuaaguacagguacuuuucuaccaggcuuaaaaagacaauugcacuguggucaucaacuuugccuuacacuuaauuucuagagaucugugugcaugacagaguuaaaacguuuuacaaacuuauggaaggcuaacaugcuauauuuaacacuggguuuauuaaauuuaauuuugaaaauacauaaagaacaaauaucauacauauuaacaugguaauaugauguucuccucaauagaauaauuuuguccaccucccccccagcccaggguauauaccuuagacauuugucuucuuugagaaguguacacuauugucacagcccuccugcugcacagcugaguaacaguucguucuuuccccugccucucucaccguggcuacucuuugcucaguguuugcccauccaacuuucccuuucacccuacugucugcuaaccugcauuccacucuucccuuguaugcgaugaacuuuuagaucacacaagaaugagguaauacaguuugauccauguugucacaaauaacagaauuuuauuuuauuuuuuguagcuuaauuguauuccauuguauauaagucacauuucuuuuauccagucaucagcugaaugguucuuugguuguuuccacuuuaccuuugggugugaucauggcaugggaauugcuggaucauauaauaguucuauucuuaauuuugugggauccuuuacacuguuuuucauaaugaauauauaaauugaugaugcacucaauguucauauaguagccaauaucauuuuauaguguacuuaaaaauggcuaauaaaggaaauuaauauuauauauuuuaccacaauuuauaaacggaacuuuggguuuagauacauaauauaauauuacuuuucucugugaauaaccauuauauauuugcuguauuuuauguaaaggaauagaaaauugaauucuuuacauguuauaucucagaauaauauauuaacuuucuaaaacucuuacuggaaguaaauuugcuuaagaaucaugggauuaagagaauuuaauuuuugauauauaauauguguuaccuauuauaauguuaacccuacguauuuaauaauauuguucauacauacuaugacuuuguuaauuaguuuagcauuuguucugcaguuacaaucacuuuuugcguagugucauuuauuguuaagaaagaggaaugugucugaaucuuuaugagccucuguuaaauucaguugaacgcuguacuuugcugcuccguuuugugauagcuugggaaaauuaaucccuugugucuccguuuauucugcauauggagggaggccuguggagggaggaacuucaugcagugucuaucuaacaguguuuaguccagcacuccugcugcuuuccugggaguuguuuuacugugucaggcucccccuucucugaccaacuccaucuguauucuaauucaaagcuguaaguuauuguugacaggaacugaagguuuaucacaugauauaauucaucauuaauuuuuuucuuuguauaucucuuaauguaagcaacaagaauauuauguggcuugccaggugaauuaauucuuuguaaucaugugacaguugcaggcuuuaugcuagcccauggcacacuuuuaaaacucgcuccuuaaaggcacuauugagugagucaauaugaaaaucuaauaagaggcuuauaaaacuucaaauggcuaaguccuuuaguacuuuuaauuuuaguuauuauuuuccaaccucuucgaaguguccauuauuucuuaaguuuauaauuuaauuuuuauaauuaggagaauuaagcuguauauaaauaguauauuucuacacauuaauuuuuauaaugcuuuaacucuuguaguuuuguuaauagacuguuccacccuauguucuuaucugagagacaauauagcaaaaugagacggaaagaauggaagaauggaaagauguaggggcaggagacuuaaaacuuuaaaugaaaacccuaacaggguacauuggcuccuuuccuuuaguuuuugucaccaguuguuuacugggcucugcuuuuguguaaggcuuaaggaaacaagaugagaccacaugcuugucucugaggugcuugcuggggaacuugccaggaggcagggguuaacaggucuggaugcagcagcuauugagaaggacaugaaucaguggaaucuuugauaucugucacggaagauaaauaugcagggucucucaugacccaguuugacaauuccuauaaugacauauucuguugccuauuagucaccgucuuccuccugcuguucugcaaagguuuucuacuuagaucaaaucauucuauuccugacucaucccaaacuuuuccugacugauuuagacaguguuuuuuguuuaugucuuaaaucaugauuaugaggcucagaaguaccuuuccucacaaugacaucuaucaugaauuaauuaguaacagcuaauauuugugauaauagacuguauaagcuuccuugugacuuucacugagcucagauacuuuucucacuggaauggagacacauuuccucugcuaccugcccacucugucuaacaucaccagcacucugucuuccugggagguugcauauggcugguacacuuccuuuauggagacagcacuuugguaacuucuguuuaucuggcagugcacucguuagugccuagaaggugacuguguuccuauuggaaucugagcugcccuuccaugaacacugcaggguugauuccugucauucuguuugauauauucccucucauacaauuaucccacaagcuuuuccccucaaguaaccccguagucuuauuuucagucuccucauagcuaugguggccucaacucuaggaaacagaggcaaggggacuggcucccaccuguucaccccauuaacucugcuggcccuuuagcuuuauuuaguauuuccauaguguuuacuuuuggucagccuuuuaucuuucuuucuuuuuuuuuuuuuuuuuuuuuuuuuuugcuuuuuccagacaggguuucucuguauagcccuggcuguccuggaacucacucuguagaccaggcuggccucgaacucagaaauccgccugccucugccucguaagugcugggauuaucuuaaaaauacaggcuauagaaucuuuuuguuugcuuugcccuuaaccuaccaagacacugugagugguuccaccccacugacagcuuacacugacagaugagaagaggucaucucaucuguuccuuugccuauugaucuaaaugagaaagacauauggaaacaaaauuuuuauugacuaaauuacugagcauuuuaauuuucuuuguacauuagcaaggagaugauuaguccauauguugauuucugcacuuuaauuuuuaugacucuaugacuggggaaugccuuuauauuucaggauuccaaaggccuuagauguuuaaaauuaaaaauuaaaaugucaaaugacuuuuacaguguauuaauuuuuuugcugggugccucuuagagacucugaauuaagaaggucuuugugugaguaugucucuuaauuggaccugaugaugcaguaagagaagcagaccugaauaauugaggaaagaagcccugggcagaaggacugcaaaugaaaggagaaaggugacuguguuccaaggacuacagugggcuugcuggggaccaggguaugcucucaacugucucugauggagggcgugaaggaacuuguauucaucauggauagaauagaaauggcuuccuuuugcuugauuaaugagggcauuauaagugacaacagaaauauaaggcuagggcaguggcacacaucuguaauuccagcacucaggagucagaaacagguggauaucuugaguuugagaccugggcaucaagggcuacacagagaaauccugguguguguguguguguguguguguguguguguguguguguguguauuugaacuacauuuguaauuucuaaagucuuggaaaguauagaggaagccaaauaauacuggcauucaaggaacauuauuauauuuggacuuuuacuggauuugaaguacagaagaacucuuguuaagcacuaggucaguauagcugaguauauaugguugguauagguuaguguaguuuacuguaacaaaaaugguaugugccuccucacaaugguguaucuggaaguauaauguguaauuugaugguauuuucuagugauauuuuacaaaugcuaugugguaaaaaucaggauacccuaaaguguucauucuaccugugauuucuaauauaguguacuucaaaaaauacucauaaauucuuuuuuuuuauugaagccaugaauaaacuggcaggcuucauuauaaaagucgugguuuaauuuuggguuuuguaguaggauuugguuguuaaucuuuccaaauuuagagaauaaccacagaagaauuaauuuauuggcaaauugcauguuagucuaaacccagucuaacauaaaagggucuguuuuggaaauauguccaagauuacaaaaccuugcuauacaaagcuugcuuuaauaucuuucucauuuaacuuguguuggaaguguaauaacucauucaucauuacuuaauauuggauagguggguguccuauguucaugugguuugcuauaaaaggaagauguaguuugaauauuuauaauaaacaugaauaucaaguauuuaaauaauuauucuauauuuuuuugccaauguguuuaucuuugagaaauguagaaguauuauuuccacgaugucaguuugauguuugcagugauauuuggaaguguguuauucugagcauucaagguaugugguaucuuuauguagauaccugcuuguuuuuaaugaccuaaagcuuauguggauauguuggaaauguaaaagaaauacccaauuuaaaaaaaaaguaagaaaggugcugugauuucuguacugagaaaguccaccagaugacauugugagccaaacgccauucaugcaugggaggcaauguggacauugugucauacuuuuagagaaauauaacuuuuuuucugaauuacgaauaauaauucauaccaguccugaaaugcacugugcagugguuuguguagcuucugaaacucacaugugaguaaaugcuuucaauuuuauauuaaaaauguaaacugccuuuaaucuucuaucaaauauuuggagauaaaauuauuuuuuucugagcuuuucuuuuaaucuuugucuuuugaaaccauguuuugugauucuugcuacacuuuggucacaaacccuacacgugagugaaaaugaacucaaucaaggaagccauucgccucauacuucuauuagccuuucaucuauuuugaaagaagauuugguagucuguuuacaugaaaaacccagauaauucuauaaaauauaaacagacacuuaagaaaauugcaaaguuuugugaagaacugaagauuugauuaaauguuagaaaugugccuauaugcaaugacacuuguaaagauaggaaagcuuuucugggaagcaguaucuucccuggagaugccuagccugcagcugagugcaagcagagcgagcuagaugcuaaagugguggaugcauagccuuugguucuggaacugucgcucagacacgaggugcugugucucacaucuggagugguguauuucuuuucgcacacugauguguuuuuguuguuaguuguuuaaaucaaacaugucagcacuacugauugccccugauaggacaagaacuucuaaugucuucuccacauugaaguaagagggacacucaggucauauugaaaucugcggugguacaagaagucccuauucuucucuauaauagaguuagucuuacccacacccucccuuacucuccccuucucuuuuuguuucuugauuuucuguucuaguuuuucauggcaacaaguucaugugacuuuccucuugcgguaacuccugagacguagaaucuacaacucacugcccuaaaaucaccacucugcgcugagacuuucuauuuaccaauuccaucucuaucuacuaacauuacugauagcuuccauagaaaagucagcaguauaacuuuucagugcaagaauuuacauaguuuuguacugcuuuuuauguauucugaacacacauuugucuuuuggacuguaauagccaaaauaugccuacucagcaucaaugaaguauguuuauguccagcuaugggcccauuuacaucugauuuagaaauauaaauugauaauauaauuuagaaucaaaauaauaugggcauggcuagaaaaaauacaauuucuuuccuuaauaacauauuccuuuagguguaggcuaugcauugucucuguuuauauggaagauuuuacuaucccuguugccuucagaucucuucucucucucuuuuccuccuuuccucuguccuuccccccccccccacucuuccuuucucucuugcucauugaguuauuucuacuuugcugacuuugauauuaggguuccuguauacuacuaaaacccuuugauaacuucagcuuuuaaguuuucaagaauugcuauuugaauguguugucauuguaaauauacuuaucauucagaacuaagaauuaacguuuucaaagaaagauaguugguaauauuaaaucaauauuauuaagcaaacauggguaaauaaucuaguuuggggcaaacaagaaauucagugcagugaggaggagaggagcugggcgagggugaugaacucuuagaggaacaucacagaagaggaagcaagcauggccucugcaggcuggcgcaaggucauggugaguggguaccuacuguacagcaaguggggaauaggaaccuauuuggaacagaacaaaaauguuaauuacauacagguaauuagaacagcuggaaguggggaugaauugugauauuaaaagcuucuuucaggaugaauuuggaaucuuauacuuuaauuauguguauuuaagaaaaaacauuuuauuguuuucaaaguuuacuuaaguaauuugcugugcuuauuguagcuguuucuacauguuagcuuguagcauguccagaggccucccggggccuccccugguguuccuaguauugcaaugagcugcagugccuucccagauacguauaaagcucuccgacucagauuguuugcaucugggaaaccacugauuccuuuugaauuguauuguucccuugugugucagugugaaguccaaugagaaaauguuacaugguaaggauaaaauaaguauggcagagaaaagacuaagaagagcagcuuugguccuguucuucagaaugcaauuagaaacccgaaaccugcuggacaggguagauagagguuccucaguacccugaaaugcauuggagugaguccauuucuuucucauuucagcccuuuuaggaaaagugagaggacaguuucuugaaauaaaaaggaacugacaucuuucucuagcugugcuucccucucucaucuuagugucaguuuauuauauuuucauuggcaaaugauuugauuaauauguaaauuccucccuuauccuuccugcccucccacaucuucuuuguagcauacaguguccucaaguugagaaucuugcuuucucaauguccuaaaugcgacucuuaaaggccaugcaccaccacuccuggaugacauguugauuauccuucaaggcucagcucugacuuucaaugguagaugaguguauuuuacaauuaauugaaucugaggauguguguguguauguguuagauauuucauauguguguguguaaaauguuucucauauauguuguuuugcucauuuauuacuucuuagaccuccugcaaauauuuaucuagaagacacuguuucuauggcacugucccuggaacaguagagaucuuucuuccuuucauagaguauuguggugauuugacuacaaaaggaacuccacagcaaggaaguccaacuuuccaucgcugcugaauuuuuuuccccuuucgcaggcuacuugccacgaguacccuuuuucuucugugcagacacauacccuuuucuccaguuauuuaggcuagccccucaucacucgguaagaucuagauuaaaacaaagccaaacaaaauuuaccaucuuuuucuuaaauacaaagcuuguuuccuaggagacccuuguuucuaaugccugcugucuccacuguaacuacuuuuguucugcuucuacuucuguggcuuggauuccccuucugcuccggacuacuuccauucuggcaaaucugaacuuucuugcccagcucagucagcucugagagggcucaugcugccuuucugcuucucccugacuucauuauuccccacccacccacucugaguuguuuggaguuaggcuucacaccuggugcucaacuuguauguagaacuuucauucuauaucucggucuugacccacaagccauuucuuuuucuuggacucucaugccaugaucugcccacucguaauagucuucuaaccucuuucaccccgugugauugacuuuauccuucaggaaucagcuuguacauugccugcucuaccuguguuuucagcuuaccuucauccucacaagguguggccuccuccguguagauauuaccauguugaccauauuugguuauagcccuuacauagugucuugagauguuucaaggcaaaacaguuguuauuuuaaggggacaaucccacuaccaguggagacauuagaauaugagauugaccuucucauuaggugaaaguggggacauguguaauuucugaugauauuggaaagaaggcagaauagugaugaaaauagaguuguguucuauucagauaugaaguuggaagucuggcagggagaaggggaaucagcauagaaccuguaugaaaaaucguguaagccagaggagcugcugaucaucaugacugacaugcagaugauauaaagauuaaugagauauugaauuuuauuauugcagaauggaaauccuuccaaaaacagaaugccugagggcaaaacagagauugugccaaagaaacaaaaccaacaauugaauuggcaaacauggaggaggaagaaugaacaaagaauuagacaaauccugggccauguguagcucgaagcuuuacuuacacaagcugucucuguugagggauuugugauacaaaucacaggacacugugcugccauucgugcagagacagcacgucagcuacuuuuccugucacuaucauaagaacauuugacaagccaauuuaaggaaggaugggcuugcuacuuugagaguauauuccacauggcacgguggaguuugggacaguuggaagggaaauggaugcuagaauuuagcucacuuccuccuuuguauuccucaguagaggacccugaccuuauuguuguugucauugcuguuguuguucaauauauaagcccucaguaagaucaucaguuuuccaccucaacugaacgaaccucaaaagcuccucacaggcauccccaagagugaucuaaccuaggcaaucucccagaaugcccugagucuuguuuccuaugcgagucucuguucuguuaguuggccaucaguauuaaucuucacaaguagacagguauauuucuguuagcauaaaacuaugcauuuaacacguauauuaaaugaugauuaaaagucagaauguauagcagaugaaacuucgcuuaaauauguaacuuuaaaagguaugcgguaccuuuugaauucauaauucuuaaauaccauuuacacuuguaaauaauuaugggaugauaaccuauauuuucuguuauuuuucuccucuccucccacuucuucauucucuuugauuguagggaccaaacacuaggaccuuaacaugugaggccagaugucugcacugagccacaucccuguuucucuuugauagacauuccuauauguuuaucguugcaguuaacacauguuuaguuagaguuaacaagacaaagggggaagcuucuuuccaaggccaugguuuccagcacaugaauaacaauaaccuucaauaagauauuuauaguauuaaagauuagcaaauauuuaaauagcaguuuacauaauauaucucagcacauuacaauguuuaguuaucauagcaaucauaaaauguaguaugagaaugcuguguugugaggccugauuucauggauguggcuucaguaccaucuuggcauuggagacaguuuuggagacuggacaccggucagcuuugauugaauuuaaaaacuuuccaucauguggaggaguuuacaucauguggcuucucagguuuuguucagguuuccaggcccuccuccauuuggggauagcuguuacaucuaaguccuuguugucuuuuuauauaguauaggaaaggucauaucaaaggcaagaacccaagagagcugucucuaauacucauuuuucauuguacuuccuacaguucauggaaccucccuuucuacugguacuuauaagccgccaucugugucccccucuguuccaucgugcauguuauuucuccacgucauuugguuucuucuuccuuuaccuaggaagucugugucugcccuuuagcagcaucuccucuggagaacuuuaugauaccuguuuuccucuucucacuguuuccuuucccugccugcugugcccuugaaaggccuaacccagcagucuguacagcugcauggucucauguuccucacucaggaacaggacucagagccagguguuaaugcaugggccauagcuaaauguuugauaaugugagacaauaauaguuucucaauaaaugcuuggggaaggggaaugaauuuugguauauucaacaauauauuuuuuuuauaagagaaacacuguaauuuucucuguccgauccagaguaagauggauguagacauguauuuuucuggaguccacacaaguccugggucaugaaucucucuaugugccucuggccauugccuuccaaaacacauuugcuuccagaucucuucuugcaguagcuuuugaugcucugauggauaagcagcaaggacuccgugaugagugcacuuccuaguggaguuacucaaggaaaacaaaugcucacucgggucuuugaaauaaaucugagggugaaaccgaggcagcgagcacuucuugugcugucguccugcuuucgguuugcugacaggcugccugcauuugauuuaagaugauagcguguaaacuccuuaaguuagacuguuaauuucccgugacagcuuaugaagcuuccccucccauucuucucccacacccaggcacgcauaucagaggaacuccuucgugcgacauuuguuuaacaucgucugucagaaaaagugccacaguaagucagucaggauucagguuugcaaacauacuuccaccuuauugaacaucacaaggcugucaaaaauuucauuucucuauauguuccccuccugaaggcaaaacucuuauaggcguuaauggcaaugggaucuugucacagccuuuggagcuucugcagggcguuuuuaguuugcgcugcaggacaacgaucuuugagauguuaguuauuaucugauauucuuuguuuuuccuaccuucucuaaaaaaguaaaguuaaaaaccuuucuaaguagccuugauguugauaaaaugucuuuucucuuuuuuccugccagucuucuagauucuuuauaaccagcacaugcccacucugcacucagugguacuugagugaaauacuuuuuaugccauucacauuucacauacuuguucaugugguggaugaugaaaaaccaccaagagggagaccaguuauacuuuaacauguaauuaauaaucacagcuccaaagaagguugcauuuuuuuggaacauagccagggguauguccucugcagagagaagaaacgaaaaauagacgcauuuauaaugcaaucagaacaccccucuauaauuuauguauauuaacauauccuaagagacccugauguuugaaugucuuuaagauagcacaaagucucucccaaacaaacaugauggaauuacuugagggagcacauuaagacaguaggcauggcccuuaauggcucaacaaugcauauagucauuaucacggcaaacuccaggaaaaccaucccccgaaaccacaaggagucagguuauuucugaggccuggugauucuguauauguugcucacauccauuucaucaucauauguuugaaaccauacaaacguugacucucuucaacauuaauauuguuuuucuuuuuacuuguagcuauauauacugaguauacaucuuaauuccuuguuauaguauauagaagaaaguaaguaauacuuuggaauuuacacugcacauaaaauaauugguagucuccgaguauuguagaccuaggauuucacaauaauauaacaugggcuuaauacucuccaaguaugcauaacuuggggcucacuuuuauaauuugcuuuuguauucuucaccauucaacaccccaggugaagaggaauaucaggauccuguccuugcugacgauggaacagacugaucucuuuuacucuagaauaucauuguacuggggcauuuuggaaguagcucacaaauguaugauaagacuauauaucaucccaucucugaguccugaagauaccgcagaccaggugaaggcccugucuguggaucuuauguucauggcacuccaggguguucauugugucugccucuuaauuuguacucugaaagaaaaaaaaauuuauaaaguuuugaaccauuuuagaaggaagcauuauaaucuuaacugguuaguuugaguuuuuauauguugaagauguuuccuauauaaauuuaucugugauaacauuucuagccaauuaaaaauaaaauguauuuagaagaaguuucucuacacagacuacagauaucucuaucucugaaagauacuccuaaaucuuuuaaguaugcaguugagcuggaaagauggcucagugguuaagacuacgggcugcucuucuaaggacucugguuacuucaaggcacaaaggucaccugguucacauccgucuguuacuguagcuccagggggauccaagucugcuggccucugugggcaucugcgcucagcugcacacacacacacacagaugucacaugugcaggcagacacugaagaauauaauaaaauagguuagaguaauaaaauaaaaucuuuaaaaauaaaaauuuuaaaagcgggcuggaaagggcucagcaguuaagagcauugacugcucuuucaaagguccugaguucagaucccagcaaccacaugguggcucacaaccaucuauaaugagaucugaugcccucuuuuagagugucugaagacagcuaaaguguacuuacauauaauaaauagauaaauaauucuuuuuuuaaaaaauugcuacauaguccauaguauuuuuaaaaaaauaaauuaaagaaaguacaguauaaugauuugucucauugacuuuguuucuucagauacaaugaaauaaaacuccuauguugacagauggucuguuuccaucuucagccuugucuucaagagaacauuagauucuauauguuucauggcauuauuuuaguuugcaaaugacgucugucuuuuaaaguucuuuucuucaacauauaacaaguguaauaucauuuccaaauauucacuagacgggcuuuaaacacacauguccucagugucugaauauuccucauucuaauauaauauaguauagggaaggaagacagcccuaccuugcauccggacaauguuaauaccgucuugcuguacuguauagucuuuguagaauaaugaacacaucaauauauuuauuuggaaauauuucagaagguauuaucagugugauuuagaaauauaacauauuuuuaaaucauuucuuuguucauuucaauuauucuuuuccaaaguaaccaugagauaguugaccaaauacuuuccuucaggagcagcugaaaacugagcaaagaaucccaugaacuguuuuauuggagagaagccggagguguuucuuuucugcauuugcuucucuuaaucuacuugugcuguuuucaauuucaugccuuuaugacaaggaugagagaaaggugggagagugagccuucucucuguauucucccuggguuucaguaggcaugcucagacuuuguuuauagugaaaacucucuguuuauaaucauuuucuucuuuuaucucuucagucauuuucugaucuuaccauuuugaaauaguauuucucucccuuuugagagcaggagacuuauacccuguguauuaauuuuucugugcaucugugggcugugcucaggagcucccgguucuguggaaucucgcuuucuguaguuauuggcacagucagucaccagucaaaccagaagcuuucucagcaccgcuguccucgggauucuccuuucuucagugcuaguucauuguuuuguaagugugcuugucagaggccuagacaaucuggaguaagugugagcacuguguacuucccugccucuucuccagccuccuuccaucccagcuaugugugagguccucuuccuuuucuaacacugaagaguuuagucgggaauggaacaccccacccccuucauuuguguuucuggagcaaagcacuguuugcagugccaauaauguuuacauuuaaaaguuuguuauugauuauuugggaauuuuacgucaugcaucccaaucacaggcaccucccagccuucccucauccaccuccugugccucgugacucucccuccaacagagaaaagaaggaaaaaaagagagagaaaaggggggaagcccauuuuguguugucuauacucacuggacauugucacauucauaguggcuaguccucccgccccuagugggggaguggcaaggagucucuuucugccugcaucuagacuagaagcugucagcuguaacuggagaggagggguaggccaaacucucccaugcccauggguauuaccagauaacagauaacaucaagcuacuguggacauucccauaggcuuuggugguaacccaggucaaagacaucaaaauggcccuggcucagguaaggaccaccaacccacucaugaccccucagagccaugggccucaacauggucugagguggcuucgcaugcugcucaugucaggauguccccgacugcacacagccacaugaaucucaggcuucaucuuggccuagagcagcaguggaguccacagauaccaccauggcuuucuguggcauugcagaccauagugguccauugaggaggccaauccaaaaguaaacuuucuuucuuucgguccucuaucauugccuauagccagggggauccugcggucuggcagcagguaaggggucugaguccaucucuguauaagcuccaggcugcuguacaccauaccacagaucccacuggggaaugacagcguguugagcucagacaucccuaaccugugucacuuugucaccucucaccugcauugugccuccacuucugccuuucucccuagcacacacacacugcuccguucuucuuucuuuuccugcucucuaucacauauuacuucacccuagugugucuucuggcaacaaggccaaggcagaacuucaguguuugcauuuuuagaguagauacuguauuuguacauucucugaaagccuaguagcaucagucaggaacuuuuuuucuccuaagagcaauugucauaauacaaaaacaguaucuguaucuucuccugucauuggugaagacaccucauguccagauagcccuuucuuugugaguuguacuucagaaaugcuuuucuuauaggauaccagaguucugggcugcuugcaucauuauacacuaguguaccagcaccacaagguauuuaccuucuagaacuuucaaugcuuuguugcagaguaauaucauuaacaucuucucucauauauucucucucugcaaacauccccccacuccuuguaaauucuccaaagaucaucuaaugcgugugccuuuauagcuacacugucuccacuguauugcuguuucuuucccuuuugacagaugagagaaaguaagccuggcuguauaaacccuucucuguguugacaauucccaaacaacucccuucuucuggacuguucagugaaagugaagugagcaaaacagagauauuugaaagaugcugauuguccacagcugucuguuguucugcuagcaugauagaaggacagagcccuggauggcagaagucacaguucgaggagcccaggcggaucagaccagggaaagucuuaagaauuaacagggucagacaugaagccuggaauggugcgucucuucuacuccuagcacuugggagguggaggcaaaaggaugagggugccaaggucauucucagauggugacaccaaggccagccuaggacgcaggagacucugucuuggacaacaagcaacgaugacaacaaaaggcuggggaaauagaaauaacaugggacgaaauggguuuccccagauggcaugcauuccuccuccuucgaauucaguagcauaauuuguaaugaacaguuucgcuuagggauguuaaaugcagagacacagugcaucaucccugccauuacagcacugguucuagauguuugugaauaaauaagugaaugaaguuuaugaaaauccuguacaagggaauauguguuagaacauaaaggggaggcucauauauucccuuaauuauccuaauugccuaguauucugugagcugucagauuuaggagugccaccaaucuuagcuuuaauuccaauuuugcucacuauguuucuccaagacuagguuucuucauucacacaauaggaaucauguccauguuauauuggcaugaaaaucugagccaacauucuuacacuaauuacaguggcucuugagaccaggaaaaccuuacgaauaauacuugcacagguucuugaaccaaaaguaaauuaaaaguaaguguuuggugggugugagugugugugugugugugugugugagagagagagagagagagagggagagagauuuguagggccuuagcauuuaggcuuugcuuauggacaaggcaaagggaaguucaggauaggaaaacuuugccccugcccucuuaccuccacacugggcgcugagcucagccuuucuuccguccucucccuguuuccaggagcuccuucagagaaguauaguagaauggauugcucuaacaagggacguuaggaaauagagaaaagcugcuugcauaugaaucccuaaaggcugaauuucaagcuuuuguuucaaggaaauaauuggagaauuuuuccuugaugugcacagaaaauaauacuuucuucucuuuuaugggaauaaauuaggaaaaucggauauugugggaauaacagaaugaaucaucuuuagauuaucucuaauauguaauuugaauaaugugaauuauuauuuuaaguucuaaaaugcuaacaauauauaguaacacuuucaaauaaagaaaaauaucuaguagaaugauaaaagaccuuuguuaauuaaaauaauaguguauaugaaauagcagcaaaauacugaugaaauuacccaguauugguacauuuuuguuagucaaguuauuuauaagugagcauagcagcaaaccccuauggaauuaaaauaggaaaggaaacaaaacaaagcagcuacuuguucagucuuaacaaacaaggaaucuuuccaaaauaauaaagccgagcuuacugagaaggccugccuugaucuaaaugauuugggccagcaagugaguaccaauuuaaaaaauaaaacggaugcuuacaacgugguuuggucauuaagugugugcuccuguagacacacaaaagccacaggugcaucagugauuuuaaugcugagggguggaggcaggccaaugucuguaucucacuggauagucaguguagcugaauuaaugaucucuauguguagugaaagagucuggcacaaaaaauuagauagaaaaugauggaugacacccagucucaaccucugcucauuguaugcaucuguauauacacuaauguauauacauuuacacaauacacauaaaaguuuuaaacuaauauucuguagcuuuguaguaauuuugguagaguuuuauauggcugucugaauuuuauucuugguguucagguuuaagaaauaagucaugacuugaaauaagaauuagaagaguuuuucagauaccagaaggcaguuugggcugagcucauucauguaacuuagcccacccugggaagaugugcagcgcuccaggcagagcaugagaagcggccgaugggcucuccugccuuuugguuuucagucuccuaaggucaaauggcauuuuuccugcuaagugagaaaguuauccuacaggccuaaugguaguuacucaucccguuuguuuucuuauuaguuuaaugauaaugaauuacaaaggaaauuuguggguaacauuuuuccugcuuauaauuaaugcacagcccaaggagaaacuggcauucuauacuauugaaaauaauaaaauccuaauaacaaagucccaauaaagcuuuagagucuguuucuggcauaaaaaauuaaaaacuagaacaacaucuuaacacagaacacuguuuuagacaagggcguuaaaauggccagagcuuuaguauuaguaaaucuaacccaacccugucaacacacauaauugaguaugcaugauauucacaguuuacuaaaggggaucauuaaacuccagaauaaauugcaauuaugagcagacauuaucuccaguacuuuugaaaugugcucuuaaguuucugcuaguaagagcuacacuauuguguuagacauuauuguacauguguacucaacacuaagagauaaucaacuuggcuauugaggcucuguggaaacaauuuagagcucaaauauagagacugucugucugcaaauauuauuuuuccuuuaauuuaaggcuaaccuggaacuuaugggccuccuaccuugcuaggacuaagaugugcuaccacacuuggcucuauuugcauauuuuaguguucuucauuaauaugggcuuuuagaauaaauccaaucaugauuuuucacucuuaaaagauuucacagcugcaugaaaacugguuggugauaagcagcacacagaauuggcccuccugugaacuguagugggaccucacgcugagaaaagacuuacuucccuggcuuauuuucuuguugaguuacacagcaaauauuuacugagcacccaucaaauaccaggcucuauaguagccagagagaaucagacaggaauugcacuucaagcucucuuacugcuaacaguagugaguggggcaaagcauuguaagaagacagcaacacacacaaagaaugggagaauauagugccugaacuuagaccuucagagaaacccuucuauaguaggaaucuccuaggcugaaauuaggaagauccauacuuagaugagggaaauccaugcauagccucaugauaaaagaaagccagagcaagagaggcaaauaaugugugucuggaggcccagagaagcugagguacaccagcuuuccagugggacacacuugccauuaguaauuuuuuuucuuucucccauacuugggagguggaugcaaguguuugugaaacauaugaguggcuucuugguccaugaaugguuucuugguccaugaauuuguagggccuuugagaauucuuugagauugaaaacuuaaguaugcuauacccaaauaaagaguucagaccacuuucuuuuauuuuuuugauauuuuauuuauuuacauuucaaauguuaucccauuuccagguuuccccucuggaaaaccuucaaucccuucuuccucccccugcuuguaugaggguguucucccacucccccacccacucaaauacagagguggaugcucccagccaaucauuugacugaacaggaggacucuaaugagaaucagaacacugucuucgucaccugccccaggcugcucucuggcuuauauuccccaacacucaagaauguacuauccuuagcaguuagaguauaaccugccuauauccagguugaaccaaaaucuugagauuauuacuuugaauguauucugcaaauuucuacagauuuaucauguuacuaagacacccuauaagcauuuuagaacuauuucagaacuaucagacaauacagaaguguaaaaaugagagcugcaugcgacuauccugagauguuuccugaaagagguaggacugaaaccagaaagaaacacagguugguccaaaggcaccuuucuagucaggaaguggcacauauaaagguagaaauuacacaguuauccucaaauguaggcuauguggagagauuagagcagugaaaauuuggcaaaauaaauuacauaggaaaagaaugacagguuagcuuacuuucagcuaaaagaaaauagaauaaaaaguguaaucaucuuugauucacugagaaugugaguaacccuuuuuuagaguuagugugaaugaaaagaaagggcauagacagggcugcuaccacuagggcagaucuaugguauccugucaggaauaaauagcccaguccguuagcuaccagcuaccucaaguuacuagggccaugggcugugaugcacuaugauguacaccuuagcuccacgugcuccugucuauguaacauguccuauugucuaaucucaguuccuucaucuuucuaaugagugugaugguaguaacaauaguuagaagaagcauuuuucauaauuguuggagaucacagaaguagcaauugguaccucugcuaacagcugucuuccuuuguucacuaaaacauaagcauacucauuuauucacuaagcaggcauauuccguagaugcucaaaggucuugccugucuacuuuugcucuuaggaggggaaugaaugacauuuugcucuuaggagggggugcuauuugaauuuguaacuuauuuguaacgaaaacaaauuauuugcuucaguuagauucuauuacucuuauuucauagcacuugucaaagacuuuugcaagaaccuuuguaucaaacucaauaugagaaauuauuuauaaaaugaauuauugcccuuuaguuugugcaucuguccuuuaucaaaugagaaucugugggcaggcuguggggaauaaucacuugagucagagaucauacaacucgcugaaaguuguacaugacagcacucuguggaggaauggcuauuugaguucauuuuagccuuaccuuggguuuuguuuguuugcuagaauacucagucaguucccucagggcauguuucagacaguugaccucucugaaucccuugcuucuugcuggcagagcaggcaugcaucuguagaaaagggcucuagaaaugacugcuuguggagcuagucuuagagaaaaguuaaacucucucucucucucucucucucucacacacacacacacacacacacacacacacacacacacacacugugggggagggagagguggaggggagaacccaaauacauaaaccccauacucuuagcuucuaauuguugucuucaccccuguuagugacuuuaaaaauaaagaacauucaccuugacucacaguuuuguaggguuugguucauggaaacgugguuacucugugcccuguagaaagguauuucauagucacaggcacacuagcaggaagugaagcuccucaucucaugucagcuaggaagcaacagugagaauagaaggaccaugauuccaguauuucuuucaaggggaugcugccuccagugaaaucacuuccgguuauuggacuccccuuaaagcuuuccuaauguguugcuuauauuccugucauugugaccaaaauaaacauuuguuuuguuucauaguuucagaccaugguggcaggaauggcauaucagagaagcucaguucauguuagugggaacauuuggcuagagggcgucaucacagugcgugagacugaagugaggcugggcauagucuucaaacccucaccuaacuggugaucuccuuucaccaguuagauucuaccugcuaagguuuacagccuuucuaaccaguaccagcagcugcagaacaagcuuuaaaacaugagccugucaaagacauuugacauucggaauguagcacccucccaacagaaucaaggaagagaugagaaagucuacaucauuaauaaugggcauuuguggggauguuucacaugccaacuauagcuuucauugagaaaaaugggagguguuuuauacaucuuaggaacuaacuccaaaacaccuauccccaguccagauaugaaaaaucuacagccacaaagaaauucacaaagaaauagcaaaauugcagauguaauaucuagcauguguugucuuagcuaggacaugagcuuggaggaucuugaguaagagaacaggcuuggcaaauguucuaagacuccaucucaaguaacacaaacacaagaaaggcuuauguucaucccagggaacauagcucaauuguagagugcuugucuagcuugugcaagacucugagcuccaucccuaccaucucaaaauaaauaaaucaaugaaagacugaagaaauguauaauauccaauauauacacuugaauauuucauuaagaguucauguugaggggcaguauaugugugaaaugagauaauguuuauagaaaugagaaucucuauuuugaaacagauuauuguccuauuagguuugacaauacaaaccaucccagaaagcaaagcaugagcugcacugguggagcaggucauuggccagcagguuuucagcaggguguuguuauacaagcuucuucaggaauuggagaauuuugaauuucaacuugaaauaaagguuuuaggaauuuauauuugaggaauacaguaacagcuaacaguguuugcauguauaauauguaccuuucuuuauguugauccugauuuaaaauagucaggugauaccuuuuuaaaaaucauuuuaauucguacuuuuugagauagcaucucacguggcuggacuugaacucauguuccugugcgguucugcacagaacucccuuagacucuugaaucaauucauccacagaucaugaucaaaugauauugagacgacgaugcagcaucugaagaaaggaguucugggaauucaguguguggagaagggcauaauaacaacuaggcaaugcccaagaacaaggagacgaauagggaucuggagacgugcaguuucagagacuuugacaggagucauuauaaagagagagaugcaucauucugaguuuaccauucauuuugaagcuuuggauuugauuaguccaugacuacucucuguuaucacuuaaugcuaauuuaugagcccauuucagccuagaauaauagaucugaacauuuauuuccuaguaaguuagaaccugugugcaucucuccugucuuuguucuaucucugcuucucccaaacacacagaguacaaacaugaaaaaaaaaaucaaaaaacaaaaacugaaguguggugucugccuugcugagaauagccgaauagugacagagguagauaggcaaugacagggggugacaagggagguugauuagugaauuauuuugaaaacaugauuucucaugcuagauacucaaaacauuucacagacuuguucaacuuccauaaauauuacaugggagggugagucuguuaagaucuuuauauacacacacacauacacccuugaaauggagagcacaaugauuuguggcaaacacguuuacuuugcuuugcauguuacuaaaccuacauuuagcacuugaugcgauuuuuuuuuucucugcuguaucuuugaaaggccuucuuccaguucagcuaccagaggaauccaucauuuugguuuugcuuacaccucccuggugcauucugaguucccagccuuaucuaucugaccccuuaugaugugacaccugauucaauccuuggcuaccuucucauuuucuccccauauuugugcccuuagccuauuccagucucaguucugugaaggccaucucagcuuggaacacuuuccugaguucuucacuuugauggucuuuugcuucuuuaccauuuccauuaguuugucgucuaggagucuugauuuuaauguaucccagacucaguuccauauggucacuacuugcuauccuuuacucauucuuguaggcuuagauuuuucaaaaucuacuuuauuuagcauucuuaaacacuucaacgucccuucuagcccacugaccagagguaguggagaaugaagguuaauaggaaaagggggguuguagaccuguuuagaaguaguuccuuggggugauuccaaucuuagcugucagaauaccaacaauccaguucaauagagugggggcucaauccaacagaaauaucaaggcuccacugauuuggcaugagucagcagaagcagccagaagccgcuggaauaccaagagaagaaggucuuugguacauuucucucuaugaaguuaagacaagugaagaagugagaccagggaagaccaacaaggaagcaaagcauugcaugguauagcaaugcaagagcauccucucuguuugugggguuauauuuauauuccuuccaaacaucacacagcuucucaagugucuguuuucagcaaaacaucacaugcccucucaaguguuuguuuucaucaaaacagcuuccagaaacaucaugugacacaacugaguuguuaaagaaaccagaaauuuccacuucacauuccucuacauuucagucagugaagaugcacggcuugcagaugcucugagcaaagccuacaugucaugccuguuauugcaccucagaggcagcccaucagagcauauaugcugugggcuuucaacagagaacccagaagcuaaccauugcucaggacuuacaagucagguggaaacuagauuucuuuuucuuucgguuuuuagagacaggguuucucuguguagcccuggcuguccuggaacucacuuuguaggccaggcuggucucgaacucagaaauccgccugccucugccucccgagugcugggauuaaaggcaugcaccaccaugcccggcguaagcuggauuauugaauuaggcucuucucuucugcuuuauucucuacuuccuuuucagccagaauaacaguuaaaaauuucaguccuauuguaugaguuuugugguugaauccaugguaaaauuuuuucaagugguuuccugcucugccaguauauuuucagcuuucugucuagagaucgcuccucuggaugccagugccguuccagcuguugcuuuuaaguccaugcaugcauuuguccuaccaggaaaccaucuaacuugcucuccuguaucuugguggauuuucucugauauugccuugcuaguuauccuggccgucccauugauccccuucagcaugcucugccuuuucucccacucugcuuguuacagucugugcucuucaucuucucugugccauucagauuuguuccauaaagguggggauuuuuaaggauuuugcucacuauuaaaacucagcaucaugccucacauguaauaggccaucuauuuucauuuaaugaauggacuuucucacccaaguuguugagucacacuaacaaguguuaccuauguaaucugugaauggaauuuuucugcugauguccuuacugugauuguaaguaaagauuuccuaccucagaaugccucugauacccaagucuucaucuucaugagaaagaauugccuaucagaucaggacaagagaaagaaguauguauauauuaccaccuccaacuguguagaguucuuuggcacagaauggcuucaaaauauuaucccauaaacucaaaaaaaccugaagaccuuuguaguuucccuuggccucugcugcauucacugaagacagaucuaggccuaguucacgaaaaggaacagacaacuccauugggucuuguaacgaugacacuaauggccugugacaaaauggauauuuauaggcuggguaccaugcaagguggagauuucccucuguuuuugaaucugguaaagaaaaaagguaagagucaaacaauuccaaaguuguggccaaauaaccuccagguguuuccugauucaaggcguuuuucuggugucacuuuguacaguacaaggaagauucuuugcugaaggugcugcauagaugccaggauaugucaguggugguggcauugcugcuuuacugauugcaaauggaauguggcuuuguugucaguaguaaccuacuuuugucuuaauucucuuccuguuaaaucagcacuaucauucaaaucguuaacuggaguuuucauuugcuugcugucuuaacuuccacaguauugaccaucaacauuuucacuuuuguaauauuuauuugggcacauuaugccugcagugacacauaagugaaaaucagaagacagccuaagagaguugcuucuggcuuccuaucacgugguuucuagggcucuaacucaguguagcaagcuugaaggcaaacuucuuuuaugacugaauuuucuugcuggcccuauuaucaaaauaguccagauuuuauuuuuugcaguuucuucauucuugggcaaggguguguauauacaagcaagagauugguguucuagugucuuacucuguugcucuccacuguauguauguauguauguauguauguauguauguauguauguauguaugugcuauuuauuuacuuagcauacuaauugacuagaucaaauauccaacaaggucuugagacuccccaacgaucugcacuaggauuucagaccucauguuucaauccugaccuugccaugagugcugggaacuugaagucaagcccaugagcaggucccacguuacccaucuccccucuccccagccccauuccccuuauucuucagugagaagccuuucccgguccuauuugacuuuuggucagaugaucuugauuuguuaacuuuuuaaaauuauaaauugacuugugagaaucacagauacacaaaugcauuucauaaguugcuauaacauuuaaauuaucagugccaauauuaguaucagacaugcugauuucuaaaauuccuuuuaccuguaaccuuaaauguuuuuuaagguuuugagaaguacuuugugcuucuauaaauucuauaaauucauauugugugugcauuuguguauuuacagcuaaaccaugggcguuccaagaguugccugugagaugcuaaguggucagaguggcuguggacuaaaagcucaucugcgaguacagcugugaccugcacacacuggccucaaugucugcuucucagauacucacagcacauuuuccucuucagcaacaucauuuggcaauacauuuccuucugcccucuacaucucccuggauuauagacagaaaauauggccuuuccauuuaugagaauauaaaguccuacuaugacguaguuccauaaaucugauuuuauugcccuuuuccaaaguaauuucugauaguccugccagaacucucacuuuuguuugucauguuccagcucuauccuuggauaagaaggguuccucuaauaucuaccuaagaacuaaggcuuacguagucaauuuuaaguccucagcugugcuaaauagucucuuaaauuuuauauucuaggaauucauuuacuuuugcaaaacauuuuuauuccuauuuccaguacuagguguuccuuuccguuucccacaugcaugacuuuuauagcccagcauaaaguagaaugcucugccauauugauuuaaugguauguuucaaugaauuuccccuguuacagugcuugcucuaggccaggcagccaaaggggaaacagacagaugugcugguuagcugauuuuaaaagagaaaaauuccauuuuccccauucuuuaaugucagagcugcccugccugaccugacgcugagauguaucaggcuccccugacauccguuacaggaagcagugaucugaccuuuuaaaauuuuauuaacauuuauaaauuuguuuuaguguauuacguuggaagcaaugauuuuuguccagguuggauuagggugacugguauacagauugauagcgcugccauagauuaaucugguggucacuuuguauccugucuagaugcugccuucucuuuucucugcucuuguuuuuaagacuuaugguaauaugaggcaagcauuccaucuguuuuguuacaucaguuucgaaagagcaggagccauuaguguuagcuucuggcugugaugucuggcuggcacuugauaaccauugggaccuaugcauuccuuccuguuuccucucucaguuccuagagcauuccaggaaccaugcaguccugagggcuauaaaagugacuguuacuauccuagugaaagaaacuuuucaaaugacgauuaggaacccgugauagacaaugaagauccuaauccaagacagccccaguucccuguuguagguuuaacgcuccugaugauuucuucauucuguuucucuuccuucccucccuccaugacuuucccuuuucuuccuuucucguuuuuuuaaaccauguucuauuuuggcacuuggagcaaagugauucauauaaccuugaaagaagaaacuauuugucagagaucaauacauaaagaucucuguuaaugcuaaucaggugagcuuaaauguauacaguggccuuagcaauuuucaucuuucuguccauacucaggaaguagagaacucuguauuuuuaugagggcacucaccugcagcagcacacaagagccaggagcugauccccuuuguagccuugcucacaauagcuguggugcacggugaugaggauugacacugccauccaucauccgccucuuucuagaugcaucugaaacuuucaugaagcuuggcgacuccucagugaguguagauugcuguuugacuuuauaguaaauauuuguuuauuuuacagacagggaaauugaggcauugggaaccuaagcaaguagauaaauaacuuacagaaacugcugggaaauauuaccuaauguuuauugagccccuauggagcacauuuucaugaguccauauauauugugcaauauauuuuguuuccggcuuuccucuuuaugcuugcagaaaguaauccaugaaacauaaugccaugaauuuacucuuuugcccucauggggaacuaguuuuugguuuuggacaguuuacauacuuuggcauuuucuucauauauuagaccuuuugaauuuacugugcagacuuaaucauauaaacauuggucacauuuucagguucagauccuccaucuaaacaacacuaacaaaauacaaauacuggcaugugucaauuaccagaaagaugaaguaagaagugguucgcauaaccuggaaauuauuucaguugguacuuuucagugacaacagaaaaagaaaaaagaaaaaauauagagaaagaauguauauauucuaaacaauauauauguaauguucuaaacaagcacuuuuuguguugcagaucuuuuuaacccuuuaauacaccauuguguuacuagccucuggguugcugcuuuucagugcacacuuagagaacuguugauaaacacugcaguccuagagaggaggggagggugaacaguacaacuucccuggaacagcugguaaaugugaauguugcauuuccucacuccuugaagauccuuugagcagcagucugugaagaaacagucuagcugcccacugucccuuucacagccagccucugguauguauuucuaugggugggaccauaagaaagaaaucuugugauuuacucugccagcuagacccaguuaggagagccugacaaagcccaagacucuugauucuuccuuuauacaauacucuuucucaguugauaccugcuuagaagguuguugcuucaggacaaguaggaugguugggacaucuccuauauaaauggccuuuacaaucaaacaggauagaaauagcccauacagucaaauacccuuugaaaucucacaaugauauuagaaucagccagcuuuccuuuuauuucuuuauaguuguuuaucugguuccauaucaucauaagguaugguguguuuucauaauagccauuuuguguuugaagcacuagugggccucccuucccauguucccugacacauacaaaauggcucugggcugagaucuguaacaccuaugcagcccaguguaggguuuucuaaauaguuuuuuaauguccagggaaguacaguaaaugcagucagaagauuuuuuuuuuuuaauuuaaauuuauggguuuaaaauaagucauuuaaaauaagaccuuguuuuucucuuauuuucucuaaaacacaugaaauaaaaauguguacuuauguuguagauuauucugugacaacuuucuaucauguuaauugucauuuacugaacagccuauguuugaaagcuuuucuacaaugguacccugucccauccuuaaaaguggcuucagcugggcgugggggcacacgccuuuaaucccagcacuugggaggcagaggcaggcggauuucugaguucgaggccagccuggucugcaaagugaguucuaggacauccagggcuauacagagaaauccugucucgaaaaaacaaaacaaaacaaaaaccaaaguggcuucauuuuguagauagauaauagcucauacaccuagauaaucuguaagucaguuguuuggaacucagaaugcauuuucucaaggaaauaauuucauuucauucaaaccucacuaguguuucucacugaagcuuccuuggucuaaucuaaugaaauccuguguucuaggaguagauggacaauuugacuuaagcuucuagaaauacuuuucuuccuagugaaaccugaggucagaaccaugcagugucagaauauuggcaaauagaggggccuuagagauguagcccagccuucugugugcccugggauguuagcuacaccugcgguagaauguucuuuccaagagggcaagggcacaugcuacagaaucuccagagucacuuccgugcgaagcagagcucuggccugaguuugauggauguucuagagugaacuuggcaagaagagaucauaacaggucugagggcaggagugaauauucaaggacauucuucugugcaaaacaucaauauugucucugauucuuaaacucuucacccucauccuuuucccuccaagugcucggcugcagaguacagugccaaaagcagaaaugguggggugcuguugucuguggaugaagacgagcuucuuaggucuaucuggggaguguaugaagaugaugcagcugucugaauacaggacaagacacacaggggccaugacagugccugguaaagcauggugugcauguguguggccucucuaccugcugcauuucaguugagaguagaaggguaacugauuuucuccuuuuuuuuuuuuuuuuaaucuaauuuuuuuguuuuguuuuguuuuaaggcauuuuuaacuagguauuuuccucauuuauuucaaauccuauccccaaagccccuuaaacccucccccaacccugcuccccauccuaacccacuccugcuuccuggcccuggcauuccccuguacuggggcauaugaucuucacaauaccaagggccucuccucccauugauggccgacuaggccauucucugcuacauacgcagcuaaagacacaggggaugggggggggggagauacugguuaguucauauuguuguuccuccuauaggguugcagaccccuuuagcuccuuggauaauuucucuagcuccuucauuagggcccuguguuccauccaauagaugacugugagcauccacuucuguauuugccagguauuggcaaaaccucacaagagagagcuaugucaggguccugucagcaaaaucuuucuggcauauggaauagugucugaguuuggugguuguagaugggauggguccccaagucgggcagucucuggauggucuuuccuucugucucagcuccgaauuuugucucuguaacuccuuccauggguauuuuguuccccauucuaagaaggaaugaagaauccacaguuuggucuuccuucuucuugagggaaacugcuuucuaaugaguucaauccuguaacuuagugauaauuuggggaaaguuucauggaaauuggaguugagaaaacaauuaaacaauauuuaaacacugugcugaaaagucugugagaagcuguguuuagcaaacaagaagaugccucuacuuacacugagucuugcaaaucuucaugcuuuauugccagagaaauauguuuauguuuguuuugaacacaagaggauggcucuaaagaggaagauagauagcuuaaagcaagauccuucaaucuucuagguagaaugccuggagauccccuguucacucagaacuuccuuuuuuaaauuauuauuagauauuucuuuauuuacauuucaaauguuauccccuuuccuaguuuccccuccaaaaauccccuauucccuccccucucccccugcuccugaacccacccacucccauuccugguccuggaauucuccuauaggggggcauagagccuucgcaggaccaaggucaccccauugaugacugacuaggcuauccucuacuacaaauauagcuggagccacaauguguuuucuuuggcuggugguauagcuucaaggagcucugaguuuacugguuaguuccuauugaugcacuuagaacuuccuaaagggugucaggagagaacacuuucugagguaacuuugcaaacugagaucaucagucacacaaaacaggcucuguugcccacuaagccauaugccacucacagcucccuaauuuggcauugcacucugguuguauaugaagauuucuuuuauuuguuuuaagacuuaaguuucuggugaaauuuuucuagguuuuuuuaggaauuaguuauuucaaccucugguaguacaaauuuacaauuguaauuguaaacacuauacauaacagacaugguauucauuuuucuugugaaguaaaaggacuuuguucaggguauggaagcugugauggcuaccccuacucucugugugaucuauauuacaaagucucccacuuaagcuaaaauucugacucugggcaagugcuuacuuccaaugguuucuuuccucaucuguauuguaggccaacucacugcaguguucucggcauucaguuauguggcauguguacaagguccuggcaugugcuugcugcccaauccaugccugcuuuguuuuaguugaauuccauugugucaaugcuuuccuugcuuguugcuagcaagaagacaaugauacuauaguagugauuugccuggaggguuuuugagaaacuaugaaggacacccugaaaaccuauuuugucucuaugccaaggucaugagcuuccagaauuuccuguuuagauucuccuauuuugucuuccuuccauaguguauacaauugugugaugagaauuuccccugaauguuugugucugccuuuauuucuguuugugcauaggauaugccugauaggguaauucuagcugguguucacacuuuaaaggcuuggaggacauuccuuuguauuccucuguccaggcauuuaccacagugguauuauuuucuguuuuauuuagcagauacuuaauguagcuauuaucaugagcaagcaauaaaaagcacaaagucuaauaggaaaagcauauaauggacagaugccacaugucuuggauuucaaauucugugaaagaagacaggguaggcaggagcagggagggugcugccuuaggcaggguguugagagcaggucgacauucaaggaaaugcaugaaugaacacagcaaagaagcccugggcuguguaugagggaagccuucuugguggaggaggugagaaguucuaaagaucugggaccagaucagugagaaggaagugugugugauaggugacaucaaagagaugucaggagcuggcuaugcaacauccuguagcuacugggagucuuuguauuuuauccagaauuggaaagcuuuugaugggauuugaacauugcaaaggaaugucucauuccuaguucuuucuucuccuuuucaaagauugcuuuggcucuuuaugaaaaauauaccauagggaaguaaaaguauuguuaaagaggagaaagacacugugguaaugcuaugugacuguggccucagucgguuccuauauucuggguaaauuaugaagauuugccaguagaccugacaagacaaugagaaaaccagaggucaguguaagcucuucuuugaucaacaggaagagccuagacgcaaucuaaggggguaaugaagauuaaggaagaccuggaguccugaggucagucugaggcuucuguagucauugaacuuguugaguaguuagacaagcuuugcccuaacucacuucugagcaugacaaauuuagcuguugcaacuuagggaaacacuuuuauuuaaauauagugaauguaaauuaauuuuuugaaauuaaauauggcuaguggucuguauggcuggcugcauauguuaauuucaaggucaucaacaugucagugguuuauaaagccuccaaacuagauaaauuuauuuggaaaggagacuagguaaagaagaaaagacauuugaggauggauucggccaguguaguagaaguuaggaagaugaggggcuacaagguggggaaggcuggucaauagagcuaagugguagucagaacaguaggcacugugugugcaaugcacauuccuccuuaagugcguuacauaaguauuuaucuccuaauaaccccuacuuaucccagauccuagcaaguguuuuuguuuguuugguuuugcuuuggguuuaaauuguuucaaaagugaaggacagucaucaaaugagauugucuucaggaaaugagucccuggcauaaggugugguguucucucuguguguaguacuuccugcuggucagucuucaacagcauggccaccaccgucccaccucuccaguccaagcagagcuuggugaaaugaagccaacaugagcuaucuuugucuguuaggugacuugguaaaagaaucaaacagcugccuagcccagaccucccuuuuuacuguauuuuuguucuggaaaguaugugacugagguagauuuuuacccuaaauuucugaugccuaggguugaucucuucccauuucaacuucucuuuuaguugaauuuucauauucaauuuucuguuuuuucuuuuuuaaaacuguauauauauauaaaucuauaauauaucuuauauaaaguauaucuguucauuucuccuuuuguuucucuauuuugaaaacuccaugguuccuuaauguaccuagacucgcuccuuacuuggcgguaugcaggcguccuugcuuuguuccuccaccccugcaaguguccauugccuauuucucucuaguccccaucucaggcuucauuccuugcaccagguacuguaccaccuucauuucuacauucgauggguuguuucucaugauaccagaguuauuacauuuacaaggagagaaaucucaaagccagggggacaaguaugcuuuuaccuugccgacuucaaugcacugguuauaguucuuaugguaguuuaugcugguaucauucugaguuaacauugugacacacugaauaucauuuuccuuuuucuucuuccuuguacucuuuuauaauaguguguaguauaggugacauaguguauucucauugcuauguuugaaagucaagugugcaguguguugguacagagagauguacagaggagcagauggugggcuaggauggagccugaccccaaagaccuauagcgacuuucuguagugaaguacaagaaaggcaaagaauuggugucacucuugggcucucaagaguuuaaaucugccaagggaaaacccccucauagcuguaccuugccuugaaugauuaaaagucacaugaagcauggggaaagaaauucccagugggcugcuggcuaggaaaccucugacaguagaaagcuuuaacaaaagcaauugcuuauaacuccagaaacuauaaauggaaaugaggaaggauuauauauaauacaaaagauaaaugcacagacauucccugcccaauggguuuuuaauauaagacaagccaauuaaggcaauauguacaguaauuaaggcgagucuuagaaagggucagggcugcucgcacuucauacauuuaguuuauuuugaguuuuucuauaaggauaauuauauuacuuuaagaugaauuuuuaugacugagcuacauggaaaugacugaauauuaaaugaauuuuguguauuuaaccuuguaauucacuuacaugccauuuaugugccucacagagaaugugugucuucuaauguuucucucuguuaacccagaugccuuccuuuauugcugccauauuacaauggguguuuucugcauuuuuaugaagagccuauuagcagccuaggcuugauuuaaagaacuuacccagugaaugaauacagcucuucccuaugaaugaauuuagcacuuuaauguuauuuauuuacuccacaccauaaaauguaauauaauaauuaaugggucccuugggcuuauaguaaaacuuagugaucauccucucagcaggaagcugaacacaaucugaguggagaaauaaugaucaaaauucaccacacacacugggaugccauuuauauaccugaaucuaauaaagacagaauuacagugguuaauaucacacuuagcacuggcaucugaauguaaugagacuuugagauggggaagacucagucacagaagcaggaucuuagguuacaucaccuucaaauuggcaagacaaauaagauaauguucucaauaguguguaauccuuaauuuucugugaugacuguuagguuagugcauuuuacauacaggaaagccauagcccuauguauuuuguuucaggaacaaaauugcuucaaaauccccucauuauccauuuaauuuaggguuuucauaacgacugucacccauccacccauacaguaccuacaaacuagauucucagaguggcaccaagaauggcucuacucucuuaguggaaacacagucaacacugagcacucauuuauguuacaucaaccuagaaacucuucaaagcaguguuauaggaauaagcacgagaugagauguacguaugaugagaguagagccgacuuuauucuggaugauucugaggucucaucuacuugcuaguaguugucugccucuuguguggauaagcaaucuacuuagucaacuuucuaacuuagagcaagcacacuggacgcuugaugaccuuggcaagcauaauuaggcuguucugucaugagugugagggugaaggcauggaagaaaggccucugaggcaaagcuucagaaagcagacuuuaacuuggggagcuaggaccucaaaguguagccuuauuuuggacaaaauaaaaucugccuuguaaaauaaucuuuacuuguuaugucuucaguuucugaauuucccauaacacucucaggcuuucuuaccugguaguucaucauugucagcacauguauuauuaauuauuuugaccuggaacauuagggaaaaaaaucacacugucaacuugguagugugacuacuccaggaaccuuaaaauuggaagcuaaacaugacaaaaagagccccaauguaauucaguuaguagggugaguggugaugguagcggcuguggggguaagugauggaggagguggugguaacggcugugggaggaagugauggagguggugaugguagcugcugugggaggaagugauggaggugguggugguagcugcugugggaguaagugauggaggagguggugguagcggcugugggaggaagugauggaggaggugaugguagcggcugugggaggaagugauggaggagguggugcuucuuugucgaggccaaacugaucucuccacaaagaggcugugauagaauuucucauggcuuuuuaugcauacaacagaaagagaaaaagauugucaucccaguuauccaugcccagauaaaagcccauagccucacuuuguguguguuugcacugcaugguaagcauggcuuuagguuuuuaguuuggcuuuuuccucaucuguaagucagcuuccaaugcauccuuuaauuuuacagauaaauucuuuaaguuccuacagauggcauaaaucucacuaagcauuuucaaaguuaaauauaaaaaaaugugauucuacuuucuuucaacucuguggcuacucaagccagcaagugcucucggauccuugguuuccuaguauaccuaaucuaauggacucuugcaguuuaugcggaaggauuugguguauuuuaaauuucugucuuagggagauaguucuguuugagagcacauacuagcuuaguaucaccuaaugaauugggauuuauaugacauguguauaauuauuuuacagucacuguuuuauuuauaauguguucagcggcauacccacuaguucucagaaaucauuucacucuuuguuuuuuaaagugucucaauuuuucccuguauuuguugaaguuaauagcaaaguguaaaaacacuuauaauuuuaugauauauaaacuaugucuuaguaaggcuauauauaauauauaauuauauaaaaugaaagauucuaccuaccuaacaaagccauauauugaaaacacaguagccuucuuucauuagccuuauccugauuugguggacugugcugcuccaugcauugacugccauauuccacaacuaauuccaguccuaaaacauggagguaucucagucacuaauugaaacucucauuuugauaagaacuugagaaggguucaguaauucuaauuuccuacuuugcuggccaacacaauguaaggauggaauuacccaccccauucacagcuuauuacccuguguguucacucacgaggaaauaauuuaaggcaauuuacucccaacuguuuuccucaugcugaccccauuauuaaaguaaucucaagguuauuauuuauuuugaaauuauuuaauuuccguagcgauuguaaauuuauucacaccugaucuuauucucucucucucucucucucucucucucucucucucucucaucccccccuugcucucugucugucugucacucugucucucucugucugucucuguguguaugucaucaugaaauguccacauuguguguguuuaugauguuuccucauuaugucaccaauccagguccuaaucgcuccuaccucuguucuucccugaugauuuccugcuuguuuugaaaccucccuaacaguggagggaggguuagggggagaaggggaccugacaugcugugucucuagugaaaauguucuugggaaaaaguuguuuguuuucacacuaauaaaacuucaguuuuauaauaauacucgggcaauuggagcucuugccucuguagacacucauugucuuagacaagcaagcaacgucuauguacucuaccuauacuccuaauguucuaagaaaaugaacugucguguuguaaaugaaccauuuugaaaguuuuaaaacacuuugauuuucauaauuuuauaaagcuuuuugauucauuuucauuuuuauugccuugugcauuguaagucucccccccaaauuuuuuguuuuuguuuuguugcuguuguuuuuuguuugguugguugauuguuuggugguuuuguuguuguuguuguuuuuggguuuuuuguuuguuuguuuguuuuggguuuuuuuguuuguuuguuuguuuuuuuuuuuuagauaauacaguaccuaaguuuuccuuuucaaaccaguugugggcagugucucucugccccugcuuuuagugcucuggugaccuugguuuggugaccuugggucauugcacucaguguggcuuugacugcagaccugcaggaguggagccugggugugacauccgguucuuacccuggccugggguggccuaaagaguauuuucagcuucacugaaaucucacauuuuccacauaggaugguacaaguguuaggcuaacuauaacccuuuaucaucaauugauccuggcaggcauugugugaacagggcuuuuucuaccuagauuuuucuuuuguucauuguagagcauuaggaagcugaaggauuuuuuuuacuaaaacugggcauggaugucuauacuugcaauccacacacacaagaagcugagucaagggaucugccauacaucugaggccaguauagguuacacagcccuguggcaagcagcaagacaaaucaacccuccaaguuagaaauugaggauugcauagaugaacaaaauuagcuuuuuaauuugauuaugaucaaagcaucaagaguaaguagaaauaaaauucauauuggguuuaaacuuugcaaauguuacauuaaauauauauuuuuguuauucuuuagauugauugaaagcuuuuuauuaauuuuauuugauaaguuuguaaacuuucucucucgcaagguauuaaacuuuguuuuacaacauaauccccauucaugugagucaaagucuaaaaauuuuuguuuuacaucugaagaccaaauagaugcuccugcaucaugcuagacaagagagugauuaaugacucugaucaagaucugaacugaaauaaauuuugccucaaauggagagaaaauagucuuaacacauauccuacuugcuagcuagcucacauauaugugccccccuuuuggggguucuuucuucucuucuauguaagauuagaaaaaucuuaugaucuuguccuaauuuaaaauagcaauacaguuaauuuuuaaaugccuaaaauaaagaguguugacagccagcacuucauaugugcguggucuaaugccuuucucaccuuacauaaaucucugggaaagcucuaggcaggaaaagguuuccccaacaccauaggcuguaaaguggacauagccaacugcucauucagcucuuagagcagucucugagacacugacgcuucugacuucauucuccuacaggagcucacugcucaccuuguaagaaaaaaaggauuccugcugaauuccuaggaaaaagcaagucagagcuuuucaaagaaugauuuugcuauugccuaaagagcaaauagccuuucagacacuccacagguaguuauuuaaauacaguuaagccccugaucacacaugccuuugaugaaccuucccacuuuaaauacaucaaaggaaguaaagagaguugagagagccauuagaaaauggcucuaauaaacacuaacauugauccccuuccuuccccaacugagccacuucuuuccuuguaguagcuaucugggcgggcuucuuauggaaaucaaaugcuugcuuacuacuuaaaaaaaaaacaaaaaacaaaaaaaaaaaccaaguaauuaaaacaaauaagcaaccacauacucuuuuuuaagauuucagggaacccaggcaguacuguucuugugcacuuuuggcugugacuuuuaaguugaaccuuuuugaugguaaauagccucuugcuuaugccuguguguuuuggcuuuaaaaaaaaaaucaaucucuaagaaaaugggcuuccaucucccuuucagcccugucuccuuugaugauugauguuaauucaguaaguugcugacccaagaaaaaagaauuguuugugcuguuguuuugaauaaauaaacuuacaaagaaucaauggcuguagcuuagagaaauuaggugguggagagccuucagucucuucugucguguuucucauguaaauaaagcaggucagauucuuuuucagggaugcaaacuugcuucaaggggaaugaauuuguuuuaauuuaaaaauaaauguucucucuguagcuguggugagaaaaauuuauguuuaugaaaacaacagauauuuacuugucuaauaauucaaaauuggcagaaaaaaucaugcuuauguguuuagugggccucaccuuucauuccuguuguuugaugggaacucggucuucuauguguguagaggauuuugaaggucuuuauauaguuacaaaauuaaaaggcaauauaaacugcuagaugcaacaguugauucuuuauuguaaaauauuuauugacugauugauuuaaugaguaauauugauuuucugagucaccauuuuccuuauauaaaucauauuaucaaauauuacaaucauggaauacaagauaauucuuagagcaaaaaaaaaaaaaaaaguuaauaacugaguuccuggccaugaacauaagacuuauauuucauauaggaauccaaguuaauugguugaaggaaggcagucuuuuuuuuuaaucaccuuuuauuuacugccacuugauuagcagugucuaauaaagucuguuucucucuuuuguacuugaucaacaguucagucaaaucagugugcauuuguguuacuaauuuaugcacaauaagaauuuaucauuggcccuauauauuaccacucuauaauuuacaaacagccuuacaaggcaagaaauauuagagccagguucaguguuggauaccuguagucgcugcuacuugauagcugauguaauaggaaguucucuagucuccaggaaucccagaccaaccuuuuuggggaaaaagggggguggugggggaagggcuaaauaaauuguggucuucucacucauugggucagcuuuucauuuacauggccauaauaaaaccuaauccccuaauccccuguucuagaguugggcuagacaccuaggacauuccagaucccuacaccguuaugguaucuuaggcuuacugaaugcagcagaaucaagaagguuuuucuauaaauuuuccuaacucucuuccacugaaacaguucauaauuucuugguuauucuuuuuuuuuaauuggauauuuucuuuauuuacauuucaaauguuauccccuuuccugguuuccccucugaaaaacacccuuccccugucuccuucccccucccccugcucaccaaaccacccacucacccacuccugcuuccuggcccuggcauucccccauacuagggcauagaacaggaccaagguccucuccucccauugauguccuucuaggccauccucugauacauauguagcuggaggcaugagucccaccaugugugauauuugauuggugguuuagucccugggagcucuggggguacuggcuaguucauauuguuguuaccccuauggggcugcaagccccuucagcuccuuagguccuuucucucucucuccuucauugggaaccguaugcucaguccaaugaauggcugugagcauccacuuuuauauuugucauguacuggcagagccucucaggagacagcuauaucaggcuccugucauuaagcacuuuuuggcauccacaacagugucuggguuuggugauugucuauggaauggauccccagguggggcagucucuggauggucauugcuucagucucuauuccacacuuugucucuguaacuccuuccauggguguuuuguucccccaccucuaagaugaauugaaguaucuaagaaagagacaggacaucugaauucaguguggccucaaggauuguguccugcaacagaaagaaaacaguagugaaacugagcaguagacgugauaguaaagucuguaguuuaguuaaccaggauauacuuguguugauaugagucuugggaauuguauuaggauuaaauaauggggaagcauuuauaaggauuucugcacaauauuaguaauggugcaguuauuucaaaaucacuuuuuuaaaaaauaaagcucuauaucguacacauaaauaauuucuuucaaaaagaaauaguauauuguguauuauauucauuuguguguaauuauggacauuaugaaaccuguauccucacagcucuaaaagggccugcagcucaguggucggggaugugcacuaguaugacagaggcuguagguuugagucucaauaugauguauaagcauagcaaugcacauacgcaacauacaugcacagagucggaaaaaucugaauaauauuggauuacuuuguuacuauuuuagagacuuuuuuuucugacagauguauuauacauugccuuuaauuugauauucuuuuaaaaacaugauuccauuuaccaugaagaaaccaucaaaaugauuguuaaaauauguaaaugugcaaguuucauaaaugguaauauugagguaagaaaaucaaauguguguuuagugauaaacauaaaugcuauuagcacacaugaaaauguacauauccuggaaccauguaaauguuguagacugauauuuuuagcacuucuuaugaauauuacauauauuaauuuauuagaucuuugcaacuguuuauagccucucuguugaaaaagaaaucugggcuggugagauggcucaguggguaagagcacccgacugcucuuccgaagguccagaguucaaaucccagcaaccacaugguggcucacaaccacccauaacaagaucugacucccucuucuggugugucugaagauagcuacaguguacuuacuauaauaauaaauaaaaaaucuuuaaaaaaaaaaaagaaaaagaaauccuuaauucuuacauuauagacaccaaccauuuugacuuaauuucuaauacucccuuaccaagugccuugccauaguagcacucaugggguuugugguauauuauaugagagggacauaugaaauacuaucauugcuggagaguuauauaucagcaaguaguuguuaagaccuuuuuacaaccacauaagguuucagguucucagcugggucccagagcacauuguuauuuuuaagcucuggaaggaaaggauuugguacauaccuggcaagaggguaacaugaauuucaucuccugugcaaaacacugugcaguguuuuucuauaaacaacuuggugugaauaauggggguucaucuaaaagaccucauuucccaucugaaugcugugaacacugacucuuuugaaugucaucucuccuugcuuauuauugcuccugcuguucuuuguugggccuggcuucuccaucuuucccuauguguuuacauuacaugccucauuccagcugacacauucuguuaguguuaucagacagauuagaaggaguaaaaucacuaugacuguuguuucucauucuuccaggucaacaagcuuacuuucaaagauagaaauccuugauugcugugcuugaggcagaauugaucaauaucaaguuugugguuuauucuacauuggacuuguuaauuuaacucacuguguacugauuucauaugcaguuguaggucauagcuuaaagcucccauuuugugugugugugugucuguaaaacuaaauaacuuuuaagagucugguaauagaaugagugguuuauaauuaaauuaucuuagcuauuauaacuaauaucuguggcuuucgagucuuaugaaaauauguugugauguuauucuuucucuaaucauuaauauugcuuaaguuuaaaguuuuaugaaaauaauuucagcaaaauuuacauuugcaagccccaccucaguguaccuuuuggucucuagguagcauauuauuucuucuauguaauauuagaacacucagaaaaugcagggaaaggagguucauucuuuuuuuuucauguuuuuuuuuuacuauauauuuucuuuauuuacauuucaaauguuguccccuuucgugguuuccccuguaaaaaccccccaucaccuccccucuccuccggcucaucaacccacccacacccacuugcuagcccuggcauuccccuacccugggacauagagccuucacaggaccaaggaccacucuucccauugaugaccaacuaggccauccucugcuacauaugcagcuggacccauaaguuccaccaugugaacucuuugguuggugauuuagucccugggaccucuggagguauugguuaguucauauuguuguuccuccuauggggcugcaaaccccuucagcuccuuagauccuuucucuuucucugucacuggagaccuugugcuuaguccacuaguaggcugcaaggauccaccucuguauuugucaugcacugguggagccucucuggagacagcuauaacaggcaagcacuaguuggcauccacaaaagugucuggguuuggugauaguaucugugauggauucccaaguggggcaaucucuggauggucauucuuucagucucugcuccauacucugucucuguaacuccuuccauggcuauuuuguucccccuucuaagaaauauggaaguguccacacuuuggucuuccuucgucuugaguuucaugugauuugugaauuguaucuuggguguuccaagcuucugggcuaauagccacuuaucggugaguguauaccauguguguucuuuuuugauuguguugccucccuccggauaauauuuucuaguucuauccauuugccuaugaauuucauaaauucauuguuuuuaauaacucaguaguacuucacuguguaaauguaccacauuuucuguauccauuccucuguugagggacaucuggguucuauccagcuucuggcuauuauaaauaagacugcuaucaacauaguggagcauguguccuaauuacauguuggagcaucuucuguguauaugcccaggaauauuauagcugggucuucagguaguacuauguccaauuuucugaggaaccgccaaacugauuuccagagugguuguaccagcuugcaaugccaccagcaauuguggaguguuccucuuucuccacaaccucccuaguaucugcugucaccucaguuugugaucuuagccauucugacuggugugauguggaaucucaggguuguuuugauuugcauuucccugaugacuaaggauguugaacauuuuuuuuaggugcuucucagcccuucaguauuccuuagaugagaauucuuuguuuagcucuguaccccauuuuuaacagaauuauuugauucucuggaaucuaacuucuugaguucuuuguauauauuggauauuagcccucuauugcauauaggauugguaaagaucuuuucccaaucugcuuguugccauauugaaaaaguugucauuucuguaaauuauguuauauauuugauaauguaugaaauaggaaaaguuuguacauguuuucucauuacaucuaaagauacaagauuagauaaaaacaaaauuccuagaauaaaaucuacugcuggaagaagcaucucgaucaugaccguauaaagcacugaucuauaacuauaucagaauauuauugggaauuauuuuuuuccuucuuuuguuuguuuguuuguuuuauuauuuuugccacucuuguuuauuucuacccaaugugcuauccaguuccuggccaacaaggcaguguaaggugugagcuccuccuguggugggccucaaauuaacucaaggauugguuguccaaucccacagaugucaccacugcccuagcacaucuugcaagcagggcagauuguaaguagaggguuuuguggcuguguugguuuccaguuucucuuucuacaaccugaagaguaccuucuugugccaaagagacuagacugugauaggaaugcaagcuccaaaccuguaucagcuugaccuaucuucauucaaugaguuguguggaaguuauuccugccaaugggaacagcugucaguuuucagggaccaaucuucuauccuaauaucagccuagguuguuuaagauucucuacugaacgacuuugaccaacaauucaaccaaauggagcccuagucccaccauugaaagccuugccuggguacaaaagauggccaguucagacuccauauccauuacuaggauauaucacuagggucacucucauagauuccaggaaguuuccauugcacuagguuuccacacugcacccaaauagcuccuaauuccagcucucuccauguacugguucccuucauuccucuccucccuccugcuccuauccccucugccccuagacuacuggcagaaucuacuccagugagauccaugcauuccucuucuaaccuccucuuaauauaaccucucugagucuuuggacuguuguuugauugucauuuauuuaguagcuaauauccucuuguaagugagcgcauacaguauuuguccuuuuaggucugaguugaaucacugaggaugauucuuuccuaguugcauccauuucccugcaaauuucaugauguaguuuuucuaacuccugacuaacacacuuucauuacccacucuugaguugaggcacaucuaaguuguuuccaguuucugguuucuaugaauauagccucaaugaacuuagcugaccaaguguucuuggguaaaauggaguuuucuuuaaguauaugccuaagaguguguguguauaguugggucuugaggaagauauuagaaugauugcaccagcuugcuucuuagcuccauuugcuugaagaaucuuuuuccagaccuuaacucugagauaauguuuugaugcugagguauguuuuuuuuuuuuuuuuuuuucagcagaagguuggauccucuuuucccauguauuugucuugccuuuuuaugggaauauugagaccauugauauugaaagauauuaaugaacagugauuuuuaauuccuguuauuuuggugguaguggugugugugugucugccugucugucuguguaugugucuguguguguguuuccuucuuuugguuuugcuaaugugagauuauuuauuuccuguguuuuuaaccuccuugguuuggaucuuuuuuuuuucuagugccuucuguagggcuggauuuagagauaaauauuguuuaaauuugacuacaucauagaauaucuuuuuuucuccaugucuagugauugaaaguuuugcuggguauaauaaucugagcuggcuuuuguggucucuuagugucuguaagacaucuguccaagcccuucuggcuuuauagucuccauugggaagucaaggguaauucuaauaggucugccuuuauauguuauguggucuuuuucucuuacagcuuuuaguauucuuucuuuguuguaaauauguucaguguuuugauuauuaugugacaagggcacuuucuuuucugguccaaucuauucgguguucuauaugguuuuguuaccuuuauagguaccuccuucuuuagguuaugaaauuuuccuucagugauuuuguugaaaauauuuucugggccuuuaagcugguauucuuuuuccucuauuccuaauauucuuagcuuugauuauaucauagucccagacuuccuggauguuuugugucaggaauauuuuuaaauuuaacauuuucuuugacugauguaucuauuucuucuauuguaucuucaaugcccaagaugcucuuuuccaucucuuguauucuguugaugaaaauugccucuguuggucuuguuugcauuccuauauuuuuucuuuuucaggauucccuuauuuuaugaauuccuaauccuucuauuaccauuuucaggccuuggauaguuuuauguguuuucuuuaacuauuugauuguuuacuuuuucuuggcuuucuuuaagggauuauuuuauuuccucuuuaugaaccucugucauauucauaugguuggucuuacggccuuuuucuuaugcuucagugauuuuggaauauugggaccuaccuugguaggauaauugggcucugguagagacauauugcuuuggcuauuauuaauuguauucuuaugcugguauauaggcaucuggauuuggaggugauuauaggucaaggugcugauuugguuuaccuugguuuaguaggaguuuuauuccuugguuucuauuuccucuuggugucuucagagaauguguuagcugaguguggccuauuuuacuuaaagaaagauggcuuucccaugcagucuguuaugguucagacaccucuguuaucuauggccuacguccuguuuucuuugagggagagguauuugcuuuuucaccucuuugugaaaguguucauauuuguauucacucuaaauacuugagaccagaguaauauguguacuauguugacauuuauacaaaguuugaaaguuugagagacugcauauguguuucuguauuauguuuuaaauaugcacacaucuaacaucauaagcauaguaggaaaguaagaggaauauaauaaagcaguuccuggucacccccaccuacaacuccuucccucccccuuccucccucccuuucuccucugagagaguggaggccuuucacucuggcauaucaacugucugcaggguuagccacauccucuuccacugaggccagacaaagcagcccgucuagaagaacauaucccauagacaggcagcagcuuuugggauagccccuauuccaguucuucaguauuugcagugugugcggggaaccuagguccagccuguguauuucauuugguuggugguucaguaugagggccccaaggguccagguuaguugacucuguuggucauccuguagaguuccuaucaucuuuggaguguucagaccuucccccaacucuuccauaguaauucccaagcuccauccacuguuuggcugugggccucuacauuccucuaagucagcugcuggguggagauuucauaggacagacuugguagacaccugccugcaagcauaacacaggauuaugaauagugucagggauugguacuuaccuauaggacaaaucucuaguugggucaguuauugcuuggccauccccucagucuuggcuccauccccuaccccugccuuucuuguaaaaaaaaaaaaagauuugauuugaaaaguuuuauggauuuguaugccugucucuucucugugguucuugccuggcuacaggagguggccucuucagguuccauaucucuagugauauguguuacagcuaaggacauucccauugauucuugggcaccccccuacuuaucccaggucucugucucauccugaagauucccccuccccucuuccccacucacucuauuuguagauuuccauucauucucauucuuuaguugagggacaucuguguucuuccaguuucuggcuauuacaaauaaagcugcuaugaacacaguugagcaagcgucccugugguauaguggggcauauuuugaguauaggcccugggucuugagguagaacuauucacaguuucuaagaaacugccaaauugcaaaggugccaguaggaauacaguacuucaaagacuuuuacuucaagucccagugggcuuguaauuugacuuaauacuagaaauggcaauauuauaugaugaucauuguuccuuugggauugaucagaaaagauuuagcacccuguuauguugugggaacuaccuagagcuagccccugcaccaagugaucucaaucgauuggucucuuggcccaccaacucaccagcccugcuaggccgcauggcucccaccaggccaacucucagacagagccccaaguuccucaagcuuucaagcaaugccuaugcaccccugguuagccaucucaacaucuaauuaccuggcagaaugaagauucuuaacacuuaauuagccaaucagguuuauguaucaauauuaacacaauuacaagaugccaauacaauaauuucagagccaaaugauaaugauaaagcuuuaacacaauuauuuuaaccuuuugauaacacuacaucagccuccacucugguucucccucuccuucuuagaccucucucucucucccugucuccucagcuccucacucugccucccuucuccuguccaaucagaggccucccacugcccuaauguguuuggacaggaaaaauccugcaacucuguuaucuuaguuauuaguauuuucuggugucagaaguaugaacgcucaggaauuagaacauagucuaaauauguuuacaaagauguaaauaucuuacaauguugaaaaaauauaauuugucugucuuagaagaguaaaacuacaacuguauauguugauacaaauacaccaauauugccccaaauacccaccuguauuuccaaugcuccagagucaaugguagacacauugaaaguugaaggguaaccugagcuacaaagcaagauacagucuuaaagaaagauggcuuucacaugcaaucaguuaugguucagaaaccuagcucuguuaucuauggccuaagucuuguuuucuuugacaagagauauuuacuuuuuugccucuuugugaaaguguucauauuugaauucacucuaaauaccugagacuagaggauucuguuuaaaauuaguaagcagugguuguuuacaagagaagcaguuacaugcuucuguggaugcccugaaauugugcuagucucauuuccuuagagguauuuuguuguuucuauuuuaugucauccucuuccaucugcaacccagucuuucuuguuugcuguuuucccuccaaaaacuucuuacuacaagucaaguagcuuggagggaaacagucuuaaaguuuaucaucagucucuaagccaacaucuaacacacucagcauuucuuggaacacaguugucucuguagaggugauugauuguucaugaccacggugaggccucugcuggaccacuucagccuccugcuuuaauagucauugaguuucuccuccagcuccccucucuacacguacagagugaaaaacucuagauaucuugugcccuagccucauuuacuaguacaagaaugagaaaguugaaggaauuauuaaagcugggacucucguugacacuuauuaaagcauaggagaacuuuauuuggcuggagcugcaguaaggcuuugugagagaguaagcuuagcucaugcgucagcauccuagaggucuguauccacccucuggauaguagauggaaaauacuucaagggaaaauucuucaaaggaaaugccagugguaagagagauccagaaaaaucauccugucaggauuaucacuaacugcaggcucaaguguuacguuauugaggcugguggauaaauaauguaaucacacagcaagguaggagcugugacauugaguuaugucccaguggugaugaguuguuugauucucuauccagauucauauguauaccuauucaucugcauaugggaggcugcaguuaaaagauggugaguucaaggccauuauaagaagacccuuuauaagaagaaauguaguacaagaguaaucaucccccucccacaaagacaaguuuaugcuuccagguuuauaagaagaggguggaggacuauuuguauggagggcucuuuuuguaucugcuaauuuucauuugccuucagcacagauucuuaugccauggugacacauuuuguagaaacacauugauaguugcuucauccacaaaaaaauuaugguucauagcgauguaacuaaauuaucuuaauauuugagaaauauauaauuaaaggaaaagauaaaugaggacaugggcuaagcgcgauugguagagcauauacuuagcacacauagaggacaucaguucaauuuucagcaccauuuuuuuuaacucauagaacauccaacuguaaaguuagugugaccauuauaaaugagucagaaaaguauccuugagcuuccugauaaaggcacagauggauauagauauugcuguuauaauaccuuacagcuauaauauaaaauaagcuauuuucucaaucauuccugaaaguaaauaacuucuagagaugucauggaaaugaugcuuuguaauguggugagaagugaagugggaacuuaagggcucuuuggaagucaguuggguaguguuuuacucgggcaaacacaugaaggaacaucccuuuaaaggagacaaaacaggagaaaaaauguucugcuaaagcuagcacaugaaaaggcaugaaaauacucugcuaccaacauacauguauugguuuuccuuacauugcauaguugugcugcauuugucaggaugccauaaagagaagcacaccaaaaaacuucuggugcugugcugcaguuuguugucacuuccaaggacucaggccgauuggaugcucuugcuaaggcaagacccaugcugaggcaaggcauguggaggacacaugauauuuggaggguauaaauagaacuccaaugagugauggagacagagcuuggauugcugguacagcuaacugugcaaugcuugugggucucacaucuucacugaucuucacuuuccugaaagaagcacagccaagagcuucuaguuuuccugaugguccuggcugcugaccggagccaagguugagaccugacugucucugcuaggcccuaucaccaucaccgcuguuguuauccugacuaccaaacuggacugcucauucaugagguguuugccagugggucgagcugcugcugccugcuaaccugugaacugaacugauuuccagaaaacacagaugggaguugcuccaaagaaccuuccuaaacagguccacuuccaccuacuccccuaccccuucccucuacuuucuuuuccacuacuucuggagaguguuggauugcauggaagguuaaagcauuuaaaaacuaucauuaaaaauaggauuuagaaaaauuaaaguuacagacaagcaucuuaucagugcaccaacaaugcaacagaacagaaugaacaacauucuaauaaaaguguuuacugagugucuguguguguggaauaugcuacgugugugggacauggaauaguggaauucacagguuagcaggccgcagcagcuugauccacuggcaaacaccuaugcagacaugaccaaugauuaaagguccugauugaauaugauagggauucacagguagugaaagaaaaauuagaaaauacaauagagggcuaggaagucaagaggggaaggauaaagaauauggccacucaggaggauaguaggacagguucuccacaacguagaugaaguaggauucaauuugggaagugaugccguuaaaaugguuacgaauaaguacaccucauuuguccuaaauuuagcaguccuuguucagagcacugagacuaucccaaugugguaacuggugugugcucuuucauuguuuuuaucaacagugucuuucucucccucuccuuguuagagacacuagugucucuuaauacuacugugaauaaagaugcagacugugccacauaagugcugugccaagugcauuuaaugcauuguuguauucaguucacaccacaguccuguaaugccagccuugcugaugcucugggguuguaagcagaaaaaugaguauuuggagaauuuagguagcaauuccuaaugcacagaaacacacguggccggauuuaaauagggcaauccguggcuagaaucuguucauucuccugauuggcaugugaauuuuaaucaugaaaagugauagauaagauguuaucuguguucuaggcagugagggcagaaaagaagccacuuauuguaggucauuuacuguaggucaaguccauucuguuccuuuauagagaaagauaaaagagggguuuucuguaaaccgaaaugaguuagaaaggcuuaggagaagguugucuuugaucuaggcucagugaaaaugccaagugugugcagacuuuccaggcugcagagacacugcuugccagggaguguagagugugaccuuggaccagccuccugugaacuuguaggaauguaaguagccaccucaccuggaccuguggaagcacaaaauuaaagguggcacugugaauggccuuuccuucagucucaguucuauuuucagaggagcacccuccuagggaaaaaggagagggacugggggggacgacaugggggagguugcuggagggguaaccacagggagggggauaucauuugaaauguaaacaaaaugauuaauaaaauaauaucaauaacaauaauaauaaauaaagguggugcucccagagucauucucaggcuuugcauuugauucuagauguauucaaacauccauuauaaauguuccacaaguggaaaauaacugauuuuuuuaaauaaucagaauauuuugauauuguaucuuccccuuucucccaaaaaagcgugguuuccuuuuuaucacaacuagacuguccaccucugacccaaccauauuugcaaagggaacacuuacaggaccagugcuuuucauaucauuucccauagugcuacaacagauucaagggucguaugccugcuggccaagugcuuugcugcugugcauaguuccuagcccuuuauuuuuagggaaagaguagacucugagggugcugacucaucauuuucccaucucaagcucuuaggaguugaauuccuuccaauuagccucucaguguggagaagcuugguaucauucaacgauaaguugucauaauaaaaucaugaacuguuugccaacaaguuggugaaacuaagccauuaauaucuugaaucagucuguguugauaauuguggcagugguagcaacucugcuuuaagcauuauuaagugaugucuguugugcucucagcauuuuaaaaguugaaaauggaagucuuagagccgucuauauuaugcuucacuuaacaaugaaauugcauggaucaaaucaugcaauaauuuuuaaaaucuccauguauuuuaugugguguggcuauucugaggcauuguguaaaauaauucugucuguuacaugaaaauugacauguaaguuuauuccacauaucagagauuacuuuaccacuaacauacucccucccaauuuuaugucaucuauguguaugugugugugugugugugugugugugugcgcgcgcgugcgcgugcgcgugccugcgcacacaugcugagccauccacuggauuauaggaaacuuaggaguggucacauucuccacaaagaaugauucucccucacaaauuaacuacccauucucaauagcuccccaguaagggcuguggccuggagaucaucuaucuguuuguguaaggauuuugucuggcuugaacuuuuguagguuauguacugguaaccauagcuacuguaaauggauguaugcaaaaagcaugucauguccagaacacagcauuuuauagcuuugaugcucgcucaccucucaggcuucauuccuuccauuucuuuuucagcacuguucacugagucucuguggugaugggcuuaauguaggugccccauuuacagcuuagaggcuauuuucaaugauccuuaagccauuaaauauauauauuauagacacaguucucccucucuaucucuucuccucccccuucccuuucucucucucucucucccccccucucucucugcaugcauuuacugaccagcaacauuuaagguaugacauaaauuauaauaucugaacauugauauuuauauuuauauuuuaucuucuguagauuuuggacuuuguugcuguugccgucagaauauuacaaugcacugauccguuagcucuuucagaacagcacaguaaucccacacuacuggcugcuccauuguugugcuugucacgauuugcgauuguuuuguugguuauuaaacuggggagcaccagugccuuaguuguugccuauuugacaaaaccucugcgaagagcagaccuagaaugaagugugucagaauuucucaggggacaucgcaaaccuucuuagacuucgguucuucucuggugauuaugauacuagaggguacgguuuggacauauucacuaaauauuuauuuugauuuaaugaauaaaauguauuguuuuccccugugguagagagcaaauuauuucacuuuacacuguugagucauagauuuacugugacccuuggaaagcugaaguaugaggaaguaaauagcuuacugaagccauacagauugcuccuuccauuuugucugacaacauggucauuuguuucaauucuguauacuuuucaauaaacuaccauugccaaacugucuuccacaggagguuauuauucuuacaaaaauggaacgggacucauggccuagggagggaagauggauuuggggaaaacauuggcuaauaaaaguuacaugguuagguuuucucuguuuucuuuuuguuguuuaacgcuggauuuuucuuaaauaaaguauaguaacauacacauugacagggugguugcauaacuuacauuauuuuuccacaguuauauguaagcaaaacuguucuuuaaguuuacucuaauuuuucccugagugccaccuuuuaaucagcacaaaauuuggagaagacuuacugucuguuuuauaagauguugacacaaagucaucuuuacguuucuugaaaacaaaagaaagugaagugauacuguuugucaguucuuuuuccaaauuugucucacuugcuucacagguuuugacaaauucuaaaauuucacaaauuugugcccacucacccauuaguaaaagggcaucugggaagccccauagucaguuacuuagccuugggauguaauggcuuugcauuaaaaucugcuuuacuaacaggccuuguuccaaauguguaugucagaucauuuggguagcaacagacagucuauauucacuuguguugcugaaguuauguuuuuauugcaugaaauaaggugaugugaaaauuauuuuucauagcgagauaugaauaucaaaucuguuccaagaaagauuacagagcuuucuuuggcauauauguugugucagcuaaagaggagagaagcccuucuccgauauuaaauauuaacuuaauaguguucauauuuaagaaauugaauaugaucgagucuuaagcgucccugaauuaaaguuuaaugaugaaagcgcauuuugaauaaguuauguuuuauuugagguaggaacucaagaaauaguuaggaauacuugcugcucuugcaaagggcagagguucagaucuagacacccauauaugguauucaaaaccagcuauaaauccaguuccaguacugugucuaccagggagagaagcaggcauacacauauacauauacaugauaagaaaaauuuaaaagguaaucauaccuuucuugucugguaaaauaaaguaucagaauacagagauauauaucagggaaccauaaauauuaucuugaauuuguagguauuccaccaaaagguuaaaaauuccuagagguuuuacugcaaguuuucauuuccucuugaguaauuuaaaguaaauuguacuccuagauuuuagagacuucaaguagauguaguuaaaaucauaguucaacaucuuggacaggaugaucugaauuagaucuaagcugauuuaauuagccuuuugcuaguuuguacauggacuuuuccuccaauaguuugaauugauaucacuuuuagggcuguauuuucuuagcuuuaauacaaauacguuauuuaaguaaaaucaagcaguuaaguaguuacaucauaugucugccuugaccuuguagggauauauaaauuagauuugccagugacauugcauacugcuaaggagauauagacauguauauauaugccuaucuacuguuauuggauagggcaugguagauaauuguuaguccaauugggaacagucauaagauuugucagaauaauaucaugauuaaaucauaagucauuugacagccucucugaugauuauugcuucuuuauuauagaaaguaaaauugaaacacaaaauugaaaaauaagacagguagcuauauacauauaaguagcacaaagauauauacccaaagaacuucuuaauuuauuaacagaaacuauaguuuugacauucaaaauauguaaaagagcaagagaaagucuggaacuuacugauuccuucuuauauugggaaagaauggcccaccugucuagguuacagaagccugcugaaguuagaagccugccuuaaccccacaaguuuuucccaaaaugggcauagguugugguggauugcugugacuuaagucuucagaggaaugcuucccgauuaguuaauuugcccaauuaauaugaaggugacuaagauuaugaagaugucuuuguaacucagacugccauugcaaacacaucagacugggugacugcagaaacuguuucuuaaaucaccggaggcccaaaggcucagauccuggcaccagcauugucagguaauggucaaagcccaguuucuggcuugcacauguguuuccucguauuaguucauggugcaagaagaggaagaggagaagauagaaaagaugacaaagaugagaggaaagugcuuacccgguugucuccuauggaaaugccacuuuuaugacccccuauaggacugauaaaacuguaacacuugggaucagggcuucaaccgaugcauugaugagggagaaacaaacacucagacuaacauuucuaggcugauuccauacaucagguuccgugccauguuuauuuaauuauguuucuuucuguuuuccuuuaaaaagaaaaaagguacugcucgugguaaauuugaagccaagauacucauugagcacauagugaacugccagggacauuggagcauugaaggauuuguauggaugcuuuuuacucuuaaaaaaguauaaauaaauaguugugauauguugagaaaaugauguagaguuuuauuuuccuuguuuuaugauggggcauaggaagguaccacagcacagccugauggaagucagaggauggauugugggaaaggauucuccccuucuacuaggauuaugggaaucaaacucuggucaucacccuugacuauaaacacccuuacccacaagccaucucacaggcucuaaagccaugccuucuaggggccuuguagggucaauugcugccaucacuuacuuaguuuuccaggaugaagauagaaccaggaccccuuugcauucugggugagcacuguaugacugagccaugccccagacucuguguaaaggauuaacacugaccaguuuuuguauugucuuugugaaggaguuuaacuagucuuaucugauuuguuugaauuuuagugcaugugcuccugguacaaauacaaaagauauuaaauugaagcagagaaaucaauauuuccuauuuuaaaauugauuuuuggguauaauuuacuucuuaauuuuuaaaaaaauuuuggugcucugaaugcaacacaaggccucuauauacuggcagugcgcauccacagagccacacuuccauuccugcaaguggucauuucugaaauacauuggaugauaccguguuuguuucugaugaacuugaguuucugcgauauggaauccuauuuauagugacauuggcuauaucuuagauacugauaccuguaccucagguuuuuugaugcuuuguauuuuauauuauuuauaaagcacuguuuuuaaguccccauguguuaaaucaugagcuaucagguucagaauaguucuggaguugaaucaacacucugaacucaugcuucuuacuagacauagauguacuggcauuuuuacacaguggcauagcauauaagcacuuaggaaaagagaagacagugaaaaggaaggacaugugcccaagaggaaauaugggguguucuacauaacugacucuccuugcaaacuaaaauaaaugaagacuucaaggcuuuuaucccaaaaagcccuuguugcauuggugcaauuaugucuagaaaaaucaaacacucuagcuggcagauggagacuacuuuguuuugaaugccccauaugaaagucacauugaaguuagaguggauguucaaugcaaugacacagugugcauucuuagcauucacuaaguucaucuguagcaccacagcaaacauggaaaacuguaacaugcaugaagauucugggucuugauaaguugcuuaggcuacauagccaauuacaaagcaugaaaaggcaggucauacauauggacuaccaugugaucccauaggucuguggccaccucuuguggccacuauuuuauaaaauacuuuaccaugaguaguauucaaugugguuggaaaaugcuuagguuuguuuguuuguuuugguuuugguucuuuguuuuuuguuuggguuuuuuuuuguuuguuuucuagagcagucaauuuauagcauugggcuuggugguacuuucaaaaggaauuagaacugauaugcuuaguguguccucugagcuuaaaacuuccuucccucaguagcagcaggaagugucuucauggaugccucuucaggaaggugacucugauaagcaauugcuucuuuaauugcacuaucuguggaggagcaaaagauggcugauuguaaucaggcacugucuacaaaggcugacauuggcaaaaguacuguagaaauguauagauuuuucuggagaagugaaacaaaggagaugacaucaaaaaggaauaaaagauucuuuuacaagggaaucaggacagaaucaaaacaguuguacacauuauuuaucaacuguggugaaccauucuguaagccgacaaucggugauggucugucaacaggcucugccccaacagguuaagguuuuagcuaccuuauuucuuaucaaauuaauguuuguguucauguggucuacagacaguggaauacucagacauaauaauaugaugucuuugccuuuugugaguuuagcauuguuuucagauuuucuaugacaaaucuucacucucauaaucuauuuucuauugcugcuuuaacugcuauauaguuuacauauuuaaagccuauagucaguaggcaaauuuccuacuggcucugaagucuuaguaaaauaacuuacuucugauugucuugguuuacuccucugcaaaauaagaauagaaagagaauucaguugauaagauuguguguguguuugagugaaagagagagagagagagaaugugaguauguagaaaguguguguguguguguguguguguguguguguguguguguguaugugugugugggugugugugcauagagagagagagaguaugaggacagagaggaagggaggggggagcuggggggagagaaccuggggcucaaagucaaggucacaugugugccauaucaagaaagugucucugaggcccaaguguuggugugacuuuuaugaaugagaaagaugcuaguguugcacauauuaucuagacugugguugucacugucaguuuugcugccauuguguaugcccuuccucagcugugacuacuccauaauaaagggucaccgauauccucucagcaucugcuaucucauagaggagagcauuuacuuuuagguuuguccuauuacacauauguauguugugcaguuuuuaucaagcauauggagacauaugaauuucauaacauagccguggccauaauugggcuuuuagugcagagcaauugggaugagucuguguggucuggcuuccaucgcuggauggugcagcuuuuagagaugggucaucucuucaucugucucuacaucugaucuugcaggcuuuucucagggucuugccucugacucacagcccugaaucagggcaguguuuguggcucacguugcagaaggggauucacaccaugguaacauggguuugauugcagauaugcagugcucugggguauacccuugccaagagcccccagcuguuuacaugugcagagacaaggaaguucuucccagacaccuacugcaauuuuccuuuucccuuucuuuugcuuucacauggcaccauguccuucuuagcauuuuuauggaguuuucuugaaccgaaaaaccaugccauguuaugaggcuuucuuuaacagcuagugaaacaaaaagaagagaaagaaaaagcaaucaguaccgguuacaggcauuaucagacauucuacaaaaugaaccagaggaaggauaaauuaaacauacuacugauagaacugaauccaggggcuggggggaccacaugccacaucgucugcauggaggaagagcaauagaaacugugucauuuuuuacugacuuguucugucagugauugagguauuucagcauacaacugggaaaauaauagguuacuuucacaaugguagaaguuuaacaaaugcucaaucacucacccugcaucagcgcugucauuggugagagcuuugccguaugauauugaugcuuuucuucuuucuuauugccguauucuuugcagauucaaucugucugcaaugggccacuaaacauuucaauuugcuaccuguagagcugggcugcaaugcugaaacugaaaugagagagaaauggauuuagugaaacucaaaagagagagaguuucauggauuuuuauacaaggaugcacaaacugaaacccacugauaagauacacaugaucacuuuugagugugucauaaagguacaugguauuaagcaauucagggauauuuauagggaaaauagacucagcuggguacugauaagaccccuacauuugcaggaacugagacucugucagcuggguauaucuuccuauaguuagugccaugauaauagccucgcauacauguaaaacuaugcuuacucugguguucugcagugagcugaucuaggaaagaaugggagaaaguuaauuuuuuuuuuuuuuuuugaccauaccugagcauucagucuuuucauagcaacaauuguuugagagcucugcuagcuggagagaggagucaguuccuuaggggagccucuuauuguugucauuuucucuaacuacugccugugcuucuguuaacuaaccacagaucucacaucuuaacccucaucccuuuuugauacuguaugcucuuuuggacugugugucucucugcucaauaucuagguauuccaaaagccuaaaccugacguauaauggaaagcagauaugaucaauggcaagacuauuaacaaguccccggcaaaaaaacagaaucauugaaaaguaaacccugaaaacacaguaaagcaccucauugagaugcccacugcauccaguagagugaccaagaccaagcuuggaaaauggcugccauuuugcagucaucugauguaaaugcagaaugguuugguggugaaaauuuaaacauagacuugacauagaacuuuacauuucuauuccuauguauacuuaccaaaaagaaucagaaugggagauucaaacaaguguaucuccacacaauauccauagugacuaaaaauaaccaaaguuccaucaacagauauauggauaaauuaauaguacauacauacaauggaauaucccaccgugaaagagaaugaacugcucacauauacuacaaaacuucuaaaacauuauucuugacuaaguuagaaaggccagacuuaauacuuaguauguuauauaauucaguuuauauaaaauaauucuaguacauaaugcucagaauuagaauacagauugguguucacuacaggauagggaaggggagaauugagaguaauugccuauggauuaaagguuuuacuuuggagugaaggaaguguuuuggaauaaguauuauuaguaaagacaagcacuccuagguaguaguccuucauggcuggucucuuuuauggugcuaucauucuagaaguaggguugagagugcauaauacuaacugaucucuuggucuacagaguugacugacugaaagagaagcaaauggcggaggcaggaaaugccauguuccuuccaaagaacaggugugaccuucccaaugggauggauauauuaucacccccacccacccccauggcccuuuaucaucauuauuuucaucacucugaaguauuuauucaaugagagcuucugugcucgagacauuguguuaaucuuugguaauauaacuguagcgagguugacauaauauacccuucauugaauuuaguuucuagugaaggagaaagauuugaaucaaacacaacaugaaaacccccaaacaaaccacacauaaguaggcaacgcuaaaguaucaagcgccucaguaagagcugugcuagaaaugcauagagagaggaaaccugcaagcguagggaggcuugcuuugauuccacagagugcacagauccuuggacauggaaggcgggugagccccuucacaccucugauacaaggugucaaaaccagcuaaacuccuuugagaaguuacauguuuuauuuucuauuuacuuaaaaguacauauuucucuuuacauggugguucucaaccuuucuaaugccuauaaaauauuuuucaugacccaaguauaaaauuccuuuugcuauacuucaaagcuauaauuuugcuaguauuagaaauuauaacugaauauuuuuggagauagaggcuuaucaacgggguuaugauguacagguugagaaucacugucuuaauguuugaacuuuccuaguuaccuauccuuugugcuuauugcauauauuccugaggauuuacuuagaaaacguaaguauuuauccauuccuuuuuguuguuuguuuguucauuuguugguagcuaggauuucauacagcccagggugguuuugaacauauaauauagucaaagaugacauuaaucuccugauccucuugccuccacuuggggaaaugcuggguggaguuggcuuuauucagugcuagagaugaaaaccaggacuuucugcacaauagccaagcauucuauuaccugagcuauaccccccagaucccagaauuuaguuucuccaugccaaucuauugcucucuuaccaaccgcacuauauucuagucaggcacuuugauugucgguauggggccuuuguguucuuuuaaacaguaucuuuuuauaccacuuucugcuaggauguuaccagcauuucugguguacugucugauuccagcucuucccugcuuuuggcuccaaguuucuugagguugacuuguuggcugauuuauuuauuuauuuauuuauuuauuuauuuauuuauucauucauuccuucuucccucccucccucccucccuuccuuccuuccuuuuuuauuagauauuuucuuuauuuacauuucaaaugcuaucccaaaaguucccuguaaccccgcccccugcccugcuccccuacccacccacucccacuucuuggcccugguuuccccuguacuggggcauagaaaguuugcaagaccaaggggccucucuucccagugauggccgacuaggccaucuucuguuacauaugcagcuagagacaggagcucuggggguacugguuuguucauauuguuguuccaccuauaggguugcagaccccuucagcucuuuggguacuuucucuagcuccuccauuggaugauuucuauucccaucuuguuggaguugcugcucacugcccuuacucuuguuuacucuacuuuuccacaccucuuccagccauucucuucuccuguugucuuggucucucuugaccccgucuguccucaacuucuaucucuacccuacucuguuaguuuuuguguguuugcuugguuguuuuguuuuguuuuuguuuuuuagagacagaguguuguguagcccagacugacauagaauuuaccauguaguccaggcuggccuugaacucuuggcaguacuccugccucuuucccaguaugagaccacaaaggugacuucuccuacuuacuugcauucugacuucagaaagcauguuugucaggaaguuucugucagguagauguauuauucuuguucaaaugggaaaaucauuuauagguagugcugagucaucaaagcaauuagcuuugccucacgagugcaccuaagacauuucgccaaaagcaagauuuuuuuauuauuauuauuaccuguuucuguaaaagauuaaagccaguaauaucagcacucaggagacuggaagugcugcaggcuggaacccaccuggacugcauagacagaccuuguguacgaaugaaauuuaaugaauauuuucaguucucauuggcuguuucuuacauugcuaccacgagacauuuguugcagccugcuauauguugaauauuuuucuagaggauauauucaaugauguggugguuuaguugaaaaauguaugguaaguucuacuguaucaagugugcacuucuauuccuagauguauugaccaaaaagaaucagaaugcgggauucaaaaaaguauaucugcacacauauuuccaauagcacuauccauaguaacuaaaauuagcucaaagaucuguugacagauacauggauaaauuaaugguauacucauauaauguaauaucgucccaccguggaagguagugggaaacuugacaggagauucuuagucguggagcuuucaauacuguaacagaaacaaucugaaaguccuaaugcgggagcuuguuagagcguucaugcaagaggaucuucggcaaagggaaccuguuuacacauacagauuuacaaaacaacuugaaugcaaaggacacuacaacuaaucuagaaaagucccucguguucacagaauacagacuuuuuauauuuggcaucaccuaauagaaugaaagacuuaaaaugacuuuaguaccaaucucauguucugaaaggggacauaaaauugaaaauauccaaaauggaagagcuuuuuucuaaagauucuugucuguaagacucauuauuaguagacuuuuaaaaaaaaaaaaaaaaccagaagguuguuucuucaguugacuguaguucauacaagugccaaguuauuugaaacaugaacuuuauuacugguuucauugucaaacuaaaaacuacuucauucucuuugauguugcccaugaguuuagaauuggcacauaacaccagaaaaacaaagcaaugugaaauagaaagaauccagacaaagaugaauugcuagaacuuuuaaacuggcacucuuccuucuuaugcauuuagguggcuuccaaagagauaccgagaaugaaaucaggaaaauuucuggguauuucaagauugauaaguaguaggaaaucuuugaaucuuggugaaguuugcagguuuacaagugaccaggauuagcuccuacaaauuacuuaauaccuaaggggaugugggauuuucuucacuugauuguagagaggaccuguuuuuaauucacuuuaucauggccacauuagauguugauucauuuucucucugucucugucucucucuccucucuucucuccucuccccccaccuuuccuugcuccucucccuacccaccugugugccuaucucuaucugugucucccucugucugucucuguguguauauacaugugucucagugugucucacuuacuugugaagucuccuguuauuuuuacccaugucacuguguuucugcauaaucuauuagaacacaauguuuuuuuuccauuuuuuauuagguauuuagcucauuuacauuuccaaugcuauaccaaaagucccccauacccacccacccccacuccccugcccacccacucccccuuuuuggcccugguguuccccuguacuggggcauauaaaguuugcaaguccaaugggccucucuuuccaguaauggccgacuaggccaucuuuugauacauaugcagcuagagucaagagcuccgggguacugguuaguucauaauguuguuccaccuauaggguugcagaucccuuuaccuccuuggcuacuuucucuagcuccuccauugggagcccugugauccauccauuagcugacugugagcauccacuucuguguuugcuaggcccuggcauagucucacaagagacagcuacaucuggguccuuucaauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccaauucuaaggaggggcauaguguccacacuucagucuucauucuucuugaguuucauguguuuagcaaauuguaucuuauaucuuggguauccuagguuuggggcuaauauccacuuaucagugaguacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuacccguuggaacaucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccacgccagcaucugcugucaccugaauuuuuuaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugccgaaacuuuggaguuucauuaggucccauuugucaauucucgaucuuacaguacaagccauuacuguucuguucaggaauuuuuccccugugcccauaucuucaaggcuuuuccccacuuucuccucacacaauauuuuuauauucuuauuuuugagaguucgggaacaucuguaucaaugcuguauuuuaugaauuuuuuaacccaagaaagcucuugguauauuguuuauaaauuucuaaugaguagucacacagacacaggggugugggggauaucaagugccuguuuuguacaugguuacugcaugguuauguaauuucccuagaggaaaugacaauuucauugaaauuggaauauaugucugagaagacaauacauagaauauaucuuagugauuuacuucguugauaguucaggaaccgcuucacuaaagagaaucaggagcuucuuaacagagagaauggaacuuuagaaaaauuuauuugaggagguaagacucaugccaaaugucacuggaguauagguaguaauaguaacuucauucauugguagcugucaaagucuccacucaccaaauaauagcaauaaaccaauuguuccaccuuauccaggaggaauuaagaaacaaguuaugcgaguaagggggaaaacauaaggcuaagcuggcaaggaaaggaaaagcauuguuucccuaauucccaugucagcacacauagagguguacucagcauggacucugcuaaacccaucauguagauaaaaauuccuuugcuguucuaagcggucauggggcaagaaugagaaggaaucaugucucugcgaaccagcugccuacaaaagguaucugagaaugucagcugccaaguaucuagacaccuucaggcagugcgaauuuugugaagaauucaucacuuuuggggaacaaaaguugcucucuuggccaagccaauauaucuagaaaacacugagugagcucuauggucacaagcagguaaccuuucuucuugugcuaguguggcugaaaguuuggaacccagagguauacaacucaauucacauacuagccuucucaucacuacuuaugucaccuuaggccccuaacuucucugaaauaaugaaauugaaguaauacugauuuguccccuguaggauuguaaugacugaugguuauguaggcauuuagcacauuauuaaguuuuagugaauauuagcuaaaacaaaaaguucucccaagaaaggcaacugugagaaaacuugugugggcacauguauguccaugucugugagcagacuagucccaucagagcaagguacauucuggguagaauuggguuuaaccugugacuguauuacccuuacuguagcacuauggauucacccucuguuccauuuagaguccucaggauuuucaugucaaacuaugauauguauuggacauuuuaaaaauaauguguugguaagcaauccaaauagauuuaaagcuaaagaaacuaaaaacaagaccuuuuagacuaaaagugguuuaucuuccaggaagcuguagcuuuaaguucuagccuuggaugucauucauucuguuuuuagccuuuuuuaaaacaauuuuuauuagauauuuucauuuacauuucaaauguuaucccaaaagucccauauauccucccuccaaccugcuccccaacccacccacuccugcuucuuggcccuggcauuccccuguacuggggcauauaaaguuugcaagaccaaggggccucucuucccagugauggccgacuaggccaucuucugcuacauaugcagguagagacaagagcucuggagauacuaguuaguucauauuguuguuccuccuauaggguugcagaccccuucagcuccuuggguacuuucucuagcuccuccauugggggcucuguguuccauccaauagaugacucugagcauccacuucuguauuugccaggcacuggcauagccucacacgagacagcuauaucaggguccugucagcaaaaucuugcuggcauaugcaauagugucuggguuugguggcugauuauaggauggauccccggguggggcugucucuggaugguccauccuuccaucucagcuccaaacuuugucucuguaacuccuuccauggguauuuuguucccuauucuaaggaggaaggaaguauccacaaguuggucuuccuucuucuugauuuucauguguuuugcaaauuguaucuuggguauucuaaguuucugggcuaauauccacuuaccagugagugcaugucuuuagccuuuggcucuucguuuauaggcuuaguugcagaauucaucagaacuugcucauuugcucuucuccuucauuguaguuaugguuugagaccuagcauuguaagaacaaagaaaucaauauaaauuauuuuuaauaugacacauugacaagaacaaacaacauguacagcaagauuucucugaaguagaugauagugguugcugauuuaauugaauuagaacagcacauccucuuucaaguuguaaugguuguuuuaaauguagggugccaaaguucaauacauauuagaaaugucuuguauagcauucuguucuccaacccuacuaagcauagcacuuccuagaaacugauuucuccuuagaaaauggauggauaggucaaugauggauggaugaugguuggauagauggaugaugguuagauggauggaugcaugcaugcauggauggagggaggguaagggcauagauagcaggguggaucauugaacaauggauauguggguacacauauggauggggggguagauggaugaauugacagcacacaaaggagcuggcaauuaguagauuuucacccucuaauauugugacuaauugucuucucugucuaucacaaucacuaccauggacugaggaccaaucgaggugauguuuuguuugucuuuuuuuaaucucuagucucucacucaguccuagaauacuuuuuccuuaagagaaaugagugaauaaaguuaaacacuggguuuuauggcaguauuaacaggaauguauguuuccuauuccucuccuccuuacuuuuuaaguaaaagaacugucagaaucaggaugauauuuuacuacauuguugaggauacauaucucaguucacuauuggguuuuacaaauaauaauauucucauuguuaguaaauagaauaccagaccacuuguugauguagaaaacaaauguucucacaaagggauaauacaugauuuuagacaggguuuucuggcagucuuggcauucuaccaugaaaguaauguauugccauuuugggcccagguguaaucugauaauuuaagaauuacauuuuuauuuaaaauagaaccuccuagcauuuucuaaaguuauauagauaguaguauaguacuaaggcggaaguuuggaucuauaagaaguuuugcuucagguggagcugcucuuguguuuacuaucugugcccaauuaagggggaaagagaacuugaaauucagaauacucauucucucugucacugaaugaauggcuucucaguguagacgggaaaguauagagcuuuauuuccauuucuuucauuaagacuaagaaaaacagcaguaguaucucuuugcaauauacucuuucccguacucacaggagcuuauuaugaagaaaaauacccugaagcuucaucagccaugcuuuuggagcaguaucuauuuugagcuugcaugggauccauaggggaucaaacugauaauuggagccauuaauaugauagagaaccucuuuuaaugcauaggcaaaaugagaugccaggaaaaaagaaguugagaaaucaaaggggucacauuucucuuccuaauaguguuacuuagcaugccagaagauagauuugaucacaugugaucagauuguaaguuuuuuaaaaauguaaaacacagauguagugugaacuuugacaaucaaucacaggcauuaggacuuuguaugaccuuauaguaagggguaacugccagguagaccuguaggguugggaguuuagagaaaagaaaaccauggagcaucucacaugguuuucuucuugacucauuagcucgcuauuguugaggacuguuuucacaagaagaguucuuuuuuuaaaaaaaucacauuuuaucuacaaaaaauuauuuuuauuuuccuucuacugcagagauuuauccauuuuaguuuugaaauccaugauccaugauuaaaaagggaguagggguaaaucucucuucccuuuccaguacaagcuagugugugcacaagcagaagcuaacccugcaccuuggugggaauguagcaggaacgguaaucuggccgugacuacagccaaagggaugaaaugucccuagucuuauacccggagggguuuuuuuggguuccuuuguuagcugcuucaguucugccagcaucugugaaucuguggcaugcuaacuuuucuuaauugcuugcagauaggguaaaacuucagacucucacauuccccaagucaguugaguuauaacacuaugacuuuaaauuaagauacaggaguuucuacaugggauucaguuugcaaaugcauguaaguucugggacauaaaagaggagguuaaaguugaagagacaaaagguguucaugguuuccugauaagaccuaucuaauugaggcuagaauauagcaaaucuuucuuuucuugcagugaaguacuggaaauccauugauagugagaguuugagacauaugaguagaguuuaaaccaguuucucauguauauucagcuguuuugcccaaggguccauccuugugaccuuugcauuuguccagauuucuggggagauccugaggacuuuucaaaggggagaagcaguucuguuucucccuuggggaaaaauguuaggauuuugugcacugcgggcagagcaauauauccuuccugcaggaaaggaacaagaaucuuccagccucuggugauggccacacugcuucuuuauaauuaguuuggaaacuguugaacuauaggucuuuggugucaugcagcugacacaacaagcagaggagauaacuguucaauacuucagcuuggauucuaggcauuuuaaagauuaccauuaguuuuuacucaaauauuuaaguguccucugaaaaucaauguaaacuuuuaccaccauucaaaaugcaaagcuguguauagcacuaucaguccaaacuccccuaaagaguugugguuuucaaugaguagguccuugaauucuguccuuaaugcauacauuuagcucuucagaccgggcuguuuucaugugguuauaaauaauuccagggacagaaaagaaaaacuuaugugaaucagaaaugguccuacauuucuuauuacaaguguuccuagucuucucucaguuaguaggcaucucacagauuugcuuuuauucagaugcuucagaaaauuauaacuccucuaucuaagaguauuguuuaacuuaaaugucauuucuauuuauguuacuaaucauaaauuauauaccugcuuuugaagucauaugucacagauuuucuagacaaaaacuauaaggugaaugaauauuauguucuaugguguugcucacuuaaguagcuguuuugagguucuuggcaaaauuauguuuuguagaugguaaaaaagaaggaagagcuccuaugagucacaccaaaguguguucugcagcagcugguucagggucaguuccugcaagcccuuggaccauugcauucacucuucuuuauauauuuuuguuuuuuuaauucuuagauagaauagguuagagaagccaaguaacaucauuccaaacagcagugguaauauguccuccucuagaagagaucagaaaauauaacuguaccccuuauacuccacaggaguaucaccuucauuuucuaaaaaguuuuuccccgugauaacuuucuucaaacugagugaaauccuggguuauguaaagagaaugaauccuagacaagauugauagacauauaaguuauaugaaucaacaaugauagauuaauaacugagacaggcuaguggauugaguucuggguuuccucuuuugccaccagguuuagguacugaauugcuaagucaggucucauuuucuaacaguuuuuucaaaacacucgcauccuuucuuaucagguagcucaagguagagaugauguggaguaguuaccuucccaacuccaaaguuagccgaaaagagauuucugccaguccaagcuuugcugaaaggaaaugguaaaacuuucaacccaugaauggcauaugggucaagggaaaacuuacaucuucauucuucugcaauuuucuuugugaaaauuucauauccaucaauugauucauuuucucauuugguaaacauucaugaauaacucugcaguauauaauagugcccuggucuuggggguuuuccauugagcaacacauacaaaauuucugcauuuucacaacuuauacucuauggagaaacacauauaguaacuauaccauuaucucucauuuugcuaauauaucacaaaauacagauauuuauaaaaaagaguccuuaauauagaugaagugcaccaaugaacaaaaaaaaaugauacuuuauauauuuuuguuuauauauuuugaaucacaggcuggcauuuugagaaccugugaguggcuggugaaaacggaccaguaaaugaagagaaagaagagagguggggguaaagugguaguuggaaguggacauggaggaugggguuugguagaccaugacuaacauuuuugacauugaauaaaaauagaaaccuuuagaggguuuauagaaguagaaaccuaccagguuuuaaagcagugcuagaugacaggauucucuccaaugacagaaauauucuaaaaucaaaaugcccaguaagucagucaggauacuguuauggggcacuugaaauguaaucaaugauccuaaagaacuaaagacuuuaacucacugcaauuucaauaacaucucuuaggaauggcuggcauauugggcaauaguuuuacauuuucagcagcugcuuugugaagaacauacguaaggagacagaggcacggcaggaauaaauaauucuuuuuuuuuuuuuuuuuuuuuuuauuagguauuuagcucauuuacauuuccaaugcuauacccaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucccuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuugacuuccucuuuuuuaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaaggagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaagaauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccauaugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggcgcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaaugcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuaccgucuaucagcagaccugggagacagauucucuccucugaguuucagugcucagagcacucucugcuggcaagcucucuuacagggaaggugcgcagauaucuuguauuuggaccuccuccuggccgaagaagaaggcccaaaacaggaccuuucucagacaguguguugcuuuggcaguucccaggugguacagacucucaccuaagcagacuaaauuccuaaguuccuuggagucccgggaccaagauggcgaccgcugcugcuguggcuuaggccgccuccccagccgggugggcaccuguccuccgguccggaagguggccggcuguccccggcccacacagggugcugccucagcgccucugugcuucugccuguuccagaagcugucagguucucuggcgcacccucucaccuguucagacuaauuuccuaaguucggcgggucucggaccaagauggcgaccgcugcugcuguggcuuaggccgccuccccagccgggcgggcaccuguccuccgguccggacgguggccggcuguccccggcccacaaagggugcugccucagcgccucugugcuuccgccuguuccagaagcugucagguucucuggcgcacccucucaccuguucagacuaauuuccuaaguucggcgggucccggaccaagauggcgacccauaaauaauucuuguagucagccccacuaaggcagggagaacacuguuuugcaaaggguuagauuaaaguauuuuagauuuuuuucugucaugcagccucugcuaacacuacucaugugcuuucugacuauauauaagagagcuagggugguugcuuuucaacagaccaguauauguagguauauguagguauauguagguauauguaggcuguagcuugcagacuccuggucuccuggagaggcugaugaauaggcuauccuugcaaguagaguugacagaauuuauuggcagauugcaagcaguauaaaagaaaaagcagacucacauaacuugacaucuguggccuguauauuugguaaaguggaguuaccauuuacaaagagagaaaagucucaauagcaaauuuuggaggaaaaauagaacuuaauuuggccuugcuuuuuuuaaagacaucacuuggacagcuaaaagaaguuugaaguugaaaagaagcaugugggcuauaguacauacuuggugguuagcagauguaauaguaguggugagugauaacaagguuuccuggagugacgguuugaaaagaguacuggucuguggcagaucucugugugaaauaaggguaaggaggugagaagacuuggggaaggaugaacaacagcagaaagugcuguucuaggagacaagugaaaggcauucauugguacuuagcagaugccacguggaacauggugaguguugggccacauguguuuggucacugugucaccgaguauacucuggucucuucccacuucuguuaaguuguaauacuucagcuuuguucaggaauaggcaaugcugccuuccuguggccaacuccuugaccagucacguauauuuuaauauggguagagccagcuacagcacauauagagcccaacagcucuacaucugaauuucucuauucauaaagauuacugcuuuucuccaucauuuugugugucaaauacucuauucaaaaugucuuuucucuuucagucccuacugaaacuuggucaucuauuuuggaccuauucaaaugucuugucuuuuuggcacauuguccucuuucuggaaguuucuuuuaaaccacgauagcaaccuuaguguggcuccacugccgugaguggcauuuuacauuuaaucuccguugccgauuucaugcauaaguuauuuuagacuccuaagaacaugugcauaacguuaguagaauagggauuaugagcacugacggugguaaaacaaauuauuuugaaauaccuguucuucuguaugcuauuaguuacuugcgauuuugcuaaguaauuaaaauuuuugaaggccuuauuucuuuaccuucacuggaagaugaucaagguuucaugaaaauuagauaagaaaguuguaauaaauuuauucauuuauugugaauacuguagaucagguuaaagcaauuuuuaaugcaaacaauuuaacaaccaaauaaguacaaggaagacucauaaagauuauugcuuuucuccaugcuuuuauuucuaugauaauacugcuuacuuuugcauggucuguuuuccuaaauuauuuacagugaaacacuuacucaaccuuacgccuuaacuacagguggauuuauccuuuugugcucuggauuuucugcugaagucccuuuaagucauugccacuugguaacagcaugguaucuucugauucuuccuuuguccccaagugcuauauuauuuuggaucaacagagacucauagaaugagaaguuacuguagccaaagucaauauuuguaacuuuucauuagacuuuaaagcgucaugugaaaauuugauagcacugcaucaggugggauaguuacauggggugcugagucuccuguuaauggcuuugugaagcuugacccgggaacguuacauggggugcuaaauuucuguuaauggcauugugaaccucaggcagaaagacgcacaguuguucuuuccugaaaguaacugcugggaacuugccuugaggagaauauuucugugacaguauauacugggaagguuuuuauugagccuuuccauugauauugucacaugguguuuacugaagacagccuuuuauuucauaacucuagguagagcuaugaggguauagaccaucucagacucuuuugaacauauugaaucagucaaagaauuccuuucuuuguuagaguuagacuagauuuucugggcuucacuugggauauugcuggauuucuuguuacuuuaccuugauuuuuacuaauaacuuuccguauuuuauugcuuucucacuauuuguaauuuauguuauauccuccagugacauguuauacaguugaucuguucuauaaacuaacuuugggguauuuaccacauuucuuuaucagugagcucuuuucacauuuagguauucuauuugguccacugacaucuucuagucauuuaauacauagcuauuuccuagucucccuuuguuuucauuugaccuagccuaacauguagaccuguaauuacgcaaaacucuccccuugugcaucuuucagcacaacugccacuggaacauucauuuauugcacaaugguuugucuccugugggucagucaaucuuaccuuaccccuccagcuccagugcauauggagguaaucgaaaccaucaccaccaaaacagcacguaagauacgagagaauggcuuuauauuguaaggcucuugguucucagauaauccuugguuugaugauuuuucuacuuucauucguucuccuuagaauuaguucuaaggaaagcaaaaauacagauauuaaaaaugaauaaaaaacuuaauaaugaacuaaaaacuuggggaaggcuauaagaagaaaugugagaauggguaauggaugacuugguuacuaucuauugaguauauauagaauuauaccauuuuauuaaacauuguuaauuuugagaagacaguaaccaugcuaguguuuauuauauaaugauuaaaggaaaacucguguuugucucuaaucaaugggccuggucucaucauuguagccuaauauucaagucuugcaagucaguauuuguacaauuuagaaaaagaaaugcauggaaaacaaggguccuggggcaaugcagaguguuguaugugucaccuguggcuggagggugucauggaaucagaucuuaggucccggggaagauagcaagaccuucugaagcuuuucuuuuuugauauaugauuuucaguuagauacagauuuuuccuggaaauucuauuuuaaugggacuuuuuuauaaucuccauacucauguuuuagaugccaguauaagagaaagaauagcagucauagucaauguugugugcuuuuuuucuaaaaugugcccauguguggagauagcuuccuggcucaccauaguacacuaagaaagcuuccuuugcuaagucuaaauuuauaagucucuugguucaaggaagaagauuaacuaaauauuaauucagaagccucccaaaucaguauauaaaguaguugaccuuuacaaaugaaacguuucacuuuggagaaggaagaccuggcugcugggauugcuuucuuccugauggagacaaaggaaauaaaagcuguaggcuuuggagcaaauaauaguaugggccuaaucuccuuuuuuucuaauauucacaguucuuacaaucacaacccaagguuucuuuaaaaaacaaacaagcgacaaugacaacagaggcaaacagagacaaccucugagucuggcagccucuaggagacuccgcuucuucuguaguaacauaggucaaagggauaaccauggagagugacagggucaggaugucacuggguaaacugcaauuauauuuucuacuugaacaggacauauucuggaaagucauagaagcaucuuggaggauccucaaguaaggaguauuaggaugaagugucugugauuaucucuuagugacaugucuuguuuugcugcuauuccuuucaaaucgaugauggacugguaacaggacuuuagugaugaaucagguauucgcugagcaagggugugaaagagagagugcugugauuuaaucagagucagcuuggugagcagcaagccacuucugaaggacaacaucccaaguuguuccuuugcuucuuguuuagaaaaguuuaaaaagacguuugucuucuaucuuucuccuuuccucugcuauuuacuaaaguuuuauuguacagcaaagaaaaauacaagcccuguguguucucauagacgcaguguguuuuggaaauacugagcuccuuagaaaucgauguuuuguugagucagcuccucuccauuuuuguguagauuagcucauagacacuaguaugaagaguuuuacucauuuuaugaaauguuaugagagauauucagauauucuacuaccaccuacucuacuugauuugacuucauaugaucacuuaaaaggccuuauacaccucgugaacuggauuuaguugugcagaugggaaaaaaauauguaggguuuucggauuaaguaugagucauauuuacagagaacagcagcacauuuaacauacuuccucaaggucauuagauaucuuucuauggugcuuuaucauuuguguuacaauguuguucagaguuaauauuguacaauguuaaucagagguuguuauuguuuaaaacauuuaaugauuuuuuauuauugugauaaaauugaacaauaccaaacuuaguaauuuaaccaucuaacugcgcuuacaauucaaugacaggaagcagagucacaucaugugcucccaucaccaucaagcacaccuaggacuucaaaacacuuuguccccuaaacggcaauucucuauaucccaguugaaagcuucugugucuuuuauggagaacacagauuggaagaugcccaguacucccagcuccuucuaucaucauuaauuucacauucccuguauauuacaggguaugaugaaaaacuaucacacuggcuucuccaguuauaaaacuugcaacauaacagagaacaagaaugaaaagauaagacaaugguaacaagucucgucagccuuaacgcuuccuggcucagauaguuggcauggaaucuagcagaagcccuuguuuugauaccuugcucaagcacucacccuccuaguuacauguuaaguuucuauaagccuuugucguguuggcuuuagaauggauguaucaaaaguuuauuuuguuuuguuuuguuuugcuuuuuaccccaguaaauguuuuagaaacucaggaauuauguucuuaacuauaacaauguaugcuguagauaaaaaggaguuuuacagacauauuaauagauauguaugucagcucucagaguguuccccucuuaaugacauuccuuguuauaauauuuaaauuuaaugccuagaaucaaaaaaaaguguccaaguuaacaacuuuuaccaggcuguuuuaccaacuucauaauugacauucugucacugcucggacuuuauuucauuucugcacagcucaauauauagauuuuuauacaaaccauuuaccaagcacuagacaauagugccuucggcagaucaaacuuggacagguaaguuguuuguuguccacaggagagccuuauuguaucacaaggacagcuuccguuaacagccuaggaugaaaauuggugacacugaaaaacucaaacuauugaugagaacaucccaaguacuaaaaagacuuuaaaauuaagccuuuuaagcccaugcagucauuauuacauuaagcaggagauggugauggcucauaaauugguuuuccauuuuauuuaaacaggaucuggcagaauauaaauggaaucauugaaguucacuuaucucaugauaauucuucacuuuuuucaaugugcguaugagguugaaauuguagaugauuucugauuauuucuguuagacuauuuauuggaaaauuacuuuuagaggguuuuucccaguuucucuucauuuugguaugucuugaaaaacccagggauuccuugacauucucauuuuccuguaaugguuucaugcaggucuuugaaauuuuagagaauuaacaagccaugauucauacuucauugucaguauuucuuaaagguucuaguuugguauuagauaacuauuucaaaacuacuccuaccucaaucuuuugaucaaauuuuauuguucuucagucaguguggaugcuauaaaauuuugcuuugaucaguccauuuccuuuucuguuaaacaguuggcaucugacuuuaagccauuuuuuauaaaccuccaccagaugacucaagcuuauucaaguuuuuccaugugccauccuucggaucuuuucucaugaagaaauaugcucaguuccauuaggcuuauuauccugcuuaaguuagaugagagcuaauuggguagcuggaggucaguugguggguugguugguugguugguuggguugguugguugguugguugguugguugguugguugguuggugagugggugggagggugggugguuuggggauaguuuuuggcuuaccucuguaggggguuacaguccauaauggcagguaguacaugggagccagcagcagcaggcaugguggcuggagagggaagcuaagcgauuacauggugaaccacaaaaaaaaaugcagcaguggaggugccugggcccuuauguuuugagacacuauacuccuuucccacucugcuggguugaccaucaaguccugucauuauuagauaaggguucucaacuguguugccuccacagcccuuacuguauucagccauccuguuguguuccacagucuagucuguaggaucuagguuacugagccugcuuugccauucugucuauguaauauucuucuuuuuauccccaacacaggaagauaacaucacucuguuugucccuggagcccgcaguguuuuguuuuguuucuaucauuuuauuauccgauaugugagaggaagaucuugcuguucuauacuugggguucugucucccucuucucuccuuuguuucucuaaggauuaagucaucuucugugugaagcaagcuuccauuuguacuuugauuuuguguucucccccagcuuucagcaccccacucuuucuuuccuuuguucaauccaacccucugugugagcauguauuuguuuucucuaucuaucauaccuucuuucuacauaucagcuugcucauucucuacguacccuaaacaaacuuucgcuucaccuacaaucugcuaaaacacugccuucuucucuauaccaaguuuaucugaaaaguugacugggcuccuucucgccauuuuauuacccacugacuccaaucuguccuggaacauuucugugcaaaguuuagcccuggcuguauuugacuagaaguugcugugaaaucuacugaugccuggaaaccaucaugguaguuucugauuuaacugcucagcaauaagcaucugcuggucguuuugagcucgugcagcugggcagaaccucugcaccacccuugcaguaaccucccagcuguuccuucccacaguuuuguauccuugugccauccagguucuuaugaacuguggagacaagugcucacaguggaaaccaugucauuuuccucuuucccuuucucagugccugcuuucuccauccucccuuggcuucccuuuuuucccucucccugaguuacugucugcccaaagaacaauagaucaucacauuuauauaaucuagacugauuauauuuucuuguuuagauucuaucgaucugaugucugucccacagucacuaucaccauugcaaauugcccuguggacacucuuccuuccugggccauuggcagccagaucaugaagaguguuauuuugccacaauuuuccccacuagcuucugcuuuuccagaggucuauacuguaucugucauacuuaucuucuacguuaucuuccuuuuucucaccaccaguuauuaccuccauccuguacauccuaucuuagaaauuacuucuuaauuugcuauuccucuccuauuuccacagucauuaaucuuuuucuggguguguaugggcaauuguaauaaguuccuagcugguccuuacuagauccuacacaguguaguauugguuuucagcacagcuccaaucuuuccccuauccuuuaaagccuuccaagucuccuuauugacuauaaugaaauauaaacaguuagcauaaauucaagacuccugccagcauuugcacuucaaauccuucauccucagucuccauguugcaccuaaauggggcuguuagcaguuguuccacagcccuuugucuuaugaccgaauuuuuuucucaagaucauagacaggaagguuucugccaugcauauucuagcuuguauaaaccccucuuguguuaguacuucuaaauucagcauggaacuacuagcuugagguuucuaauugcuuguaucucacuuaacuguuguguguguacauauuaaagauggcuguggcugacuuauucugacacugugucacagcuuugcuugaggucuggguaguauuuucuuuuugugagugaguguguguauguguguguuguuguuguuguuguugucuacucuggaauaucuaauauuugacuuuagugacaaaauaaaugucccagagaguugaacucauuuacucuuggguuuuuguugcuguuuguuuugggaguuuuuguuuuguuuuguuuugcuugcuuucgaucagugucucucaauuuucaauuccaaauuguccuccugcuacauugaaagaaaugaaauuucucaccaguagcaaacaacagugccagucuaugugagacuguuaaugaugcacuuauaaugccagcagacacaaaaaggcuugagaaguuagguguagagaaccaucaccuuucugguaggcaucacuggaaauggcacagcacuuaguacagcauugucagagaugaagaaaaucccuuuaggagaaugagcucuguaugagagucuggauagcagauaauuuuuuucugucugugcugccuuccacagggcauucguuggaaugaaccgucauugcaguuagacagaggcuauacuguacuucuucuugugcugucuuuugaugagaugaguuuggauucuguuuuuaguuauauagccaucauuuuuagagaacaugguuugaaauguuuguuaaaguaauaaugauuaggaauucucugaacuguuagcuucuucccauuugaagaugguguugacagcuuucaggguuguugguuguuggguaaggagccugagcccacgugagccagcaugccuggaaauccccucccgggacaauauccugacucugccuccaugccaucgggaucguugugguuucggguaacagaagugaauaugcucuagaugcauuugggguuuuacggagaaagcauuuaauaaaauaguugguugcguugaucguuuguagcaguggaagagaaggaaacuaacugguccaagggagauugaaggagaacugagauccaaaaguguaaaaugagcugugaaguguaauauaaaugcaaauuccuucaguggucuaagaccugacacucccaccucugcugccucccuccccuacuuuaccuacacuaaggaaagaauguacuuuucccugcagggcaacaaagacuugugcugaacgcaaggauugugcuuucucaguucuucaacuuugcuuucuuucuguguuccuugaauauuaaauguaaaguauucuacugcuaccuugagaaaaaugguauuucucagcaguucuaaauaaugguaucaaugcauucgagccuguuaguggcuccuuuauaauguuaccugguauaugaaagcuggcaucaugcaugggcauguguguacacaaugugagguuuaugaugguagccucaucuuagucagcuguagaaucaggucaguuucuguaagcuugcucaccgcaaagcaugccggaaccugggcuuugcgggucagaccaggaaggaaaggugauacaaguuaguaagaacaagaugaucuggggacucugagcaagaauuuguguuuguccucacugucuccaccccugcuguuaugaguguagcagaaacugauaacccuaucagagagcuagacauacauguauggcugaggaguccuuccuggaaagucagcacagguacaagagugacagccacagaccaagaugcugagacacagcugguggcaacaucaaagugccccacugccacccuucccaugucaguaucccuccuaugccauucuaaccguuaacacauggggaaggccccaaucugcuuaacuuuaaacccaugagcaagcagugaaagcaccuuauccugacccaacugcacaucacaagcuccuauaacaacaaagcuauauuagucaggguucucucgagucacagaacuuuugcagugucccugaauacuauuggaaugacuaacagucugcaguccaacuaacccaaccaugggcagcugugcaugggaaguccuauaaucuagugguugcucaguuucaugaggcuagguguuucagcugcucuucuguagaagcugggauccugaagagguugguuccaacagaucugcaggccaguaagugcuagcaggugcagaagagugaagccuccuccuuucaauguucuuguguaggccuccagcagaagguguggcccagauuaaaggugggcaccaccucgccuggguugggaacuugcuuugucccaggcugaccuugaauucagagaucugcuugccucagucuccugagauuaaaggugugggcuaccuugccugggccuaaacuuuucauggccaauaugucucgagaucuccaugucaagauccagauuagaagccuguaucuucuagucucaagaucuguaccacacaugugcccuccuuuacuaaauuguaguuuauuccagauguagucaaguugacaaccaggaauagcuaucacaaagccuucuauauaaguuuuuucaaaaagcuaauauucuauaggccaaauuugcucaacauccucaaaacacagaaacccccaaguuguaacuguguguguguguguguguguguguguguauguguguguguguauguauagucauuaauaccauauagcugaggguucuuuaggauggcuuauuguauuuagggguaaagaauucuaauaagcaguggugauaauaaauacaugaagauguaaauuucuuaaaaguuuauagucaauuuaugauauugacucuauaguaauaauucacauuauaauguagucugauccaaugaauuaucucuggcagucggggaaacacuguaaguguauuauuagguaacaacccuggcuaccguuauaauuguauuaagggaauccuucugaggauagaauguuagacucugagggggcggggggcgggcauugauaugcagucccuuuucacugcaggugguuaaguaggcauaugacccuuugaaaacucuggaaccauaaacuuacccauacaugcuauaaaggagucuguguaguuauuagcaucuguauuaauagcaggccuuggcccuuaaacuucacauucuugauuccuuuuuaccugcaagaagaguggccagcauacaucauuagugucguucacugucaucagaacagugccacugugagagucuuuguugacgaacacaaucucugcaaauaucccagcccugcugggacuuucaagacuuguuuacugucugucagcagauauaauuuaacuuucuuuccugaaauaaacaauauaaaacaaaaggagaaaaaacagguuugauccaaucucuuuuccccugacaauuauuuuccuuucugaguaaaccuuuagcaaaucuccuuccucacucuccucuauacuugccuuuacuucuccuuaucugcagagauuuuaccuaugucauauaauaaugccccugucagauuguagacacuaguuaucuuaguaccaauaaccuuguuaaguuaguuaauuaguuaguuaguuaguuaguuaguuaauuaaguaagcacauaccuuuguguuaagauugaaggaaugaagacacugaggugaaggcacacagcuguaccuccugccugccugcagcuccugccugccugucugcagcuccugucuugccuucaugcccacccucccucccagcucucauuuuguaagaugguugaggcuauauucccggcauggcaacaugccuggggaagggucuuggguuuguuuguuuguuuguuuuuuacccucagggcucuucauaauuuaccuuugcguuagcacuuaagcuuguggcaguaauagugagaaccaugaaaaacugauauagucagcaccugugaggaaaagacugcuaaggcccuugcaagacuggccuucugcgucugacuaaaagaauuaguccauuuuguucccaucaacggugucauuucaauaugugauggguagaacuguggcauccauuuggcagucuaagugggacaacccucuggugauaacagaaaaauggaaagacccugagauuuuuagccacaaggcaagugauucugaaaugacccuaucuuuggaaucauucacguucacucagccugugguccauaccugacuggguacugaggaagcuuuauaaauccuuaucgugugucuuuguaggcauguucaaguaucuucuugcuauaguguuugggaauaaguuugguuccuccuagcagguacccucuugagagguuggggagagggaacugggugaggacugucuuuguugcuucagcugauucguugguaagugugaggguacgggguuugccacagucauucauuaucguuuuaaaaggaaucauagucgugccacccuccuaacuccuugcucugcuaacuguaucagggguaauaguuugccccaguaauggaucccuguucacauuuauuuaggaauuauuucaugaaaaccaagcuuacucccuguucuaccaaugcuuccgauauuauugucaguagcauauucccuguauuaaaucauuucuaaauaaaacagcuaaaguguuuucuguugccuacuuagcauuuccagugauucuuaugacacguguuacauacauacuauagaguaguuauuacuugaaccaagucauuugacaaaaacucaaaccucuucccauggcacuacaacuagaaagucaauaaguuuguuauauuuuuauuuuuggaagauagcuuucuacuuuguauuucauuucuuuacccuaaauuauucugguauuuccccacacacauacccaucagccccuugucuuucagaacacaagucuaucccguucuacuuuucuauuuuugagaauuucauagaugcgugcuguauuuacaccauuuccacccuucccucugaccccuucaaauccuugcaugaccuuuaacucccucucaaguucaggcuugcuuggcugugcauguguuuagggcugagcacuugggauuagauaaccuguggggucuuaucccugaggaagacugauuuucacugccuuagcagccagcuguugccuguaacucuacauuuaggggcuugacccugcgaaaucgucguuggcuuguugucaccuagagguggccuuauucaagucuuauuuagguaaccauauuguugagauuucguggguauagcuccuccaucauaucuagaugacacuauguaggagcaggugucaugggccucugguccuuacaaucugucugcccuguauucuguaauguucccugagucauagguguggggguugcaaugcaaauauaucaguuagaccuggacacccuaucuucacagccacuuauuuucugcauuuugaccaagugcuugcacaugcugcaaaaagaagcuucuuuggugaaaacaacacucaccuguuguuuuaaguauuuagaauacaauuguacauuuuauugauuuaggacaguggcuauaguagauucuucucuaggguuuuuugaccucuccaaccaugggugguugguuaaguuuauauuaccaggauuuagaauuuacuccucuugauuaggcuuuaaguccaaucagacagcuguugguuacuuucaagauagcuguaccacuauuaaaccauuggggcaaucuuccccuugcuauaagggaagaaaugggaacaaugaugagagugcuacuccuaacuggaguaggagaggggagcaauagagagugagaaaggaagaauagauaauauuuaagguguguuugaaaaacacauagggaaacauuuauaaguuuacuuaaaaguuaguaaacacaacaugcauuuuuuaaugaagucauaccauacagagugauaaugcucccucaagagccauagacucucuaagaaaaaugugagugccaguuguuggucgacaaaguucaagugaaaccccauuaauacagacuauugccaucacccuugguugucucccaagacuuaaagacuuaaagacuuaaguaaguccuuauugcuguagauaccacagacuagggauauaggcagguaaagauagagcuggaacugaccuacaguccugccuccuaaggacugacucucauaguaccagaaggugcuauguaagcugccaaggcaagaaagcaaucaauaguccuacccaacugggaaccaugacaggucuacucuuaucagcacuggcucgucucucucuuucccuuugugaggacucagugaaccuaaacuucccaggcucuguacucacugcuacaacuuuccuucucuccuggcagccuuuucaauuauucauuaagacacauccaacaugacuuucuuucuuuagcugucucuacauuuuguucuuauauaauugugguucauaucacauccuaucauagugacuuguuuuucuacauuagaccuuuguaaaaagaaagcccaauggacuggagagauggcucagcgguuaagagcacugacugcucuuccuaagguccugaguucaaaucccagcaaccacaugguggcucacaaccaucuguaaugagaucugacgcccucucuggagugucugaagacagcaacaguguacuuacauauaauaaauaaauaaauccuuaaaaaaaaaagaaagcccaaauuauaccugccuuugcauccgccaucugggacauugugccauccuagaauaguuuccuggacuacuuagaaggaacacuaauaugcuaaucaagucuugugcagagcacaauauuauacuuccagaucuagucauguaaaguccuaggauguucuccagcuuuugaaccuuaaguauuaugccagcuacuucaaacaucauuucaauaaauccaauuugaaaucuguaucaugaacaccuauggcauuauuugaugcaguucuaaucaguuauucacacuguaggcugaguuuguuucucaguaccgucuagugaauugugauugcugaucugaugggugauauccuuaugccugugacuuggggacuacauugauucccucagguaucgugagguuauuuuaauauaaaugaguuuauuauuuacuaaauguccauacuguguguauaacugucacuucauaauggaugcaccuuggucauuccugugucauuccuguggcuguguuaacauuucaagacucucauuucccagcucugucuaugcugugucugucuuuagccuuccacuuuucuucauguuucugccuagcguuuuuucauucauauuuuucuuuccauuccuauagaguuucacccaugcuuacauuuugcuuaauuaacaguuuucgcagcuguauucaaaguccauuaagcauugcuaauuguuacuacuugguugcuucccaggguuucuaaagaagauaaaauaaaacaggaccaaacaugacaccuugguucacuggggucaucuugaucccuauaaaaccuagcauacagcuuuauuaaacuguguuuucucauagugagccacacauacugugauagcaauuuaagaugacaaaguauuauuacugcuagagaaaacuuagauauauuuuaaaacauguuuacacuaccuuacagauauaauuuaaaaacaaauuguauacacuaaagcaagaaacuuuuguuaagaaacuuuuguuuuucuccaagcaaaaaaaaagcccagaguugugagcgguugucaaugguacaugaauauucagauaaaccacccaggguuacuugguuguuuaagaugaggcuugauccaguagcauuugaaaaaaaaaagggggggggauacuuuuugccacucaaaacagugccaccucaucuucuuggaguuauauagaccagggaguuuugguagauaauguguggagaaauaugagaaacacauuauuuuaaacucaaaagagggacaaagaacauggaguaguuuuuccuuuucccagcugcccucugguggcaaagacacagcagacagcagccaugcugaaggaagcugcuucccugcuuaagagggaccaaccagagccuugccugugcaugugugauuccaaagcggagugcagggccuccuaauuacauccugcuuccccguggcaucugcucuuaucguggcugcuccaggcuccaccagcucagucaauacucacauauuagcaggagacaaucgauagaaaaauuaaaaaggaaagucaagguaauuaggcuaaagcugcugcuuaugaguuuucaauaauugcuuucgcuuccucuuguuuccucaucucuagaaaaauagggccugauugaaggacugggucguguuugacugaggacaugucaaaauuauacaaaggcaggcaggaaauagaauuaagcuguauuuguuuuagagcaguaaaggggcuuugcaugauggcaggggaagaauaggagcugauuuaaauguccccauuagcagcugugccauugucccuaccuguuucugucaccagcuucugcaccacuagcaggagcccacucagaagcaccaugacacguccuauacccaagcuccaggggaaggcaagagggagacuucccccagaaagcagcaucccgaucacucuggaaauuucauucuaccuuuuacaaaacuaugaacuaaaucaaaaucuccuaguugcuagccguugugugccgcuguugagcauuggucucuggguacaguugucauggauggcagcccacuuaugaacacauuugggugaacuguauuuccuaggacaggaagucaagucuccauuuugaccugccugggcauuuguguccucuaaacagagacacccuucgucuucuuguugcaugguacggugccaacuaccuuauagaggaggaaauaccaagggagccccuccucugagagugaugaaucaagaaggggaaaaaaaaaggauaguuuuguuacagagauauuuuauguuuuauguccauuuacagucuacauaugcaugauuucugucagcuuaaagcacuuuauaaacuuuauaaccaaauuauguacuuacaucauuucauucacuguugauauauagcuguuaaacaucugccacaugcauauuucuuucaggaaaaaaauguaaaagagaauucgaucuugguaaauacacaggaaauauugagaugaaaagaauaugauauggaaguauuuauugugcaccugcuaugucuaaagcauagaagagcccacuggcaaaagacaaaaaaaaaagauagaacucuuaucaccuuccccacgugccccuuccuuccucccucccuccauguuuguugaucagaagugagugauaauaccuguguuuggguccagggcagucugauuuacaucaucucguuaacuuagacuuuuucuuaagguguagggauugaugugucaaacugcucuugaggcagguaauucacauguuauuguggauagggaugcuaugguguggcaaggggagcagaggccuagagagccaggcuugcuugccaagagcuguugcacugauuccccucugucacuccucuccuaccugagcuugugucugugacucugucaccuggagaacuuguagcaaggggacuauguuaugaugcaugacaugaguuugacauuuguuuagaauuguaccagggcucuguagaagacuccugcuuccccuacagccuucgguugagguggagaaauuacaaaccaaacagcuuugaucaccuuccucagcuuccuuggcuccaccuccugguccuuuccaucccucaggggaguccccgucacagcacuuagacucuccugcccuucucuggccucgcuaugaucacuuuuggggugugugguaacuacugugguuuuuaaacagucuuccuauguuagaucuguaacuuacaauccuccugcuucagccuccuuacugcaggugugugugugccuucaugccuagcucugaggaaaauuuaucuuuguaauuuuuuuuuuuuugguugugaggguacauaaugagaagaaaacuuuugaaaguuggcuuucauuuuguaccucaauaguacagagucugucugugcugugaauuccuggccugugggucucuagacaucucugccucaaccauucaucuccaguauggggguuaggauuacauaugugagccacaacauguggcuuuucaugaaauggaacucaggcauauguaacgauugcuuuuaccugugagcugucuuccugacuucuacggaaaauaauggaaaguuauuuuucucuccugucauuuuauuucaaagaagguucaacaacacccccucccuuuuccucuuguauuuauuguuuccgucauaccuccauauucuuugucuuuaauuuucuauaaaaguuuggguacugaauacaaaauaacugcaguacaauaguaugccacccuucuggugauguaaauagauaguaguaacugugacucagguuuaacugccugauuugacuugcaggucugcugcauuucuuucuaacuuaaaacauuucagcuaugccuuuaaaugaccucuguugcugucagugaguuaugcaaauuuacuguuuguuaguuaagaggcauuaauaaauguauuucuaugaggcauauauaaugaugcagaaauaugaaugagagcuuuaugcgaaacaaagauguauacagugacaugugauuguggguauacaaacaguucaaaugucuuaaaugcccugaauagugugucuauaauauugugguuuguuuuagaaccauucuaucuucuugcugucuuuucuucauaugagguacuuaccacaauguacaauauuuuacuagucugcuuacauuguuuuugguggucucuuguauggagcacauuuuuaugugaaaggccuuauguugucuaauagcauuguauauccuuuuaguaaguauuugcugaaaaauaaauguuuacuucuuucuuuuuuaugucuuccagugauguuagcaaaauagauggaauggggagugcuguuuuguaagcaccuuuuggccuuauugaaggcaaacuacugcauuuaguucaaggucaggcaucaaacaagaagggcuccuuacauuauauauuugcuugaugugaccuaacacauaaugugguuuuguguuguaugguuuguguguguguguguguguguguguguguguauuuaauccauuuaguaaaguggguagguuaauuucucaguaguuuagcauaugaaaggcccucucucuugguuauaggaauucuaaguuccaagguacauggaaagcuuuagauauuuuugaguuaaauuuucccuucaagcaucauaguaaguaauaauguauuauucuggcacuuuauuccaaaaaguguagccuggcuaaugaaucuaaaagugccuuuagugauucauucagcaucaauuuucccaacuccacauuccauucuaguauguuuucagcuuacuaagcaacaaaguaucucaucaaagacuccauuaucugucugucagccaugaagggacauccuugauucucugccagaagaccugcuuuccaguaaaucguggccucggcacucugggaggugcacacaguucucugguagcucugucacucagugcucauuuuuaugaggaaaccugagugccacagaguuguaaggaccccacaagcucucacagggaggacucaaauggaaugcagaagccuuuucaucuguugcuggaaaauuucaaaguccuagagaugaauccaccuuuccacaugguccuucauucaacuaccauacgggcagcaagaaguuuuaucacaugcuuacaagucaguacagaguuuucuuuuuucuggagagacucuuccugaagcccuuugaagaaagcaaacacaagggagaugagaaaaagaagguaaauugagaaaagauaaggauugagaagaagggcagguuuacccuggaggcaaccugauugaagugugcuuuaaccguguaccucgagcaucagucagagaggaaugcccagggacaagcaugcgcaggcucucucuguggcaucguguugcuccaaagcccuuaugucagguucauauaagaugagaguauauugcagugaacacagcugaaagccgucauuccuguaagcaguguccagaauaaggacaacuacaugcccaguggaggaaaugugcugcucugacagcagggugaaggugguggcuaucaacagauguacuuuauuuuucauauagggaacucauuuagcacauuuaauguguaagaauccagcaggauucauguuuuacauuuaauucaaacaacaccagagauauacucaggaauugguauucugugaagaucaaacaaaauaauuuaugaacuggcucugaaauucacauacauuguacuguauuuugguaguauuuuuauguauagguuacuguggacaaaaguaagggugauuugagcuucuuaggucauuugagcauaaacuuaacuccucuauagcuccguacucgcucacccucagacuucuauaacuguuccuccucugaggcaguguuuuacaucuauaugauucaggaaaaaaaaaaaacaguaagggaaaguacuaauuauuuucuugcauaucagcaacuaccacauaauugcaacaucuaaacucugauugaaaauugucucuuucugauuuagaauaucuuauuaacuacuuacuccuuggccuccuacagaagaaccuguagugucugagacacggagagcaguagauuuucucuuccugugugugaguaagugcuuucccucuucugucuuguaggcagcucuguugcagaucugggaggcgcuggcauguguugcuggaagcacugcagauccuauauuauauuauuaucccaaaugcugcuuacucugaucaaucuuuucuccuggcuuugaaguuccacuaaaauaguaaacacuguagaucauauaaugaaaccaauggcauuguaacaaaaacucuauuacugaaaguuacauagauuuaaagggagauacccuauucuagaaauuaugacagguuuuuguuaauacuugucaguagucuaggaagauaugaagagaugggacaaacuucaggcaggaaaacuaccaaugagugcaugcccagcccauugcguuuuaguugauuugagaaguaaugaaguugacaaccaagaauauccaucacagaaagcauuugagcauugcauuggguauucacuggaagugcacauggaacucaacauggugugugucuauggcugagauuuauuacaguaauaaauaucuuaaggaauaguaguaauaaggucgcacaacugaaggucauggggaugaguugcaucucaagaagcccauaggccucuuuauguuuucucucucucucucucuugagagggccacccggugcauacauuuccuccauauauaagcauccaauaauaugaauaggggacucagaggcaaaggucaagaacuuguggauuagucauaaacacccccauuuuacuccagucucccagaagaaaaacaaguauucagucaaaccacauugcacacacaaacagcugacacacugucauaccguggagcacgggaaagcaagaaaucaccucuaaccccaaggugccaaaucuccgucagaggcaacucuacaggcucuuguguagauccccuccagccugcccucccuuauuuaccugagguuccuuggcuucaguuacuuaccagacaucugaaagguaacaugacagccugcucuggagucaggcugaaggcguugccucaggcgucuggucuccauagguaagcccuccgguuugggggucaauguaaaugguucacugcuguggagacuuaacaucauuagcuggaaaguacauucaggggaucuuggugccaugccuugguuuuuguuagagucccuguccucacuuuuggauuuuuuuuuucccccaguggagagcagacaggugaucggaagggacaguucucuucucuggggacugcuuaguaguuguaauuguguuuuaugcccagauggauagugacuauguuuuaaaacuuuauaaauaaucaggccaacccugaaauuaugauauaauugucugguuccauguuguaaguaagucuacccuggucaaacacugagcaugauuaaauagaagcuacaauuuugacaugaaauuauguuuuauuccuuuucaaagguacacuucuccuuuuauaguaccuugggaguagguacuuucccuucuuuguuggccuucugaugguuguucuuuucuuuaucaaugaacuugauaucauaaaucguaagcaaauaagcaccugaaaguaaaaugaaguucuuagaaauauguacaaagugauggaaagcuacagaaauaaugugauuuucuaguaaucagcaggaaagaagcauuggucuguuaaaauuacuugagcauccagguaccgugccuucccauuuucaaugccaccugcuuccuacuucuccuucccagguggacaacauuccaaauuuucuugcacuaauagugagacauuaucauugaaauuuuauauuucaauauauuuagaacucaauacguuuaagaauuauugaccuaaaacacuuuuccaagguguugaauccauccaugguuguuagagguauuggacuacuuuuggguuuaauuaaucucuucuggaugagaacuuaguaaaucuaguauucuuugcugccuucuacaauggauagauacagcuguggcaucgcugagccaaagugcuugggauaagaauugacuuuugauucaaagcuuuuagaucuauugacauauauuagagauggaacacaaaucuaaguacagaaucaaugagcauuuccuauuuaccuuauucuuauagaguuaauuuuauacaagauuuuagauaauuuuuguacaagaaacuguuuaaugauacuucacccagcauuugucacuguaacaaaauaccagagguaacuacugauauguuuauaaaagauaaugagguauaagaauauguucuauggggguguggugagguguggggggaaggggaugucucagcgagcccauuucaaggcauuccuucccccugaggaagacaguauagaauaggauagaguuuauucagggcaaggggaggggaguuaaaaggguaguagaggcagaggaaggcagagugagggagagaguugagaaguagaggccggccaugaccauguggagggagaggggaagggaauagggagagagagggagcaagaggcaagagagagagaaaggggaggaaggagggagcaagcagccccuuuuauaguggacaaggucuacugggcuuuugccagguaacugugggguggaguuuaggccgaaugcuaacaauuaccuuuauaaagagauucacuuaguucacaguucuggagucauuaggaugugaugucuguaaccccuauauggcaagaaccuucuugguucuuuccaauagugguggacuccaaaagcagggacucacauaggaauggaagauuccaugucaaacaaaacuucagggcgaugaagaggucagucuuguuuguuuuauacucauucucuccagagaacuaccacaaagccaucuaagaaccauuugaaucacucucuggaggacccgugacccccacugcuugcuugaaggccucccacuggaaccuaccuguuagaaggucacagcuucaugucacugccacccugaggagcaacacaggagcuugggguagcacauaaaccuggugcuuaguaccagauguucugcuugugacucauauugccacucaaaaugguugaaacugcguaguaucggaguguuuugaacuaaagauauuuauucugugaguauaaagccaaacaaucagaacccuuaaugcugugagggauccagcuuuaaaaaacauggucagagccgggcgugguggcgaacgccuuuaaucccagcacucgggaggcagaagcagguggauaucugaguucgaggccagccuggucuacagagugaguuccaggacagccagggcuacacggagaaacccuguaucgaaaagacaaaaaaaaacaaaaacaaaaacaaaaaacauggucaggauagugccugaagcguaaggcuaaugcuguuugaaugcuagcaauggcaagauuuaagaggacccacguugagggaacacagacuuuucuagaaaagaaucagaauauuugcacagaaguugguaguaauucauguccaaguuuauuuugguagaaaguacuuauuucuugaauugguuuauggaaucuuuugaugucuuauuuuauaaaaggcuuucaaaauauuuggaagccaagcauauuucauggucacaaagacaccuuuaauugcuuccauaaaguuguggucugucugccuucuuuucugacaaagugacauuuauuagcauuucucucguaguuauuuguaauugcacgaauguucaccauuuccgacguuacaaugaaaucuuuugagauucuagucacauuucuaagcagauguaccaaauuacagcuuaagacuucugcuugaaaugugaaguuccaauuaguaaaauaucuggggugggauggguuagcaaagaaggaccugagaauacauaaugcccaaaauaguuugcuaucuccuuguuaacauugcucccacccaaacuuaacucaucagcauguaugaggugccacgucucccacaaaccgcuugguuuccuuuucacccaaguuuaacuggguugcucuggcugaauuuagucgggaaggagaauuuggaggauacaggaagcagcugagucuguguggagcacugcugugacuugggugucuguggcucaucuguucuucuccacuuccaucggaaccacagaucauguacagaucuggccauaugggcuuuuuacaugucucuuaaagcaaaucuauaauacuuguuacuuuccacucguucuaagagcccuuguaacuguccucuuccauacuguuucuuucccuuaaaguaaccauugcaucugggaaguuugcaguuuauuuuaagaccaacaccuaaauucuuuuaccaauaagucuuucuuauaagagaggaacauuuguguuucuucaacacuuacauauuuaauuuuaguugcguugggagggaagugguguggucuaaaggaaagaacgugugugguaaaguaucaccagcuuugcucacgacuauuuuugcugcuaacuucagagauuugguguucucaacauaaagugagagcgauggagcucaucuuccaggggcuuugcuuccuucauuuccucauccucccuucauguguugaacacuuacucaguguuaaacacagcggccccaccagggagagugaugagaggcguggucuaugucaccaugaaacccauaauccacugagaaaaagaugagguaaguagguacuuacaaaugacaaauggccuaaaacaggcagugcaggccaugggaccaacgcaaguaucaaacaaaggccaucacacggucucuguacgagugagagguaggacugcucacauggacuagcacauaaacaaaggcugaugucuuggauucuuggcugcucuuaacaagucuuguaaauacuuuuaucagagucccacuucucaauuccucucaaccuuugaaaacaacuuguccuuaucaccuuuuaccuugcacaggugccuacaucucaugccagguuuuguuuguuccacuugcugugaugagucagucaauuugucaugauuucucugagauuuuggucuggccaguuguacaacacuguucuuuuuaucucuuuucuauagaauaggcuggcuguuuucucuaccauuuuacccaucucuuucaaaaaucaaauaacuuaaucucuuuagaauaggcuuuauuuaucaaauaaauaaauucagucucuucguauaaauauagaguacuuucaucuacugggaaugugagcaucaagaagcugaauaaucauucucuuuaggaccaacacuguaguccucauuguaguugcguguucuuugauucugccagccuacuguggcuccugaggcagagaaucaaauguguuuguuugcuucuauggucacuagcauauaaaaaugcuucauggucagcacuugauaagaugacaagaaaagagaugcacaaaaagaacuucacgguuaagcuugugcuauaucuaaccacaaacaaaaccucuggaagugagcuaguagcugacugauccauguggccuguuagaguuaaugcuauagaauuacaguucaggcauugacagaccucuugcuaggaagagccaagaaaaucuccaugaaucugaugcuaaaucuguaagaaugccaagaauuucuccaggugaagaaaguacauuccagccgaggauucaggauucagaaagcauaagaauggaaaacucaaauacauguuuucagaacuauaaguugcucaggccacuuacugaauauuuagcauauugcagagcaugaacaucaugcugggacaggaggucaaagcuuaaaccugaaggucuguuuuauauaggggcguaccuuggacuuaguaaguugaagagcauugcaugaaaagccuaaucagaaagauuugaucugauuugaacuugaaaugggaagaggagagcagagauacuuagcuuaagguaugccaggcaaaagcuuguguugcuuucuggggugacucagauuugcauguucacuccccagauaaugcacuaagggaggaggauuaggagguguggucuucuuggaguagguuaguccuuguuaaagaaaauguaucacugagguaguuaaaaaaaaaaaaaacagugacacagagaacaguguauuaaaauaaucugaggaaugguggggucuugaagcaagaguuguuuaaugaaucagggguuagaguacuugccagcagaauucacaggucuuauacaagcuuuucgaaaguuagaagacagaagagguccaguuuuacccuaggcagagccucucuuugaaauaaagacagugacagcaggcuaggaucccagagaaggcauagauggagcuuagguuugaacuucuggaccuugaaaugcugaagagaguugcagaaggaaugcaugagcugauuaggaacagcucuggagcuuagcccaguggcagugggaguuacagguguuugggugcugggcgaagcucuaacaguguggugaggucacuccuuauagaacacauggacucuucaaacagaauagacagucuuuagagccagacaguggcuacaugaggaauacacccaaaucaugcaguucccgcccuuaccauguuuugucuuuuaaugcauaaaaccaacaugcugggguaacacauuuuaguuagcaaaaacaguuagcgagaagcagaacuacagaagccagagaguaagguuacuaaacuuagggacguuccuagcugcaucccgggacuguugacuugccuuugcuccugguuuggcagguggacuaggucuuugauucuguuuugguggacauuguugccugugagcugggcuucaaggccuaaauaauacuucucucauagugucaguugugcuaaggucuggggccuguuauauuccccacuguuucugugagcauaagucaaaacauggacucagcuggggaugggguggggugggguaggaauugggggcuuaggaaugggggugguauauuguccucuuagcacuuguaguuuaacagaauuuauguuuuacuaagcuagguaagcaguugcauaagcgggguccuauagggaggacuagaagcaaaaugaugauugacccaguuuugacacuaaguaguuaaccaagggaccagaagaacaaagacuuguaccagcuguuagauucuugauuucucuucuuuauuaauaaaaguuaucucuagccauggcaaaacuuuaauuaucgcuggcuuguugacauagaagcaacaagucucucccacugucauacagagaucucuucacucguaaagaggagguccaaauacuccucaacuuuauagaaaacccucaggaaacaauuuuccagaaggccuaguaagccucuggaaguaauauuuuacauaaaucuacagaagguagguuggguuucauuggauagacugugagugccucagcccugaucuuuuucauuucuauaccaaagguccuagauuuuggggauuugggaucuuucucaugggguggcaaguaagaugaaacuagacagccauaauuguagggccugccagucuuauuucaaggggguuggcagaccuugugaugacccauuugucuuugucuucuauaaccucccguagcugagaaugguguauccauagguuacaccggcugccuuuacuguuuggggguuggugaggaccucaggguuugggucuuacccuguuggcuuuaggcccuggaucaggguccucuuuacccacacaaggucaccaggcugaaacuuguggacaagcucagacacauucaagagugcagccucuugaacagccugaugacuaguaagcugggucuguguucuguuugaugugguuuguaagauauuuauggagaauuuuuagaagaguuauagagaaauaacagcaccuguucugugagauccacaaacaggaacaguacuuaucuuccuucugaucacugugucuucagcccucaugggcuucuuacccucuugcucaaaugcucauguuuucaacuuuccccaacucguuuacuguacagcccugacuggcucugaguccuccgugaucugauugccucugccuucccagugauggcaucugcagcaggagccucaagcccagcccuauauggucuugguuuuucucauuucuugacuucagcaggaauaugugcucugaacagugugcccucccucucuuuucugagccacagcuucuaucauccccuuuguacuagacuaugucuuacuagacucugcaugggggcucucccuuguuaagucauugguaaaauagugaaucuugauuaaaaauaauuaaaaaaaaaaacuaguaggcaguggugacacacaccuuuaaucccagcacuugggauuucugaguucaaggccauccuggucuacagagugaguuacaggacagccaggacuccacagagaaacccugucucgaaaagcaacaaacugccccccccccaaaaaaaacuauuuuaucuugacuggggaaacauuuuuuauuuuuauccugaucuuuuacuaaaacauauuuucacaaugcuucauguacuauuuuuaucuuauuuccuuuauauaucauuguuuucauauuucuacauaauuuuaugauuauauuuuucauuuaaauauugcuaauuauagaaaauagacuauaaucauuaucuugaugacucucaaguguuuucaccuguguauaauuuaaggaagagggugggaguguuuaaauagcuuaaggaaaccuagacugccacauuuuauuaagauaaagguuacauuuuucacaaaaauuauuucagauucauuuagccauucugaauuuccauuuccugaccuauggagugagggcauagaagcugauuaugaucauuucucaaggccuuuuagcucuaugaaagugaccaugcccucugcauguaauggauuucuaaagaauugaucaguuucucaccuuuugguuucauacaugccauuaaggaugcaggaaaaggcuuggauccugucuauuuaaaaguacgcugugcauaaucacaaagaauauuaaauucaccacugucuucaguucaagaguccugcccuaaacauaggagagaaaaauuauggaaaugacauggaaaucaagcuauaggcauuucuuagaugagguuugauacgaguuuuacucuacuauugcaauaccaagaaaguagaaaaugggaaguuauuuugaaaacuauauguaaaacacacuaaaaagcuacuuaaaaugcugccuugacuuuaaaauguaaaguauuugagucucauuugguguuuuccuuagaagaucuauaucaccaaagauaaugucucuugcggcuaaucagaagugcuaaagccaggcuucuagaaugagaaggagaaaguggacaagcucacaccuuucgggccaacuaauaaaaacauauguagaagacuacacaugcuuuccugguggugcuggcagcggcugaggugcaugccuuuaaucccagcacuugggaggcagagacagguggauuucugaguucaaagccaaccugaucuacaguguguguuucaggacagccaggacuauacagagaaacccugucucaaaaaaaccaaaacaaaacaaaacagaaaacaacaacaacaauaacaacaaaaaaccacuacacaugcuaucuccccacugucuaucuucgguaaauuuucugacacugacuuucccauguugacuuuccauauguacguagacaaaccggugcugacauucugcuugguuuuuguucugauuuuuuuaagggaaugcgucccagaucuguaugacugcaaucuaagagauagauagauagauagauagauagauagauagauagauaagaaagagagcaagagcgagagcaagagagagagagagagaagagaagagaagagagagaagagaagagaagagaagagaagagaagagaagagaagagaagagaagagaagagaagggaaaggaaggaaggaaggaaggaaggaaggaaggaaggaaggaaggaaggaaggaaggugaaauaaaguaauggacaaagauauuuuucuuugaaaaaucuuuuaaacugaaauguaucaggcaaacugaugaaagauggggucaugaugaugugugauaaagacaucuguguugguacugaguauuucuguguugguacugaguauuucuguguugguacugaguauuuccucugucucaggaacauguccagaggaguuuaaaugccagacacuuaggaacuaucacuucacaaacaaacugcucugggcugcaaaggaauuccuaacuuuuuucaguuacauauugaguaaguggcacagucagaauucaaaccucaguaauaugacuccauagccacucacuccuguguuugccacacuggauguaaagcugucaucacaugcuuacagugaaaucaccuaguaacugacuccuuaucuccauuacagcggacugcagaaguccuaguaagccaaugcucagagagaacuugcaagaaaggagaaugacuuauuuguccuugguuguuguugggguguguguguguguguguguguguguguguguguguguaguuuaagaaagaauauagaggaagaagaaagggauaggggguagacuaguguuuuugguugauuagcagucauuagcacaaagcacaaggcagauggacacagaaaguaaaagcacuguggcacagguuagacucuaagucggcacagaguaaccaacaaaguagcagggccaguuaaaaugcuuuacaaguaaagccaacagggguaaagccugcuuucagagcacuguuuggaugcacaguucuguggaagagccuucuuguggaucccaugguaaaucaugauguggacauagcacauuuggguaucaaaacauaccugucuaacaaaggcauucagaagaucugucuucauuuaguucacugaugucaaugugacaggguuuaaucacucuggaacacauucugugagggguauuuuaguuuagguaaaugauauggaauggccaacccuaaauguggcaagaggacagugucccagacagcauuaaaugggagagacuaauagagcacaggcuucccuuucuuucugcuuccugagugcaguucaaaagugaguggcuauucccaaucuuacugaccaugccuuauccacuuaaaugggcugugcccucacauugugagccaaaauaaauccuuauuuccuuaaggugcucuugccagcuauuuugucaaaacaaaaaggaaagcagcuaauaaagucgcuuuaaugaaaaaaguaaccuuucaagacuuauuuucauaaauucauuguuuuuaauagcuauguacuauuguguaaauguaccacauuuucuguauccauuccucuguugagggacauccggguucuuuccagcuucuggcuauuauacauaaggcugcuaugaacauuguggaacauuuguccuuauuacauguuggagcaucauuuggauauaugcccaggagugguauugcuggauccuccaguaguacuauguccaauuuucugaggaaccaccaaacugauuuccagagugguuguaccagcuugcaaucccaccagugauggagauucuuauacaaauggauggaucuggaggauaucauccugagugagguaacccgaucacaaaagaacacacaugauaugcacucacugauaaguggaauuuaguccagaaucucagaauacccaaaauacaauuugcaaaacacaugaaacucaagaagaagggagaccaaaguguagguacuucuacucuucucagaauggagaacaaaaugcccauggaaggagcuacagagacaaaguguggaguagagacugaaggaaugacuauacugccccaccuggggaauccaucccauagauaaccaccaaaaccagacacuauuguggaugccaacaagagcuugcugacaggagccugauauagcugucuccugagaggcucugccagugccugacaaauacaaaaguggaugcucacagccauccauuggacugaacacaggguccccaaugaaggagcuagagaaaguacccaaggagcugaagggguuugcagccccauaggagaaacaacaauaugaacuaaccaguacccccagagcucccuggaacuaaaccaccaagcaaagaaaacacauggugggccucuggcucuagcuguauauguagcagaggauggccuagcuggucaucauugggaagagaagcucuugguccugugaaaguucuaugccccaauauaggggaaugccaggaccaggaagcaggaguggguggguuggugaguagggcaaugggagagaggauagaggguuuucagaggggaaacuaggaaaaggaauaacauuugaaauguaaauaaagaaaauaccuaauuuuuaaaaagacuuauuuucauuaauuugguuugugccucaguuuuuguaaacaaugaccacguuugaguauaauguauuauguucuuuaacauguggaaggauggguguauuauuucccuauuugagaauguccauuccuagaguaagaagcaggugggagagugugcuaaccagucauuugagggcuauccaguuuguguuucagaaucuaagcacaaccugacugucuggcccugugcuuuugaccuucuguuccagggccccaagucagcucuacccgaccuuguaguauucuggacugcacuuaggaagugcauuguuaacaaagccaggaucaagaucucacaaaacguucuccauuuuacaaaauguucuucccuaaaaacuaagaggguaaauaucauacaacauauuuaguguccucagacugauuuaaaggaggcuuuuuauaucaagagaguagaaaacucuguauaacagaaacauccucgagaaaaauggucuugcuucaagaaacaucugauauaacaaacuuccagcaaaauaaaccaauaugcaucaucuaucagguuuuucugccaucauucucuaaccuauaauacccagccuuacaaguaaauguacaaauggaauggcagauuuacugcccuccucagaagccaguguggauucagucuauugacgcuaagugagcaagcagcuacacuaagaacuuaguauuaacaagaaaccuacuggggcuucaaaccucucuaauuaagaagucuuaaagggagauuaucauccucuauugauguuuacuucugaaauuuagaacaaaacaguguaagcagaagguaccccaaggaacauuuuuggagaaaucccaacaauugcauaaagccacacagaugaaaugauuuaauuagcugggauaacacuucuucuaaagcauaugaagaggacucaugaaacucauaaaaagcucuguguuuucuugcaugugugagaguuuaagggugcuuaagagccuacuuuggaagauuugccuagucucccuugacagcaucguacucuugcuagaauuacaaaggacacugucaauaguacucucuaauugucucuguagaguuuagaacugggaggguaccauagagccuucccuaguuaagaaagaggaaauggauuuagggauuggauuuugucuaguguaggugaaaguacucaugcugggcucaggcugucugaaaagauggaaaggcuuuucuuaucguuccauuucuuuuugugucccauccaguguuugguuuugauaaugugcaguggacuuuguugauuguucuaauagcuaauuuuuguucauuuuuaaucacgucccuagguaacuuacuaauaaaacuaauuauacacaaaccuugucaccuggacaacuccuccacccccacccccuaccuacccucauguggagcaaauagucgauuuggucagguuuuugcuaucaaaauauuucuucucuuucuucacgugagauuucacugaugaaguagugugccaaaaaggaaugagaaaagggaaaaaaaugagauuugcugagcuuagcucuuuaguuuaauuuuuccuaacuacguauauacuuacuguuauaaaccuagggcucugauuguggccaaugaugcuacugagaauauugcuguguguucuacucuuuucccauaaaugcauguaaugugucuuaaauaagcuaaauucuauuguguagcauaccuucagaaauugaccacauuauugacacacuuaauaaauccuaaaacuccacuuagaauuuuaguuuugaacaauauaaaauuaguuuucaguuuacaaguguauuuuaccuaugaagcucauacacuaaagaguuuauaaaaaaucacaggagauuagaugugcugauaaaugucauuguggcuuauaaauauguaagaaauuuaggaauggaaggcguuauuaagaacugagauuuaaauaagaaaccauccccucaccucugucauauuguaagcccauagguagucugcacuggcugguuuugugucaacuugacacaagcuggaguuaucacagagaaaggagcuucaggugaggaaaugccuccaugagauacagccgugggguauuuucucaauuagugaucaaggugggaggcccccuuguggguugacuuaucacugagcugguagucuugaguuguauaagaaagcaagcugagcaagccaggggaagcaaaccgguaaguaauaucccuccuuugccuuuucaucagcuccugccuccaaguucuuguccugugugaguuucugucugacuucuuuggugaugaacagcaguguggaaguauaaacugaauaaacccuuuccuccccaacuugcuucuucagucaugauguuugugcaggaauagaaacccugacuaauacauaaucuuuguacuuuauugguagcaaaauuggcuaaugcaaccaaugaauauaaaaauauuucaauucagugauuuucauauauagauauuuauauguagguaaugcagugauacuugcauaaauauuuuucuacaaauauguucaucacgguuuguuuacacagcagaaaaauuggaagcaaacuaaauauguagcaauagggagauaucuguuagccauaauauauccauauuguggcauuauguaauaauuauaauauauuuaccuaagauuuucaugacacuggaaaacaucuauaaugaaaaaaacaaugaacaguuugagaauaaucuguauuauaaucauaguuguaauaugaagcuauuuauaaucauagaaauauauucuaaaauauacuaaaacauugucuugauuucugacaaaaaaaauguauuucucaauguuauuccauuacuacauauaaacauauauuacuuuguauuauuaauauauauuaagacuuauuaaaauguacuauuuaucaucugaaaggauaccuuacaucauuguuuguuggaauacaaagucuguauuccuucuggcugaaguuuaguaugcucaccuagaagcauggacuuguguaucucuaaguucccaaguccuacugacacgugaaaacauagaaaagauucucuuucccaguagaacuucuuccccugugccugcucccuuuguaugcgaugugagcaguggaagucuugacucaacaguaacugaggacuuacagagaagacuaaauaaggugucacaggcaauagacuagcaagguccaaggcagccagcuuaccuuaauacucauuuuuauuuucugucaccccucccacauaguaguuugcuaaaaaucggacaaaagugaaaauauuguuuugacuaggguugguaagguuuuccacuaguuaccauaaaacuucauaauauaaaguauuucugauaccugugaugccugacuagccagaaugugaagucucacucuugcuguacaggaagccucaaggauguuucauugaacaucucuaagucaaggaaaacccauuuuaccccuugauaaagguucuaguuugugagucaucuagugugcggugacaggguuuggccuaggacuguaauguuuuucugcaguaaaugugcauugaaaguagguuugaagcacauaugaaaauugucaugauuuagcugauuuccugugaaacaaucagaaaauacacuuuauauuuuuuguaugcagcaggguccuuuaauuuucaacuuagguaauacuuguaauucugagaaaguuagugauuucaacugcagagugauuuacagguaagguguucuagcacuagcuaaccuggcuggauguucuuaauacuuaucuaucugaugguaaucuagagaauauugaugucuauuacucauauauacauccauuuguccuuuguguaacaucaggaagguggcaagaaacagaaaauucaaaaucagaggacuaguuuuuaagcugugauauggccccucaugagccucaucacccaaaauaggucgcugaacacuucccaggucucaaucucgccauaacugaauauagaugcacauucagcagcagcuacaggucuagccaucagcugaaguagauauaugagggauauuuuagaugagaccaguaagccuacauggaaguugaauuuugcuucuaucuagguugugcuauuugcaauaaugaguauaucuuguugcuuaggaagcauucacacuuguggugguuugaauaagaauagcccaauaggcuuauaugauuaaauacuuggucccacuugauggaacuguuuaguaaggaugaggaaguguggccuuuguugaaagagguaugccaaaggguggacuugagauuucaaaagacuggcacacucccagccccucccuccugcuucuggaucaagauguaaauuucccuucuuuuuuuuuuuuuuaaguuuucauaacacuuuuuuuuauugcuuuuauuuuuuacagucuagucguugucccccucuugguccauccucccacaguuccucaucccauuccuccucccccugucuccaagaugauguuuccuuuuuuuuuuuuuuucauuuuuuuuuauuacguauuuucuucaauuacauuuccaaugcuaucccaaaagucccccaaaccccccccacuccccuacccacccauucccauuuuuuggcccuggcguuccccuguacuggggcauguaaaguuugccuaaccaaugggccucucuuuccagugauggccgacuaggucaucuuuugauacauaugcagcuagagucaagagcuccgggguacugguuaguucauaauguuguuccaccgauaggguuacagaucucuuuagcuccuuggauacuuucucuagcuccuccacugggggcccugugauccacccaauaguugacugugagcauccacuucuguguuugcuaggccccggccuagucucacaagggacagcuauaucaccguccuugcaacaaaggcuugcuaguguaugcaauggugucaucauuuggaggcuaauuaugggauggaucccuggauauggcagucucuagauggaccauccuuuugucucagcuccaaacuuugucucugaaacuccuuucaugggugauuguuuccaauucuaagaaugagcaaaggucugagcagcacccggguagcuagaguaaauuccccuucuauuccaguggugaugccuuugugcugccaccauagacucuagcccucuaaacauaagcccaguuaaauucugucauuuauaaguugacuuggcccugcugucuuaucacagcaacagaaaccuaagacaacagguuaacugcguauucuugauuucagagcuuugacuuagauggaguuggucucugaugcauauagucauagcccuccugccuuuugauugaauacugcuggguuagcuguaaucugugcuauauuguaaaguuuaaagagcuggauagaugcuuuuuaaguaagauuauaucacauuuucuggugucuuguucauguuuuggaaacacaagguuaauggaaugauuccaagaaugauagauuugugaaagcaaauucagauuuguuuuaaugcacaaaucccuuguugauugcucagggcaaacaucuuaguuuuugaauauauagaugauauaaaugaaauguaguguuuuaacaucuauguguggcacaugacauugugauguuaaaauuuacauuuggucauauuuuagagaugagcaaauuaaauuuuuuaucuucucuauauuagucuccuucuuuuacauuagaauauuuuccauaaggaagcucucagaugaacccaccaucuuucuuuccuugauauuagacacaaauacaucuuuaauuuuauauuuuuguuguuguuauaauuugauuuuagucugguuuaaugagucaaggaucccuauguagcccagguugacaucaaaugugugaucuucuugcaucaccguuuaacuaguggcuuuacacacaugugccauaaugccugacuagagaauuauuugcacuuaucugugauucauuguucuauccuuuggguagucugcuuaugucuuaacucuuuaaagacucaaagugacagacuauuucugggugauuuguuuuccuuucuagagaaagauuucuguuaggagauuaaguaaaaucaagaucucuccagcauaagagauacuugaagugagggugaaggcuggugacauucagguggggcuaaacaaaccaaccaaccagauccucagaguuugagacaaguucuuacugacagaacuauugcuuccucuggcacuccugaucaguaagaguucauuuacuugccuacuuuacuugagucuggcuucuagaaggcuugcauuuggaauuucuguucuuacugagagagagagagagagagagagagagagagagagagagagagaagagauagcuuuauaauuacuauguaagaacuauaaagugggaaagaauacauuggcaaggcauauuacaauuacuuugucaugcaucugguuauguuggcauauuuguuuaauuaaauucccuucuaauuauaacuguauguacucguguuaauuauuauuugcuuaacacaggcaauagcguaauucuucaaaagaaagcaacucacuuucuauuuaaauuaaauucuaauuuaauaugcuuccuaaaauaauaguagugacauuucauuagaacaguaguugaaaaauauuuaucuaccucacugaaguuuggacuguuuaaauucaacaaaauuguuucuacaucagguaguaauugggacucuuaaaaguucuagaguaaaauguuuaguguuauuacacccucaaaugaugcuauacaugguucaucuacugaaagauacacuguuacccuuuaaggagaaucuaucugccuuuuaaaacguucuucuugccuacugcugaaaggggaaaguguuaguacuuuagaaugacuuuauagacuggccaguguuauucacccuuaauacauucacacgccccaaucacaugguugugaucacccauauccuuaguguguagguugucucaugauuauaaguccuucauuaauuuuaaaaagugaauucccaguggaauugagucuuacccaucuucauggucucuuuccauucucagauuugaaauuuugugucucuauagaaaccucaugccugcaucauuuaucacacauuguguguuggggagcagggacuugcacacauacugggaaacuggaaacuccuauccacauaacuaacugccuuccucucucccucccucucuccuucccuuccucccuauuuucaagacagaaucucuauauguagcccaggcuggcuucaacuuaagcccuuccuggauuauucccuagaguguuggggucuaagcaccacaccuuacuaacuccacuuuguggcacaggccugauugccaucuucguuugaauuguugguuuguuuucuauguauuuaaaaguagcuuugucuuucuaagcagagcugaaaacuuguguaugucauucuuacuaguuauucucuguaauucauaccaggaauuucuuuugcuaucugaagaucuugaucuuugauccagagagaauugaguuucaaauaugccucuugaaguaaauugcuaauuccuuaagcuucugaauucuuauuuauaaggcauggcuaccauaaacacaaagaaauggucaaauggaauaacacaaauaaagccucuagcucacaaugcuuauucauuauauuuauaauauuuggacauuugucauguucuaaacuuacugugugcaugcaggugaauuucuguugucauauccucccgucuguuucgagagacagguuaacagauaagacaggcaaugccaaaaucagugccuuucaaguuucuauggcaguagaagauauuuucuauugaaauguuacauaaauccauaugagauuuaugugaaacauagaaguauaauuucuguccuugaaacauaagagcuauuugugcccuucugaaucauaucugaaaaaucaugucaucugagauccauaauuuaaagcuacugaaauaauuuugacucauucaaagugaauguccauaugucagguaugguggaggugcuugaaaugauaauaaauuauggucuagcccuccaccucaaacuucaacaauucauagucaaauauacaaacucuuccaacucugauaguuaggaacucuagauugaaaauaaaagcaucaauaguuauaaacaaauaugcuuagcuaggcaggauauauaacuacauaagggcuauagaguuauguucauccacagaccaaucugggagaguuuucguuaaugauggcuuuaacaauuugggauuugguugcugagaaugguaaggaauauccaacuaauugaacccuuggugagcucaucaaggauuaacaaagaagacauagagacuggguaggauauagcaagcauuccucaaugcuuuuaaguggcacagacagaacuagggaguugaaaaugaaaugggcugaaaugagucaguuaucagauaauaugggaauuuagugguaagaugagcuacuguggcuuuuaaucaagaaaaaaugcuacauggaaaccuuguacaccuggaauacauacccauaucaacuauaaauaggcaaccuauacacguuaaugaugaaucccuagaguuuauaacauacuagugaaucuauucauuuacaacaguagcuauaccauggaaccuaaaaaccaaauguagguagcaagcuuuaauuagcaaaauguaguacuacaguguuuucuagaagaaaucccuuucuaguaaccacaaauuauaccagccucauaggaaaguauuaucuaauaucuauauaaucacaauuuaguuaaacuccuaaaauuugaugcugaauuugggacaaauguccaguucaauguuauagaugcuguuugauugacaauuagcaguuuaagaugcaaggaaaaaaagaacauaguccuucucagaugccucagaugccuagugacagagcugguaaguaaagagauaauuugacaguacuguaguaaguguuacagaggaaauagagagagagauugaauaagcagaaaagagaaugccauccuagaguggucaucagguauaucacagaguggguggccauacucaaggcagugugagcaugcacgagccaauugcugaccuucugaagaucaccuuccauuucuacauuuagugauuaucacaaaaaauugugauaacucagugugaaaaugcacaauaaaaggcuuggaguauugguuguucaaaaauauacugguuucuuuuuuaauguugacaacugcuggccuuucguuauaaagguggccauauauugguguuuggaagcaguugagcuugucagccauauaaaauggaggcuuuuauuuccuauuaacgcaccauuuuucucuaagacauuaagcaggacaugcauuugauccaucaaaucucuuuguccucagguugugucugguuuuuauuccaauuuucaggucugucugcacacaucuaugccuugagccauguagcucauagagggacacuugauuuauucugauaaucuccuuuauuagcaacugcgaagagcuaucauuuauuuaaggaacaaaaaucuuacuagagagaaacuuuugguuaauuuucuaacaaggaagaaaauuucuaaagcagucuaccagaguuauuuccuaagcaagaccaaugauaacaggauuacagcaguuuugaacuuuucuuuuauucucuuuaacaugaagguuuucuauccaaaggaggcaguuuuuguucagugucugcuuccauguuugaagacucauuagcagucacuacagggagccucacacuucuagcuuaccucccuuuuuguccagcacagaauugcuuuucuuuggguuacugcaagggcuuuuguuuugccggcuucaucgugugcauuuuaaacaugcucaccuuuaccaagacgagcauuaauaaaauaaccaaauuguacaucaggaaagaauaaaucguugcuuuggcauauagugaaaucaucgagugucacguucugugugggaugccaucuucacugcuccuuuacuuguuuccaucauuuuugcucacuacgauuuuucucauuuaacuuaugcuuaccccaggguugcguucaauguauaucuauggagaaacuaagaguugggaaaucaaacaugguguuuacuauccuguauucacuggggaggggcuccccaccaaggucugucugauuccagaguacaugcuuuugaacaucucuuugauccuucugcguucuuggaaaguagccuaguucucacuguaaacuauaacugacugcuagcgacaguaguuauugguucauugcuacauaauguuguaaacauuggaagugagcuauaugcaauacagaguuaauaaauguuuauuccgcaagugugguuuuguuaauaauagcuguacauuguugcagacacugagauaaguuuuuaaaaucuuacauauagcugcuaaaacauaagcaaaguaauuguaggcccuaagguaaaacugaaauguagagcauuuguacaguauacccaagguucuggguuugaacccaagcacuggagaaaaaaaauuauaucugaucucuuacccacaauucccaauucuaaaaagcuguaagaggugaguguuuuaguguuugcaaaaguagauauaaugaauauaaugcuuggccuaccuaauaaaaagcuacaugugacauuuauucaaaccuuuuaaaauauucaugcaugaauuugauuauaagugacuacacaaaauuaucucaccaaguuagagaacauauagacaaucccuugcauaaccuuucggagauuugaccuuugaauuguugacugugugguccuugcaguuuuagagaaggaauuguaucccugcagacugagcaggugcagcaucccagggaaagaaaugacacuuucccucggagacagaaaggcucacggcagagaaggcacaaaaguggugcugagugucuagacagagcuaaggucagggagcaggacagaugacugugaagaaacugacuuguaaggccacaaaggaaauguggccacucugcaccucauuauggaggucuuuauugccccuggccagguuuuucuuuagcugggugcucaggaggacugggaaggccuugagcagaguagucgcccucaucccauuuuuuacuuuaaagacuucucugucuguacaguauaaagccauaauauuauaagcaugguuagaagugaugauucaaaccaaggcaguagaaacaagaaaaggcugaaaggaggaagaguuugaugacagagaaaaguggacagggacuagauacuugcugcucuuccagaggaguacacuccagcucugagcaccauugguguaguaccugcagcacacacacacacacacacacacacacacagagagagagagagagagagagagagagagacagagagagacagagaaaucaaaaucaaaauaaauuagaaagaaagaaagaagaaagagagagagaaagaagaaugaaaggaagaaagaacgaaagaacgaaagaacgaaagaacgaaagaacgaaagaacgaaagaaagaaagaaagaaagaaagaaagaaagaaagaaagaaagaaagaaaggucuacuagguggaugugucaggcuuucuuguguugcuagugcacucuuuuguuauacuuuuauacccuuacuggauaaacaucuucagcagcauauuuagcacuaugccucaaugcaaaauuauuaaugauaagugcugcauagaggguguauagauacgagugcagauaaacaagcuuauccauuuuacuguucauuuagcaaacagucuguuugcuuucuuaaaccuuauaucaccucucaguaccaaauaagauacuagauaaguauuauggaaaaucuaauauacagcccagauuuugauuuucaaaauagaagucacuuaacuaauauuuugauaagcagauuauaaauagucacuauauaaauacucaguuuuauuggcuguggcagcaagugacuguuuaagugaagaucauagcacaauuaagaauauaauuguuuucauccucuggauaaaguuuaacaacuugauuuucuuuccgauaauccccaguggaucuaccuuccaacauuccccaguaugccucagcacggccaaaucaucagcaaccauuagaacugacuaguccacaggugaaaguuucucuuuagacccuuggugcugggauuucucaauucccaccuuacuucuccuguggagggaagauggaaacagauaugucuauugaggagagucugucugacaacuuuauacuugcucuguuuucucuagggccuucuguuuacuuaaugaauacuuauucauuacuuuauuuuguuagaaaaacgggcccauaaccaaaacuggacauauaucuaacugugaaaacauacccugacuuuucuaugcuguuuuguuuaauuccaucuauccacacuaacuguaccccaguauaaaaacuccaauuuggucuuuuagccaguaacacuaauuagaaugcuaaucugauucccaaccccggaauucacaaaugguuacagaugggcaugguacccacucuaggauggcacagauaagaguuaccaaggauuuguugcuucucauauaacgucugucagcugacacucuuugguauuguuucauucggcccuguuugcugauguugcuugcuugguugcagaauauugaugaguaaucuuguggauggaaaaaauaaaguagggaaaauugcuuacuuucuguguugauucagccccauuccaucuuaacccccuaguuagagcacaucaguaaugauucugucucugcaguucauuccuaaauaaaauuaauuggaaacuagauagcuuccuaauaacuaugcuuguuuuugcauaauagaaggagaaaaggauuaaauucuuuguucuaauuaauaggaaugaaaauagaauugcaaucuuguggcauggcaaaaugagagaaaauaaggcuuguaaguaauuuucaugguuguuuaggaauaauuguuucauuauugaguuaauaguuuuuacaaacagcuuccauucccauaucauauuucugcagucacucuuuauugagauugccaaggcagaggaugacaugaaguuguuuuaaauccaucacuuguuuaaaaaaaugaguucccaaauuguuaguggggaagaaugagguauaggaggaaaagaaagggucagauggaaaucacuugguuaauaagacaacaaaauccauucaccagcuuguuucaaaggagacucuuauuauucuggaaagaaauuagacaucagaucccucauaggccccaggcucugacauguguuuuauaaugacaguuaauuagauacugucugcagcaaucauaggcugucauuucuaauacauuucugggaaguugaaggacaggagaagucaucccccuccccuucuucccccuucccguaacuaaaaaacgguugccaaaauuaacuaugaauauaugaggcgcaaguucaacaauuaugcagccguggugcacauucgugucuucuauuuaguaugugcccugcauuucaggcugugccaggcaagcauucugcagaccaagauguaacggcagcacuggaaauguuuaggagcagcccccacagcgguugcuaacaccuggucuuugggaaggugccacugucacugcaacuuaggcagcagagcacagagcacuucaguauugaaucaaaccaccaagucccucucuguauuaaaguaguucucauugcauuaauugaaguuacuucuuuuuuuuuuuuuuuuuuuucuguuuagaacaaucuuaaauugggguagccccuguggugguuguuauccuaaguuguucgugaccucuguuguaagcaucauuauaacaagacaauaaaguauucuuugaaggaaacuaagccaugagauacaaaccuuugcuuauggaaguuuaaaaucuuagauugucaaaauguuaagguucauagagauuaucuaguccaauuuuuuuccuguacaaagacauuugagacccaaaaguaauugacuaagacacugcagugagcuggauuuagugucuugaguuauagacugguauuuuuccccccugagaagcauugacucuugguuuauuauccugguaauugugauccaaucacaggaauugucuaaggcugaguuagucuguaaaauggacauaggaaaaacauacaccucccagagccacagugcaugugaguggggaagauacagucuucuccaggguugcaagcaaaggugugcccucauugucucuaucaugccaucagcauuucuaugugcaugucuaaggacacauagagaagcuccauucccuuucuaauuggaaauugggcucuucuuuuuaaaacaucauuuuauuuauguacauuccaaauguuguccucccucccuguccucccucccagaguucuucaccccauucccauuccccuugcccuuuggcucuaagaggguguucccccaccucaccucaccuccuccucaggcuucacccuucccugggaaaucaagucucuacaggacuagguacaucaucucucacugaggccagauaagacaguccucugcuacaugugugccugggggcagggguggggguggagguagacaugguaggggguggagguaggcccauguuucauguaugcucuuugguugguggcuuagucucugggagcugagaagucugaguuaguugacacuguuggucuuccuaugggguugccauccccuucagcuccucaauccuuccccuaaaucuuccacaggggucccugacuucaguccagugguugucuaugucugcaucugucucagucagcugcugguagaggcucucaguggacaaccaugcuagguuccugucugcaaucacaucauagcaucaauaauagugucagaguuuggugcccacccaugggauggaucccaaauuagaucugucacucguuggccguuccuucagucucugcuccauuuuugucccuuuauuucuuuaugacaggaaaaauucugggucaaaacuuuugaaggugggguggugacccccauccuuccacuggggacccuguccauccacuggggguggucucuucagguuccaucuccccacuguugggcauuuuagcuaaagucaucccuauugaauucugggagccucucauauuccaggcuucugggacuuucuagagguuccuccuacaacacccccacccccaaagaagcugcauauuuucauucauucucauggcccucugggcuucucuucugucucccuccacaccugaucaugccuccccuuuccccuccccuuccccucuuccacucaggucccucacuccuucugucucccaugauuauuuuguuccaguucuaaguaguguugaagcaucuucacuugggccuuccuucuuguuaaacuucuuugaucuauggguuggaucauggguauucuguacuuuuuggcuaauccauuuaucaguuaguacauaccauguauguccuuuugagucugggcuaucucacucaggaugauauuuccuacgugagagaggaaaauagcauaguaugucugcuauuguuuuuauuguugugguugacuugacaugagcuaaagucaucuggaaagagggaacaucaauugagaagauuccuguauuauauuggucuguaagcaagucuguagaguauuuucuugaucaaugauugauguggaagagcccagccuauugugggaaguaccaccccuggacagguggaucaggguuauuuaaaacaaaacaaaacaaaaacaaaaacaagcuuugcgacccauagaaaucauauccaguaucaccuaucaccgcugcuucaguugcugccccuguaagauaaacccuuuucuccucaaauuucuuuuggucauggucuuuaucacacuaggaaagcgaacuaauaggcuauguuuguugugugccauuguaauaaaauauucaaaccagauaaagagaauaaaguuauuuacacuuuccauuuuagagguuccauuccaaguucuagcuguaccauuuguuuugagccucuagcaugguagggguucucauuggaggaaggcacuuauuuuauaagcaagaaacaaagagaugauggcaaagauuggaauccagaauccccuuugagcucaugaccccagagaccaccucccagacuggccucaccuccuaaagcuccuaauagcaucacucauucugaagucuaggccucaaacacacauauaggagauucucacccaaacccuaacacauggauaaagcaucaauaugacuaagcauacauauaugugaaaucuucuuuuuuucaugucuccugcaagguuuccuugaucccacagacuuuuuccuucucuucugcuuuguggaucauccugugugcacauacagcaagauggauaugauaccauaacgccuguaaagcauugucuguuggccauuuugaauauucuggaaucuacaaaacaauugauguuuuuuuauguucuuaaaacuucagacaaguguuucuaggacauaguuaggcuuguguuaagggaacauaaaaguuaccaucaguucuuuguuauguccauacuauuuuggcuucuagucucggaggaguucauaucuuuggauauccuuagguaaucuguagagaaaacacgcuuagaccauaaaaacaagguacaccucuauuucuaguugaccuaacaggcaaaggaaggaacaaauuacaguaccuacuucaagaauguguuaccugcaugaggaaacugaauuguuuuguuucuuuuugcuauugucucuuuacugguggauaggaaucucuucuacaucugccauuugacaagaagaguacaaguuuugaugucucuauguuguugcucaauuaaacagcaggguaguacguacuucagagacugccccuccguucacuuucucacacugcuggcuucacuaacacaauuuguacaugaguuucaguucuauauucacucacuauucagucuucuuucaggagcuaauugaaaaucuugccucuuguuucagacauuuggcacauguuaccccaagcccaauuccuuuguguggcaaaagggaccaugaaagaaggcuaauugaccuuuuugugaauaaaggacuucaaaauucgaaugaugaaucaggguccguuaugaauguagacaugauucauuuauuacucucauuagccuuuagugugugaaagagucaacucauguuuaauuuguguccuuuuacaucaucaacauauuauuuuuuaggaguuaucaaauguucaagagcuaacauuuggcuuggagcaaaccuauucauaugccaaauaauuuggcugaaguucagaaaacuguugauuuggguguucagugauguccuucaaaaacuccagcuuuuauguuucuugauugcaggcuggaugccacgaacuuguccccacuucacucauacccugcugauugcuuuguaucaagugcuuaccuaugaugcacuaugguauaacaaacacgaaacaaaacuguccuauaacaaaaaagcuccuguagcuaucuagaaaguaacuaugacagaaucaaaaacaaaaaaaauaaaacaagcaaaugaucaaaaaaaaaaaggggggggucuuaaaucucuuuuaaauacaagacuaccuucaggagcaagaaaauaguuucauuuguaguuucacauguuguuuuaaguaucuuuuguugcaguugaauauuuaguaaaaugggauuuuaaguucuauaugguuuuauuaggaucaucaacaauucuuguuccuuaucaaggaagguucuuucggcuugguauuuaccagacucucuaauuaaaacccauagaguaguguaugugaauagcucuuguaguguaugugaauaacaggaucauuuaaauuuuauuucaccagaauacauuuuaaagaaaccuuuuugcugcuuccucuauuuagaucagauggaaagacauuauauggcaguaaaauacuuucugcugaggguccuguagcaguccuuucucaggugguaaaaagugauuccacacuaccaauguuuuucuucuaaauaaaacggcaaggcaguauuacgagugcuggcugaagccaggcaugguggcgcacgccuucaaucccagcacugagggggcagguggguuugugaguuugaggccagacagggcuacauacugagauccuaccucaaaaauaaacaaaaacggaaaauugcugauguaaucauggaugccuuacuuggaauugugguuagaaucuacuguccaguauagauaaugcaugugauugcagaccuuagauggggucugagauaaaauuggguaugcagacuuggaaccagacuguuguuucagaucauggccaauuaccugugcuguacagcacugugugagcuccagaagguugucucaucgcuuugugccuucacuuucccgacccagaauaugacucaguaacaguagagucaccuuuuguaaggacuaaacuuguucauacauaugaaguuacuugaacugucucuggcauguauauaauuuauuaugcauauggauauaugauauacauaagacuauuuccauaggcagguaaaauguuuguuuuaguauuauacccaguccaaguaguauucucuuccuugggaaucagugauauuugcaagcgaggucucuaauaguuuuuaccuauuuaauaauuaaaagucauuaugaaagguuaacaaacuguauuugauugaugagcauagcucuuaugcuacuccaaauauuuaaauuuuagacaagacugaaguguaauuaguacaaaagaaggguccaaaauauuaaaaaugggaauuuugacccaaauuuccaucuaugccacuuuauguuggcuagugucuuaguggcuauuuaaugaaggaauccaaaaggaaaccaagucuuucaugaacuuauuauuguuauuaauaguaauaucaguguuauguggggcuuggccagaaauaaagguucacugugguccucacuuccuuccagaguacaaccacaguccuguaacagcuuagcucuucccaccauuguucauuuggaguaucagcauagccaagcuuuugagcuguuuuccacuuuguggugucacaaagcagaacaaacgcuacucaagcaauaacuauguuaucuaaucccugauuagucuacugcuagggauccuccucuccuuuaauuuaauucuacuaaaaagcuaacaagauuccuuucccuucugauuuagccucauaugggcugcaucagugauucuuaaguaaguuguuacaguguuaauuaagauuuuguggucaggcuccauccuuuaauagauaugauaggauuugacuuccucuguauuuucaaguaagcaaccuucaaacauucuaugaucucucuacuacugagaagauuugauacacuggagggaugcugaagcaacaagccgucuauugauuugucuuugaguauaauugacucaucccuaagaaccuugggugcaaaaggaccccuagaaucuccguuuguuuuuugguuguuuguuuuuacuguggaguugcauugggaagcuaaucuuguucaggucugccacaggcuuugcuuucagauacucacaguuaugccuacugcccucuucauucuaucagugaaaaguuuaaauacuaugcccuccucuauuaaaaugggguuucuuuucuuuuuagugacuuucucaauacuacuaacucuuuauuugugcuucagugcuagguuaaagaaaaauguggguuuguaguacuauaauauucaaagaguagaaaaacaagagacagaagaacaguuuaauaccugggaaccacagcuucuaaacuuuuuagaacuuaccucagccucuggaucauucaggaaagucuauguacugacuuguagauucaggucagagacucauccccauaguuugcccuggagacauuaguauauuuagggggaacuaggaaaagcagccacuuagugauaggggaauguuagaacuaauagucacuagcagugcuugacagccagcuguauuuucaucucuguugaucaaaguaucgccuaauaucuuagcauuuagaguuaauaugcuuucuaaaaucccacuuucuucauauuugaaauaagucuuuguuccuuuaguugcuuucuaagaaccuuuuaauuacaauuugaucauauaauuugucagaauugccacaccaauaaaauuuuguuuuguuuuucuaaaucuagaaagggaaacaugaacaauaugagcagccccgucuauguguuacagugagaauuugucauuaaacauauuuuagcuggcuuuucauauuaauagagagacagccuuuucacuaaggcuugaaaacacucccggauucaacagaaguccaucaaaagaguuuugcacaaauaaaucuugugugucaugucuccuuuucuuucccagaauucuacuauaauaagaucccagauuggguggaaaugacucaguuucuacaagacaugccauacccaguccuuggcaaggaguaucuaagaaaucauggccugucacaaaccuccaaagaucuacaggaccuguaaauccuacaccccacagcagauucucucauuuggugaucugucaggaauauccacaaugacaacagcuuacauuagcauggugauauauuuuuaaauugagaauuaaccuuuguuggcuaaaauugaaaaugagaauugaaugcacuagagaaaacucuuguucuaaccugagcuucauauugacugcucacaaagcuggaaagaugaccuuucauugcuguagagucacaaggccaugcauaaucagccacucucacaauaguagauuacaauuccuauguucccaccaugcuuugguucuaaaaacuaaugucaauuuuuaaggauuuuuucugugguacaucaucuaaaagcacaagucugaagcuauuuaugguuuagugggugaagggcuuuugucacagaagcaugagggccugaguucaaauccacagaacccagacaaaagacagaauacugcaugucuguaaucacagcaauccccugaaugaggggacauggaggucugagaguccccaaaaccuucugggucacugugcuggcuuauuuuaugacaucuugacauaagcuagagucaucugagaggagggaacccccaauugagaaaaggccucuauaagacugagcuguaggaaagucuauagagcccagcccauugcagguggagucaucccugagcuggugguccuggacucuauaagaaagcaugcuggacaagccacggggagcaagccaguacacaacacccuccaugcacucugcaucuugccucuagguuccugcccugccuuccuucagugauggacuaugauguggaaauguaagcuaaauaaacccuuuccuccccuacgaacaauacagcaagaguugguagacuugagcguagggucuguguuugacauguacaacuuccauuucuugaggaugucauuucccuucucuaggauuguuucuuugucugcagaauguaaauacuggaauagcaaggaggauagacagucuuuucuuucaaaaguucacugauccauucaauaacuaggcuaaaccuugaugauagcagcccucaaaacccauauacucaaaucuuuugggguacuugguauauauguagagaauuuucugcauuuccaugagguccauaccugauucaucauggucauuagacuggaccgguagaaaccugggcugaaauucccaacuguacucuuggcuuggucacagcccuuaugcccgggcauguugucugacuuaucuuuaguucuaccagcugcaaacacaaacaaggcuuccuucccgacaagcugugugaugaaugacagcacgauagucuuguugugucagcagcaaccuaugcugauguuaauuauaaccuugugguuucuguuuccuauuagagcugugccuuuguccuccuagcucuugagguguuuuucuacuuauuuguauuagggaugaggacagccaaguuggcucugcaacagaaggcugccaaguaucauaacugaauuauaguguuuacugaaaccaguaucucuuaagcuuuuguuuaaaccauguuaacuuucauagcucagaggaauucaucaauccugacuacuaguuauuugucaaaaugcuacauuaggaaauaaaauguuucugcauaucuagguuuccuaaaauaaauguaaccucugaggguaugcaagcauucuaggauucauacuaguuagaugcuugggccccugggcuuacaaauaagcaaauauccuuccuugguuuuggaaaacuguuggauuauuucagaucacacacauacacccaucuuuggggccuuaagggcauuaacauuaauggaagugaugcaaaauucaauuagaaauuaucugaugcucccugcaugucgauuucacucuacaaggagccucuucugcagaaucugccugaacagaugagacucggcacaggcagggagaaagcugucagaggagaaauuucaaauaagggcagaaaaaugaucccaacaugggagcccucuucacagcauuacccuuagcagaaguagagccuagggcaagucacauuauaauagaccuaaaauauuuuaaaugaaugccaaggaagacugcuacuuuagauuaaauguuccuaggacuagaguaaauaaccauaauugaacaugcagagagacuauagugauaucaaagucugauugcauuguguggacuauacaggacaaaauaagguucuggagaccuauuuccuggcuuaaagggcaugacacuaauggauucuacccuagucacaagccugaggcaugggagagaaucaugccagaguggaaagacucaaauaucaagacagaccaggguuuaaauucaagcuguguccuucaauucccuaguggcuuucagcaaacuacuguacuucaucuuuaaaaugagaauaaugugauugggccuugugguacaugucuguaaucccaacacuuagaagacuaaaacaggaguaauguaagaguacauacaaauaaacacaaaaacacauacauagaaaagugauaucagucucauagagguucuaggaagacuagaagugaagcucauauucauucugaugguacuugauaucauagcauucagcaaaguauuuuuauuuauuuacuuauuuaauguauauggcuguuuuaccuacaugugugucugagauauauauauauguauguauauauauauauauauauguauauauauauauauauacauacauacauacacacauauauauacacauauauucacacacauauauauauacauauauauacacauauauacauguauaugaguguauauauauauauacacauauguguguguguguauacauuuagcuucuuccuaauaguguauacacacacacacucacacacauauggcccuuggaagccagaagcgaguguuugauccuuuaggacauugugagucaucaugugggugcuaggaauuaugaaauaucugguuguuuuucauaugauucaguuugcuuucuguggacagcguaugaaugugauaaauucuucauacuuccauccuuauguuccuacauaaugaaagaguagucaguucuuuuaaccacugaguugccucaccaaugacccucaauaaauguuuaaagaccuucugugauacauauuuuaucauggacaugaaccuuuacauaucuugaaaauuuuaccuuuuuagcugcuuccuaauaguuggaaauuucagaauauuuaugucuucauuuucuaagccucauugcugcauagacuacuagauacuacuaagauuagacauaucaguaaacuaggguuugacuguaguugauuccugaaaaaauauuauauucaugaacacacaaagaauaucauacuaacauuugaagcacggcuguguguggcaucaucaucacgaggcaugguccuggccgucauacuguuuucgauuccuguaggaguuaucugcucuuaugaacaaagaaauaacaugauuccuagugcacagggccaaaacguucaucucauucaucaugccaaaucguucaucaaucuuuauguucucgaacucuugaugcauugagaaagucuagugaagcucccaucuacugaacugugaagaguucaguguaagggaugauugcuuguagguugcuuuaaaaacuauaaaugaucuggaaagaaagaagguucaggcuuugaaaacucaaaaugcuggcuuuguuauuucuucucucauuacaauauaccugaaguacagaugcuccaaaucaguuaauaggugugaggcugagaugcuuucaguuucuaauagauuauuuuauguaguuuaauuucuuagauauuuaguugaugacaugaaaagaaaauuucauauguaguacaugaaauaucaguugucauaugauuugguuugcuuccuuuggacaaccuaugaagugauaaauucuccauaccuccaucuucauguuucuauauaauagaaaccaaucauuuaaaagcauuuuuauuccauguucuaugauuuucuugguaauuacauauuaauaauuucgaucaauaaaauaugagcacauagccuccuccuuguucccuuuucuccuucaucaccaucucucacuauguaaaaggucaaguguaagaacugauaacguguggcagguauugaacucuuguggccauucccucuucaagggaccauuaaauuaaaaggacagaaaaauauaccuuugguaucuuaauuugaucauucuaauugaggaaauacaccuuuaaauuacuuaguguguauacucaccugaucauuuauuugcuuucuaauuuggaaccuuagucuuugccuuucugaguuuaucuccaauuaaugaaaugacauguagagaaucccaaacaucaauauucaggagauugaacaucagcuuuggccugagucuuuuuccucuuccucuguauagaccaugcuuguugcguguggcauugcuagugggcuccuucugggagcggacagcagagucugguuauaaugacacuuucagauuuguucugagucuguaauuaaaugacaucacugagucuuuaaugcaucugcuaugaaaguuggaaggcuaaauuaucccauuaaagagagaaaagugucacuggguguuaaaagaucccaaguuuaguaugcuguacaguugcuucaggaaagcuguuccaagccaguugaacauggagcacagugggaaggcugugagccuggaaggccgugugguucagaacaagcuguucacgauccacagcugcacuuggacuaacuuuuuaaaacagagccauuaaaaaacaucuucugccuuuucaaaugcaaggaacuccuugccugcuguuucuuaugcucuuagcugugcuauuccaggcaugccagaaaauauuuguagcguaugaccucauaaucaucuauuccuucuaucucacaguuaaucugucaagccuuuuauaaggauagacugauuagacaggaagagccauggcuuacuuguauauagacgacuccauauucucuuuccucccaaagcccuuguucauguucucugaacuacuuguauucuuacaucguuagcacuuuaaaugccacgacuuuuaguuucaggguuuaaaagaagagguggaacuguaaauaggaaccuguguuaaacuuaaaucuuaagucuuaguuuauaucccaacuucuuccuuauauaccagauauaaucauuaagggguuguuuucacugcaggcaaaggacaugggggucugguguguagccaagagauagacuugugccuaguauggaugaagcccuagguugagucuucagaacagagggaaggaaaagaaggaagaagaaagugggaaaagaaauguaauauuaaagagggaaagguaguuuuggaaggauacuguaaucccauaaaaaugcuagagaccucauaagacucuguggccuaacaguccuaguuaucacccacuccuaaguuacagaccucacacuggccaacugucuuaagauacuggacagaucaguguagccacaguaaagccacacauuacaauaaauggcuucaaagaaucuccuuuucugggguuauggguccuucuuuaagaagaagacuaaggaugccaccuccaaagcucauguguuuuuggauuagguuuagguaaggacacaucaagaauuucauacaguauggaccagguucagguaguuuuguagcauagcauaaguccuagaaauguagcaacaguugucauaacaucuucagaaucugggaaguguggaacgcugguccuaaaagccaaugaccacucauaaguucuggacucuaccaggaugcauuuucuggcuuucauuguuugcaacuucuucccuagucaacaaaagaccacacagcauccaacagugaugauguuaucagcccauggaagggugauuuaauauuucauuaaauuuuguauguauguauguauuuagguguguguguguguguguguguguguguguguguguguguguguguguagagcaacaguuaaagaaauagaggccaugaauugauagagaauuggguggguucaggagaaggguuaguagaagaaaagggaagaagguagaugaugucauuauauuuuaauuacagcaagaaaaaaaggaaaacuaucugccuauaugugcaugcagucauacaagaaaauagaaaagagacugcuacgcuuuuuuuuuaaucccuucaaaugguauuacuugacuuauauguauucaaaauccacucugcuuagaguauugagauaaaaccgugaaaacuaaagaugucaaaucagguccugcauuucuaugcauuaguuaauaauauaagacaaacacagaaggagcuauuauacaguuagacuucaagauuguaaauaaacucaaggugaucauacuauagaugcaaagagcuuuaugcauaaaauaggaaggauuuaugacuagcaacaguaauuauaaguagcauuuauugagcauuugggucagguacuacagugaguacuuuuuagggguuaauucauuuaauugcucaccauauaggugauguagauuuuuagaugaaggcuuaagacuauugucuuagucaucuuagacuauuaaagcaaaauaccauguauugaguggcuuguacuacauuucuagcguucuggaguuuaaagucugagaugagagugccaucucguucugccgaauguuccucuuggcauaaagauagcugcuuuugguguaucuccuuaugggcuguaugggaggcucuguucuuauuaagauacuuuuccuaaccuaauuaguucuaaauuauauaccuccuaauacuaucaagauaggaguuuagccaggcaugguagggcuguacuggaaagucuaacuggcagauuuaagaguucuccauccauugguaacuuagguauaguugauuggguuagcaaacuacccaaguuacugcguuuguuuagaagauuaugucacgacaauaacugugugauaauugcaggugugcuacuuagucuaaguaucauuuucaaaaauauguuauuuagugucagugguauuguuucaaagucuguguugcuacagauaguguuagcuucugccuguacgcugggaguuuuaaccaucacaaacacauuauccagagauuuuacuucucacucucuggaaauccuggugugcucaacauauugaucaucuuguucaaguguccaaggacacacugcuuuggacagugagagcucuacccauuggaccauauaauuagcugaaauauaauucccauguaacagaccugaugccauuaguguugggcagcuccugagggaguccgaaucugccuccagcccuguaaauaaucaacuuaugacuaacacaaccugauauucccagcagacuaggggguggcucacuuugaagugcacagugagcuagaggcugcugaguggacuaugcuucccacagcugggagagaaacaggcuuuuaggagugauagaacaugcauuagguuuuagacaagaaacagauuuaaugaacugauuuucauuggagaagucugagacaugucuucaccugagguucccuaauaguccuaaagcuuuaagcugcuaaugagagccucugcccaucccauuggggcacuuacauguugcuaagcacugagaaagauggagcaaaugaugcagaagcuugauucaauuuccuggaauuguuggggugauuccuggaacaccugaaauuguucuaaaaugacagaacgacagaacuuagacagcugguagaaacugggagcuggacaccucuaccacaguucaauguuaguccugugcugcgaaaugugugguuuguggauggccacgugauuucaguugaaagcaaaucauuagguaaauucugucuguacugcacccaccguucccaaagcuaccucaucuuccucugugggguuuacaaagcugguaacugaagggaggaugacguggcagauuguucuuuagcuccacggaaagacaucaugcgugguaugguuuacagguagcguucucagcugcaggcugccagggacacuggggaacuagcuugucaaauaaacagaaagcauucauucucaggcaugaggucucaauagcuuucacaagcauuaaacucacuuagaaaauaauuaguaaucaagaaggcauuuaaacucaacucucugaagcagagagagagaugugcauuacaccaauugaacuaucaguuuaaauauccacuuuaguaguagacauaauuugguuuuagugaaagaagacauguauguagauuggaaaauguggaauguuuuagucauugaagugucuuuuuauuagggcugagaauuaggaacuguguugaccuaugagucuucuccucuccacuggguccuguaucuuguaacccaguaggacuaugggaauccagcagcugaccucauucaacagcuucccacugaggacgcccaguaccuagaggucugcuaaguuggugguaaaauucacagguuauuuucaauauguuauugaaaauaaaugcucuugacauacuguuguaaaauaccaagaccugaguuuauauuuuagcugaaguucaauccguucagaauaaagcauuuacuuuauggucccuaguacucgcuguaucaguucaguuccaucugugugcaugagguuucaugaguacagugucacgugugauuggaaccuuaguaucuguugauuguuggcuggauaaaugaguaauggauaaaacaauuagaacuccuuuuggcaguuauauaaaugaauuaauuuucuuugguaguuacuuauuauuuauuuaauaaauacaaaguauuuugaaacaaagucucuaugagagcaaaaaaaaaaaaaaauagcucaacaauuacuuuggguaguugcaaacuaugccugauaagugcuuugcuuuaagaaggcaguaauaccaaaaccaacauuugaauccagagcuacuugguccauagucuuaucaccaaaacuauauuuuuaaaauagcaucuaguucuugaaacauuuaacuuguguguguguguguguucugucugucugugugucagauagagagacagacagagagggagagcuccaugugugugcagauacagucaccuaugugugcauauguaaacaccaaaggucauccuuggguauuuuccuccaucacugccauauuuuuugaaaccauuucaucacuaaacaggggacucauagucucagauaaucuagcugacaagaagcauggcagggccuccugucgguacccaccacuccucauccaucauuggggcugcagcuauacauugucguacaccacuuuuuuuucuuuucaacaccauuucucagugaaccuggagcucaccaauuuggcaaaacugacugaccaacaaaucucagacauccuccugauugccucauuaucugagauuauuggcacaagcuacugugccaggcuuuuuauuccuccuccuccuucugcuucccuuuuauugaaaauauuuuuuauacacauuuuucugaugacaguuuccccuccaucagacccccacccccaagauccucccaacgucaccuuccauccaaauauauauccuuucagucuaugguuagaaaacaaacaggcaucuaaauaauaauaauaaaguaagauaaaagcaaaacaaaccugaauaggacaaaacaaacaaacaaacaaaaagaaaaagaucccccaccaccaaaaugcacacgaaacacauauagacaguggcccauguucacacacacaggaaugggcuccaucucauagaguggggcuucaguccaaucagacauuagcuguuuacaagcuuugugguaacauuacaguagcacuucuugcaggcaggucaucguuguacagggaaugguguguggcugaguugguguuuaccuuuuuacuuugguagugaugccuaguguuugucuguuuguuuuguuuuucauggagcugggaaucugaacucaugucuucauccuuguacagcaagcaauuuacccaucuucucagccccuaagauauguaauauuuuuaaaacaaaaauauuacuuagaauugaaaacucaagcauccauagcucuaaguaaaacuugcuuguacaguuucuucuuccuuuuaugucuguggguauaaagaugugauucaguguuguuuuucauuugaggauagaacucugagugaauuuuaugcucuaaaggaaaccaucagugauggccagaaccacguuugaggacugauaacaucauggacccuggaaaauucuuguguccucaaacccgggagguuuuaccuaccacaucaggcagguugcagacccuagauaaaaggucccauuuaagggcccugacacccuugcuuuuguuucucucauggcuuuggcugcucugucagaacugaagggguuuuccaucuacuuacuaugcccauuagaguuaaacaacccauaguguuugaucauuuacaguguuccagaggugauuuccacauuguccauggaagcugauuacuuauuuacaacugagacacuuuauuuuuuggaaaauacagaagauaaaaaugcugcuguagaagaaaauuguucacaaagagcaaaaaucuaaauuaccaugcuaugaugaagcuguaaguggagcuauuguaaaauaugcauuuuuauccccaaaugaaaauggaacuguaaaaacugagaugauuuuaauguucuggaaaaagccuauaaaaguagugugcauuuagaguuuuucaaaaggagauaucaaauaguagcagcgagcagucagucaacuguagguuguuggagaggauuugcaggcucucugguguagagaaccagaugguaugucaucuucccaaggugcccuuauugccuugagaccaucauuaggacuguucuucacugcaguuacaaggaaaggacauuagcaaauguaaccacuuugugaaaaugccuuaaacucuucaaagaggagccuguguaggacgcccuggaauauuuucaacuaauucuuuucucuucauguugccuuuauccuagugaucugaggagaacagagacacucuaguacucuguucuucuugacuauauuuaucugguauuucauauaacuuuuaaacugccugucucaaaugcaugacucugcaagaacuuugagccucacaacaaugacagguccauaugcacuugagaugcugcccaccauguucuccuccuguggugaggagccgaugaaaaggccuugggaacugugaagggaagccauagucuccucaugcaucuacccuauucuuuugcugcugcugcugcugcugcugcugcuucuucuucuucuucuucuucuucuucuucuucuucuucuucuucuucuucuucuucuucuucuucuucuucuucucaauuucaacacucaacuuugaauucuccaugaguauucuaacauuuuugaccccuagaugaaaaacauauacauacaugucuuuaaagaaaucauagcacauacauugaggagacuuaaguaaauaauguggacuuuccgucuuuucugucgcaauccagucacaacuuaagcaucucuuucccagucuaaguggcaaauaguugugcaccccuauggcagcccagcuccauggccaccucacucacaggagcacaguaccuggcccccucugagccaggaacacagccugcugcuuugacacauuugcugaauuucuguucuuugugaaaucucaaaaugauuugucuugauuuugaacuuaguaagcuaugccauucuccggucaauaccugaaaggugguuccuucagaucaccuuuuagaucucaguccuuucagcacaggugcccuucccuccugucuaucaguuccuuggaaacuacccagccugcugauaguagccugagugugucucagcugagggcucucacucauugucucuucagucgcuguacucuuugaccccagaggggacagcucccaaucuaaucacuguuuugcaauguuucaacuauucacuguguaugcauucuuaaaugucagacugaaagggccaguuucaaagaauuuuuuaaaauuagguauuucauacauaaguucauauauaaccauuguugaauaaacuguuaucuucaaugacuaaggaauaaagauacuuagagaaagagaacaaugguuaauggguuugcuuuucccucuaaccacagccaugaaaauguaauugucauuaaagggcuauaaaguugucugcuuuagugguucagcacacuaauggcucccugcuuuuagugcuguuuuaguguguugaccccuguucccugcagcucagaguuuauuagugauucuggccuuugggaaugaauauucauaauaggagagcaauggugauucgguucucuuuacagccccaagggcaucaccugggacagcuggggagaaagguuccgauuacaccagcaucccauauugcaccauggagugugaagcuaaguucacagcuucuugugaggaagcugaggcgcagggccgcaguuauaagcagugcacucauguugaaacauaugguuucugauuuccaggucauaaucuaugauauaauauauucuccauauuaacuuguuugcuuuguuauagaaguucuauccugggaagauaugaaaugccaaaacaguuagcuagaacuugaccacgacaaugaaaucucaguuuacaaagcuaaggaaggaggggagaacaguagaaauauggcucucucaacugucuuggcuuuuaaaguaauuuuuccaacuacacuauauauucccucuuuuaacucuuaccaucauuauaaacaacuuuuuaaaggcacucuugaguuuauuagcaaguaaguuguggaacaccugcuugguauugaugguuauaggagauaaaacagcaaauauggaagacauauguuccuucuuuuucuaauuguaaauauuaugugauaacuuuauuaaaauuauaaugauuguguuuuauuuaaacaauuuuuauuagauaucuucuucauuuacauuucaaaugcuauccagaaaguuccuuauacccucccccccccccacccugcuccucuacccacccacuccugcuuccuggcccuggcauuccucuguacuggggcauauaaucuuugcaagaccaagggccucuccucccaaugauggccgauuagaccaucuucugcuacauaugcagcuagagacaagagcucaagggguacugguuaguucauauugcuuauguuuuaauuuacaguagacauccaaacaucuagcuuuaagaguuuucaguuaaauuccauuucaacuuuucccauaggcagcuuauuuuaguaauguuuuauucuuuacauuucuuaaugagauuagaucuaaagagaggauuguuuuacuuucccaaagugaugccacuagaaucucuagcuaauuuuguguuuuuccuggacugcauaccaaucagaauaauugagaaaacuacuauagugaaccagagaggcacuacccaagguauuugcagggggccucaguagacugaaggaugaacugcauggcuuugccuauggagguguggugcugccccaacacuggguuaacaagaucaugguuuuaugugggagucaccugacuuuauacauguacucuuucccugguuaugugccuaggaagcuaauuauucagucagaaaguaaugaaagacccugccaucugucugcugcucuaauaaagugucagcauaucccaacuaggacauaauuggguugacagacacaaagccaguuauuagaauguuauuauuuuauugggggaaaaaagaagcauacaguguaacaaaacuaaucugauguugucuguuacuccuggaauacauggcccuucacacagaauacaugggcuuugaaaccccugaccagcuuaggaacgauuggaguuccuguucucagaacucauuucuguauuauuacaaaucauuauaaugcaaucuaauaaaacacaguuugcauaaagauggggcccauuuauaaagcugucaccccagccacucuauuaauagagccauuuuaaagauuuauugugagcauauguuacuuuuugcagagggacagauugagagcugcaggauuugaacaugcuagaaugugcuacugcagauaacucaggggaaaaaauugaagcuauuuugugcaagacaugucuuucuuccuuugcaggcauaacugcaagacaauuguagugaggcauagaagacaggugacgagggcacagucgugcuacauaacuaccuuuucuuccuuucacauauucugcuuuguuuucagauaucacugaagauuugggaucacauaggugagcaaaauauaaggcauuggaaguguagcugguuaugagcuuucuccuucaagcggcuguggcuagaucuaucugacagccaaguacuagagaugugguuuaugaauucagaaacaggucagggaccauuguaccccuccuuguucuauccuaguguuucuugcccuuggagcucauggagagaacuagaaaggaguccaaucagcuucuuuauuguguguggguguguguguguuuucaacaagccucuaaagagcuccuguaguauaccagguacuuuccuugguuccagauacugccaaagagcugccuucuggggguuuacauuccacugaggcaaauagaaaguaaaaagcaaacucauacaugucauaucagauugugacaacuacaguggagaaaaagaaggcagcugaaagagacaguuaauuagggagauauuuuuaugucagcccuucucuaagcuuuuuaagaaacugacugcuaauagugagucuugugucuggauaaagcauccaacagauucaaguacccuguuguguccauuacagacagcuuacuuuaccugguaauaguccuugguguuccuugauugcaaguuaguggguacagauggacaugcaaggcuguuguaagccucacgcaguccauaacagaacacuccaggguuccaccauuggaaacugagucacugcuuguucuugaaggcauucuuuccugaggaggcaaacuacuuacaggcaucauuuucucauuauaaacacucuacuauuaacugauuuggcagauuuauaaaugaacaaaauuaauucuuauaauuuuacuuaauguaaugauuacugugugagacacauauacauugcacaaauguaaggcagugucaccacgcauacaucacugacaaccuuacaauaauuccucaagacacauacuauuuucucacuuguagauuaagggccuggucagagaaguuccauaguuaacuaucagcagaucugaagcccucgggccugugugacccuaaauccuauacagacuuuuguauaccacaccguccaaaagauauuaccucugaguucuucauauuaagggcaaauuguguuaggaaccuugggaaauauaaaauaauaauaauaauaaaauaaaaaugcaauuccuguacccagagaaaugacaguacacuggaaagagaugaucacaugagaaagagccgaggacagugagggaugagguagagacacguaauugcauugcuuggucugugaaagcuagggagagacagagauuaauggagacugcagacaauaagccugaagcagagcguuugagagacagguagacucaucugugaauguuaagauccacucguguaccuaggcugaacaucagauguugugucauaacccaugaacauugcuagcgaugguaagcacagcgcagcuagaguuuccuccagcuuuccuguccuguaguuaagccccagacgaaguguucgccuugugaaagaagcauuauguuauguaaaauaaauggaucuccuaaaagacuaggucacauagucagacucagagcaguuagaugguaacaguaugaaaggcagccaggagcugauucugacugagggaccuauguuuguguccccugccccaccucuccuggggcacaucuucauugaguaaaucacaggcuaccugucucacucgcauugucccuggucaguccauauggcauugguuucauauacauugaaugcaaguguguugaaacauuacugaaaggaaaugugcucugaauggacagaaccuuuaacaaaaagucccaaagaugggggaaaaaaaaugcagauccucauggaaggacaagcaaaggagcauucuacucaaguguggggagaccgugggguggaggccauuaaagcccgagcuagagagugggcaggggcagggugggagacggagguguacuggaaacggaagccacugugcaaugagauuguuaaagauccagguaacgagcauauagagaagaacugaagacaguguaagagacagagcuuguguggagguaacuggugcauugcgcuacccugauaauagugaagccacugaaaugaaacaaguugaaagcaacagaugaaaauacuagcaauguccugaaucagcuaguaacuuuuuccucuacaccuuuucacccacccaucuaauguucuuugcuuccucuuuaagcuuacacuuaguacugaacccauuccugccaaaugaaagccuggcagggcauugcaggcuguuggcagcauuauuuuaggcggcaaaagugaaaaggacucaaagauuuugaaacaaaauugaaauaucaacaugauuuguauugcuuagcugucaccccuuagcuucuuucaaaucagacuuaguuagaguugcauacugcucguauauuugaaaacaaauacugcauaauaccccucacuguucugauuucucacuauccuguuuccuuuugcauuucuaaaaauucauuuauuuuuuacacuccauauuccauuccccaaacccccauguacccuccaacugcuccacaucccaaacccccccacccccgucugcauguggaugccuccacuccucccaccccaccugaccacuaaacucccuggggccuccauucucuugaggguuaggugcaucaucucugaaugaacacagacccggcaguccucaacuguaugugugucgagggccucauaucaucugguguaugcugucuguuuggugguccaguuuuugagagaucucggggauccagauuaauugagacugcugguccuccuacagguucgcccuucucagcgucuuucagccuugccuaauucaacaacaggggucagcugcuucuguccauugauuaggugcaaauaacugcaucugacucuuugagcugcuuguugggucuuuugcguggcagucaugcuaggucccuuuuugugagcgcuccauagccucaguaauagccucaguaauagcaucaggcuuuggaaccuccccuugagcuggauacuacuuugggucuaucacuggcccuucuuuuccucaugcuccucuccauuuccaucccuguaauucucccuggucucuggugcauucugaaguuuucccccaaccuccuguuuccuaagguugccuguuuacauucuuucuccuggcccucagggcuucaguucuuuucccucauccaauaccagaucaggauccccucucccccuuccucccuccccacuugugacuguagcuugcagagaauuaauuggucaaagggaaagagccucguccuucuguauacgaagaccuagaauagucacugaggguuuuugauugauuguguguuugguugguuuuuaucauccuuguaauucuuaauaaaagauuugcagucccaguaauauugguguuccuguuuuguuucaucaauagcccuucugcucccucacagacuggagggagggagucacauuagcauuccugcacugacuuucugggcauccuauacuaaaguuuucuuuauauuguuucuuaacaaugcuguuuauuccugggauacccaagaggaguggagcaugggaaugguggggaaaugguccucuucugauuggcugcaaguaggccaucauucacucccucuucccauuacuguuuugucguuggguggguauguuguauuuacucuuuaugaauaaucaauaagcccacuccacuucuacauuacugcaaacauaacuaauaagaagcccaaaucuauuucagcagcaguauuuuuuuuaauuucugaaugguuucagaauauauaaacuuagaaauaugaaugaauuagagcgugcacaaaaugaagguagaucucauugucaugauaaaaacaccaaccaacaauauguauuuucacauuugucuaagccuacccuaaguaguugcuuucaccauggccauuuucagagcugacauaacuucaccuuaugcagaaggcuugcagugaguguuuacugaugcacagugcuagguccaguggagaacaucgaaguaaacugaacccacaaagaaccuagcguccagacaguuguagaauaaacacaugaauuacacagcaguccauaccacugagccucucuccuguauaauucuuaguuuuuuuccucgguggguaaaugagguugggauauuuuuccuucaucacagcccacaguaagaauuuuuaaaacucagaauccagcauacugccauauguguuaaauaaaaguauaugaguauuuaauguauauuauacauaaauuggacauggcagcuuguccuugguagcuacaauacacgccaguauuuccugucucauucaagucuccuugcucucuuucaccaccaccccauaguuuacaauccuucaaugugauuuuauuugaauaguuucaguuccacaugucuuuaggcugaguucuccaggagcagguuuccugucugcauuguggcaucuggucaugccucacagaaagcaugcagagaacaagcagacaaaggggcaugcaaaucucacagccugaugaauggcguugccugccacagguuccuuacaauccugaccuggagaaaugaggaaaagcugccagugucucauugugacuccuguuccugcgaugaacagagcaagauaaugaauuauguauaauugagaaauaaugcacacagccuaagauugggcaaaaacaccuaccacccccaacuucuaauacauuucaucucacuaauggccuccuuuauucagcgugcugaggauuuuuucugaaacucugacuuaaggaaugaaaucuaccuucaauuauuuaugguuuaaauuaaugcaaauaagacucccuggcuugcugugcugauacucauuaauaaauauuucacuggguauuaggaagauucagauugacuaaaugaggcucuuuuucaauauaaacaaaagcccuuguguuucuucgcuacugugcagacccaguucuuacgccuggcuuucaauacuaaaugaauguuaggugggugcaucagcagagcuauggauccugugggaaccagaguccguggggguucugcaguaaaauaauccucuaguuaaaccaaauuuaaucucauuagcagaguaauugugcuaauagagggaaugguuggccaggauaaagagaaacccacauauucuaauuccucguuugcuucuaucacuggaauauuuaacacugaacuugggcaaaaggugcagauuuggcccuaaaaagccaaagucuucaugauguccacaucucuucacacuuuccggaccucugugcaucacuugugucauguuguacauguucuuggaucuuugcuguagaaauaaauuccagggcugcaggaucaucacacuuggugccuuuuauggaugaaucuugcccucuguuucaacaaaaaauuaugcaucagaccaccgaggauguaguaguacagacaaaaauaucuuaauaugaucaaaauaucuguaacuuagauauaaaguuucuguccaaacaacuccuauaggcuuugcugucucuuguauauucaguuccaguuaguagcaauaugcagccugaaaguguaagacggugagcagagucaugugaucauagacacugugguaucugcucugugcuuuaguaguuagcaccauaauaugggacaguuaauucuguggggauugauaacauuaccauaaaauuucuuuuauaagauuuuuuucgccauuggaagcgcuguuuauugauacauaucuaccugcagauucucagacagucaggaaacacuccucuuucuuacuggauacaaaugugguaauuugcacuuuuguacacugugguuuugugaacagaauuuuaaaauauuauuuagcuuuacugaggaaaacuugaaagaaacagacguauaaggguaguaaaagucuuugguuccuggcuaauaauggaugcaugaaugaaacugucaagcaagagcucucuggaagagaaaggauagugauagaacauuggcaaaaauagcgaaaaaguacucgguuuagcucacuuuuuauccuagauaaguauuauacaggcucauuuuguuguauugaaaugcugagcgaauagugugugguucaaagugauccagauuucaguggggguaaccuuagcugaaauggccaagagugggaagauggaaccugaagaaaccaccuccaguagguagacaaggcccccaguggagggauggggccacccaccuaccuucaaaacuuuugacccagaauuguuccugucuaaaagaaaugcagagacaaaaauauaacacaguaaggccauccagugaacaaagcccaacuugggaucuaucccaugggugggcaacaaacucugacacuauugcugaugccauauugugcuugcagacaguaaccuagcauggcuguccucugagagaaccagcagcugacugagauagaugcagauacuuaacaaccaacuguuggacugaggucagggaccccuauggaagaguugggggaaggacugaaggagcugaagggaagggcaaccccauaggaagaccaacaguaucaucuaaccuggacccccaggagcucacaaagacuaagccaccaaccaaagagaaaacacaggcuugucuguggcccccagcacauauguagcagaggacugccuugucuggccacagugggagaggaugcaccuaauccuguagaaacuugauggcccagggaagagaggauacuaggggaaggggggaaaugaugugcagaagggagacggguggguugcagagcaaccuccccguggcaaaggggacaagguaauggggugaagagaaggggaacuuggaagggggcaacauuuauauuguaaauaaauaaaauaauuuaauaauuuaauauuucauuaaauauauuguccuagaaaacacaugugauguuaugggaugagaaaaugaucaugguugaguuguauugaaucaaauaaaccaagauaaagauagaagaguguaaggcucaggauucaaucaauacuaugugucugcgguucaucucauaauuguuugcuggggaugacauuauuuugcagguacuuuuuucuuagauugcugugcauucagauuggcgauuaaucaaguaaugguaagcauagaauggguaagccauaauccaaacuaagaccauggaacaagguuagcugccagauaggcucauuagagauaauucaagcuaggcuuucuaaggcaaucauuuacuacacauaauaaaaacccauccucuuaaggaacccugaaagagaaccaauuagucugucugccauauauuuuuuaaaucuuaaauuguuugagaauuuaaucauguguauaauguguuuugaucaacuggaaucccccauucucucucuucgccuacucccagccucgaccaccacucuuccuucccaacuucaugugcucuuuucuuuacccacuguagucacuuagugcugccagugugagcauggauguagagccaaucacuggaucggcgccuuucaguggccacaucccugauuaaaaaagaaaaaaauccuuccccccacaccaguauccauuacuaccagcuucuuggggugcccaggguagaacuuuaugugccccucccccaccccaugauagaauuugggugguuugaucuuaugcacaucuugugcauucagucacaucugugagaucacacuugcaacagccuugucgcaacagguacacacaucucuuuuggcuacaugacaaauuuccauaauuauauccacuagugauuucuguuacugauacuugagugcuuuucauaucaggccaaacucacugagcuucacaugggagagcaaggcucaguuuuaagaugcugauaauuugucuuuaaaugccucauuuugauacauuuaacacaaugcacacaucaucuaguuuacauguuccuguauuucuugcacuaccucaguucucugcucaucuuguuuauccaaccauguuuauacaacagaacauuaaauaagccaugcauagugaccacugucaaaagucauagcccuuaaugaaccaagacuaaauaagcuauaauaauaauucaaguguuauuuauuagaauauuuauuaacugggcacuaguuaauuaauuuggaugcuucaggcaugauucaaagguacauuaaacauaguuccugcucugaaggagcuugauuguguuaccagaggaaaaaaaacagguagaacaaugaggaaugcugugaaguacugaacuaaaguaguuacuuuaccacugaagacaaguaaguaacuuagaggucaggggacauucuacacuuggaaucaguccuuaaccaaaggcuacaguggggggaaaaaaggacaauuuugcaaaucucuagucuagcuccucugccacaacuuagaaguuucggggugccaugagaauacuacguggacauccugagaaaaagcacuaggcuuauuuuuguacguguuauacacuggagauauauguacaccuacgaaguaccauaguaccuccaggaaguuguaacugguagagugaggggcuccucacccugaguauuacggggauauaguguucccucuguuugcuuuagcauuugcggccauggguaccauacgauacacacuccagauauauugcccagauaagcaaaguggugagcagaugaccauaugugaacauuauacagagaaugucucuaaaucuggaagcuucuugcauaaauagcaaaguugggagaaagugauagaugauuuuuaagcuugauccagagugauugugauaaucaugguauaaauauggaaauccuaggagagaacuguagaaacaaucauaacucagcaauaaagaguucuuguagaugaggcauaauuugaauuaucaggaggagauccaguuggaaguaccuagcaagugacugggaaugcaggucagggaccugcaguuuaaacugaugauaagauuugcuauacuuuaagguaaauguuuauuuuugauauuuuaaaauguucuuaucgagaccauaugcucuuuccuaucuacucacuauuguugggagccgcccccacauucgccgucacaagauggcgcugacauccuguguucuaagugguaaacaaauaaucugcgcaugugccaaggguauuuuaugacuacuuguacucuaccuuucccgugaacgucagcucggccaugggcugcagccaaucagggagugaugcguccuaggcgaaauauaacucuccuaaauagggaagggguuucgguuucauuauugagaaggggcuuucgcuuuuggggcuggggguuugcgcuccuagcuccugaagauguaagcaauaaaguuuugccgcagaagauucuggucuguuguguucuuccuggccgggcgugaaaacgcuauuaagaauuggugccgaaacccgggacgagaaauuccgggacgagaaaaaauccgggaagaaaaaacccgggaggaaacucgggacgggaguuucaccggcgcaaggaagaucccucauuccagaaccagaacugcgggucgcgguaauaaagguucccguaaagcagacuguuaagaaggauucaacugcaugaauucagaacuuuucagcuggggaacgagaguaccagugaguacagcuuuacgagguacgccuggccuugaacuuucuaaggaaauucaagacagucuaucagaaguaaaguggaaaauguuuggccuugaauuuuuucuaauguuaggagcccuuuuguuccuuuucacauguuaucaggugauuaagauagggcugaaaauucuggaugaaauucagggcaaucuaucagaaguaaagcggggagagagaguaggagcaaagagaaaauaugguacacaaaauaaguauacaggccuuuccaagggucuugaacccgaggaaaaguuuaggucagguaagaauaccuggggagagauuagaaggaaggaaaagaaaaaagaaaagaaaaaagaucgauuagcggaggucucuaggagauacucgucacuagaugagcucaggaagccagcucuuaguagcucugaagcagauaaagaauucuccucugaggaaacagacugggaggaagaagcagcccauuaccagccagcuaauuggucaagaaaaaagccaaaagcggcuggcgaaagccagcguacuguucaaccucccggcagucgguuucaagguccgcccuaugcggagcccccgcccugcguagugcgucagcaaugcgcagagaggcaaugcgcagagagaugcgcagagagacaaugcgcagagagaugcgcagagaggcaaugcgcagagagaugcgcagagaggcaaugcgcagagagaugcgcagagaggcagugcgcagagagacagugcgcagagaggcagugcgcagacucauucauucccagagaggaacaaaggaaaauacaacaggcauuuccagucuuugaaggagccgagggugggcguguccacgcuccgguagaauacguacagauuaaagaacucgccgagucgguccguaaauacggaaccaaugcuaauuuuaccuuggugcaguuagacaggcucgccggcauggcacuaacuccugcugacuggcaaacgauuguaaaagccgcucucccuaguaugggcaaauauaugaaauggagagcgcuuuggcacgaagcugcacaagcgcaggcccaaacaaacgcagcugcuuugacuccagagcagagagauuggacuuuugacuuguugacgggucagggagcuuauucugcugaucagacaaacuaccauuggggagcuuaugcccagauuucuuccacggcuauuagggccugaaaggcgcucucccgagcaggugaaaccacugggcaguuaacaaagauaauccagggaccucaggaauccuucucagauuuuguggccagaaugacagaggcagcagagcauauuuuuggagagucagagcaagcugcgccucugauagaacagcucaucuaugagcaagccacaaaggagugccgagcggccauagccccaagaaagaacaaaggcuuacaagacuggcucagggucugucgagagcuugggggaccucucagcaaugcagguuuagcggcugccauccuucaaucccaaaaccgcuccaugggcagaaauaaucagaggacauguuuuaacugcggaaagccugggcauuuuaagaaagauugcagagcuccagauaaacagggagggacucucacucuuugcucuaaguguggcaaggguuaucauagagccgaccagugucgcucugugagggauauaaagggcagaauucuucccccaccugauagucaaucagcuuaugugccaaaaaacgggucaucgggcccucggucccagggcccucaaagauaugggaaccgguuugucaagacccaggaagcagucagagaggcgacccaggaagacccacaaggguggaccugcgugccgccuccgacuuccuauuaaugccucaaaugaguauucagccggugccaguggagccuauaccauccuugcccccaaaaaccaugggccuuauucucggccgggguucacucaccuuacagggcuuaguaguccacccuggaguuauggauugucaacauuccccugaaauacagguccugugcucaagcccuaaaggcguuuuuucuauuaguaaaggagauaggauagcucagcugcugcuccucccugauaauaccagggagaaauuugcaagaccugagauaaagaaaaugggcuccucaggaaaugauucugccuauuuugguuauaucuuugaaugauagaccuaagcuccgccuuaagaucaacggaaaagaguuugaaggcauccuugauaccggagcagauaaaaguauaauuucuacacauugguggcccaaagcauggcccaccacagagucaucucauucauuacagggccuagguuaucaaucaugucccacuauaagcuccauugccuugacgugggaauccucugaagggcagcaagggaaauucauaccuuaugugcucccacucccgguuaaccucuggggaagggauauuaugcagcauuugggccuuauuuuguccaaugaaaacgccccaucgggaggguauucagcuaaagcaaaaaauaucauggcaaagauggguuauaaagaaggaaaaggguuaggacaucaagaacagggaaggauagagcccaucucaccuaauggaaaccaagacagacagggucuggguuuuccuuaguggccauuggggcagcacgacccauaccauggaaaacaggggacccaguguggguuccucaauggccccuauccucugaaaaacuagaagcugugauucaacugguagaggaacaauuaaaacuaggccauauugaacccucuaccucaccuuggaauacuccaauuuuuguaauuaagaaaaagucaggaaaguggagacugcuccaugaccucagagccauuaaugagcaaaugaacuuauuuggcccaguacagaggggucucccuguacuuuccgccuuaccacguggcuggaauuuaauuauuauagauauuaaagauuguuucuuuucuauaccuuuguguccaagagauaggcccagauuugccuuuaccauccccucuauuaaucacauggaaccugauaagagguaucaauggaaggucuuaccacagggaauguccaauaguccuacuaugugucaacuuuauguacaagaagcucuuuugccaguaagggaacaauuccccucuuuaauuuugcuccuuuacauggaugacauccuccugugccauaaagaccuuaccaugcuacaaaaggcauauccuuuucuacuuaaaacuuuaagucagugggguuuacagauagccacagaaaagguccaaauuucugauacaggacaauucuugggcucugugguguccccagauaagauugugccccaaaagguagagauaagaaaagaucaccuccauaccuuaaaugauuuucaaaagcuguugggagauauuaauuggcuuagaccuuuuuuaaagauuccuuccgcugaguuaaggccuuuguuugguauuuuagaaggagauccucauaucuccuccccuaggacucuuacucuagcugcuaaccaggccuuacaaaagguagaugacggugauguauaaugcucaaguauucuccugcuuuuuuaccacuaacugggaacuggguuuggccuugauucagacagccuuggcucugucuggacagguccagacgacugacaccauuaacacuuugucagccucagugacuacagucauagaugaacaggccucagcuaaugucaagauacagagaggucucaugcugguuaaucaacucauagaucuuguccagauacaacuagauguauuaugacaaauaacucagcagggaugugaacaaaaguuuccgggauuguguguuauuuccauucaguauguuaaauuuacuaggacagcuaauuugucaaaaagucuuuuucaguauauguuacagaauuggacagcugaauuugaacagauccuucgggaauugagacuucaggucaacuccacgcgcuuggaccugucccugaccaaaggauuacccaauuggaucuccucagcauuuucuuucuuuaaagaaugggugggauugauauuauuuggagauacacuuugcuguggauuaguguugcuucuuugauuggucuguaagcuuaaggcccaaacuaggagagacaaggugguuauugcccaggcgcuugcaggacuagaacauggagcuuccccugauauaucuaugcuuaggcaauaggucacuggccacucagcucuuacaucucacgaggcuagacucauugcacgggauagagugagugugcuucagcagcccgagagaguugcacggcuaagcacugcaguagaaaggcucugcggcauauaugagccuauucuagggagacacgucaucuuucaugaagguucaguguccuaguucccuucccccaggaaaaacgacacgggagcaggucaggguugcucuggguaaaagccugugagccuaagagcuaauccuguacauggcuccuuuaccuacacacuggggauuugaccucuaucuccacucucauuaguuggguggccuauuugcucuuauuaaaaggaaagggggagauguugggagccgcccccacauucgccgucacaagauggcgcugacauccuguguucuaagugguaaacaaauaaucugcgcaugugccaaggguauuuuaugacuacuuguacucuaccuuucccgugaacgucagcucggccaugggcugcagccaaucagggagugaugcguccuaggcgaaauauaacucuccuaaauagggaagggguuucgguuucauuauuaagaagggacuuucacuuuuggggcuggggguuugcgcuccuagcuccugaagauguaagcaauaaaguuuugccgcagaagauucuggucuguuguguucuuccuggccgggcgugagaacgcuauuaagacacuaucacauacuuuagacugugaaccugugccuuuggguagcccaccucaggugucuugacccuagagcugaaugucugaggauuagaagaaugagauagaacagguuuaaguccagcacugucucuggagccaugcugcccaaggucaaaauuuugcccuauuacuuaccagcuauuugaucuugagaaaguaucagugugugaugcuguccuuucugcuuccaacuggcagauacagacguguuccauucugcagcaucuaaaggcccaugugacacaaagcccagugauuacacacagcacugccucugugcagcgucucagugucauccuaugaaaauggacacaauaguguaguccucuuagggugccuuuaaaauucauauugaggaauccuuauggagaauccuuauggaucucuuugagacagcuaugguaagagcgcuguggcuguaaacaguuaugaacacugauguagcaacagguccaguguuggccauguuccccugcauuugguauuagugucuggaggccgcuggucuccaucaccagagagugcaguaacuaugauguucucacauugccaggucacacgcaggcugcuucugcuaaauucuucuuggaaauuuuugacagcuuuguucuuuauauaauaacaugaggcuguauuuaacuuaaguaaaguaaguugaagcaauaaaacagaauccaacccuaucagaauggaaagcuuauuaucuugccauugggcuuggcucagacauccauauuagugacuuauuuauuuacaucuuaagggguuaaagaaacauuguuuuauuuuaaggguuagaguuuaagucucauuucaauuucuaaauuauaugcauaaaaguuuuaacagcugucauuuuaaagaggcuuacuucauuucuccuaaagugcuuuucagucuggagggagcacuuaacaauagucucgaaucauuugcaaugcacucauggcaagacuuuugaaaguuaaauuuguuuguaagccuggagaguccaaauuucauagguaauacucuugucucuugcuacuuaaugauuguuaccucguuucuccuucaggcccaggcaugagucucacucauuacaagucagagcacccaaaccccgucugauuucauuaguucagcaaauucucuccuaggggcgcgagccgagcacacaauugggcugugcagugaugagcuuauuuuguacguuucccccagaaaaucuuuauauacaaaaggcacagaucguaguuagacucagcaugaacaauuacagacuaucgagggagcgucucuccccgaugugccaguggcucacucccaugaauuaagaggcaaaugugcuccaaugugcauuaaccuuuauggauuuuucuucaguuuucauguuccacugauuuauggucuuaaauaugccuggugcugcuguuucugaaugaguccuuuguaaaucauuccuaaacuaaacgaucuuuuuugacucagaugauacaaguaaguugacuauaucucaaaccauuucugcugaggcuucuucgcuucuuugcccaaauuuucuuccaguuuguucuuucuuaaauguuaaugugagaaauaucaaguacauaugaaacaugucuuaagccacaggugccagguugauucucuguuugcagaucaaguuguuuugggcauuucucauggccuuaguuggauuagauucccaagucccgccucucuguacaacugcuguccucucuuuauacaaggaugugcuccaggugucuaggaguagaaucauugacucuauuuggguucuagguugcuuuccuuuuccauacaaaucaagcauaguagggauuuaacuagacuuuguccuaauaaaagucuacuucagcugggcagugguagcacacgacuuuaaucccagcacuugggaggcagaggcagguggauuucugaguuugaggccagccuggucuacagaguagguuccaggacagccagagcuacacagagaaacccugucucgaaaaaacuaacuaacuaaauaaaauaaaaauaaaaaucuacuuaaggcagcucucuucuuucagguaaauaagggcugcaugucuacaguaggugcagaugcucuguauuugauaguuugucuugcugguaccaggcccaauucuuuaguugaaaugaaagcaaaacugaugccuuacacugacauacggauaugugauaaggaggcuaggcagagcaagggguuugggaugauugaauacauuuuuaauuaguuuauaaacuuccuagauaggaaccacaucaagauaaaaaaaauauuuaaaauauugagugaaauguaggcaguagggugcucauuucuguauuccagagaaccuauaacuugcugcaagaaaacaucaguuuuuuuaaaaacgcaggugucauguaugcacagacuuuuaaagccuccauucaauaauaauaugaaaugaaaauauccaguuuaauauuuacaagcacacaauuaucaguacuaaauuuaggaaaggagauccgaguuuuaaacuugcagugaaaauuagucauguacgcucauccuuugcuuuauguuuuuccuguuuaacagccuuugguucaggaggcuuauuuggagaacaguuuucaaaauccuauaauuagauacuccacacacagcauuaugcagcuccuucccuuugacucucauugucuccuucccccugcacagauguaccuguaguuuguguuugcaugcucaucauuagaaagucugggaauccccaugugacagcacuuccagagauuagauaacaccccuuccacaggguuccaucuguguucuaccuaaacucugaaauacaguauuuucauuccuaaugggauucgauugacacuauaauauacucagugguuuguuuuguuuuguuuguuuguuuuuuguuuguuuuacucccguaaagcuaaugagucuuaauuggacuuuugaugauucuucucucucucuugcuucauguucaacagaccauuuuuuuaaaugcuuauuguuagggaaaacaaacaaacaaacaaaaaaacagacaauguuguggggauuuggggacaggggaauaggaaauaaaauauaaaguugcccacaaaaaaaaaaacauaucaggagcuauguaagauauuuguacuuguugaaauaacucaccagaaacagaaugaaagcauucauugugggguuaucuggacuaauguuccuuaacagauguuugauuuaauaaugugaucauucgugugacgggccgaguuuaugcuacucuguggaaggcauggggaagguagugugaacagccauauugcccaagaggaaggcagagugacggcugacagacuuagagaggaccccauugaccggggcguggugggguaagggauggacuucaccucuucuuaguuguucacuagaaccuguaaucugaacucuugacuggagggaacuguuugucaggcagauuccauccugguuucaagaacuaugguuugagaucaaaagauggcguuucuuugcucuguaucuuguucaguauauuucuuccaagagucugcugugugcacauguaggcuuguaggaagcacuugauacuuugcuucaggccacauggaaguuuuggucauccuauacuuuguuuguuuccaaaggauucagucuucaucuaaguaucaguguguccugcuagcucucuucacccucacacuugcacacugggagcacuucuuacuguuagagcugcagccacacuuacccagcacuugcugcauguagcacuuucucucugccauucuagccaaagcaagcacaggucauucauguauuugcauauuuuaauguuuuaaaaaaguaugcauauuaagggauauguaacaugauacagaugucuaacacaaacuaaacauauaggauugcccuucacauguuuacuuuguuugugguaaaaaaaaaaaaaauacuuaaaaucguauuguguguuuuccauauauaccaggcauuaacuuuugucuccaucuauacaguacaucuccuggguuuauuucuugugucuaacugaacuugguauccuuugaugaacauauuccuaccacuguccugucugauaacuaccauuccucccauuuccuuacuaaagaagagaaugagaacauccuuuaauuuuuaauucucccauguuucaugcuuucugcugagaucccucaaagcucugagagcagauuuggaaacauguugagucaauucccucaaguuaaaauggcaacaucaaccugguggugccgcuggagauggaugugucugcuguagggaaugagugguuucuauucaagagagauggcucacugaaagggaugggggcccucuaccagagcuggagguggccaucucaugguuucaggacaucaaagacaaacacaucuccagagaaagaaaauguggcuaauuuaagauuucuuucacucugagaacaggccagacuagcuaaaaguguguuuguacaguugguaaagauuuugaagggaaaauguaaguacuucuuuuaagaaaacuccuucuaguccuucuaaugggaacaaaugggauccuaaagucuuucuagucuguuccguagcagauagaggaacaacagcaguuuccuccagcccuggagucagaaacauugacuggcuauauggaauuuggauggcuuaaauuguggcuguaacuaauggguuuugucccucacucccuggccuucuucuacucaccuucuuuuaaagauucacgagguuuucucuucccugucucuuuugaaauaagucuucuuucaauuucucauuuuuuccagaauuacucgagucacuauuuucauuguaauaacaugaaaugaucccuacaauuuacuuacacauauacaaaggcauguggaggcagaggacggggcaagggaggcgcacaaucaaugcaauagcaagauuaucuguaguaaguucuguaguaaguucauuuauugagucaguuauagguuuagcaacaaaacuuaaggaauuaaacuuuaaauauggucuaauuagaaaguaauuugcaaagauuagucugugauauauguaggcaauuuaaauuuuuucuaauucaauuuuaaucuaguuagcuaacccuucaguuuguaauaaacauuuuuuaagacuauugaaaauuuucauucccacuuguaagacuucaacucauuccaccuccuugagacaccuguugggguucucauggagauacuccauaauaaaguauacaaugagaauauauauauaauuugcguaaaguucuuauauacuaucaaauggacauugaucuucacuuucuuuucauucuuuuuuuuaaauuggguauuuucuuuauuuacauuucaaauguuauccccuuucccaguuucccccucgggaaauccacuaucccauccuuccucccccugcuucuaugaggguguucacccaccuacccacuccugccuccccacccuggcauucccuuacauagggguaucaagccuucccaggaccaagggccucuccucccauugaugucuaauaagaccauucucugcuacauaugcuguuggagccuugggucucuccacucuuugguuggugguuuaguccuugggagcucuggggguacugguugguugauauuguuguuucuccuauggggcuacaaaccccuucagcuccuucaguucuuucucuaacgccuccauuggagacccugugcucaguguaaugguuggcuaggagcaucuaccucuauauuugucaggcacugacagagccucucaggagauagcuauaucaggcuccugccagcaagcacuuguuggcauccacaauagugucuggguuuggugauuauacaugggauggauccucagguggggcagucucuggauggucuuucuuucagucucugcuccucauuuugucucuguaucuccucuuguguguauuuuguuccccuuucuaagaagaaccaaacuauccacacuuugguguuccuucuucuugaccuucauguggucugugaauuguaucuuggguauucugagcuucugggcuaauauccacuugucagugagugcauauguguucuuuugugauuggguuaccucacucaggaugauaucccucagauucauccuuuuggccaagaauaaauucauuuuuuaauagcuaaguauuacuccauuguguaaauguaccauauuuucuguauccauucuucuguugagggacaucuggguucuuuccagcuucuggcuauuauaaauaaggcugcuaugaacauaguagagcaugugaccuuauuauauguuggagcaucuucuggguauaugcccaggagugguauagcuggguccucagguaguacuauguccaauuuucugaggaacugccaaauugauuuccagagugguuguacaagcuugcaaugccaccagcgauggaggaguguuccucuuaauccauauccucaccagccucuacugucaccugaguuuuugaucuuagccauucugacugggaauuuucauauccauguacucaaagccuuuucauuuggagagcaaacacagguacacagcauuccggcauguaccagucuguucuuucauuuucaucuaauugaucaacauuaagaugauuuuuuugucuuuagcuuuuggaaguauuucccaggagugguguuucuggguagaaaggaaauccaugugugguuuucaguaauacugcaacccgcuccaugugcucuggguugcuuucccuugcaucggugcugguggaagaugccuccucccuccucccccccccccccacaucaacacauaauguuuucuaaccucugagauguggccugucacauaggcucaaaagucaggaugcuggaguaccuugugauugugucauuaugaaguugcgguuuuuccugccucgugaauuuugcuuccucucacccucaaggcucgaguucuucugaccacuucucuuuaaggucuuuggggguuucuagacagcauuuuucauauaaguugaaaauguguuuuaccaguuauaugcuccuuuuuuuuuuuuugucuugacuuucuuuuucuucuccuuucugagcauucauugcaagcagcccuugcuuuguguaacauuguggaacuguaaaaauggccguguaaggaaacaaugcaagcuauucuuaauuaguuuguguuuucuagaaaguucugucaaaacauuaaaaacucuuacugucacuuguaaacguauguggaaauuaaaagcaccgaaacuacaaucuaaacuaugcucaguagcuggcaucuuggauguacacuucaagugauuuuaagauauccaaauggacuugaguggugcuucuggcucugcauugugcacuuugugcaugugcaucucuucugugcuuagcaaacuuuugugcuucuccguuuuagucaacugugagcgucuuauccacgucuuucccuuugcuaucacugccuccaggaguucccagcaguacuugcucugucugccgaaccaucccucuuuauucuuggcccucuuuccuaucacagccaauuucuggguuuauauugagaaguuuuauuuuguuucuggauuggcagugucagaauugugugguuguguaauucuucuauaacauuauuuauauccaguucucuuuucacuucugguaucaucucguuuaguuuucuuccuguauuuuaucuguauuacccaauuauuuuggcuaucugcuuuuuauaaaauuccauauggccuuuuuacuuggugacaagaagacaacauaaccacauacuuuauugucuguauaugaacugaauagacagcacacaguggccauuugcaguagaauggaaagaagugauuguuuacugaccacaguguacaacagcuauuuauacgcagaauucugaugggauaacaucauaguuuggcuuuauguaguuacauugaauagaugauguuaacuauauuguaguucuauaagauuuaagcuauguuguugggggcugguauuacuauuauaguaacuggugaacuauuauaggaaauuuagauacuacauauauauuaaauuuauauauaauaaaccauugaaagcaaggcuaccucuauagaaaauugaaaacaauaauauauauucaucugugaguuaagaacaacuguuaauguucugauauauauaccauaaauuuuuuaauaaaagaaauaaaacauuaaaaauaaaguugaaauucuccuuugucuucuaguuccuauucuuucccauucucagccugcaaacucgggaucauuuuaaaugaaagagacucauauuucucacaaacuauacauaagcaauuucaaugagaaaugggcacuauuugugaaucugcccuuuaauuuguccuauaauuuuguuuucuucucaucauacuuuuccuuugacuccuauagucuaauuucuuuugagaauuaaucaaaguauuuugcuacaucccgcauagaaaucaugcuuuucuguuccauucucuuucauuuaauuaguaaaauaacuuaucuuuuaaaaaauugaaacuuguauugagaugcauugaugaccuugcugucuccauggaaacagccugagcccacagauacuaauguguguggugucauauuuauguuuuucugaucuauuuaaacaccuuuuuuuuucucuguuugucuuccagauuuauucaggagauugaacaugcccugggacuuggcccugccaaacaguguccucuucgagaguuucuuaccguguauaucaagagcaucuuccuuaaucaggucuuggcugagaucaacaaggagauugaaggcgucaccaaaaccucagaccccuugaagauccuggcuaaugcagacaccaugaagguucugggagugcagcggccucuucuacagguagucaggaggaccgcuccuuccuaauuguuuaaaguguauugugcauguuuguucuucuguguaucaugugugugccuuuugccugcagaggccaccacagggucuuggaucuccugaaacaaaugauaguaagccauaugaaauggguguugaggaucaaaccuagguccccuagaagaccauccaguguucuucaucacugaacuaucuucuccagcuccaaaauuacuguucuuuaaucaccauuuaugacuugggaagagucauaacuuuagaaaagaggaagaguuaccauuugguucuauauccaacagggccaaaauaagaggaaauaacuuaaacggacacuggggaaauuuaggccugauauaguuugaauaauggaaauuccuaagaucaugaagggaauaagaaaaaaaaaguuuaacuguggaagauacugagucucacugacauucaggcaacuuuuuacuauuuaucuagaauuuguccuugaaagaauugcuuuuucacuggugaaugcaucccagaguaggacuagcaagaaugaaauuagguacccuauguaaccucacuuacgggugagaaaucaguucucugaacuguuuuuuagguaguucauguaaauaacuagacuagcucugagaccaauaaagcugguguuaaaaugcagaucauuuauucaaguaguaauuuuguucauacugaacauuuuacuuaaagauauggugucugggccauaaaaauuuucugacaauagauauuuuuauuucauaggccugugguauacauuuuauacacauuucguuuauggaaugauaauaaauagaaaaugaaagcaagucaugaguuugaguuguggauauaucuugacaguuacauuaaucuugcuucaaaaggaacaaugaucagggugugguaaaucacaccauugauuccagcagaggcaggugaaucucuguaauuucgaggccauccugguccacacagugaguuucagaccagccagggguuacauagugagacucuuugucucaagaaaagaacagagaacaaacacauuguuccauaaauuacaccauaugaggagcucaggguaaagaagguuugcgcucuucagcagugcuguauacauggaggggucacacuugcuucagucgucucuugggcuaugcuaccuagcgagguaaagucugugcauuagaauucggaggcaugcuagaacuuucucaaggguugucuaguuauaaucaaauucugugauaagagauaaggggaguuguuagugugcacugucugucauguuagacaugcucuuggugaggagugcggaggggggaugucacagcuguguguccacuguucccucucccuucuagauugcugugccacuaauaagacaugaaucucaaugaacgucucaugucaacuggaagguuuuuuucaaacugcuaccuauccagguccuuuguuccaauucuucccucccgcuuccccauguaugcugaggccaacccuuaugggcuguggcacuauggccaucuuaccaaguggguucuacugggaggggcagcggcgagaaacagaaagccugagaagaaggaggcugaguagcuccuuccucgcacuuugggcaaugaagcuucaucaauaguuguagcuccaacucugucuggacucugaccacaguuucuccuccucgcuccuugccuucagccuucugcuauuacuagucucugcuuccucaccaucccuagcaccuugucucaacacugacccuaugucuguaaguuauuucuuugucaauguuucuucauuugaacuaaagacucaccuuauuaaacaugaacauuuucagcuuaaauagcaaaugcauguugagucucauaaccacauauugggcuguguacacugccggcuaaaugucaccucugggaaguccaugaugcaccugucagaucauacucaaacuugucacccaccauuuuguauuaauaacugugucuuuuguccuuaaaaucaauuauuccagucugagcgagguuagaacucuacuugaccuguuuuccuucugaccucucacacaaguaaggaaaucuuaagaccgaagccauucuagcuauuaacuuccaaguucguacucagagcuaagauacugccuuugguauaugguuauggucuuaccuccuuuuguacauaaaaacugcauauuuuuggagaugcaaaguagugaugaaaugguuauuaaaucugucuucuguucucugaaauaugagguuuccauccugaaaaauucucuuucuuuauagcaauugcaaauguucuucuaacaugauugcccauacuaaaauguuuguuucuuaaggguauccucaugucuacugguuaauuuuauuucuaauuaaauguaagugugagaaaaugugguaagugggucuaaaacauacuagccaagagugugagacguauuaguaagggagccaggagcaauauaugagagacacaggugggcaaaguucucgguuacaugaagcguaaagaagucccucugcggugcuguucucggggcguacacagagcagagcguguggucuuccccugaggcagcuuccaugucacuggucaucagcccaguuggguuuuccagggagaaggacggacagcagucucaucgcggcuuucaugcguuugaggacaggcaggugaaguucaugcucuccuaggagaacugcaugggguccugugaggagaaacaugggucugucuuugccccuccaacauggcaucugagcagcccaggcaccguaucaugagaaacacaucuggcgugcugagaugcacuggcacuggugacuuuacuuuucacggucgauuacaugaagggaagaaaggaagucaguaggaaagaaucaagcuccauuuugggggugaaaugcugugcucgauguggcccucaaauggcauaacccagcaggaugagcagucaugacaaaaguaauaucgcucaucauugcagccagcacauuagcaguguugacuaggagccagcccucuaccaagugcuuucugugcacuggcuuauauaugcuuugguuguauggcaggaacuucuucgaugaucuuaugguaaugacauggaaaacauuggaauuaaauuaccuaccccgaguccucuggcuagcaaagggaagaaugguucccacccaggaagucuaguccugagcccuguguucuacaauaguuuccaaaucauagucugaggacuaugguugucugcaagcuaccuaucucugugccaucagacacagguuugagaaugaacauuuagauacuuugauuguucuuagcccuuugacauugucugggaaucuaauaaauuaggacuuacauuauauauauauauauauauauauauauauauauauauauauauauuucuagguuuugaaugucuuuuucuaguaacucauuuuuauuguaucucaugaaaguguauauucacaacagauuguggggauauugggcuguugccauaguuagaggaacauugcuccaaauccuuuacugucccacacugccucccagagagugaaggaaaggaccaucugccuuagcucuaaagcacuuacagcagacagagagcuuggauaguuauuaccauugcuucucuccuaaauuucugguuccagaauagacuuagaauaacuagaauauuuaauaauauuuauaaaaauggcauuugcacaugugguagacacacaggccuuggugcaugugucgagaucagaggacaacuugccaaguugcuucucuccucccaacaugugagcuaugaagaucaaauccaggucauuggcugguccucacauucaguauuugauaaauggaugagugaauggguagauguaaauaaugcuuucauuacugcaaagacauauguccuuaaugguacaaaauccccaaucuugaguuucaaaaccaacauauugcuaaauuagaaugcucugauguuccgauguaagggcaggauuagguuugacucaucuagccuucuaagagguugacacuauuuuuccugcaaaaaaaaaaaggccucaacucuugcaaugcuaagccuguugauuggaguuaaacuaaagaggucuuguaggaaaaauuccucauuuuuuccuaagccauauuauggcuguauaguuucgaggcuucacgaucaucaugcuggacauggaauuugaggcucauuuauuugaggacauugaggugauccagagacuuccauucuauagaauagacacgagggaagaggucaaacucugguucaauuuuaguucucucauguauuguuguuugcuaauguagauguucuuugauguuugcuuguuuguuuuuuaauugacaguaacaauauuucauguuuuuuauuccuuaccuaugaaugcugaaugggagggcaccuuccaaucagugauccaaagacagucuccucuccccaucacacugcuauaucguugccuuuauuaguagcuaaagagcuaucuguaggcaucagaccucugacuuagccugcacuuguaugaugucaccaucugagugucuguguauuuggguuugcccuagccucgugcagcucaccugggaacuugugagacccagacucccgaacuuuauaccaggguugaaguagcccugaacauggcuuuaauauaauccaagguugaagaagcgccucucagugucgccacgcccagccuuagggucaggccuuuccagaccugaugcugugugugcuuauguggugagcaaccauagucauguuaaggaaauacucuacauugcuucaugcugacccagacauugaaaaaaaaaaacaaaacaaacaaacaaaaaaacccacuaugucccacaguggcaaaagcuucuuccuugucuagcacauuuccaaauuuuacagcgugcuuucccaggacaggagcccacguuuucuggcucaggaagggcaauaugagacagaagcagcuucuccggcugaggcucaggcucaaauucccuaucgcuggaggaacaaacauaagcugugugaguaacacaguaagccaucuugaacauuuaaagcauauuauauuuuccucacugccccagcauuugccagagucacuucugaaaaguuaaauagcuacagucugccugcaaacagccaacucucaccuccuccucagccagccacacuucccacucccaccugcuggcuuagagcagugauucucaggaacaugacccauccaagucacccaggaagcuuccuaaaaguaccccugcccacacgccaucaguuggccaggcucgagggacucccugcaagaugcccggaugaucugagcauucagccaggaucagcaccacuucucugaagacugcugcugcuuauaaucggugauuucccugagagggagaaccugguuauugcugaggcauuuacucuagucaagucuguaauagagugcucaacuuuauauugggaaccaagcuuuauacauaagcucugaaaucgcauacaaaugaauuccagccauaucacuuaauagcuucuuuacugugaccaaauuauuuagccucucgauaccuauuucuuuucuggaaaauagaaauuauaauuuugggggccuaggaacauaauaaugguuaagcgggauaaugacuguagaacauacuccaccuccuuccucauaccacaugagacuggucucagcacugagcacucuaagucaguuccugucugcuccuuagcucucccuucuauggcuuucugaccucugucacugcucuuucacauccugcuaucucccacuggaucuucaggcugcuuuccuuuccccaccaaccugcauucacucuaacacacacccaaugacuuugcuagugccccuagacccuagccugacagcaggcaagagcagcugcuguagcuccaccguguccugucccuggagccccucugcuggcuggagaucaguagcagcauguggagcucauagcgcugcgagucaguggauuuguuuccuagggcugcaaaagcaggguaacacaguggcuugaaacaaaagaagccaauucuguggggccagcaagauagcuaggaaaggaaggguauuugcucccaaaacugaugaccaggguucagucucuagaaccuaagggaaaaaagugacuccugcaaguuguccuugggcuucuauacaagcacugcacuauacauaugugugcacaugugcacauacacaguaaacagacagacaaacaaauaaauaaauauuugaaaacuuuaaauaguuuacuccaucacuguuauagguaucagaaucugcaauucuuccaaggcucuagaggggacccuagaggcucuagaagauauugcuguucuuguucaagaaacaacucuaaggaacaaccagaguuccuuagcauaaccuuucccugucccugucauuugucugacucccauaaggacacuuucaguagauuuaaggccauccuaaucuuauauauuucuaucccaaguuuuaauuucauccgcaaagaaccuguuuucaaguuaggucacguuaugacguuccaugcagaugugggcugagagguucacaacucacuccuguaccuagccaugggaaucagugaggaaguauggcuguuaaagcaaauacgcaggauggucggaauuguaggagucuacaggguuacaagugaacauuacugauagguggguaggugcaggaaucccaggcaagccaugguagauacggcugcuuucaguauaauuauuugcugaagauaauuacacugaugcccaaacuuauuaucuucccagauagagcagaacacugccaguaaccguuucuguuuucccagggaugcauggauagcagcaacagcauauugugucaucagaugagauuguguuacuaugaagaacguugccuuugaguggcauuugaucacagccaguguugccauucacucuuccacucucugguacaggagaugcggcuuuauuaguguaaauagauuagcuccauuuaaggucugcuggaagucaucaugaaaaucauuaaguugaaaagaggccugaucaauugguuccccacccccaagcucuuagagauggcucuaauguccucacuaaaaaaaaaaaaaaaaaaaaaaccuaggguuuaaaacacaaagcauuuuggaauccaaucucauucuuuggugugcaucuguaccuaaaaaaagaaaacgaaccacuuacacuuuuuguuuucuuugaguuucauucccaguauuuuguuuauucacuaacagugaugcuuggccuuuucacaacaaguagaagccucaauuaagcaauuuuuuguggcgauuuugacuuuauccagagagucuggguaccaggagucccuguguucuugucuuuggauuguuaccucaccuguuugcugccaguguacuuaccugagcaauucaaaccuuuuguuacuaauggggacuugcaaucuccuugccuuuaccuggguucccauuucauuuuuaauccaguugugcuuuuuguauaguguuaccccuauugcuggcuuagauaucucuuuuuaaaauuaauuuuauuuguaauucauuuuuuacacuucauauuccauucccugccccucccuucccacccuccaacuguuccacaucccacaccuucuccccaccacacccugucuccacauggaugcccucaaccuccacccuaucugaccucuaaacucccuggggccuccagucucuugaggauuaggugcaucaucucugaaugaacacagaccuggaaguccucuacuguauguggguugggggccucauaucagcugguguaugcugucuguuuggugguccaguauuugagagaucuuggggcuccagauuaauuaagacugcugguccuccuauaggaucacccuucuccucaaauucucucagccuucccuaauucaacaagggucagcugcuucuguccauugguugagugcacauaucugcaucugacucuuucagcugcuuguugggucuuucaaagggcagucaugauagaucuguauaucauuucugcugauuccucagaucucucuuuguaaauuuuuuuuauuaaguuuccuugugguaagguggugacagccugaaaugcaugagucuagugucaccaaugagaaaguguuccagugacaccugcccaagggucccucuccucaucuacaggaugagaaggacacuggcccaagcuaccauuagacaaggagggaaguaucaugggcaugauguguccaacagggcuugaggaagucuccacauacugagacauuucacagcagcaauuauugcuucacuuauauaaucccuucauucugauaagcaucgaggagacugguucuuggccagauccuguagaaauaugcccuauuaaaggaaaagcaucacuuauugugcugguugcuuuucucaucucuguuacuaaacaacugaaggaagaaguuuaggugagaaggacauauuuuagcuccugacgucagaguccaucauggugaggaaggcagaaauaggcugcugcccacauagugcuggcauucacgaaacagaacuagagucaggguccaccugucacccucaaagcuugccccugcaucccuaugucuagcagcagggcuccaugucagaaagguuucauuaaacucauagaacacuaauaccagcugggggcauuuccauucaaacauaucacuagcaucuccagugcuguuucauacauuguuaaaccaucaacaugagaacuugauaaccaauaaacuauuuuugaauaguuuaugaaaauauuuuaagcaccuaaaaacuaaaagcaagucccuugaacauccacauucuccguagccaaaauucuaccaucauccuucucccauauugguuuuauagcuaaaugagccugcacauucuaauugcccuucagcuguuuuaucagugcagcuccaacucgucacuguugacaugguguuacucagaggacauuaaaaaugggaauguggagccggguaugguggcagugcacaccuuuaaucccggcacucaggaggcagaggcaggcggguuucugaguucaaggccaaccuggucuacaaagugaguuccaggacagccagggcuauacagagaaacccugucucgaaaaaccaaaaauauaaaaaaaaaauaaaauaaaaaugggaaugugugggcgccacagugagugagagcaucauugcuuucuuugaagcccucacuuguuggaagcacuagucuaaaagucuuuaaauauugucaugaaacaugaaauugaccaguucacauuaguuugaagguaggcccuuuaugaauauuacaugauaaaggaacuuguuuuuaucugcauauauucagaaggcuaugauaugagcgagaaauguuuuuauacacaggcagaccacacucacucugugagcaacuauguauaacugucuuaaagguuuggucucaucucugaaggauaaaagauuacauucuggauugcuuguuuguuuguuuguuuguuuguuuguuuguuuuagugacauuuuugguuaaugggucuuuagaaauccuccuccaaaaugaaaaaaaauaguuauauuuaaacuaauuucuauagaguauagauaguaaugcaaagaggcuagaaauaaacauuuaguaggguuuuuuuuuccuuuuuucucaccaaaaaaaaaguauaguuaccccaauaucuauuuuauagggauccuuaguuauuucaaauuuuuguuuuaggagacccaucucauagguuauaggcucauuuaaaaauaaaauaauaaaauucaaagcagcaagcuagcagcuuucauccugacagggccugcaugggaaguaauuacagcuaguggcacuucuuaccagcuuuacgugcugagcgcaaggcuguucgaaauggcaucaauauagggauaagccuugagcuuuaagcugggagucugaauuuacuuuuuaucauguaaugguggguuugcugauggccagcuuaguuugucaccuagacuuuuccaugcaucaggccacauuugagauaaauauuuugaaacauugaguggcugcuguccauucugaucuucucucagcccacucuuugguggauaagagaagagaagguaaugacuuaugacaggucugcugacggggacgaagcuacauuaguccucugucacucaggucuuuagaaggcugccuuugccugaaauacauuugacuuuaugugcuaacaaaggcaucuucagauuuauuucuuuuccuuaaauguuagagaaggggaagagcaucucagaaaaagaaacugggaagaaagcaagcuggcucaacagcccaagcaaaugauagcuaucauucucaggagggaauugcugaucuggcaagauuccugguagcagccagaugaguagagacagagaacugcuguacuuagggaauuuucaagguucuuauccuaaguaauuuuugcccugucuguauguugccauucuggcuuagggacauucuagugagaaagugaauagaaacaagacuaucuccgcuugaaaguuaaaugacccuuuaaagauuaaccguucaaggaaagcagcuggucuucuucaugcuuuucaagguuccuacucaacuugucuguacauaauauuagugugagcaucuacagugggcuggggaaaucugguccauugccugugacaagaauaacagaauucagucgaguaauuccccuguguuaaaaggcuauugaaacuaaaugucaauauuuauuaaauccuugcucugugccaaacuuaugguuucaucucugagugucuugggacagauggauagggaguaccaguugugaugguucagaagccaggcacuguacagggugaagagaggcacugggggccuuaagaaucaagagaaacauuggguaagaaggauucugcauuguuguuggauguguguauauggagaagaaggagaaaguguccugaaaaggggacacaagauucucggugaucuaaaaggacaaagugucugugcagaaguggaaggagaaugagaaacaagguuagacacagcaccccagaggccaucuugagcuuuacagggaccagcuuccuguugacguuugacagggaaacaugaaaggcuuuagggaaugcagauccucaagggcaagcccuuugaagaagacugugacuuuaaaagucagagaccuggcaucacagaggcagcugauguagggaccuagucacacugagcuagacucuccuaugaauguuuuguuugcuggagacugaagcuugaaacaagggccugagaacugccuaagauaggugaacgcaggcuuaguuguuugagguuacuccuuugauggauugccguaauuggccaaacaaacucaacaaacugauuuccuggaauuuacauuacagguuuucauuccuuugccacaaaggccucacaggccagagcuccucaccaucucugcccacaggagccaccagcauccagagcacauccggguugcugaaagauuaagcuguacauuucucauucaauuucucauucauucuuuuuagacccacacaagcucugucaguuggaaauccugcccuggggaguagacaacccacagcuagcucauuaacagguuaucugcgucauuguguccuuuuuagacugugaauauuaggaauagucuuuugagaagaaaaaaucaucucagcuucuauuugguuucucuuucuuuuuuuuccccaucucaaucuucuuuuaccccucaugguuacagcucuucucaagauggaugcccuaucuguagaguccagaauaccguggguauucacuugcaaauauguacaaauucaaauucagauaacugcacuuaaaugagcaguucccuaccucugcucacuggguggacccagcacuucucucugcccgauuuccacuauaagagcuuaauugcuuucccccuuuuauuccaagaggcauuucugaauugguuguccucuuggcuauuucaaggucaaggcugccuaucagguacuugcagaaaugcuuuggugaauuuguuugcuguguuucuauggcuuucaaagcuauaccagggcaagcaaccugaacagaguaagggcugaacugugcuaauuucuuuccauuucccaaccaaaguugcucuuuucuuucauccuuuccaauuuugccauagaucaguagaaauuuuuagcacauaguagguucacacugaaugaauaaauggaauugccagcaguguugucaaaagauguacaaaagcaaacucacauuauuuuucaagugagacaccauuauauuuuaaaauaaauuuucuuucugaaauuuuccucacagaaaagauguaaggacagugcaggucuccugagguuucuugcuguccauagccauggcaguuuaauuuuuauuuuuugauuguuuauuucuuuuuauuaauuuuuucaauuuuuauguaaguauauauuaguacacuaagcauguucccccugaaaccuccuuccccggccuuuucuugucccccugaugguguccuuuguucccuuggacacuucuuucaugucguaugugcauacaugauaauguauagcauauaaaaucuaagagcugcaagugagaauauaugcaacguuugacuuucugagacuggcuuaugucacucuaaugugauuaucuccaguugcauccacuuacccaccaauggcauucaucuuuauggcuggaaacguuccuuugugcauauauaccacacguuuauaaauccauuccucuguugcugaguccuacuuuguuccaucacuuagugguugugaguaauacugcagugacuguugaugugcaugugucucagugcuauguugauugcacaguauguaaaugcacagaagugguguauauauacuucacguagugaugaugagguaucuuguagacuauccuacaaagugugcuugcugguuguuucuccugacuucaugagaauugugugguuuuggacaucucagaucuucugaugggacccaucacuauugaugugaaaccaugacugcuggucugagacccugagugccuguuagggucuuuugauaccaaguuaucauccccaacccaguuuuuucauacuucauacauuauccugaguccccaugguauccuguuuaaaaagcaacuauuacaugcauugguauuuaaucuuuguguugcaaaguuuuguauguaugacaaacacauaguaucccgugccuaccauuuugaaaggaccuaggcaauucgagugacaauaauggcagggggcaaagugagcacaggaaagccauccuuaccaaccgagcaagagauucacuagcagaagauagcaaagauuugauauguagcauguaaauaagcuaaagauuuuauuuuucaugagcaaaauauuuaaaauaaguuguaauuuauaaaaccauuguuuaguuguugagaauuuucuuaaucagucacuguguugcuauuuuuuaaucuuguaugagugaauauaaagcuuauauauuugcuuaaaaaugcauuuaaauuauuuaaaugauuaguuauauauuuauaaugccuacuuuucugcagaaaaucugauuguuucuuaaaaaucauuauaagugacugacuugagcuauuuuucuuuuuuucucaacuaguuaagucuagauggaaaguaagcuaauuggcucguggaacuauugacuagauuuaccucaugaguauuaaccaaagcagaucuugugccugugaagaaacaaucaauuucucucuagcagcuuagcaaaugcagaugcuucaagcaauagcaaaaagaaaggggagcggcuauuuugaucaguuucuucuuucuuuuaugaccuggacuuagagucacaggcagacuuaccucuaugguagaaauauaauagaucagacaggcacuauugugaccucaagcauauacaugagacaagucauuuacuuuuauaauauauaauauauaacauugucuaaaauaguuuuuauaugauuaauuugaauuaugaguuuucccagcacaauuugguguaugcuuauauaaagacuugacuuuaauagaaccuuugaggcuggcaugugccuuagaaaauaauccaucugcaucccuugagccaggccccacguaugagccuugucuaaagugacauccagaaaugacagcuuauaacagaggcucuagguccccuccuucuggcuuggcucucuguauucugcuugugguauucguuuaaaauguugcuuugguuaguucagugauuuacuuuccguggaguuuacacacacacacacacacacacacacacacacacacacacacaugccucccaguccuccucucacauagccccucccccagcacuugggcuuuuacuguaagaacgguauuuuguuccguugaacuguagagaaguggcaucuuuaacuaccauucuuacagaaugacuuugccuuuugauccuuucgcuaggcagagcacguuucacuccacaaccaaauaacaagcaucccucuccuaauuugugguuuucaaauuucugcaguguuuuuuuuuuucuccuugcuguccagaaugcugucugaaaagucacaaugauuuaaauaauugauggcuacuuuaugaaauugucagccuggguccauccuccugccucccccaaccacaaguccucgagcagcuaauccuuuuauguuguauguguuuuuucuuccugguuucauuuagauaauuauauuauucacccugaaauauaauugucguuauacugugggggaggaaggggcggaguagggugggagcugccugcuguuggcaucugcagguuauaaaaugucuguuacacucuagccucuaauuucuuugccaucccaccuuuuaaagauuuaauuauaccuguguaaaagcauaauuugaaaugugacuucugauucuuuuaaaagauaaaaaagagauuaauucauuguuaaacaugagcaggcauaguacaauagaagaaacuuuaagacugaaauucagagauuugcaguacauugaguaaacaauuugugaaugccuacugugugccaagacuuggcaaauguaaaccauagagaagauagaaaggcuuuuguccucugggcgugugcuuccuggcgaucagcugcccacauguggcauggcaugaagcagugugcuugacaucugugucucaacaucuuguccucaugcaguguuggucuaggggcccucccaccugggacaucucaggagaucaugaagcgguggccaucauucuucuuugucagauuuaguuggaagaguaaagcacuauaaaagguauaaauuugcuaagaccauaaguuggaucaccaugucugaaaucaaagacuguccagucugaaagcacucagacaaaugaccccuauuuccagaauauacuuccuacagacuaccugccauagcccaaagcaggaugaguuugagaucagaaaauugcauugccugagcaagugccaguuguuaucagaguagaaauaacuuugugugucaaauuauugcauggcgccuuuuucacuagcucacaaagcuauuuuuccagucaaaauugugguucugguguaugcuuucacaagucuagccuucuguccauggguuagaauggaagaucaugaacugguuuuuuuucuuuacauauuuauuguucaugucucuuugugaguauuugaaauguauauggucagacuuaaccaacucaaaaucagaaacuaaagauguuaaauguaaacacaguggcagagcagacuggaacuuuaagaagaaaugauguucaucucugucagguccuuauagcauuggcuaaaauaaggcccaaaugacagcaaaucgccuguuacaaaugaaacacaaauagcacaugauagaauagagauuuuaaauggauuuuauagcauguuuguuuucagggagcaagucauaacccauugccuuauuggagaagcaauuuuccuguuacagagaaaaugcaguauuuaagaaggaaaugaauaugacaaccaaaugaacuuaguugaaauuagcaaaucuguuucuuaguuacuuguuuuuguacugggaaagugauacagggccaagaucagcuuuccauaguaauaguucuuuuauggaaaaaguagucugucugaguuaaugcaguuugcacauguccuaucuucucugguggugaagacuaccauaaggacucucucucccuuacauagcaauaggaguaguuccucugacuagccacugccuccuuuuuucuuuucaaagaacccuguucucuguugucuagcaauaaaauaucaucuggucauaagcccacucuuuuuccgugggugaagaauuaucuuuaucuuuaggacuguacucuuuggaucaguacugugaauauuuuaauuaucuuguucaucauagaggguguuaucuccuuaauguguucauuuugauccauuccaugaaggugaaacacucugcucuucaugucgaaucaagcacucugauaguguuaguguuccuugucuacugcuccaggagcaagacuggauccaagcuaaggacacugucuccacagagugcuggacaguaaauaugagccugugguuuuccaucucuguuugaauagcugagccuuuauaguauaaaaccaagagcagacuguauaaaugaacacaaguagcugugagcuaauaaaaccuuauuuacaaaaaauaaauucagcagcuggacuuggcuaugaguuguguuuugccaaucccugcuuuagacaguguguuggaaaugauucguuuuuguugguuuaauuuaaaaguuucuguccaagugaucacuuagggcauuuuuaugaugcuuggcacauguauagaaugaauggguggugaugaauuuauaauuaaccaucucugucuucuaaaggacuuagaacauggugaaaagaauaauggcuugucccucuugagcagcagcagugccagcauuuuggaaacccuuucucucucucucucucucucucucucucucucucucucucucucucucucucucuuuuuuuuuuuuuuuuuggcacuacagguuuacagcucuuugugcucugugcuugccucucuccaaacccugacuuccucuacuugugugcaguuccuccaucacaccccucgccauagcauuuggcgaugauccguauuagguaaugagauaguuuguugugccugcaaugaagaaaaugauguaaaauguuuuuuaauaaguuaacaggagcaaguguugaaauuacuguaaugagauaaugacagugcagcuuacugcuuuaaagauugugcucuggugaaagcacaggcucuuaguacauuuucccugcauuuuccuugucaggaguauuaggcauuggucuguuugucuaccaauaauaggaaauggucauugaguugagaagagacugggacccauuugggaguguuuuaggaugucagccauggaacaugugugccaauaaccaaauccuauagugaugagugcuuuuagugaauguuaaaauucacauuucugagccuuagaccaauagacuaaaucugccucuucaauaugcuucuuucuauaaaucacaugaacuuuguuucuuugacauucuaagugguuuuuuuaacaucagaaauauuugauuuuuaaaaaggauuuauuuauuacgauagguaaguauaccggacaagucccuucuggucagcgccagcaccggggcauuuugggcacggagucggcagacaccuccaagguccccuagaggagucuccacgcgaucuuagaaccacccaugaguggaacacaacuucuguuccaauccaaucgcgagggaccugagacagcauuagagaagauggaaacccggacugaccagggucacaagucccuucuggucagugccagcacuuggucaccgggacagagagucgguagaaacccccaaggucucuagaggacagcuucugagacagauccuguuucgggcuccagacauccgggcaucuucccgaccagaggagagguguccacccugcucuggagggcuuuguuguagcaccugggagagccaucuugguucccagaucccucugagacuagucugugcaggugagaguauggacuacagaagcuaacagcuucugugacaggccaaagcaacacagcuucugggacagguccuguuucaggccuucaucuucugccagaagggagguccgaacaccagauaucugugugccuucccuguaagaagagagcuugccuacagagugugcucugaccacugaaacucagaggagagaccuagucuccgaggucugcugauagagaccaacagaaucacgagaggaacaaucucuaaccagagacaacuauuacaacuaacuccagagauuccagauggcgaaaggcaaacauaagaaucuuacuaacagaaaucaagaccacucaccaucaucagaacccagcacucccaccucacccaguccugggcaccccaacacacccaaaaagcuagacccagauuuaaaagcauaucucaugaugaugguagaggacauaaagaaggacuuuaauaacucacuuagagaaauacaggaaaacacugcuaaagaguuacaaguccuuaaagaaaaagaggaaaacacauccaaacaggugauggaaauggacaaaaccauacuagaccuaaaaagggaaauggacaaaauaaagaaagcccaaagcgaggcaaagcuggagauagaaaccuuaggaaauaaaucuggaaccauagaugcgagcaucagcaagagaauacaagagauagaagagagaaucucaggugcagaagauuccauagagaacauuggcacaacaaucaaagacaaugcaaaaugcaaaaagauccuaacucaaaacauccaggaaauccaggucaaaaugagaagaccaaaccuacagauaauaggaguagaugggaaugaagauuuucaacuuaaagagccgccaaauaucuucaacaaaauuauagaagaaaacuucccaaaccuaaagaaagagauucccaugaacauacaagaagccuacagaacuccaaacagacuggaccagaaaagaaauuccucccgaaacauaauaaucagaacagcaaaugcacuacauaaagauagaauauuaaaagcaguaagggaaaagggucaaauaacauauaaaggcaggccuaucagaauuacaccagacuuuucaccagagacuaugaaagccagaagauccuggacagauguuauauagacacuaagagaacacaaaugccagcccaggcuacuauacccagccaaacuuuaaauuaccauaaauggagaaaccaaaguauuccacgacaaaaccaaauucacacauuaucuuuccacgaauccagcccuucaaaggauaaaaacagaaaaaaaaaaaaaaaaaaaaaaaacaauacaaggauggaaaccaugcccuagaaaaagcaagaaaguaauccuucaacaaaccuaaaagaagacaaacacaagaauacaauggcaacucuaacaacaaaaauaauaggaaguaacaauuacuuuuccuuaauauaucucuuaauaucaauggacucaacuccccgauaaaaagaaauagacuaacagacuggcuacacaaacaggacccaacauuuugcugcuuucaggaaacccaucucagggaaaaagacagacacuaccucaaaaugaaaggcuggaaaacaauuuuccaagcaaauggucugaagaaacaagcuggaguagccauucuaauaucgaauaaaauugacuuccaacccaaaguuaucaaaaaagacaaggagggacacuucauacucaucaaagguaaaauccuccaagaggaacucucaauuuugaaugucuaugcuccaaauacaagggcauccacacucauuaaagaaacuuuaguaaagcucaaagcacacauuacaccucacacaauaauagugggagauuucaacacaccacuuucaucaauggacagaucguggaaacagaaacuaaagagggacacagugaaacuaacaaaaguuaugaaauaaauggauuuaacaaauaucaaaagaacauuuuuuccuaaaacaaaaggauauaccuucuucucagcaccucaugguaccuucuccaaaauugaccauauaauuggucacaaaacaggccucaacagauaccaaaaucuugaaauuaucccaugcauccuaucagaucaccauggacuaaggcugaucuucaauaucaacauaaauaauagaaagccaacauucacguggaaacugaacaacacucuucucaaugauaccuuggucaaggaaggaauaaagaaagaaauuaaagacuuuuuagaguuuaaugaaaaugaagccacaacauacccaaacuuaugggacacaaugaaagcauuucuaagaggaaaacucauagcucugagugccuccaaaaagaaacuagagagcgcacacacacgcagcuugacaacacaccuaaaacucuagaacaaaaggaagcaaauucacccaagaggaguagauggcaggaaauaaucaaucucaggggugaaaucaaccaaguggaaacaggaagaacuauucaaagaaucaacuaaacgaggagcugguucuuugagaaaaucaauaagauagauaaacccuuagccaaacucacuagagggcacagggacagcauccuaauuaacaaaaucagaaaugaaaagggagacauaacaacagauccuaaagaaauacaaaacaucaucagauccuucuacaaaaggcuauacucaacaaaacuggaaaaccuggaugaaauggauaaauuucuagacagauaccauguaccaaaguuaaaucaggaucagguuaaugaucuaaacaguccuauauccccuaaagaaauagaagcagucauuaauagucucccaaccaaaaaaagcccaggaccagauggguuuauuagugcagaguucuaucagaccuucaaagaagaucuaauuccaguucuucacaaacuauuccacaaaauagaagcagaagguacucuacccacaucauucuaugaagccacaguuacucugauaccuaaaccagagaaagacccaacaaagauagagaacuucagaccaaauuucuuuaugaauauagaugcaaaaauccucaauaaaauucucgcuaaccacauccaagaacucaucaaaacagucguccauccugaccaaguagguuucauuccagggaugcagggaugguuuaauauauggaaauccaucaacauaauccacuauauaaacaaacucaaagacaaaaaaucacgugaucaucucauuagaugcugagaaagcauuugacaaaauccaacacccauucaugauaaaaguuuuggaaagaucaggaauucacggcccauaccuaaacaugauaaaagcaaucuacugcaggccaguagccaacaucaaaguaaauuucgagaagcuagaagcauucccacuaaaaucagggacuggacaaggcugcccacuuucucccuaccuauucaacauuguacuugaaguccuagccagagcaauuugacaacaaaaggagaucaagggaauacaaauuggaaaggaagaagucaaaauaucacuuuuugcagaugauaugauaguauauauaagugacccuaaaaauuccaccagagaacuaaaccugauaaaaaagcuucagugaaguagcuggauauaaaauuaacucaaacaagucaauggcauuucucuacaugaaggauaaacaggcugagaaagaaauuagggaaacaacacccuucucaauagucacaaauaauauaaaauaccuuggcgugacuaacuaaggaagugaaagaucuguaugauaagaacuucaaaucucugaagaaagaaauuaaagaucucagaagauggaaagauuucccaugcuuauggauuggcaggaucaauauaguaaaacagcuaucuugccaaaagcaaucuacagauucaaugcaauccccaucaaaauuccaacucaauucuucaacgaauuguaaagggcaaucuccaaauucaucuggaauaacaaaaaaaaaccuaggauagcaaaaacucuucucaaggauaaaagaaccucugguggaaucaccaggccugaccuaaagcuguacuacagagcaauugugauaaaaacugcaugguacugguauagcgacagacaagaagaccaauggaauagaacugaagacccugagauaaacccacacaccuauggucacuugaucuuugacaagggagcuaaaaccauccaguggaagaaagacagcauuuucaacaaauggugcuggcacaacuggcgguuaucauguagaagaauucgaauugauccaauccuaucuccuuguacuaaggucaaaucuaaguggaucaaggaacuccacauaaaaccagagacagugaaacauauagaggagaaaguggagaaaagccucgaagauaugggcacaggggaaaaauuccugaauagaacagcaauggcuugugcuguaagaucgggaauugucaaaugagaccucauaaaauugcaaagcuucuguaaggcaaaagacaccaucaauaagacaaaaaggccaccaacugauugggaaaagaucuuuaccuauccuaaaucagauaggggacuaauauccaauauauauaaagaacucaagaagguggacuccaaaaaaaucaaacaaccucauuaaaaauggggugcagagcuuaacaaagaauucucaccugaggaauaccaaauggcugagaagcaccugaaaaaauguucagcaucauuaaucaucagggaaaugcaaaucaaaacaacccugagauucuaccucacaccaggcagaauggcuaagaucaaaaacucaggugacagcagaugcuggcaaggauguggagaaagaggaacacuccuccauuguuggugggauugcaagcuuguacaaacacucuggaaaucauucuggcgguucaucagaaaauuggacauaguacuaccagaggaucccgcaauaccucuccugggcauauauccagaaaauguuccaacugggaagaaggacacaugcuccacuauauugauagcagccuuauuuauaauagccagaagcuggaaagaacccaguugccccucaacagaggaauggauauagaaaguauggacauuuacacaauggaguacuacucagcuauuaaaaagaaugaauuuaugaaauuccuaggcaaauggauggaccuggagggcaucauccuuagugagguaacccaaucacaaaagaacucacaugauauguacucacugauaaguagauauuaggccaaauucuuagaauacacaagauauaagauacaauuugugaaacucaugaaacucaagaagaacgaaguccaaaguguggacauuuugcuccuucuuaggauugggaacaaaacacccauggaaggaguuacagagacaaaguuuggagcuuagacgaaaggagggaccaucuagagccugccauauccagggauccaucccauaaucagcuuccaaaagcugacaccauugcauacacuagcaagauuuugcugaaaggacccugauauagcugucucuugugagacuaugcaggggccuagcaaacacagaaguggaugcucacaguuagcuauuggauggaucacagggcccccaauggaggagcuagagaaaguacccaaggaacuaaagggaucugcaacucuauagauggaacaacaauaugaacuaaccaguacccccuggagcuuguuucucuagcugcauauauaucagaagauggccuaguuggccaucaguggaaagagaggcccauuggucgugcaaacuuuauaugccucaguacaggggaacgccagggccaagaaguaggaguggguggguaggggaguggguaggggaggguaugggguacuuuugggauagcacuggaaauguaaaugaagaaaauaccuaauuuuaaaaaaaguauacuguugcugccuucagacacacuagaagaggucaucagaucccauuacagaugguugugagccaacaugugguugcuguuauuugaacucaugaacuucgaaagagcagucagugcucuuaaccucugagccaucucuccagcccaaaauauuugacuuuuuaaaacauauuuuacucauuauuugauuauuccauacauguauacaguguauuuuaaucaaaucuacacccuaugcucuccccucuguccccucuuucuuucuaccauauuuggaaguuaucuaacucucugcacuuuagccaaguuguuucucaaaucaccgaacagucagcauaagacacuagagcaauacacaugaagacuaaauacuucccucccucaacuuuauuaucagagaguagaagacauacuagcaaaucagcuuuaguccaccaugaugggcagucaaacaaagcaccaugugaguauggaugaucaaguuuacuuucuaagucauuccaaaaagauguuauaaaaaugccaagauuaaaugaaucucaaaagguaggaaccuguugcugguagaagaagaggccuugacaaagauauaguaaccuaacucaucaaggacaacagauauauugucauauauacccaaaggcgauuccuaugcagugaugaaagugaauuaacaaaucaugugauauugauauaugggauuagcuuaauaaguauuuuuguucuuaguucauaauucacuuuccuguugaacuaauauaggcuggcuuagaauucaugaucuuuuuaccucagcuacaauacugggauuauuggcauauaccaucacccucaucugucauacuuacuauucauuaaagcaaggcacaaagaauagauaauauauuauuucaguuauaauaugccaaguaauucuauggaguuuaaagauguguguuuuauacccauggaaggaguuacagagacaaaguuuggagcugagaugaaaggauggaccauguagagacugccauauccagggauccaccccauaaucagcauccaaacgcugacaccauugcauacacuagcaagauuuuauagaaaggacucagauguagcugucucuugugagacuaugccggggccuagcaaacacagaaguggaugcucacagucagcuaauggauggaucacagggcucccaauggaggagcuagacaaaguacccaaggagcuaaagggaucugcaacccuauagguggaacauuaugaacuaaccaguaccccggagcucuugacucuagcugcauauguaucaaaagauggccuagucggccaucacuggaaagagaggcccauuggacacgcaaacuuuauaugccucaguacaggggaacaccagggccaaaaagggggagugggaggguaggggaguggggggguggguggguaugggggacuuuugguauagcauuggaaauguaaaugagcuaaauaccuaauaaaaauggaaaaaaaauguguguuuuauguuauaaaagauagaacaagguuacuucagggguuaccuuagggggaggggacaguuugaauacagcaaggaaguacuuaggacacuagaauuuuuuaugucuuuuucggguuuugguuucuauucaauuucuccuuuaugauuauuuaccaagauauguguucauaugauaaacauuugccauacauaugcguucgccuauuuucuguaacaaaauaguuuauaguauuucacucauagucuuaggguuuguaaaucgaagagugaccaacccucucugcuugaccucugaugaggaccucauggcaggugccaucagaauagcaaaagcauguguuaaaguggucacagaguaagaugaacaaacuauagucagggagucagguuugcugcauuuuacaucaggcuguucuuacaggaauuaacuggaguccuaccagaacuccauuaaucuauuccaggagagaugccuccaaacccaaguaccucccacugccuccuaccucuuccacugucuccuaccucugcagcuccucuuccuuucacuaauaccauacuggauaccaagcuucauaaauuuuuggauagcacauucaauguuuccaaaccauagcucuguguguguguguguguguguguguguguguguguguguguauguguagguuugaugaaauagaguuuucucaaauaagagaaaauuuugaaauaagaaguagaaagagugcgcuugaucauggucuauuuaauauacuauaauaaaauccagugccugguggcucugcacaggagucuguauuacagagaaaucaucuucugccuugaccuaaccacuucccagaggcuuugggguuagaauuucacguuggagauugggaugucagcauaugagugggagguuuguuaauuuagauguaaaaugucuccagugaaguccuguguuuggacacaggguccccagcaguagcacuguuugggcagguuauggaaacuugaaccucacugguaggagguggucacuggggucaaaccuugagacguucuaguccagcuucauuucuucauuccucucuguucccugacuguggauguggugugagcuggggcuuacugcucuugcuccuaugccuucccugcuuaaagccauuauauuucucaccauagugaaauaaucccuugaaacuauaagccagaauagacccuuuuuccuuaaguugcuuuuaucaggauaucuuaucacagcaacaggaaaaguaucuaguauuaaaaaaaaaaagcauucaaucuauugcauauauuaaggguguucugcacuaaaaccucauagucacuaacuuggcuguaaauagaacaccaggaucuaccaugggaccaagaaaacugauaaucuucccaccuucauauccuccucacguucaggaacuaccucaaaguagguaugcccuucuacacucugaccuuggaugaccuucaucuucacugaaguugagaauuccauucugacuaccuugaauguauggucccuacuacuuuauaccuucuuccucauacccacaucacucaucacccccaucacccacaucacuacugguuucuccuuagauucaauucaacuuucacauccaaacaaaaucuacuucagagccagguccuuaaaaaaaaaaaguuugccuuaaaugaaaaccauuucuacuuugaaauagauuuuuguuccuaucaaauagguaagaacaugugaccauguguuuggaacugcccuuuggagccugauagacucaucuguggguacacaaguaaagacaauaacauccugccccccagaaucuaccaguagccaauugccaguuaugguccugugagugcuccccaguuccauugacccauucugccuucccaguacaaacagcugcaucugccaugagguaauuacagucgccauauaaugcccagaagauagcaucccacaguccuucuucauaucuucuggcucucacacuccucucccaccucuucuuccacaguguuuccuuagccuuagaagggguggcacaaguguccuauuuagaacuaaggggucgacuagcacuuauucucaucucacugagcagccauggguaauugcauucaccgccauugauuacagacagaagcuucucugauuuugacuggguguaaaauuugucuaugcauauaaauauuuggaauguaaucuggaaccauguaacuuuagcuaaacaacuguaauaaauugcuuuugagggccuaagacuucccaaugcauugggguuuugauugaguucaugguaucagacaugaguuuucuccuguggugcaggccucaaguccaaucagagaauggucaguuaccagccuauuugcaugcgugucuugccuggcagguuauuauugugguuuguagcauuuacaacugggaaacaacaucacugacucccuuucucccuuggcagagugcaucacaccuuacagcauuaugaagucuaggaaggauagugccucuacaucauucccaguuugauuucucuguaccuugcaaugaaaguauuccuaucagucauuuuugauggauaggaggaggaaugaaaagagccucuauggccucccguacuaacaacucauaaggaauuuucucauauguggcaaugagaguuuuguuuaauaacuccauggcaaccugaguaucuucuuucugacuccuuaacauuuuuuauucaauuggcuuacaaauaaguagguuuccauauggcuuuuucagaccacuuucguuuuuauuaaccauuuccccaaacuuauaucuugauauuugcaacugaaguguguguguguguguguguguguguguguguguguguguguguagguagccucuauauuauaggaauuucaauucuguugcuguggguuucucuguuugaaaugaauaaaucuuguuauauauuucgagagauaauauaaaggcagacucuaacuagguagacauaugcuuuaugacuuuuuuuuuagcauaguaacuacaguuguauggcugaugaacauccuguuccuagucugucuuacaacaaauggucuacugggaggguucuguggaguugcaauguaugagccuccagugugggccagcuagaaaagagaaagccagauucaaaauacaaccuuuaucuuccucccaaaugaagauaucuguggguuagacugagcccaaccaaacugccugggaucuaauacucucacaaauaaaaaagauuggcauguaguucagugacaaaaagauuucacagaugucacucuccagcugauagcuccugccacucgucaccuagucaugggccuccuccucguggaggcgguguuaccuuccugacccccacuuuguaacuucauuuaaauccagccccacacuucacauugcauacagugggcuaaaggaaaucugauuacaguaacaaauaacagguucaucuuacaaucaugucgugaacauaagacagucaccugacucugcugcaguaguaccagaucacugauaacauacucguuuuaggaggauuggggagugaagcauuucugguuaacuggugaaacucuucuaucugacaagacaauaaagacuauaaaagaccacccuugguucucuauaauaaaccauaagcuuggcagugacucucugauaacacccaucuccuccugauucugcauccaugcacaccagaccugugcacauacccauacaggaaaucuuucauuuagaccuccaaaaaggugaaaucacauuuaugucuguaaaauuggucuuuaaucaagcaaagaaaucggagaugaagugaaaaaaaaaauugagcaaaggcaauguaagaagcaagccgagacuggaauuuuauaaaaucuauucgacuccugucagcugcuugcuuuguuaccauaggcuuucagucauuuaaaucuuuaguguuaucuaucaacucaguuccaccacaaaauacuaacaguagaaaucacaagcucaucugaaggcauccaaguaccuguuaggcccagcccuuuaucacccuuaauccagcccguuuguugauagcgugcaucccaugccuggcgccaugcccuugagauuucuaccagcaguaaacagauaccucaccuguauucuagacaggaagacuccauauguucugauuaagcaauucuugaauuuaugauggugcaaaaauaagugcacauuuagugggaagaauucuggucuuuccuggguuagcauauacauucucauuauggcaggcaugagcaguccaucgcagaucucagauuuccgugcaguggugagggagaguaccugagugcauagugcagugcugccaagcuuggucaggccucaggugaaacagaaaaugcaguuuugacuuacauugcgcuaaucaggauuguaaccccaccagcaguugaugaucaucugugugcuccgguuugcucuuacagcgagaaaggagcauagagccuaaguaacaaaagcccacuuuuccgucuguguucuaguaaauuaaaccgaguugacaaaaguaggcaagccagaucugcuggugggccguagcauacuaacaaauacaguggcaagaaucugaguauuaaguuagugcuuaauuauuguagcuugaucuuaagugagccucaucaauuuccuauuuauuugugaaguuugugauucacuucugacuccucacaauuaugccagaguaucuuggaacauguggguuggguacagggcccccacacaggacguuaggcuacaccucggaagaucuguaugaaugugcuucuaauuggaaaccuuagcaguguguugccuaucaaaggggagcacucuggccucuucugccagagaguaugccugcuaucuucaggaagagugcacggguuccuuaacaucaacccuggugguugguuggcuggugagcaccuacuguucccuucaaucuaagccuucccaggaguuuagacuugccaaggacgugguacacucaguuuuguacuagcaucauaaaaguggaggcuucggauugcucaucacugucccuaaagcguacaugcugacuugcugaccccuuacucauccacaguucuucccaccuaccugaaauacccacuauucugucccucaacugucaggcccuacccuuaagcacaucucagcuuuccuaugggaccugaaguaugcuuguucuuauucuaauaauaccagcuccuaaaaggccuuuuaaggagcgacaguuugcucaguuuacuuuuuucuuaucuuggcagucuuagcuuccgaaugagauuguaaaauuuuuugaaaucugagacuauuccuaacccaaaucugccugucucacagcuuuccuaaugguaggucacucaguacacguuguuaaguguguuuagacuaaagcaaauaugcucuugguaucagaaagccucucggaagccaagaauauuaauucaugcaagcaguguuuggugcuuccgcauuauaauggcaggucuccuuugccauaaucucaaaauuuguauguauuucauauucauucauguccugguaaauauauagcaaccaguuuucuaggaaagaaugaggaggaacugauaucagccuugauguuuacuguuugccaauacccaugguauaacuucuccuauguggccaauuuaaugcugcuaacaugauaugcuaucuuaggaacucauaguagcacugcaucauauggagccucccucauauacaugcaaugggcauaaaugauccucagaacauauagaguaggaaaauacaaaacaacuaacugggaaguaguagcuuuugaguauuacuguaacuuuuauuaaauguauuuaauugugcauuuacauuauauaauuuuuaauggugaaugcauuugcuaacugacucacuuuagccuuaagauguaacauugcacccauaggaacagacaagacgcauccccaacacaucacuguuuauugugaaauuuauuuuaguggguucuuugucugccuucuuucacagguuaugugcuuccugaagguagagaacuaucucuguucacccaguguugcaucucugaugccaaacacagauauuuuuaaguauuuauugcuugaauaaaucagcccaauuuuauuucauucuuaccaaauuaauacaaccuaaaaccaaaggaaaaugguuucuuucucuaaaauuccaccccccaccccuuacuuuuuuucuuuuggcugccuuuaacuauauacgaugacuauucguccugaagcacuucagugcauuaaauauuaauguuuucaauaucuugcaacuaaauauaugugaguuauucauggguauagugcucagagaaauaacucuuaauauaaauauauucaggaacuauuuuucagcauaaugucaauuuuuugagcugcuucuguucuuuuagcccaacaaaacauugccagucccugugauauauagauuauuuguuuugaugaaauugcagaaaauguaaacccuuuauggauacuguauucuuucauuccuucagccucaagcuuuggcacugacaagaaugcagaaauagaauucuuagcauauuuugcacuuuagggcauucuaagggaaagagaauacuauucucacaguauaggcuaaccuugcacagaacauguuuugugagcucccauccuaagguuguuaauaggcaccguguaaaaacuaguuccaaggucaaaauaaguuugggaagacauuauuuccacaugaaaugagcuuuuugcaguagcacauaacagaaggagauacaguaaauacuacuuccccaguggacuauucuucuguaagagacuguagaccaaauguuccaaggaguucuguaggaaauuguacacucaucaugagcugacuuacaaaucauagagggcuugggacugagagcacagagcuucccugguuacacucccugcccugcacccgugucagaacccaucucacauggcuuccagaagcuuuuucagggaacuugccuucuuuccuucaaccaguaaacaaguaaaaaccagaacucugcaaucacugucccuuccuguuucuccaugggaaauggcugcaaagcaaguuggcuuucuucucagccagguuacuauuauuuucuuuucuucuuuggacuaguuguaacuaauucaacccuuccuccaaagaagccccuagaauucuugugauccuaacuguuccuccugugucucucucaugagaucucuagacuucaguugccauggaacgucccaugcacucauguugaaccucuuacucuggaaccacuguuucuguuugguucaugcuucuagcugcagagaaucaccaaacuguaagguagacauuggggucagucguggggaauaggugacuuauauggggacaguacugagagaagaucucucagaagguaccauucuaagguuuccugaagcaagcuguagagggcaagugcauuccacagaggaagggaccaggagccagcucagugguggacgacuugucaccagaaaaggggccuggauaggagguaaaggaagaggaaaggaaaguaaugagaugucaaagaaaaagccagaugagggcugcaggcuuguguaaggcaacuguggcccagcuaacuauguuguuuaaauaugguggacucuguuggaagauuuuuuuuuuaaacacaagacugacaauaaguuuucaaaaauuaauccuacuuaauuagacuuucgcauaagucaccguguuaacaccauccuuuuaguaaucuagcucuaauuauuugguuauuacaaauugguuuuuuuauuuaaaaaaacgcacucaaauuucuaaaucuuauugauauuugucauaguuuuacuauuauuuuccuaauaauaaugauuagaaauuuucaguaguuuuggauccaagugaagaccaucuguuucucuuaauuuuguaauuuugggcuuaugcauaucaggauaauauuuaauccugacuuugucacuuacuguuguuaaacauucucaguuuuuuugauugauuaaguuuaugucuuuauucaauauuaucaauaaaauuucaguaccugucauuucuaugggcuugagcucuuagaaauaucuuucaaguuuaaaagaauccacugaagccuuugcccccuugacauccuggauugucacuugucuuuuuguuuuucaaaauaauuaaagccauauagacucuucagucuauaaauccugaaggaaaaauaauauaucaucuagaauaucaugaaauagguuuuuaggugaaauuuucuugucuaaauuuucauaauucaagagacugaaauauaacuaauaaauucuagaaggugcccuucccccauugaaaaacugcaauauucucccuugugucagaaauuggacuacaaagaaaaauaaaacuuagaaaguaucacuucuuagggcagcaucuccugccuuuuuggauacaggccugccucaguucauucacucauagugaguuuacugagcauucugccaguggcuguuaccaaauauguauuaaacaauaagcaauagacaaucucucuucuuagguauuccuugaaggguugcuugguggaaaugagauggguuuaguuacuagaagcuagguaaagucaauuauauaucauuuugccccuaaaguucaaaagcuguucuggccuucagugggaaaguaagaguuaaaguacaauuggccacagcucaggcaggcaaggucauuuuggccuucuguaaaacaacaccauuccuuagcuugacacugaguaacugggugcuuacucaccagcuggaacaccugcuuccuuuagcuagcugggcugugccauuuuuccgucccaucuucucacucucaagauuucaucccuuguuuugccuguaaccaccauuauuuuguacagaaagaaaaucuuacuuuacccuaauauaucuaaguugcucaacacuggguuuagguaugccugaccccgccccaagccccuaaagugugccagucuccagguauuaucagacucuuaccccugguuguucuucugugccuccuguggcacagugaucuguuugacagcuagucagugugagcugaaccgcugguuccagacauaccugucugccguaaugucucgugagcaagcuucuagcaguucacagggguugguggguucaagauguuggguuuauuuccauuugucuucccagaaguaguucauuuuacuuuuaaggaaauggaauacauggaggagauagccuuaaccaggagcaaggggcaacuaccucaucagaaaaucagugccaaagcuuccauccuaacuggcuccaagaaauguccucaugugaacugccacuaagcacccagcuuccugguccacaggaugaagcaaugguaacgcugugaaggcagacgcuggguacucauggcugggcagagcuguccagcggaaagcguagugucuguugcucauauuccuaccccuuccaguuggucuuuagcccccuaaguauuugucuuacauucucuucaacuaugcucacuuguuaaaggcauauacacaaagaggaguggagggggcuaauccuguauuucacaugcucuaaaacuaaacagagcgugagaggagaguuuacaucacaucugacauucuuacugaucauugcugauaaaaacuggcagaaagaaagguaaucggagccucgggaauucaauucccuccuuuaauccacucagcagauauuuuauuuuuaaaacacaagugcagccaucagcaaaauugagaggcuguaugggacccugaggcacuuuuaaacuuuggagcucucuaaacucccaccccaucccuaccuucaaauggucccucacagccauuucuucugcuuagguguuacccacccccuagccccccacacccccacuauuucuuuccuuuacucccuagaaaccaauuaaaagaagaagaagaauuugccuuuuggcauuaauuaaagaaagaagaagccuuucugaucuagacccucagcuagagauuugugcaguccauuacccugcuacuuaggcuucucagauccacaccaugucuuucuuguguucggaaguaguagcacagggcugucugauuuucagauaguucaggcuucuucugucauuaaggcauugccagauaguuccuaccagcagagaagagcaggcaguuccugugcguggccuccucucuauccuaggcauuuggcacagaacauugucugccugacagugcuccgucaagccuucugaacgaccagccuuccuggaauagcccaguaguuucaaccagaaaaugaacuuaguuccacuugcaaauuucugcuguucugcacugcagcaagauacccuagaagauuucuucucauaagauuuaaaaguaaaaucuacaggcaugaccaccacauguguuccacuuacaggucgggugagaucgaugcuucacuuccaaucucaagcuuguugcgcaacucuaucuggagaugugacugucauccgaggagucauacugcacucguucaccuaucccugcaugcccaagcuuuggguacgagcagugucagcauauuaguggaugacaaacaagccugaaaagcauaguguacccuuuucucugggaugggggucaaagcauuauugauaagggaauaggcauucagucagccccuguguuccaucugcugcucaaaguaguuagcucuacuuugaagucaaaaacaaaaagauuaugaccaaacuguaaucauuguucguggcuauuauaucuaccuauguagacugaaauggagacuguugguuuaaaucugguuccuaauagcaagcuacuggcacugucccuuuuaaccauauaaacaggucuuuuccuucagcucugagccugggcuugcuuaccuacaaucuuaaggucuuuaucucaagaacucugagaaagauugaguaagguaaaauccuaccugcauauuagcuuuaagaaacuaacucagguaguugaagaagcuugggcuuuuaaauuagaugugggaccaguuuccuagaacugcgaacugccccuguauaugugaccuuucacaggaagcucaauucccuugaaccuuaauuuccauaucuuuaagauggaaaaauacuacccugacccuuagagcaccagcauggggauuaguguguagaugaaagauauguguauacauauacauuuauauuuuacauauauguguguguauaaguuuguuuacauauauauuuaaauuauuggugugaucagaaaaaguguaugcaugcuguuuuaacaaguuccaagggaguauuacacugguacaacacauagggcacacuaaguucugguguauuuacugacagugugauaucaccucuuuuguaauugaauuguuacuucacaguuacucuaaauuccaugacuguagggagacuguuucucaccucauaagcagcuucuaguaacauacuacaugugucuaggcccucaggaagucugugcaauuaaugauugccuuuuuucaucugucauuauuuuuuucccucugauaacuucauggauaucauuuacguuuguaaaaaugacuacaaauuagaagacaauggucaauucagaaaauccucaaagcugcucccauucugcaccuuugggcuucaaauggcucugaggagggcaccugaaugcauuuuauaauccaacauguguggagcuccuugaggguauggagagguccugggaaacgcugauuccuggacaaugcucagucuguaguaacaacccguuuccagauacuuucacucucucuauccaaacucauauauuaagucaucuccaaauugguaaaaacaaugucuuagggaccuuuugugcuucaucuauuuugaacaugaaguaacaucuucuagcuuguucuccaauccuaggauucauuucaaucaugaaacccuacuacuccaagagaucuuuguugccaucccugacagccucuggguacuugauucuccuuuguccgaauuuugcagaacuccaccgugggguaacuuuuuuccccacuuaagauaugggggaccuuugggauagcauugaaaauguaaacgaggaaaauaccuaauaaaaaauuuuaaaaaaagauucuuuuuauaacugaguuaaaucacaagcuauuacuugugagucauguuuuuuucccuguguagccacaaaaggcaacugacaccacagcuccugcuacccuugaagcacaugucccagaggucgugugccagagugucugucuucagcuccaccuggcuccugaugagcuuuuguuuuacaugaggcuguggagucaggggcuuugcucccucuuuuccuaccaucucacccagagagcuuuucucaauaugacagccaaauaaagaugaauuaucuccuugcaaaguuaauuucuguuucucagcagggagccacuggccccacugggcuugaaagugcugcuguuugguuaauggaugagccucucuuggaugcugguacccacacuggaacugcugcagugccugacuuuccauuuguuuuaauuuccuacuugcagcugguguuaggagaccuaaauggguuuauucacaggauagugguuuggagucauuagcccaggaaugaaggcgagggcuggugagcuucuuucaggccauccuugaccacuugggaaaguuuaaguaguuaaguugguuggcuuuuuaagaaagugaaaucgcaaacuccuaggacaaaugaccuaauggaguaggcucgucucgucucugacuuucaggaguuggaaaauaaugacauuuuuuaugucuuaaauauaugagugugacaaaauaaaauaagaugguggauaaagaauaaucuggaauuuuuaaguacaauuagugaucaauaucaggaagcuauaaaauacagaacuauacagcaaauaguuguuuaauguucuagcagagccagaaugcaaacuggaaaaguccuuaugaugaaucuggaauuucucuguuagauuaugacauugccauuuguccuuugagaaggucaaaaucuggccaucguuccuguauucagauacaaugcugauuggugggggguggggguaaaguugugaagcaacagaacacuauugguaugguuugucuucugaaacauuuaaagcuuauaggagaagaagaccauguguccuugagaggaucccaacucuacgcuguggacuguguaucagaaauaaugcccagaguugcuaugcucauggaacauuuggcugcauagacugguuaauguuggacagcucacugucucauucuaagcuucauuuccacagcaucucuacacucaauacagucacgccaacagugugcgagagcuccagacuacaaguuccaagaaagggaaagagccaggacuccccaguccuacaaaguacuauuucacaauggaagacugacucuggugacucugcgaugaguucauuuugcaguuugugagagggaagaaggaggugugcagauggcuauauuugggcagauaugguaggcauauaucucagugcccacuguuuuggcuuucauaccaaagguauaacaucacagagguauuggugacuggugaaaauuaacuagguaaaaagucaguguggagagccaaggcauggaaguacuaaguagauguggcugcuuuucuccugacucccaguuuucuaacaaaaauaaauaaauaaauaaauaauucguuauuuaauuugaaccauaaaauggugguacccuaugcaaaauacuuuauuuguucuuguuuuuguaauagagucucaugcugaggcuuagaccagccuugaacuugcuuugugauccaagcuaaccucaagcuugcaaucuuucauccucagcuucucaacugcagacauuauagauuguacaccacuguguccugacacuauaugaaacuuuuaaagucaggaugcagcauuucaugaucuagcugaacacgcuggcuugcagguuauuaauauguauuagggggcucuuaguaacucagacaaauucuacugccgucuguucacauagacucugcacaucccugcuuuuagaucccucaucucucaacacugagaauccccuuccacuaauuccacgaucaccaguauuucuccaucaacugccaccagccacacuggcaguucucaaguucucacgaaagcugccccaugaaccuuguuuaacaacggaagcuucuggaguagauacuuuugaucuucuuuaagugccuaccaacuuaaaggacaggggccacucaugucaagggaaagaaaggcaaaggagcaugguugcggggccagggauucuucuucaguucucuacuaggucaagcucauuuucaggugauuaucguccauaagacaaaguauuugguugcaguuggcuaugcguauagcuuuguaaauuuccuauaaacacaaagccuauaccagcacuggcuggugugguucaggcuuuuacuucuaucuuaaaaaaaaaaaaaagaaaagcaguucauuaagaagggcuuuauucccagggcauuuuauuucuugcauugauugauugacuaacagaaauacuaauugcugcgaaaggaugcccuuuaguuaaguucacucauugcuuccagcugugaaaaucgugcauggcuuguuucuaaggcuuuuaaggauauguacaagaagucaagguugcccuuuaaauuuauguaaauaugcauguggauucaauguguguguguacauacacagacaaguguuucugugguguuggagauuaagccuauugccucaugcaagccaggcaagugcuuuaacgcuagaaaacauccccaguccuauacacguuucuuuuuuuaaaaacugaaacaagcauuggacaaagguuuuagaaauauucugcaucuuacuaacauguggugaugcagaaauuuuagcagggcaaagacaugugagucaaagcauuugaaauuuuacaucuaaagcaacaguuaccaggcugaaagccacccaggagcuucagugaucuaugagucugagucguuaggcaacacagguaauuguuuuguaguuguauauucauuucauuuaaacauuuugccaagaaaauuaaggcugcauuagaggaggccaucuagucuaaaauagcuuugcuauuuggauaaacucccagcuuugccacacuaugcuaguggcucgcaguugaaacaauccacaauuugccauaauagauugaccaaacaguuauaugagcaaccaaauuucauaaaaagguaauagguagcccuuaagcuaauuuucucuccucagaucuagugagaguaauaucaguaguaucaacacauguaauuuucccauguugacucugggcuauguucuccccaugcugaggacuuacucucauuaccaucauuaauauuggcaauuauuaauacuuggaugauugcuagccaugucucugaugucauuucuagugacuguguggcugugaugaacuaguacaaagaugcaugaccaaguaguuuucuguucaaaaaauugauuagauuaggccauuugauuuccaauguauaaauugaugauaucaaugaauauucauuagguuggcauuucaacuuuugccuuuguguacuuuguccauuaccucccauaagauaagguguuucuucuguuuuuacauagaaggaaacuauguaauuuauauaaauaucauaacuaaugagugguggaucagaaucuagugcccaucucuucucugauuguguuguuuuuacucuucuauacuuccucuccuggaccagaaaggcuuuaaggguucucacuaauuugugauacuugauaggaaccauuacaucauuauuaaccccaaaacuuuuccaauaucccaaauaucaauacucuaccuccugcuauagaagaguuauaagaguaauaaaaguuagucuccaaacagguauaguggugugggaaaauaauccuuuuauuuggggggcuaugguagaaggaucacaaguuauaggccaacaugggcuucauugcaagaccccaucuaaaaaauuaaaaagaaagaaaguggguaaaugagcagauaaggaguguagcucauacacccccugccuaacauaauucaggcccuggguucaauaccacgaaaauaaagauguuaauaacuagucuuacauggaaagauggccccauugguaagaugcuuuuccuuucaagcaagagggccugacuuugccucucugaaaccaagauaaaagaaauccagauaugguaacauguacuguaaugucaguguugggaagguagagcuagaaagaucucaggugcuugccagucggccagacuagccuaaccagcaggcuccagguucagugagaaaaccugucuuaaaaacaaaaacuaaacaaacaaacaaaaaaaaaaacacauggagcgugggcauugaagaguaaacauuuuuaaccucugaccuucacauguguguacacacacaugcacuuucacuaacacacacacacacuccucuuguuucucuauucuuccaucuccucaacacaguacuucgcuggugguagaugcuuaagacguacuaaauguuucuuccagaaaaagagcuuaguagagguuuuucuuuggacauaguuauucuauuucuuuguacucaugcuauggcagaagaaauauggcagcaagguagacuccuuuccuuaaacuaaaauguuaugacagagaaugccuacucuccagugugggggcaucagaggaaagaagcucugcacucacugaaaccgaaagggcccccaucucuccuggcacccacuaagccaagcugaggcacugcuguggcucugcugugcacuuaccacggugagaacuggauuaacuaacgccacugcaggccacagcuugccacuugggaucuggaagcuggcaagcuuuuccaccuaaggcacucugcaauguagaguugccaguuauaauuauauguccagguguuaauuagcaaauaguucguuauuuggcaguuuagaguaaugcuauggaccuugcccuaaucuuucuguccaacauuugauaagugcuuuauacauaaauuccccauugcauugaacucaguaaaaacuacagaaagaacugcaggucaaaaauauuuuaauguaucuuccuuaguggacucauuuucaaauaaaaucuuaagcaacagaagaaauaggcagaauuuucuccauuaagauuuuccccucucacauauaccucccugcaucucuuuauauucaagugauacucagaccucaugaaauagguguuauggaaauucauggaaugugaaagucuugccugaccaugcuggugcugguccccagccuugacuugggaaacuugaauacauucggcacacuguccacuucugcugucacuagauagcuucugugguuuacuuuaucugucucagagcuugccaugaaaguguucucaaugcucuguccaauguuuuacauaaauuaccgucacuaaauuucccagucauauuuuuucuucuaugugguuuuaucaucuugacccacuauaaauacgaugcuuuaugaagugucucaaaucugcuuucuaugguggugaugauuaauucucauuguuuacuuguuuggacuaaaaaacuuaagggaaggguauagcagagauuaccagaggaaagggaaaaugaugugcuuauauuuaguuaauaaagacaaaggaaaaauagaccauuagugagguauagcuuugggccacacccugggcugugguccuugacuagaaaaaaaggcaaaaaaugggaaagacauuugaauauggggauuucuauucuuuguggaauuccugauccacugagauguuagcaagcaguaugcucuccucaccacgucaacuauguaccuucaaaccaugagccagacucagccucuccuccuuuagguugguucuuggcagcuguuuggccacaacaaugaggaaagaaacuaguacaggguguauuuuagucauacugcagccuccccuaccaagaucugugucuaauauucuuagaaauauugugagcugauuaguaaagaaagcaauuaaugaaaaauaaaaucacugacaucaacagcaaugauaauaagugugaauuaaucagaucuaauuacuccacuagacuguacuaacccuugcucuugaaguuaucugcaucuauuguggcucccacccaaucacuacccaugguguuguuuuauucccaggucuuaguucaaugaugucacguuggcuguuuaaauuccaccauauuagaacugcuuauauaaccaaagccagggaacacaaguuaagacucuuccaacucuaggagacccagauuaucagauggcugucagcacacaaccagccaugcuugucucuguuccuaccaguugucaugaacucgagccaccccaguuaccauuucucuucaagaugucaagauucucuacccaagacagcuauaucuaccauaaauuuccuuggugcuugauucuaguaaccauuagacccagauuuuugcucugaauucauguucauguucugaccuggcucucuuuccuuuucguccccaaugaaucacccaucuauuucucugcaucuaccucccauuacuaccaacugcuucaaagccuuugccuugcaguaguuaagaucaaggguguuggagacagacagacuaaaugacuuuuaauguggccccacaccuacuaguuaucuuuagcuucuuacugacucuuuuuagucuuagucucauuauccauauauagauugagugucuuuacuucauaggguuauuaugagagauaaguuaaguuuagaaauaccuagaaaauuuucagugcuacaguaagcuauaugugcauauuuauuuaaugaaguaaguacuuguuagcuggguacaauggcucauacauacagcuucagcacuaggacagaaaauuaugaguucaaggccagcuggucuauguaaugagacuuugucucaaguaccaugaauaaauacuuggcaguuguuuuccuguccaccggauuacugaguaguaaaagucaaggacaguuaugaaauauguguaaaucaaagaagagagaaacugccuaagguugaacuauugggggcuaguggaaagguaaauaaaauuuuuuuaaaaaaauauagccauugggaauggagacagauaagaaagaaaaaggauuauacuucauaauacaucacaaaaauuaaaaucuauaacaugaacuuuaguauuuucuuucaaauauguguacuagggaaauaaagacuauuuuaucuuugacucccccacccaccccacccccacaucuaaguguugaacucagacccucaugugugcuaggcaggcaggcucuaagcuacacucuaaucccuaaaggaacauuucucaaaaugcuuagaaaauucucauuuugauuucagcaauuaaaucaauuuuaauuuuuacuaaaggaagaaauucaguugucacaaauuuaagguacuuauucuaaaucaaaugugcuuugcacaaaugccauggagacagagugugggaugggugucugugucuaugaaaagagcaaguccggggccagagcacucguuugucugcccaucuggaaaucuccagugauccaggcucuuaauuuuaccucauucuuaggagaaaagagaaacaauaagaggagaaaaugggcugcgagggcauucuacuucucauuuaaaaaaauaauucaagugauaacaggagcagggaguuuaaaagaaaaaaugaaaggccauuauaaugauuugaaugcucagucuguauuuugcuguggguucuauuguucucagcuacaugggaaccaugguaauuuuaugaaucauuagaauuuucuuuccaaauuauaugugcauguucucaaagugccuccuccuaaguuccccacaguaaaaggcugcugcacaauuucauuuaaugcauuugaaucuugugcuaauguuguauuuuuaaauauuuguacuuagcaaaccaaagacaaaauaaugacagcugagucuuugugcauuuuacaucuccuacuuuugaacuucugagucuguuuccguucucauguacagucuagugaggagugguggaaacaugaaaccuaguuuagcaucaugguggcuuaaaaguccauguuaaaaacacucaaaaacaguauuugagcuuugugcuuagacacauguccucugagacacagugucugcagagauuacuacugaugccuaaaccuaaccucuggagcgaugauggcgcccaguggccaguucacuaauaggccuuucuuuuuuuuuuuuuuuuuccauuuuuuauuagguauuuagcucauuuacauuuccaaugcuauaccaaaagucccccauacccacccacucccccuuuuuggcccuccaagugugagccacagaaaaaucagugagcgaaggugagagagagagagagagagagagagagagagagagagagagagagagagagagagagagaguguuuuagaguuagucuacuuccucggggauuacucuuccuauuugggccauuaaaacauucacaccuuuaaaaacagugauauuacagauuuuuaucuuuuaucucguuuuaagaaugaaggaguuucucuuuacuuaauaaaauaaaaaguuagaucucuguucaucuaccuuuuuuuuucuaauuagugaaaucccacugucuagaaagcauuguacauucuaaguauuggcuguaucuuucccagggguguagauguuugcucugugaagacugucuaagaaggaagugcuucaaaggcucaguguucuggguuuaggcaugguaggagagcugccucccugggcaguguguaggugguucuauuacuguucuuuucacacuagcuuuggcaggaugcccuggaguuuaguucauuggaaugcaucauggggauuuccaagcucauuuuugguccauuuccucacaaauaaugcacuccaguagcuaaagccuaacaaagagaagccugauugaugugggcccaaaacuuagaaggugaccuaaaaccaacguuucuguuaccguggguggcuggagaugucaugaagaauauccuauuccuugcaaaugaagaaaggggcaaagacucacucaacucucccaaguccgucaacagaaaaaucaaguuaggaucccaggucuccuguuggcuagucuuucaauuucggggugcuugcaacacauuccagcuuguccaacauggaaaggucacauagaguaguuaaguuuguuccuagaaugagcuagaauggcuggguuacaacugccagauuuuauuuuuaauuuuuuuuuuuaugagaagcaacauuagaagucauucguccucagauguucucacuccuagaauggagcagguuuggguuguagucuccuuuugaacgcauuuccccucgcauguguggaugauugcacacuugcucacauacucucugcccugaacagguccauauguuccaguuuuacuggaagccaagcuucccauuccuccuucuccucagagggcuccagagcucaccucagagguacccaaguaacccaggcugaaaggauuuguagugaagcuugucagcauaauugauuauuauauggugugagccaccaaagacaggugagcuugcacagaguggaacaaauuucuauguuguaugcaucucccauuggggccacccugucuuccuccucugacaugaugauuuauauauuugcaacucuucccuaauggaucguguccuguuauaagucgcuggaaccuccugcugagcauacuaccucugcuaacacaagaacaguuaaagaucugcucugacuucuuggcucuguuaguuggcccuaacugaaaugguugagaaugucuaaucuuuaaaaggacaaaagucacauaaaauguuugaauaauguugcuaccuuaagacacaggauccagugaugacaugacagaguuuagucacaguggcuugagaauguaagaaauguaaagaaauaaaagcauaucccagcaccuuugguggcagcuugauguucuggcauccucugcaaaccuucuaacuguaaacugcuuugaguguuagacuugcuauaaaauggggaagcuaaugacuguucuacuuucucacaaucuguuaggaucuuacaugagauauuuacaguguucgguguucucaggaacaggaagaguaguguuagaaaacguugugguuaugcugauagcagcacaggggaaauuaugcuaagacccaguuugaagaaaucucaguccugugcccuuccagucuugucuuuucaucuuagguaucaauuccuggugaauuaaaaugcuuugggaaaaauaaaaagagaaaagaaggcuuaacagaggacuugagauauccauaaauagaccaugggcuaauggcauugaagguccaugccuccagaaggcuggccaaacagaacauccaacugaugagccuuccugucuauccuguguaccuacugaguugcauaugucacaccuuccuucaugacaugauuccagugagcugucucucuucccucuccucacccuguguucacagcgugcugaaaaccuagccucaccaaauccaucacuauaacaauuguaaauguuguauaaaccuucugcaaacauccaucagucagcuugaccuugcugaacauugcaccauagacuaccaaagacauuagcccaucauuuacaguucagucgaagcaacacagugauuagaagaugggcugcuugagcucaaauauuagauggaacuauuacuuuguauucguggguuuguguuccuuguagaaccuagcaccucaguucuuccaucuguaaaauagaauguuaauauguaccuuguugaugccuaaauaagauuaccaugaguuaaauaagauaaugcacauaaaguguguagaguucacuauaaucuucugguuuguuucaaauuuuucuuuaaaaguugaaccucaagaagauaggaaaucugagugccuguguguguacuguggugcugcuacauccuacagcacaguguggugauagugccuggcacauaaccaacgcccuaucauugaguacugggugguaaaagauaguuuguucaucuuacaaccccuacguuuaccuuaacauaaauuguauuuacaguguaguuauuuccauauuaagagaaaggaaucgucaucuuggcacuuaagaccucugagggucagaauuugucuuucaggaucucuguucucuguaaaugugucuagacaguucccuuucaagucuuuuugcuuuugcagcaagucugcugcuuuauuauuuccuuuugaauaaguuagcuuucaaaaagccaguauuuguuauguuaagaaacuaauaacaaggggauuuccaaaauguauuuguuuccacuguagucuguggaauauuaagcccuucgggcagaauguuuagcaauacccagcugugaaggacagcucuggaagacacugaugacuggaggaaacccuccagguucuccugucuccugggagguggggguggggugggggaggguuagaguaacuaccuuguuguuuacuguccaguguucuugcuuaucaucaucagcacuuuuuccuuaccucuaguuuuuguuggugcuauuuugguguuuuguuugaagugaaaaugcugguacaguacauguuuuauuauaaugauauuuugucgauggucuucucuaaguauaaacuacuucaguagcgucggaggucuaagcuaauagcacuggccaggguugaccuguugucauuuccuaagaggaagaguucauauaaaguaaauaaucaagaggccucagaguguuacuuguaggcaaauaaaacguauaaguaucucauagugacugugauucuucuugacugagacaucaagggcagucagcagcuucuacuauacuauuccccuauauaucauuuaacaaaauaaaauuauauugauauacaagaauaaugagaugcaaucugcuguuauuuucucaaaaacaauuacuaauauaaaacguaguauuucauuuuccuaugcugccuucucacuuuaaucaugaagccaaggucauggcacagauuuaaauuauuccaaauaucacgaucaguuuuccauaugcuuucaaaguugaaucucuggccucuucuauucaucucagaugaauuuauuuacagugauuacagcauacuuauagcauugcacuuccacacuccggaacaguugcacuugagaaacaucuacucuggaaauacuaaaagucaaacaagaaguuaggaauagcauccguuggacuauccagagacuaccgcacccagggauccauccccccagacaguauagcauacaucagaaagauuuugcugaagagacccuguuauagcugucucauaugagguuaugccagugccuggcaaauacagaaguggaugcucacagucaucuauaagauggaacacagggcccccaauggagaaacuagagaaagcacccaaggugcugaagggaucugcaacccuauagguggaacaacaauaugaacuagccagugcccccagagcucauaucucuagcugcauauguaucagaagauguccuagucggccaucacugggaagagaggccccuugguauugcaaacuuuauaugccccaguacaggggaaugccagggccaagaagcgggaguggguggguaagggagcaggguggaggggggggcaguauagggaacuuuugggauagcauuugaaauguauauaaagaaaauaucuaauaaaaaaaaggaauagcauccguaauuaaggaauuauguuuugaaacuccagcuccagcuagcuagucccugagcacguuauugaucagaacaggacuccuuagaagguaagaaggaaucaaacugaggucaucagacugagccaucucagucucauucuccaagguguuaaagagcuaauaagcuuguguaauuacuuauaugaauucuaaagaaaucuaguauuuucugauucuccagaauuuuauaucauuuuuuccugaggcaaucauaaauccugcuuaauuuuuuggccugcagaaggagcuuuagaaugcuucucuuugacuacacugcagaucuacauuugaaguaggucaucaggugauuagugacaucaaaauggauucauuugcugcaucuuguuuuuggaagagagauuuuucaaaauguuuguccucuauacacauauuuucauaaaagauuuggcuucugaccaucucucagccugcucuucugacacaucugcucuucccuccuccccaucacaaaggaccacucaguugcuugaguccagcuuuaguucauauacacacuguuucacuagccucaaggucuuugcuaguacucuuguucagccuauaaaaacucuuauuuuggcacucaauucaggugcaaauccuucuuucuuaacacuguccaaccaucugccucaguaccauuagcuuuuucuaugccucugcuguauuuuagauaaacuuauuuauucauccauaauugcuaguaggcaggaauccuguccuuuuuggccuugaaucuucaguuaguccagugucacacacagaaaagauaguuuucuauuuaaugaauuaguuaaauuuccuugaucuucucuagacagcucuuaccugguggucaguaguaauaguuucaguaauuguguuguaccuucacauuuaaaaacgcaaaagacauuaaaacaggaugcugagaaaggcauugcgagggguggaccaaucuuagaacuuucugauggaguaucuguuuauuuaugcaguaaguggauggaauaguuuaaaacugaaguuuaccauuugccaaugcacuaccaagcagauuucuuuuuccauaacacacacacacacacacacacaccuagcacaaauggcuuccauccuaacaguguagcuacugaugaccuuuaauccugagcugcuucuccccaucaaaucagaugugaaacacucuucuguaaaugcccacuuccauuccacaguuucuccaggcucuugaucccugggacuguucaaguguaccacuaaucuguuacuccauagguauuuuaccuugccuugcucugcaacaucacauuguauuacgacuuuacuuaucauuccucuuugaguggucagcuuuucuuuguuggucauuuccugguuugcuguagguauaagauguuuuuauugagaaacaaacuucagaguacaucuucaauuaccuacuugucauccuccuuccucaguaagguacugaaggaaaccauuguauagacaggaguuauggagcuuacuaagcaccuuuugugugucagauccuauauauauauccugucucuucagaaaucuuauggaccauugggagaacaauuaaaaacauggaaauauuauagaaaaccaaucuaagauguucuggcuguuuuuagcaggaaucccucuccccucucagugugggcucagaaagaaucuuccagcagggaagggagaauguccucccucagcuuggaaagauaagaaaaugguuuccagacaaagggcacaggggacagagcauuuuaggcaauaauaagacccugaaauagccaugggugauugaaaggaauccaccauaacugaaccuuacagaucgggguggaggugguaggaggcuagagaugaaaaauggaagccaucuaaagggccuuuugcauuagugaaagaacaccaaccuagccaauacaaaguuugaaggcagugagagacaugaucaaauauaacuuaaaacuguuuccuagucuguuacgcugcacaucguaaaugacagucaucuuaaguacaaagacuguucgugcuuuuagccaugcaguagcuacccaguccaaaccuauccagcgccuaaagagccucugcuucccuaucgcagucuaccccuucagggaggccacuacucuagcugaucucagcagugguuauucaugugggggguggauuuugguuuugcuccccccuucugaaagucccauguauuacuucacugaauacaauuuauaaauaaccuacauugugcuagcuauacaggcccaguguuagugauaugaggggauggucauugacuuuguuuuuuuaaauugcagucuaguggaugagacagccaagugaaccagcgauuaucagaacccacagaagaagacacguaaaguggggaacacaugugcuaauaugucaagagagggauucaugacaggaagcgcacuguagacagaaagaucuacuggcaugaaggcacagaggcaggggcuuagcuggaugcaaugugagauaguaaccuaguaugguuaagcaaaggaugugcaugaaacuggagagaagccuagggaaguagaggagccaaaauuaaacagguuuguauuauaggaagagaaaugcauagaugggaaaagaagcccuaaaauucuccucugcgugucuaagcaugucaugaggccuacuugcuguaggaaauauccuuagaaauacauuuucagcaaauguaaagggauagucuaugccaaauauuucuauguuuugaggguuuuuuuuaaaguccauuaauaagaauaaagauagccucuacaguccuuucccaaagauucacuguagcacuaauguaugaaggcuuucaauucucccaguauagaaacaauaucaguuuucuuuaucuuaucauuuucgaaagcauuugaguauggagccaacuuucuauaauauaauguuuauauuuauuuuaugaagcccaauuuuggcaaacagugguugggucucaaacaaaacaaaaccaacaauacucuccauucauaaggguuguuuuucugugcauugauuaggaucaauucuaggaucacccucacuuggggcaaguguucuacuaaggaguuaaccuuaacucucuguagauuauuuucaaugcagaaccaaacagcagguucuuauacaugccccacccccagccccaccccagccccaccccagcacguugggcacucuuguaugccugugagaacuccaguuguugauguuucagaacaacuucucauugcauucgcugucuggggauuuuuuccccuuguuuuuugccacgcccagacuucauuaccugcuaagagguuguaagaacugugaacuuagcuguuucuaaacaaauauaaaucccuuuaaauguguuuaauagcaauuauaaugaauaaaaucacuuuuacuuacuauaaaguccuuaugcucacacagucuucuaaauuaauacugcaccaguaaaacuguggugaugcuugaaccaaaaaucaaacaaauaaaaccaggauuggccuuguugagguuuaauguuuccagcauuuaucugucagaaccacugauuuggaaauuguuguaacuucuuggaaaagguagaccuuuuuccccauacaaauucccaucauuuugcagagugcaguuucauuuuccuugaagagaauguagugauugauuauccagagugcugcggugacaagguaaaccaaccaaauagcucggaaauuguauguaaucauauagcaucacauaggggccaugucgagcacagccauuggaauuaaauugugccuuucucguuaggcccugcugguauuuccugcucaccuccagaaccuccaccuccagagacuauucagucauccuuucuccuccaaacugccaguuccauucuuauuacccaaaagcacugcaguagauauagaacaaaccucccucacccagagauugcaagcugcaggugccugugucccacaucccuugccuaugugacuuucagugagaagauuuugcauuuccuauuugagcauccuuuauuaguucugaagaugcugccacaugaugaggaacugaaaggaaggagggagaugaauaagaggaaaaggggcaugucagucgcuuugagaagcugaugaucuaguugugaaggccagacacaccugcagaagcccgagaacagcuauacacuacuaauucagccagugucaaaguaccaaggcacagauugaauacgugagucgugagggccaauaaaggagcaaucaaauuacccuuguuauuaguggacuaaauugagucauaguaaaggaaggggcuacccaagcuucccgaagcugauuaucaaucguguaauugaggauagaaccaggcccuuucuccuaaugaucagaguaaucuccucguguucaucuuacacugcuuucgaaucgcagcaggcuuugugaggauggcugagcuccucucugcuuuauuaauugcuguccacauuuuguagcauaucuuguguucugaauugggaugaggauuuuagaugcuuaacguggggacauguagccgggcggaaucaauuccugucagucacacacaaauacagaggaaugggauuauagaucagggugaagcugcagugcuuuaaucucaaaaucaauacagaaaaggaaguugaacuugugaggauucuauagagacuguaauuugguuuccugugagguuugccuuacauaauauaauguuccuuucuucucuccuucuaauuauuucaguaggaaugggaaggggcgggaggggcaggcauaggagggagaagccucuaccaccaaaucaucucaaauaagcauacaacuguagcucauaagucaagcuaauccuccauguauuuacuuugaucugaucuuuuuauuuucagggaaaaauugucuaaaauccugucuccauaguauaucuuuaagcauaauaaaaugcuucuuugauucuuuccuaggucacugugagacuguaaaaaguauuuuuuaauauuuacuuuuauggcuaacucugcuuuagccugugugauuuuauucuaauaaauaaauagcaaacucuuuauugaccaaaggauucuaggcugguaggcaugcgauuaauauuuaacuucaguguaauucugcucuucuugcaagagucaugaaauaaugguuuaaaaaaaacugagucuuuucucaaagauuuagaaguuauugaauguucuucuuuuucagaagcaacacuaacuugcugcauagugcucuagcuuuaagaugguuuuauuauuuuuaaguuuggaaguucuuuguuucaauaaagucauagucuaugugugccccucuucaucuaugcugacaacugugccaucauuuggcccucaagagccuuccucugaaaagagcuauugaaggcugcugcagcuuuaagagucagguagaaugggcugucuccuguccacugggggcguguccuugcaggagccuguagagcccagcagcaaucucuuuccuuaggcuccagccaugccuugagcaguuuaguuucaccaugugauuccaucauugugugcaaccuuagcacaggcuaaaaacaacccagccaggaaguugugaauggaaaccuccaaagugagcaaaaguugccuuucucuggggagucggcuaucuccuuuuguuguuauggcaauagauauaaaugagaggcacagugaacucacagaaaauaaugggauguggucaaaacucagggccagugcuaaagcagaguaggagguaaaaugagcagagccugggcccuugcuuuccugucucaucuuucucaaccuguuuacuccucucuucacugacaguaauugcaggagugcugaaaggguuaacuaaguugaagcaaaugacaugcuuaguguuguguccuguacuuguaagaccccuauaaacucaugauaaccaugaguauugugugacuuucaaaugauacaacacaugcugcagacgcccugcaagcuguaagagaugaccgaaauguuacuucuuguucuuaauucagugguaguuuugaaauuuaaaauaaaccauggaagccuuuuucuuuucccugccuuuaggagaucuguacucaaguaguaauaaaucucaaagaugauaaauaaggcuucuacucacuaugaacccucuuucuuaaaaccaaaaagaaguuccaauagugguaacaggagccuauaaucccagaacuugggaaaugaaggcaggagggucauuaauuuaagccauucugggcugucucaugaguucaaugccuaccugagcuacauagcaaagcucagucucaaaaacagcaaggaauggggauguugcucagggagagagugcaaaauccugguuuccauccacagcaacauuuaaaaaaagaauaaaaaaauaaacagacucagagauagcuguagaugccaugaagauuuuguggacaaaaucuuuugaaaaauuccuauccugugucauuucugugaaaaugccuuucagaucuuugaaagacuagcucuguguaauauauuuauuugguuguugauuuuaauccauauuuuaaguuuccacaaacccucagaaaagucaagugcuaucacauccuuucaguuguccuuguacauuauuucuaaauaaacaucucauguuuucugugucuucuccuuuguauugauuuccagagcacaaucaucguggagaagacaguacaagaccucaugaaccuuaugcaugacuugagugcguauucagaucaguuccucaacauggugugugugaagcuccaggaguacaaggacacgugcuccacagccuacagguagggcacugguggggaugcugacugggugugagccugcccuuggcucugcauggcaacacugccuuucuugccuacuucccugaguuuguuacagagcaucauagagauggucucuuggguccuuacacagucacacuaacaaagggaaugaaaggagccaaggagcagagacacuuaagauggccaugauguaucagcucaggggucaccucugauuuccccuagaaauuggacccuagaaguacaagaugugucuuccucaaggaaacuucaggucuugauuaguccacguggugggugaaaagauccugauaauagagugauuuaaaacgucuaaugcccuaucauauaaaguauuucucauucuuacaaacacauuccuacugacauugaucugaagccugccuacugucagaaaaggacaguuauaccuaucccuuuagcaucaguugaagggagaaaaacucugguaugaacuuggaaccuguuaggccucagauuucuuuuuucuggguucaacagaucaucuggagcucauggcaagaucauagcacuucacauggaaacccaaucauaggaacaucgcagccugguuggcaagacuuggaacaguugcagacaaaagagaauuagaauaaaguacuaaauuauaugugauauauaauuaaggauggggagggacagugcaauguauaguuauaaucugugagaaaucccagagaaaagugauugcagacaggaaugaguuuguagaaggaggcauaugugcuggacaaaggauguucaugaaguguagagaaucauuaaugcauugcaauaaaggaagggcacacuaacacaguggccuggcacugggaggagacaguaagaauuaccuaaguaggacauagugagagauaguguuaccuaggaagacggacaagauuuggcauguagauguccugagaguucuacaggaguaaggaaaaacaguaaucugaaagagugacgucauucccaugaugcaagccucccucauuccagcaggaaguauuauuuauccauugucucaugucucaauuaaauuuaaaaagcccuuaucccauugaguugugcucccaacaauauuuacuuuuuguauuccucaaaauaucaauauguuagauuaaaaucauauacuaauacuauuuuuauauacaguuacagaccaaauaaacaucaugguaauucaaaauauuaaaauauauucuugugguaacagaaaauguaaauuuuaauuuuuaaacaaauuugcuuugccaaaaauuacaaccuaguaagcaaauguuucaagcauaaaaauguauuccauacaauaaaacuuagugaggaaauaaaauacaaaugguauucaaaauagaaaaaugaaaaaguccauaaacagagcuuuuaguaucuuuauaaauaucugauggaagauuucaaaucccugggauuuuuacuuuuuuuuuuuuaauuuuuacuugaaaaguaguaauugaagcuacucagaaaacaaugagauguuuaaauauguaaugauuaaaucaacuaauugauauaucugucacgucguauaauuuauaaugugaugugaacauuuaaguuuuacuaagcagauugugggagggagguguuggcuuuguuugcuuugguuugauuuuucaaggcaggguaucucugugucccucugugucccucugugucccuugcuguccuagaacucaacucuguagaccagguuggcaucaacucuaagauccaccugcuucugugucagaaugcagggauuaaagacaugaaccaccacacccaggcaauuugaauuuaauggauauuauguccuagagcaaacacuccuuucccccugccaaccccauugcgccacacacacacacacacacacacacacacacacacacacacacacacacacagcucaaguaaccaccuuuuuacccucuacaucucaggauuugaauuguaaagauucuacaucuaaaaaaggauacgugauauuucuguucccagucuuuggaaacauuuagaauagugauuuuugcaaguguauuuaugauaugccaaaagaccugacuuuuacaaguauuuacauucauaucaaaacaacugcauguccgcuuuaauauguggagaggagcuguaguuuuacaaauuauuuuagugggcacacaaauugcugaagccacugaccuaacauauuuguuugaaauuggaauuucuggcucacuccaaggguguucuauuuccggggaaauaaauuccaaaacgguuguaccaaugugucaccuaccaaaugaaaauuuuaaaacauuuuaaacauugaagcuucaauuuuaagcaaugaaguaguuuuaaaauaauguuuuaauaacauugugguuuauguuuguguagaaccaccauuaaacuuaaaagauuuuuuuaaaauauacaugugucuuaauuugaauuuuuauuuuaacauuaaaacucauaaauacuugcuggaggauuuuauuuaaaaaacauaucuucuaacacauacacacacaccaccaccaccuccacccccaccaugagcaaacaugcaucagaguuaguuaacacauguaaguuuuuacuagagccucuuguccuaccucaacauugcuuuucaugccuugaaaucuuuuuuuuuuuuuuuuuucaguuugaaucugaguguauuuugcaguucucaagcaggggauuuuauacauuaaaaaccaaacauuauaucucuuagaaacuguauccagugaaacaaucacaaauaccaacaaaaaucauuuggcacaguaaagcaccucuuucucuauggcuaaaccagaguucagguacuaaaggaacucccaugucaucgugugaauagucaauauagaaguauugagucgagcacagucuuugucaaacaagucauucccacacacugaucagauacaugugcuauggaauccaguauugauaaccaugauuguguguaaaaccugagagucuccauuguuuagauauuagacucaaaaaauaaaacaaaguucugaauuaugaaaaaaauauauacauaugucuaauuauugccacaaaguaauuucucaccaguaauaaugcugaugaauauuacuuauuguuguacuauaauaaauaaccuaauaaaguguauugguucuagaaucuaaauucuacugacagguacuuuauaguauuguggcuuuaguuauuuuuacaggaaaguuuuaauuuccuagauuuuggcacccucuucauuacucccucucaacaugugaagugauuggaagccagcauguaguagucagguuuggguuacuauauuaaccugcauggugaaaagguuuauuuuagcucacuucugggaugcuaguccaagaucacaugucucauugcugugagccucugauaaaggcuuuuauaucaaagcagaagugcccagugaagccagcaauuugcaucuugaaccaagaaacagagaaacauuaugagaccaggcugccacaauuccuuuugaaaacacauacucaaauuccacuucuuuuuauuagagugaaaucauuuuuauuccuugcauaugaaaaucucacauguuuaugaggauaauuauuauaugaaaaucuuuuauauuuaugaaaacaguuauuuuauaaaaaaucuugcauauuugugaagauaguuauuguaguucauuuccaguucauuaugguucauuguggaacauuuccuguaucuggcauacuuuggaucuaaaucaucccagucauuauuccccauugucauuagccugauauuguccaucuuauuguccugacuuccccaagccuagacugcacugaggugugcucugcaugauaaaacagcacugccacgugccuccuuguggccaaggcuagacucaaguuauuguuguauccugucauugcauuggauggagcuucacugagccuccaccaagacacucucucucucucucucccucucucucucucucucucucucucucucucucucucugugugugugugugugugugugugugcauguagaaggaguuaagcagucacagaaaggagagaaagaguccugugucaacgaaaugaaaggauacacccacagcaucgagcugugagaggaaacacuaaagcguggaagggccacaacacaggauuacauuacucaucaaggcagccaaggauuccagaaggaugugaacugcuuuggagaguaaugaacauggcuaaagcauagaagcuuaagcagggugggauggaacuguggcagcauccaagagguuagaagauuagaaagggaagaaccaguaaaugagugugagugagacuggggacccuggacugagugugggugagacuggggacccugggcugagugugggugagacuggggacccuggaaugagugugagugagacuggggacccuggaaugagugugagugagacuggggacccuggauugagugagggugagacuggggacccuggaaugagugugagugagacuggggacccuggauugagugugggugagacagaccucuggaguacaggcucaggaguuccuguuuuaaaguuaggcaguaaggauggugaaaguagcaggugcauggaggugcucuguggaggcucuucugccuuuuagguggacuggagagagagaagggguaggggaagauaggggaaugccucuuagggaugaggugggaaaauggagagguaagaucugugcagccagggcacugcuggcugguggggccagggaaggguuuagaagaaacaagggugaaagcauauuucucuuuucaacuaugguaacuuucuaaacauagauucaagaucucacacccacccauuggaugugauguuauuuuuaacuccucaucugggccuauugagauauuuuugcauccucauucugucaucagaaauucuaagcucuccucagggucucaugccucuugagcuugguuucuuuacaggaaagcauucagugaacagcuuaaguugaaaacgcaggggcugccucuugugccagccuugccaggugaguguguguguuaugcuguguuccuagcugggggccagccuguggcucaggagcaggcccuccagccagugugaaugccagcuuugcaccuacuccuuacaugaccucagacagcacacagccucucugcccuaacuucccuuuccuaaaacaaaaacaaaacaaacaaacaaacaaaagguggggugugauccggaaaugccaaggucuacaccaguuucucacagaaugaaaugcaaccuagcuacugggcuguaauacugaugauagcagugagucccuccuggcccaugacagcccucaacugucagcaucugcuuuuucaaaaauauuuuucuuccagguguuucucacccugaccuuguacuuuuaggguuuguuucuguuuuuguuuuuuuguuuuauuuuuuuguuuuguuuuuuucagauuuaguuguagagacagguguggaacugacuguguagccuaggaagauccuccugcuucagucuucaaaguucuagaugaaauaaaggcuugugucacugugcacugcaaagccuaagccucuugaugcuuucagcgccuugcaaaaccauguaugcauagccaacguggauaguauucugcuugccaucacagaccucucaccuuucacuuuuaauucugaauaaagucucacggaggaaaagaguuuuguagauccaggagcaaguagacaaggauguaaauucgaagugucuaguagacauucacaugggcacaggaaguugguuauacucacagggcaguugguuauacucagcaaaaggagagagcucaggccuagagauagacagguaugaguaguauuugaaaggagagagcugggcgugguggcauacaccuuuaaucccaacacuugggagacagaggcaguuggauuucugaguucaaggccagccuggucuacaaaguaagauccaggacagccagggcuacacagagaaacccugucuaaaaaauccaaaaaaaaaaaaaaaaaaaaaaaaaaaaggaaggaaggaaggaaggaaggaaggaaggaaggaaggaaggagagagcucaggccuagagauagacuuaugaguaguauuugaagcugcaguacuuggugaagccucuuugagaaaaguauagauagccaugguacagaugacaaaagucugcaccaaaaaaguuugcaaaaugaggaguaagugucaaagggacugagaagcaacaggaaaauuaaaaaacaaaaauguaauguggaaaccaagccaaaggaugcaaagagaugaacugggugaaaugcgccugcugggucugcuccaagcauggacuaaguggugucuuuuagacaauggguugccaguaaccaucacaugagcuguucuuauggggcauugggguacaaaccagaaugguauguacaagaaaggaaaauauagauagagaaauuauaaauauaagcauuaauuugaagauagugccacuacagauggcaacaggaacaugguaguugcuagagaaccgcgguuacauggaggucuguuauacuugguguguuguuuccaaagaagaauacauacagaucuguaugugagaaccauaugguagagagagaugcugacagaugagagcuguuguggaccagaagggacucaccaccaucaucaguguugauauaugaaacaaagggagacucugaaguuguguugggaggagguagguaaggaugggaucuuacgcacagguagaaugguugguuuuagggagaaaugagaauaguuuguucauuguaaaugcuuaugacuaggaauucaauuauuccucugcauuuauauuucgcaagacaccuguguuuaccaucuacuauuuauuauauguauuaaccguaugggaugguauacacaugugcacauacuaugguacccauaucauugccagacaacaacuuguggggucaguucuuuccuucuacccuguggacucccaauuuggcaaguuuuaugucaagcuaaagucaucugagaguagggaaccucaguuaauaaaaugcuuccaucagaaggggguggaggcaagcccguagcacauuucuuuaaguuaguaguuggcaggguguggugcccacuauggugccucugcugggcugguggccuugcauucuguaauaaaggaggcugagcaagccaagggaaacaacccaguaaguagcaccccuccaugaccucugcaucagcuucuccuccagguuccagcccuuuuuaaguuccuauccugacuuucuucaguuaugauguggaaguguaagccaaauaaacccuuuccuccccgaauuguuuuuuggucaugggguuucauagcagcaauaggagcccuaacuaaaagacauuagaucagcaggcuuggcagcacuuaccuacuaagccgauguccugguucuuuuggaacacagccauugcuuuagguucuuggucugugacacucuaaaaaugaucuugauucuuuugucuaggagacugaacccuguggaaacaaacacacacacacaaacacacacaaacacacaagguggggggagugagggacagagagagacagagaaagaggcagaggcaaagauguccacuucuuguuuccccagaugauuccauacacaugauugucugggggugauguacacagcuccugaauuaugggucuaauguaaauucaucugugauugggaaaagcaaaucuguaaaccuuugaagucaaccaaguagaaaaccaucuuuauacuuguuuuacauggacauguguguacguucuccacacgcaaccccaaggagcguguuucugugacuucaucagguuuuucagguuuagggagcguguguuuucuucuugcgugacucugaagaugcaguguccuuacuuccucucuuccagucuguugcccucccccggauuggcaccugcugaggaguaauuagggcaguccuaauuuggacaaccaaauccugauuacagugagaggaaaaacaggaaauguucuaguuuuucugccagcaaaugacugacuuaaauagaaagccauguacaauucaaaugauccaaaaugauauaacacuagggaggggaggagggaggaaguagggaaacauugcaguccgacuucgcccucgugauucucagcagaucuugcauggaagcugucaaaucugugagcucacaaugcccucugcugagaaccagucucucaggagaaccugagcagagcuguggguuuaaagaucugaggaaaggucagggacaucucuccugugagagcacagugcucaagagaaagacugcucuggaaugaugucauggcacgugauuggggugcagauguucccuacaagggaaguaagaacuagaaguguuuuccuuaauuagucauaccccuuggagcuucaaguaaacccaguugugaguucugaaauguaccauguuccuaaucaggcagucugucuauuacugugccaccucuaagccaaaugcuucucuccccauguuuguccucuuugcccugagauucaaccagcaguuccaucuguccccaacgagucauuuaaugcuuagaauucacaguuuuugugaaguuucucuucauuuuaauuugguaucaguucauuaauuuuucuccaguggccggaguacucacacuugucucugucucugucucugucucugucucucucucucucaaucucucucucucucacacacacacacacacacacacacacacacacacacacacacacacacacaaccaugauguugaagcugguagaaaacacaaauaaaaccucugcuauauacuuagagguuccauugauaucagacacagcauacuacugagaguuauaagcagcuggggacucaccuuucagccauucacugugucuucauaaaggagcuagaaauuaugcuaaaguaugaagacacuuugcagcaugacacaccugcaagcuuagcaugaacucaguggaauugcuguagaacuugacuagcaugcaaagggcccuggauuugaucccaagcauaccagaaugcuaaggagcacucuugagaaaggaugaugauagcagauccaacucagggguaacaccuugcugccccccuuggcauguuuggugaaugaaugaggaagccuuugcuaaacugaauggggagaauugcaguaaagcagaagggugaauggaugcaugcaggaaagcgagcaaaucguaacaagggcagaaugugugcauagguaaggaagggaaguuuggcauuuucccaguuaguggcaaagaguacuauaugacuccaauggggugagguggacggcaugguccaagugcaguuauaacacccauuguguuaacuagcagaaacggacauucauggaugccuucaaacucaggaaguacuucaguaccccugcauaaucuguaggauuaagaacagaguugagcuugccuugaacauuuccaaccuaaugaaauguaaaugaaaaauaaccaacaacaaaaacaaaacaaagucaugagccagaggaacagcaaagguccacccagcucuaacccuccucagccugugaagacucucccaccugcuuggcucacgcagcacuaacacucaguguuuugguuacuuuucuguugcuaugaccaagcuaggcagugguggugcacaccuuaaucccagcacucgggaagcagaggcaggcaaauuucugaguucaaggccagccuggucuacagagugaguuccaggacagccagggcuacacagagaaacccugucucaaaaaacaaaacaaaacaaaacaaaacaaaacaaaacaaaacaaaaacaaaaacaaaaaaagggggaggggucuuauaaaagacagcauuuaauugugcuuacaguuucagagcauuagaguccaugauaguagauagcuggcaucucacgucccaaacagcaagcaggagacagagagggcacaccaggaauggcaugaaucuuaaaacuaccgccagugacauaacucuucaacaaggccacaucuccuaauccuuuucaagcaguuccaccaauugaugacaacguauucaaacauaugagucuacaaggauuaaaccaugacaugcaguuuuauuaacuauaauauaauauauauauauauauauauauauauacaaaugaaaguuauaaaauuuguaguaucugcuucauagaaaggaugaguucguuggacuuuuuaauaugcuucuggaguuacccaucaguggcuuacauuucuguguguauuauuugaucauuuagugauauguguuugucuuucuuuucauaaccuucuucaacuguacauucacauugaaguuauuagcagaaauauuaaggcauuagguuucccaaauuagguccacuaagcaacuguacuuuuaaaagugguugucauguauguuacuaguuagaacucacugacugaacugucagcuucuagaaagaaguuacugugacuuuuugcacauaauuaucuccaggagcuagcauaacauauuccauagcccgggcacucaugguuauggaucagaugagccccuucacuuuacuuaccaugccagcugcucucuuagccugcaucuuuugaccccuaaccauuuguccuauagauuuggugggaagcagcaaaccucauuucucuugccuagcucagccuacuaugaucagauaggagccuauugcaguaaccuugauacacaguaauaagaaccuggacugaguggaaauaaauaaagugcauagucacagugcagagcacuuuauaagucauuagcuuaucuagucacucacaacgauucuauuaaauuggauucuccuuaccuuacccaugaaaaaacagagguucagaaagguuaauaacauggcgaagggcacagaacguagaagcuguagugcaugcauuagaagcuaacucugacugacucuuaaguccaaauaagaagcaauggaauuuaaaaaguaaugggaagccuagacaugcuucagguggcuuagaggaacuacacuguucuacagucuccagaagaccaacagcaggccuagcuuagaucuguccuaacagucagcugacccagggcagguccucgaauguccaugccuagguguuucaucuaccaaauccaucgaccauacagaauuguuguguuaauaaugaauguggcuggagagauaauuuggugagcagaaauguuugauguccuagaauaaagacuuucaugaagaccuaaaacccaaguaaaaagucagacaugaccacacauacaucuguaaccccaguacugggaagacaggagcacagacaggaagaccucuaggucuugcuaauggccuaggcccagguucaauaagaaaccuugucucuaaggaauuugguagaaagugauagugcacacaugggcaugcacccucacaagcaaaacuaaucauacaucacacuaaauacuacacacacacacacaccauacucauacauacauacauacauacauacauaauacauacauauaccacauguauacauacaagcauaucauacucauacaugcauacugcagucauacauaccacagacauaaacuacacuaacacauaaaugcauacacagaccacacacagacaugcauucacaugcauacaaaacauacacauauauauguguguauaauacauacacacaagcauacacaccauauauauacauauauauauaccacagacacaucacacacauauaucauacauauacacacauucacacucacacuuguauauacauauacuauauucacacacauacauacauacacauaucauaccacacucacacacauaccuacaugcacacacaagaaaaaaaagguuuagcauguguguaaagaacuuagaacagugccuauacugugauaacuacuguguuagcacauuugcuuauugcuacauucauuaguagccuuguugauauuugcugaugucacaggaaagauauuuuuaugcuuucuguuguaucucugguguuuauacugcaaauauaucauuccaucauuaaaucaguuacuuuauuuauucagcaguuacugaggcccuaguaccaaagcuaggcaaggacaucauaugauaagaaaacuacaggccaaccuuguuaaaaaaaacagauacaagauuucucaacaaaguacuagcaaaucauauucagcagcacauuaaaaggaucauuccccaugaucgagugggauuuacuccugggaugcaaagccuuaucagucagcauccacaaaucaacaaaugugauacaucacauuaacagagucggggacaaaagccaugugaccaucucauuagaugcaaagaaaauguuugacaaaauucagguccuuucuuuuugaaaauacaacaacagugcugcggagggaauacauccuaacgcaguuaaagccacauacagucaauccacaguuaacacuauacacaguggugaaaauuaaaauccuucccucaaagaucugggcaggaggagaaguugggcaaauaagcaaaugaaagaauaggaauaaguaaaauuguugcauuuuacuaaugacauggucaguaacacugacagacaauggaacccgaagagccugccaauacaaacuacuaggcccacuaagagaauccaguaagacugcagagaacagaagucagucacgcuuccguaugcucagaaugaacauaaugaaaguaagggggaggacaguccuuuuucaaagacuacaaagaacacuuaggaauaaauguaaccaaggagaugaaaaaccuacgaacucaacagaacaaaugugauacugugaaugggagaagaaggcacaagugacugguguaauaacccauguuggcagaaaggauucauuuugugaaaacgacaagauggccauacuacucaagggaacguacagacucagugcagugccuuucaaaauccaaguguugguguguguucgcacauaugcgugcccguuguauuguuugcuauauguaaauuaguguguuaauucaugcagcaauacucauaaauguggaauaugauguccuugucuucaucuguauucuccaucuauugcccagagacagggucucucauugaaccugaagcucaccauuuuggcuugccuggcuagccagcaaguuccuggaaucuaccuauuucagucccccuaucuugggcuuagagguauauacagccguaugugaauacuacuauguauuuuuguauguguguguguguauauauauaugucccagaccuuacuauauauuuuuguagaaauauuuuuuaaaccucaaauucauguggaaucacaaaaguaaaaccaaaaauaaccaagacagucaugagcuaaaagaacaaaacuggaaacauugcucuaccugauuucaaucuaagcuacaaagugcuaguaauuaaaacaccacaguucugacauaaaaacagacucauugaccagaagaauagaauugagagcccagaaaugcacucaugcauacacaguucauugaguuuugacagaagugccaagaauucauauugggaggauacaucuaccuucagcagugguguaggggaaaguguacauagcagagaaggcucgguaucucacaccauauacaagagugacguguaggugguuaaauccuucacgugagacacagaacuacaaagaguacgugcuacaauuccaugguguagcuauaccaaagaaguuuuuuagauuauauuuuagauuuuccuacuccaaaauaggagaaaugaaagcaaaaaaaaaaaaauagacaaaugggaauacauuuacagaaagcucugcacacugaaauaaaggaaugaggagccaaccuacacuugggagaaaauauuuccaagucauacauuuuauuacuaguugguagaaaaccguguaggaaacuuaacuccauauuuuauuuuguuaaaaaacaaaaauaacuaaauaacagaucauauuaacaguagguaaagagugugaggguauaauuugaguguauauuuagcuuguuaaagacccuagacucaaauccuauaccacuuacaacaaaacaaaauaaaaacuacuaagagggcugaaucaaaauuuuucaaaagauguauaaauagccaacagaucuuguuagaaucacuaauuauuuaauaagugaaaauuuaaaaauauuggaacaucacacagugauuauuaaggcuguuugcaaaaagacagaauuuagcugcuaguuuguguauagaaagaagaggucaucuauauccuguugcugaaaguauaacuuguguugucuuguggaaaaaucaaaauggggcuaaucaaaaacuacaaauaaaacuguaucuagcaaucccacuucuguguguuuacuuccuaguuaaaguuaguaugucaaaaagaugucugcagucccuuguucacuaaaacacuguuuacauagccaagccauggaaucaauccaaguguccaccaauagaugaguagaaaagaaagugugcugcauauccauaagggguuucuauuuagcguuuucaacagaaauuugccauuuaugacaacauagauggaauagacaaauacuauacuuaaguacaguaagccagacgcagagacauuuccucgcgucuacgagaagagaguggaauggugguugccaggugguuguuggagauguuagaguaauaaugguaaaggguacaaagcuuccauuagaugaaacauacggcuuccccuacccuuguugcaguguauugcacuuuguggggaaucuaguaaauauaaagacuaagccucaaauguucuccucagaaaaaugaugugcccuugaugggggauauguuaguuuguuucaugcuauauucaugaaucauaguaucacuuaguacucuaugaguguuuacaauuauaguuugucaaucgagaauauaaaaauuguauaugcagggguuuacugagggcuaaacuucaagaaauuaaucuguuaggcaaucaaggcuuuuuauucuaaagcaggagacagauaaugaucauguaacaaaguaggaaaguggauuuuguuaauagaaggaucugauuuugaaaaagaccuuaguggggaugugaugcuuggacuccauugagaaggaugggagggagauguggaaagaacaugccaggcagagacagagccaguauagagaaacagaguggggagcagggguucugagcuucuuuggcuaugaccuggaccaagacccuugggguggggauacaaaggcacagagucaaugacacagagucaggcaagcagcaaaacagacucauuuauuacagaaacugggcaaaccuuuauacccugcuucuagcaucucacugguaucucaaguagccagauguggugcugucucuuucucauuggcucgcugcaucaccuguuccagcaucaguggucucuagccauccuggcagaaucucgguuggcuggggaggaaauaucagugguacaugugccagcauugcaacugggccugcuuggcucaguuccuccuacaggcuucucuggcugcacaguacaaugcugugaguacucuagagccuauucugggcccagcuucugacugagccuaauagauauccuuaaaaguuuuccagguauuuuaauguauaaccaggauugauaaaggaucuuaaaccagagguuuggauuuuaccgaagugcaauaagaagacauggaaagucuaaaaagggcuaccuagucuguuuuucuauaaacauauuaaggauauucaaacauaaaauguacuuaaauuuguuuaccaaaggaaaaaucugaacauugacaguugaggcacauuucacauuaauuuuugcccugcugccuaugauacaauguaauucuuuuucuuaaaaugucaguuaugaacaguaucaugcaaacuugccuauuugaagauuguuauuaaauuaucuccaagaguuacuaccucugcagacacucagaucuguuuccauggccuguaugcaaugcugucucuugggaagaaguguacacccugugcgggcuaguuuuaugucaacuugacauaagcuagaguuaucagagaugagggagcaucaauugagaaaaugcuuccacauaagauaaccuguaggcauuuucuuaauccgugagugaugggggaggguccagacaauuguggguggggccauccuuuagacagugacccuggguucuauaagaaagcaggcuuuucauggcuucugcaucaucucccgucucagguuccugcccucacgccuuuggauaauugacuauucuaugaaacuguaagugaaauaaacccuuuucucuccaaguugcuuuuggccaugguguuccaucacagcaauaguaaccuuaacugagacacacucuccuauaaaggcccacauggauuucugucuuuuccaaagaauugugguccauauuauuacuauuauuauuauuaucuuccuccuuuucaucuuucucuuguccaucuacuuuucuucaguuuccucccuugcuuucacuuacguguauuuauucuuugauaugagauauguaauguacacucaaccuccaacuucucccaucccuaucugcuccccaacacucacuccccaaaagcccuugcucacauccaugucuguugguuauguuugguggcccacugaguuuaaccaggcuuguguuaccauacauuuggagcuauccacuggagcauggugggcucagcaguguguguucaccugcugauagugacuucugcucucccagaaccuaucaaacgccaguauuuuagagcuguuuuugcuuggcugucuucugccucccucacuaucauuauuacuuguuuguuggguauugcacucuaguuuggugugaugcacacucaaucauuccuagccuauaaacuggauucacggcggcucucucugauccagcuuuguccuugguucauugucuaacuuggcuuccagcuuuugaaguaucugagagauugagucugggaaaguaagcacccugcccuagcugucacagaacaguugaauccaauuagccccaccugccccugguuguuuaccuaaggaaagccucagcacccagcugugucuagggacuguacacacuugcacuucccaacuguuccagugaggaagccaguugacaucagcagauguuuucugaaugaaauccacucagccaugucuugaggguagacucuucucguggcaacccaucaccuguuuuaagaggcgcgccuauuuuccucuucccuccgggaaggguacaaauaguuaaacagauggcucagucuguugcccauugagcugugaauuaauugguagauuauguuucuggcuggaaugauuaaccccauacucuuacaaaauuaauauuggggauguugggguccuuuuuugaagguauuuagauaugcccuggaauuguauaaccuacuugaucuguuucauuacaaaauggaaaauuaaagacugccuuugaaugaaaauuuuccuuuaggguaauuauauccuacaggaagucaguauuucagguuaguguauuaagaaucgauuuuugucuuuaucuuuauuucacuauaaauuaauauacuaucuauugagagcaguguauauuaacaguuugauuaacuaccaguucuauuucuuaauaaaauaaaaucagguaauaauauuauauugaacuuuuuaagcauaguaguguuuuuaaggggccuaaguaaauagucuggguaccuuuaacacagugaacaccuuagauaagguuucuuuuguuccaugaaguaaaauagaauauuguagucauaccccuccaaaauguauaauacuaucucacaagucuggauucaaucacuuuucugaacccugggacaggcuagcuuugacucagaauuuaagaaguggaaaaaugaguuugguuugagcuuucuuuuuucuuuucuuuuuuucucuucuuuuuuuuuuuuuuuuuucucuuuaccuuucuaacuaugcaaagcaucauugaccuguaacggggcucuaaccccuucagccgagguuccuucuguguaugacauugacauuuacuuuauauaauuugcccacauuacaaaauauuguucuuuaauuuuuuagaaaccauuuaaaagcggcuaaguuuagauggcuucuaggacauaaaaagucaaacugaugagcaggugggauccacaggccauacucugccgaccucauuguagagaaugaaaugcuaacuaccugcuaggcaagccuucuaagcaaagguugucccuuuguaacuuuucacugugugcugucauagucaacaaacugcucacauggaaagcaagaucuugaggaaacuuuccacacaaaagaccaccuaggaggagaggcgcgcagggccaggcuugucaacaauugauccuugcuucacuuguuaacuguaugaggacuuuuccucaguugaguuuuuagagggaaaaaagaguguuuguuauucaggaauugugaucuguaacgaauuuagagaggcauagaguaauucugugguucggccaaauacaaacuggucugaguugguaaguccgggaaaggaugcccacugaagugaccucugauuaguggguaauauagauuagugcgagaaggcuuauguuuaguuccuguucaguuucuacauaccuuccagauacgaggugucacacgaaguacuaagaacaaaacugauaagaaguuuaacugugcucagagcaccuauccaguucgugcuccucauuuguuuaaaagaagaaagaaaaugagggagggagggagggagggagggagggaaagaaagaaacaaagaaagaaaagaaacaaagaaaagaaaaaagggggaagaaagaaagacagaaagagacagacaaagggagggagauaugaagggagggaggaaggaaggaaggaaaaaggaaggaaggaaggaaggaaagaaagaaaaagaaagaaagaaaagaaagaaaggaaggaaggaagagagggggaaagggagagagagagaaagaaagacaaagagagggagauacaaagggagggagauauggaaggagauauagagggagagagggaggaagggaggguagguaaaacaaaacaaaacagcagugagaagagaucuuuauucccuggcauacaguuuagaucaacugagaaauuuacauauuacauacuucaugcuacuucuugacccagguucugauuuguguagucuuaaguguggccugugcaucuagcuuuuuauuuguuuuguuuuguuuaagagaucaccuaaaugauucuagugucuaguaaaggcugaaaaucucuaucauaggaagaguugggcauacacacacaaacacacaccauaaauagcaaggaaggaacuaaaguaaccuuugaugaguaaaaacauacagggaggauguggaagcaagaaaagaggaaaaacaauauauuccacugagcggaaagaaagaaacaaaaagggaguaaagaacaugacugcuucuagguauaguggaggagaaaguuuauuauagauacgugggagagcauagccagaugcagccauggggacaucuggagaguccagaguagacaugaccagacugagcugugccuugugagcagagaccggggagagaagguaagagcagggaaucagggugaagcagccaggaggcccaaagauacaaagagagccaguaaacgaagggacuggauuauauagggaaggaaggacagcacagaaugcugggcuagagaagguuaggguagaggugggcgugccagccgggaggacccuguaacaaggacugagggaugcagggagaacuugggaaccagugucugccuugguguauuaaauguguaccucagccauguauuagguuugaagccuaauauccacuuuaaaauguuagaacuguccuucuggauaaaauaugcagcuaacguccauaggaaaaugaccuggaaucaugaccaaauagggacaaaagagccagugcugaacagguagguguucacauagugcucucugguucuguucuguaaacacaggagccauuaaagaguucugagggaaggauucuuuccucaguguaucuuaguuuacagagaugacuuuucuggcauuauaagcccaacugauggucucagaacuccaggcaagaagcccagguaccaagucacugccaaguccacacgagaaaugauuagcuuaaaugccaauuaauggcagugaaucuggaaaggaaaugacuauucagaagaucuuaaagagacagaauugacaggauguggucacuguuggugauuaagaaggcuauauucacaauugaauuauaggauggcuagaaucagggaugccagguggcuaaggggaaagagagaaagggaaaugacugaauuccuuuugauucauuuuacuuugaaaugcuggugaaaguguccacuaagagcucucuaguuauccuuucaaacauuaaaacaagagugagaacugaugcuccccuagagaugugaguggagaagucaucagucaggagaccagauuacccaagugugaaaugcacaggccaaugggccucagcuuguaaggugugggcacaggagaagagccguccaagugggcucccaaguggguuugggcgacaagaguagaaccaggaggacaugauguaaaaagaaaaagaguagauauagggagccauuuuccugcuccuaacauauauaaaaugggagagaguuuucuuuagcuuuaaaaguauuucuaauugguaaucaaacucaaaaagaagauaauucuccauauucccugaaugaagaaguaauuagccaggcaugauggcacacgccuuuaaucccagcacuugagaggcagaggcaggcagauuucugaguucgaggccagccuggucuacagagugaguuccaggacagccaggacuacacagagaaacccugucuuaaaaaacaaaaacaaaaacaagaaguaauuaaaaccacaaaaacaaguaaagacugacgcugaagggacccggaaguugucagaacacagggagaggcaaaaaaaggaagcgaugacaccagcaucugcaacaaaagguggagaugucuucuguacauaaguuauacaagggaugguuccauucaugagugcaaccaggaaacucggacucucggggccgucauuugcuggaauguuuuuaaagaacacaguagagcuuuagaagauaguaauucugggucagggaagaaaauuguguaugcauuauuuagaaaacuaacagaaacuaggcaaauguacuguggaaagauguaaaauacaaaaagaaaaggcaggaauaauguaggauucucaggagacugaguggagggauaacuagaaacaaauagagaugaauuugaauaauauucaaauauuauauauuauacauuuggauauaccugcugaagagaucauuuuuaaguguguaguaugugcucuaugugcucugucaaugaagaucuacaagauaaauguuuuaaguggccacuaagguaagucgggagacggagcugaacagagacacauuuucagauugucagagaauauugagggcuugucuacgauggaauguuauaaguccgaggugguaucauuacuauaagauuugcaaguauaagauuauaaaagucagacuguagaagaaugcaaggaaaaaagaagcagcacgcguaagggucacgcaugacagucgugugaaagaacagggaggaagacccugcugcccucaguuuauaucucagaacaguuucucucaggcaauacuugcuuaaagcaagcuagaaaaauucuuucacccauaguucuccuauucuagcuuuuuaaaaaagaaccagggcaauauuguugcaauaugaaaccaugguaccuguguucaggcuacaaugagugaagauuuguaggcuucaucuuuucuugucuacgcauagugaacuaucuguugagucaaggcacuuuucuuauagguaccauuuauauuuauuugaaaauguaugguguaauucuuagcacaugaauauauccuugucugugauaugagaagccuccagagacuggagacuuggucaucagaagaagggccaguucauuaacaguccauaaguaaaugucacuucugucaggaaauacugcugaugagaauuuuuagacccuuaaaaucagcuaugguggcagaaauguugaguagaaaaaugggcuuuuuaauuaaguugaaauugaacauuuaaggugacuuuucagguacauccuggcaagggcagcauuacuagugaacccuugggcccuauuaaaggacuagaagccugccaacuccaggucccuagccaaagcccagaggaguuugcuguaaucaaagguuuucccugccugacauuugggacacaagcuuucuuuaugaucgugguuagcuuugaauagaggaauguccaucauacaaaagcaaucuucaaauagaacuaaugguagcacaaacuaaagaggucagaggacagucuauaguaacauuuauggcaccuuuuagcuaccacucuugugucauucaaauaguauuuuaaaaauauuauuguucuacuuuuugcuauuugaacauuucuugaaaaguucaauccaaacuucuacacauuuguguucacuauaagcuauuaacaguuauaagauggacaaucaauauuauaagcuuaugguauaaugauaauauugugauaaccuaaucagcuuauguguucaacaaguuggaacugagaauaaaaucagagguagcguuucagccaugugaccuaugaauacacauugcuacucugaugaaggucgugcacuguguuacgagagaugggcauaauaucuuuuuaugcagcaaaagaugaagccacucacuguaugagaugcuaacauguccauuucuuuguggucguuuucaggggcauuguccagucagaagagaaacuugucaucagugcuucuugggcaaaggaugaugauaucagcagacucuugaaaucgcugccaaacuggacuaacauggcucagcccaaacagcuaaggccuaagagggaggaggaagaagacuucauaagguaaaugacuacuuucuaaucuuuguuagacagagggaggaaaaccccauauauucaacaaagccuuuuccaaaugaaauguugaaucuaaagaucaaaggacaauacuuguacuugaaaaguccaacacacgcacgcccaccuccuuucccauccaagugugccuagggcucaaagguaaccaagaaaggcuugugaauccaaucugaagcauugacaaguugggguaggaugacucagauuauaccaguacaauacaaucauuuguucauucauucauucauucauucagcaaagcuguacugacuccgcucuugacaaaccuauaguaagauaaaggccugcucagaguaugucugugucacagcacuccaagcauggucuauaacuuccacguucauucacacagacucuauugucccacuguuuccugcuuguuuugaaaaaaguaaggucucuccauuaacuuuaucacucagcauuuggcuuuguacagcauauuuauuuaagccauggaaucugaugaaggugcccuuuuuacauuuggcuuguaacaguaaacuauuuucacuuguguuacuuuagaccaauaaaaaaaucuauuuuaucacauuaaaauuagguucauucuuacuaucuuuuguuuauucaagugaagaaauagaugguacaauaaaauaagagcacuuuaaaaaagcaaagaccaagagcuggguuagugaaacaugaaugaaauccagcacucagaagauagaggaagaggucaggaauucuuuaccuuuuagugcauagugaguuccaugcuugucuaaccggaugacccagagucaaaaaggaaaaagagagaggaggaaaaaggggaaagaaagaaagaaagaaagaaagaaagaaagaaagaaagaaagaaagaaagaaagaaagaaagaaagaaagaaagaaagagagagaaaggagagggagaggagaggagaggagagaagagaagagaagagaagagaagagaagagaagagaagagaagagaagagaagagaagagaagagaagagaagagaagagaaaaaggaaggaaggccaaaaauaagaauaaauaguuuuuaagaaaauggccauugucuucacuuucaacuuaagaucaaacaauaggcucaucucugacagaauguagauugaaacucuagcuaauguggugcuuagaaugagaaugugccccagguacucaaguauuugaauaugugguccccaguugguggccuuguuugggggagguuuagaaggaaggugcagcugggagcaggcuuuaagagcucacagcccugccccacuuucacuucccugcuucauaugguauccuacugcccuucccucuagauucucccucuagcacaaaaauaaacuguuccuucuacggauagcuuuuggucaugguauuuuuuuaaucacagaaaguaacucauacaaauauuaaguauucacuauucauaaaguugacuguguucacauccuacaugacuuauuuucucugaaaguagauaaauuuuucuugaucuuagcucuuacauaguuauaauuaaaaaguuguaggacacuaaguguugggugagguauuuguacaugucuauuuggcuuauguuaggacuuaaauuucuggguaauagugugugcaaauuucaguuguucacuuuaucaguuuucuaaaguauuccuaaggagcuguaaacgauggcccaaccguuaagaacagaaucuugaucuugcagagcaccuaagcuuuguuccuaguacccacugccuguaacuccaguuccagaggguuugacaucuucuucuggcuucugcaggcagcuacauccacauauagccacacacagaauacacacauacacauaacuuaaaauaucuuuaaaaaauauaaaaagaaaguaagccugaaguuccuguuggccugugugacauugaaggcugaauaucuuccaucugucaaucagcuguuccuguauguaaauugauggcacuuaguaugcauuucccucagaugaugcugagcaauuucuugugcauuuuaauauauuuauuggucuuuaugcuuuuuuucaaaucuguugcuaaauuuuaauugugugugugugugugugugugugugugugugugugugucucaggguggguuuccuagugaucuguaggaguguaccagacugucacuccuuugucauagauaaacaguucuucucccacuugacagguugcccguuuacucauucagugcugucucucauggaagagauugucuauaauaauaaguacaguuuauuguuuauuuuauggauagggcauuuguguaagaacaugugcuuacacaaaagucacagaggaauguuccuuggaaacuuugaugcagugguucuucggcaucuuuaaaaauauuaauuuuuaauuuuauucuccuauaaccuaagccuuccucaacugaaauuauguucucaugacuuuagcaaugcauaauauccucauaucucccaccacaagagagagugaaugauugaaggauugauuagagcuuaaguagauauacucaacugaccuuaauacagaaagcaagccccaaggaguucuuucacagaauuacugucaaaucaucauuuuaucacagucucaaguggccugaguaagcacauuccuccuuacuacgcauaucacuuagcuguguuaucagccucaguaguugaauuacaagcaauuucuagacgauaacuucuucugcaccuauauuuuagguuacuucaaaugagcaacugucuuccgauuguuucucagcuuauuuuuacauaagaacuucauuguaauaugugcuugcaagaagauuguuaaucagcuggacuccuucuaccugcugaagcucaguguaaaaggaaacuguucuauuccagaagagagaaugcugcuccaggaaaggagcccccccccccaccccacacacacacacacacacccucucuggcacuaccuuggauuuagaacagcuagaauuacggaucuagcuuucuuuacucuuguuuugaucauucaaucagacuaguccucauauuaaacuugaaggaaaaucaaauuauacaaauguuuccucacuuuugcccuagugaaguauauacacccauauaauuagaucaaauaucaaauucucuaguauacuccaaagaucuaccauuaaaaggagcccauucugcaucauaguuuaguuuuccauaaauuuggucauagugucugcuuuguuuuauuggauuuuaugccugaaagacuuguccaugguuuugcaugugagcaguuugacaagcaaauuguauuaaccccauuaugagagaaaucacuuucagguguguuuuacuuagauguaacuaguucuuuauuuuauuauuauucuuuuuuuuuuuuuuuuuuuuggguuuguuuuugucuuuugagacaggguuucucuguguagcccuggcuguccuggaauucacucuguaacuaguucuuuccuuuuaacccgucccauucuuuuucuagauuagauguugaaaccauguaaguagaagagagaccuuucacugauacuccagcaaaccagaguugacagagggccggauuuagcacauugaguaccauauagcacuguaugagccaaaaagacugcaaaguuacucuccuccuauaauuaguuuuuaaagcucagaagacuauuuggugaacagaugaauauagaauccaguguccuuugcauugaguaaaagcuaugcucucuucauuauuaaaugaggccuuuuucucuucuuguguuuuaacugaaaaaaaaaaaaaaaaagauguauuauuucccaguucagcauugaauagauggaggaaaaaaaaacuaggucaagcuagggcuuuaauagaacccuuuuguucccaaagagcuaaaagcaggcucucaagcccauugucuuugcgccugucaugguguguguguguguguguguguguguguguguguguguauacauccuuugagauaauagcuaucuauccacugauuaagagucugcuuuuggguggguguaauuaacaggaggaggagaguguugaaggaaguaaaagagauggucuaggaguuggggagaucagcagugagcagaagcagaucccaagaccugcugcuccuuucguuuaugcccuuguguuuuacagaacaagagucauucccucuagagccagcugugaacgcuuuaggguggcagaccaggcucugaguccucaagggauaaaggucaaacagauuagucuugaauuauagcaggcugauaauagauuauauacaguccuucucuagaccaauaauauaaugaaaacgguaaggauugccagugccuggcaguguaugacaacaucaugagucuccaaguguuaucaucccacucaaccaaugaggacacugagaaagagccuucuuccuaacacagccauuaagugacagagcuggguagacuagauagauagacugucucccagagccaccacacugugcucauccaggcuaaaauugguucaagaauguacauuuugggacuuuuuauuuauucucucauuuucaucgauuaucauaaucucaacuaauagagcuuuuuuuugcaaauaucacagauauguaucaugaugccauuugacucuauuuuuuuauuauugugucuuauuuaauauauuacauuuuauggguucucuuuacuucaauagcaaguuuuuaaacaguauguacccagauaugucuggaaggaaugguguguuaaauccaguacuuuuuuuuaagcugugucuuauauuuuccucuuaauaauuuguucaaagcaaugaaaauagaaaugaccauuguugguaagagaaggaagaugcaaagaagauaaaauguaaaaaaaaaaaccaauuaauugcuuacacuugagguagaggauaguguaguucugaguaggaaagacagccuuaaggagagccaucgcuuuuguccuuuuagugacuuaguugucucgaugcuaaccuuccacgucuucugcgggaucagaugacugggucauucacugucagauuuuauuucuuuaauugugcuaugaauuuuggaggcacggugauuaaauagcaggaaaauauuauuucagugcucagugguugacuauaaugauuucuaaguuuuuauucagauugaggucuguacuauuguuuaauuuaaagagacagaacaaaaacagagaguugguuagcacuuuuugucuuccuucuguggaauccucaaaccacacaguacagccuuaauaacuguuaaugaaugaaaagucagcucaucuucaaauagguagcacacaauauaagcuggggaaugccaccaacugggaaagugcuuuuccucuggaaguucacaggccuggguucgaggccucagcccuggcugccauuaacuagucugcuuuguucccuuuuguuuugguuuuucuucaguucuuucuuagcccuaauggguuucuucacaaggcucaggguagacaaugacaaaagaagcaaagcuagaaguauauucauauagagagacaauaggaaucaaguagagcauuaacaagcuuccaagaaguugcauacuguaagcaacagcuuuugaaaggucuccugaacugcagcugcuguggagaccucuaauaaaucugaaggagcaaagcugugauacaguggggaaggacuucagcuagucuaacaaacguucugcagaaugcagacacuuaucucccuaucucuagaugcuuaauaugacuuuuaaaaugcaauuaggaaagaaaagaugaaucagacucaugaauauauuaaguaagugcaagaguagaaaaugcuuugcuaauuuuuuuuuaaucccucaauuaaacaagaugaaggucauggauagauagggacacagucaaauaagucagggugagacucggauuuaagucucaaaauuaaacaaaagagacaggccauuagccagaaauucagcuacaaacaucaguguuugaugaauucagagcuuuuuuucuuauaucaaaacuccuguuagcaaaaaaacuggcaauaaguaaaaaaauaaaauaaaauuucccauauagguucuaaaaugcuagcuuuucuagacuauuguugagaaucauaaucucauuaaucucauuuuuaaagcacuaauuauuuuauauaguguauguuuaucuaauuucaggugaagaucuuuaauaguuuccauuuaggugugaauuuaacacuauuucuuuuucucucauuugaagucuuauaacagauuuaaaaagcugcccuucugagauagucugucuuggucaugguuggggggaggaugccugcacuggaggcugagcaggggagccaggcgaggacugagcagggagccugcagcaagcugaauuucccugccaggugauaaaggaccgcuagccuguuugccccuacuugucuuucacuacuagucccuaggcugucagccugccauauucuuccacccuccuuguuggucauucccagcuuuuccccuuggcauggccucuaauugucccaggaauaagcagacacucagggcgugacagaggugagcagauauuaccagugugagcagugugcagauucuuucuaguguggcgagugguguugucaaaggaacaaugauguaaauccacaaaaaacaaaacucaaagacaggagggagggaggaagauguaacugggacccaaccaggccaacuuuucuaauguuaaggucaauacaccauuagcaguuggaacagguuguuuaguaacaaauauaaucaccgaagaacugaaaaauuaauguugaaaccauuguaugugaguuuuucuggaacacagaauugaagcugaggaggagugagacaaguguacaguaugauaguaacuauaacuuuacguuaaaauuuucaccugcuuaaauauuuuccccauacacccuuaaucccugcuacuauuuacugccuguuuacugauucuccacaaauacccucucucugacauuugcauccucaucuuccuucaucuucacuuuccuccaaguuuuaugguagcacuguggucucuguggucucacucagccacagucuuucuccaccucucucauccuuucucucccucuacuaugaaugcugcucagaguacuggacccuuagugauccuugcuucaaucaaugacaaccagaggggaaaaaucacaacugucaauacaguguaacccucagaggaggguaugcccugcugcaucaguaucuguguguaagccuguacucauuucuucuaguugaaagccauggcacauuaugcucaacucauaauaagugauuauugauuauuuuaauucuguucugacaaaguucugaagcuuacagcauguuguuguuuggagacugauauuaucaguaugagugagugagauacaauaucuccuggcagaaaacccaugugacaugugacucuguaacuaaagaagcaagacggaguccacugcuugugugucgugguucccauccaggagggaaacaccgagaccaggcucaauuggagugcuuggcuuagaaaagaauguuuaaaaucauucuuguuccgagaugacagaccucaugaaugcacuaguauuaauuacauguguguuguaaguugagccagugcauuaaaguaauauacuguucacaguuagauguuugcuuacugggacaugaguccaucuucaugaaaguuauaagucuaccaaaggauggaaccauguauccugacacuugguaccaaaaccaaauauagacaacauggaguuaggccugagcugagccugugguccuguucuacucuucccuguccuccaauccuuccauucaugagucagccaacauauguacugacaacauguagccuggguguuuggggcuuuuccccagugguuauggguauauguauuuauucauuuaaacuagcacaccagagaggagcagggggcaugagggaggacaguuaaagggccugggguauagcucaguugauagcaugcacagaacaacugagcuugguggugcacacuugugauuucaucacucacgagguagaggcaggaaaguuggcuacagaguaaguuugagguuaacaagagacacaugaaccucugucuuaaaagaagaagaaaaaauaaaugcacacacuuaaaagugcuagguaucagauacucaaaugaaggcaacagggugcugaugugcaguauggagcuauucuugauaauacucuacugugcugugggaacuuuugcuacaagcauagauuauagagcucuuaauuaucucucaauuaugagauaauaaaugugcuuaaucucuucaauauauaaaaaaguuuuuuucaaaaauuuacaaaagaccauagaaagucuaauucaguauuguuuauguuuuccauguguaguuuauaauagagugcaccuuacagaagaaaguaaccucauguaucguggcuguuuugucaaauguugagcacaacuuacuacucuuugguacugcuuagggcucuagcuucaauguguuuacaugcacagcacauuuuauuuguaaagauucaccacuuuauuuuaugcaucagaggaucuucuuuauaaagauaccucauuuuaaaaaauugguugguucuuugaugguuccuauauuccauugaaaucaccaguucaacacuuuuacaaaaaccagagccuaccuggaguagguuucaguccuuauugugaucauugcuuuugcauuguuggcugagugacacacaugaaacuggcuacacagacccagauuucugucuucauccauugcucgcucugaagaguaggaaguggagggaucguccaggaugcaguacugagagcugcugacauagccaucucuaccgcacuuggacauuuuucaaugggaaauuuggccagguggcccacuuuuguagucccagcacuuggauguagagggcugccauggguuuaaggucagcauuaucugcauagccuauuccuggccagccaggguuacauaguaagacccugugacaaaaagaaaaauugaaaaguaaccagaaaauuuaaaaguaacucuuuauuguauauauuguuaguaauauaggccaaagaacaaaagcugcacugcuggggacccaaaauagcagcuuaaaauaaaacuaauuacagagaacuuuuacagaauuccuugcauagaaauucuacaaggcugagucaaauaggaauaagguauuuuuuaaccuaauguaucuucuauaauaauacacuugaacuuaucaaaaaguuaccuaccuugaccugugauuaagaucucagccucuaauuagaaaccaacucuuugaacuuaguauuuugcugccaacucauuccauaaaagaugcugguguccucaggauagugagaccacaugguggccaggcugccuuuaccccagagcuuaguaaccugggccuuuuuuccucuggaaaaaucucagcuguguacaguaguuucucuguacucaucuaauaagaacacaacacauaaaccauccuagcauguuuguacaagggcgaaaagaaaaccugagggaagaaaauaugcaugcgugucauuauggauugaaccugucaaagcauuucccacaauuaccaugacagcaucauggggguggggaguuguuuuaucucuuggucuaaaaggagaaggguagaaacuguguaugagaauccuguuuaugcuaguaauaauugagauuuuuaacuuaggacauucacuucucaucauauauacugauuguaccuaguauaaaaccuucauuuccaaaaguucgacacucugguuagaaauguagaucucugcaaggaauucuuccagggagugugagacugcugcacccaggagcucuuuagggcgagguggaagaaacacuuuggaaagccacagcaauugccuucugugucugccucuuaaguccccccuuggucuucagcuuuguucuuguuguuguugcucuuugacaacuaaaccaaagaucaauggaaaaaccuucuagaaacacgucucucucccagagcacagccgggaaagguccuucucugaggaccauggaguuagacuugguguagcacauaauccagagucaucuccuccucuucagccuucuuacucucgucuguaaacgucuuuguccugcuuugcuuucuuggcuugguuuuguuugcuuguuuguuggcuaacaccaugaccaaaggcaauuuggaugaaagacucgguuuuaucuuauaccaugagauuaaguccaucacugaggaaagucagggcaggaacuaaagcggaagccauggaugaacuucacugcuugcuagugaaaucagccaggcuugcucagcaggcuuucuuacaccucccaggaccaccugcccagaagugcacuauccgcagugggcuggaccccccacagcaaucauucaucaaggaauucucccuacagacuuauagucucuuaggaucauuuuuucaaugcauaucccuucuuuccacucuuuuuuauguuaugcuuacaaaaacaaaaaacaaaaacuaaaaccuuccauuggaaguagcauaguccuaaucucugggguuaggacaggaucauguuugaauggucguuauucauucauacauauagucuauaucagugguucuccaccuuucuaauacagaggcccuuuaauacccuucuucauggaagugacugucaaccaaaaaacuauuuuuguuguuucgucauaauuguaauuuugcuacuguuauaaaucauaaucuaaauaucugaguuuucugaugcucuuaggcaaccccugugaauuggcgucauauaacccccauagagaccacaacccacaguuugagaaccauuggucuguaguuauacuucccuacucacccuccaaaaacugucaccucuauuauuguaaaucuaugauccagucaagaaucacccauuuaguuuccauuaaccugccacaauguuaccagcuccuguuuacuuucaguggauuccuugggugaggguccaggccggagggccuaguuuucuaacaguugcuuugcugaacaacucauuuaagcuucccacuguguugccgcgccugaagcccagcugugcugugugacagcguuugguuaaggugaugacuagcaggucucaccuuuggaaaguagcucuuauuuccagcgguuauuaaucauaugaauuauaugagacccuaaggcucuagguuuuccucuuuccuaacaaacauucaccaauaguuucgacagccaucaauaacuucugugugaaacaucaccaagauucuucugugaagaacauguucucuucugcccuuccuuucuuuucccauccucuuucuuucucacucacacacugcacuguaggcaugcauucuuuucaguucauuauguuauuaccaggacugucuucucauuuauguuuuuacugaaauauguacagugaaauacaucuaaucuuaguguucacuuugaugagcuuugacaaauucucucucucucucucucucucucucucucucucucacacacacacacacacacacauacacacaaccuauacuccaacgaguauguaaacucauucauuacuccaagaaagguucuuugccccuuuccacacuggaagcauccacaguucugauacuuucaccauagauuaguuuugccuaauuagauucauuucuagaauuucauauuaauagacucauagugagcacucucuuauuugucuucuguuucacuccucuuacuagcuucuuccaugucguuguuugucagaacacaguccaguuauggaguuauaugaggagaguucugaaagcuuaugagaacacucccaguaaacaagacagcuuugaccucaguuucuuaaaaacauggaauuguucuuggaaaguguuuccaugcuccucccagguagagcagauaggaguuuacuucagauuacucauuaaugcuugcuugcuugcuguuguuacucaguugugccugcuaugggggaaacauguucuugccaugugugguuuguccuugggacuguauacugcuuuaacucaugagaacuugacucaugugacuuuucuuaucccucagaguauaauugucugaggcuaugaauaaaauuggcgacugcaugucacuuuagucugccucauuuaucauucugcuucauucucucagguuucucugccucuagaguaguaacagucuuucucauuaguacuuuauauuuaugguugacuuguauucuguuguauuaguagacuagaggguuuuuucccacagacuucuauuagcaaguauuugauuguauccagucuuagucccuuaaaauuucuguuaaugaugcuauguugcucauuaauucuuauaaaaaucuuuuucucuucaugugccuuuauucuuuuggauaaucacaugggagaagaguggcuggaucaugggaucaguacauauuuaauauuauaugaaauugcccagagcccucauuacuucacuuucuugucaacaucuugccuguuuuuauuugcuguaagaguuugcauaaaacuaguauuauuuuuuuuaaugcuugauaagauucuauaaugaagccaucuguucuuuuucccuuuugagaaccuuuaguuguuauuuuggucucuucacuaugcaugcauauguguauauuuauagauccuauuauuucugaaucccuuucguaaauuaaacaucucaaggaauuuauucauuucuuugaucuaagauacuguagucaaagucuuuggacagguuuaaauauucccauguaucccucuaaugucuguaggaucuguaguaauauccccccauuuaauuucugauauuaguaguaugugcccccugacuuuuuuacucaucaguuuauuuagggcgaaagcuguccaucucuuccuagaauggcagagauacuuggcauuuuuggcuuuguaagccauguaguuucauucucaucugcuuuacucugcuguaguauggauacaaccauagugcacaacacacagauaaggagaguagcuguguuccaguaauacuuuauuuaaaugcauaggcagugggugugauugcacugugguaauuaaucaccaagcuccauuuuuaucaauucauggagcacugagguuuuguuguuguuguuuuauccauuuuuacaaagaaccuuuuuguuguuucauuaacuuuacugauuagauuuuucauucucuaacuguugcuuucaguuaacuuuggguuacguuacucuuuguauggauggcacuguaagcaccuaaggguaaaagcuggcaucacugacccuguccuucuccuccuccuccuccuccuccuccuccuccuccuccuccuccuccuucuccuccuccuuucccuccucccccuucuccuccuccuuccuuuucuggugugagcauuuacaguuuuagauuccucucuguaaguucugcuuuagcugugccccacaaauguugacauagugcauuuuccuuaucauuuguuucaaaguauuuucucuuucccugaugauuuccuucgugagcugagacuacuuagaagcaugguccauaaauuucaaauaugcagaaauagccuagauacauuuuguuauugauucauaaugugguucucuuauggucagaugauacacucugaaaugaacucaguucuuuuaauuuacuauacuugucauaauggcccugaauguccucugucugcaucacucuucaaguuauuauuguaguggguguauguauaugccucccuacuuugaugauauauucuauacuuauuaauuaagagauguuuauauggauacucacauauaguagaaaugugugugugugugugugugugugugugugugugugugugugugugugugcgcgcgcgcauuugcuugcacuuucaucuagguaaugucaccaguuggauaaacugggauggcuacuuccuucuuugccuucucucaggaaucacaguuuguguugccucuuguucaacaucugaucagccauuuaauuauuucuuccauuuguaguuguaccaugacaggggagcuaauucaauaccauuuccuauuuauggcuaaagcaaagucauuauugcuuuugcucuuuggaggagagggaugucaaaucaucugaaauaaagacaagaagaauguuguuuucuucugacaugauccuauuaaucuuuaaucaucacaaauuaucccaagccuaucucugccaauaauugccauuucuuugcugcagaguauugcuuuucauauagauagcagacucugagcacugacuaugcucauggcuauugagguagcuuugaaccugugauacaguauaggauggggcuagcaugaaggaaaauuugcuguaaauuuuuugcuaaaaaguaaaaucucuguaauagcaaaucagaauagauaucucucuaaagaagguaacccagaugauuaacaaacacacagaaagaucauuaguuaucaagaaaaugcaaauuaagacugcugcuccuacaacaccauuacuguaauuuuaaaguccagauaauagcaauuauugacaaggacauaggauuuugaacccuuaagcagucccucagaguuucaagguuauauuaucaugcaguccaguaagucuacuuuuagguauaugcaccaagacaagugaagauagaucuacacaaaauguaugcaagauaaugucauagcugcacauguagacacaagcuuauaauuccagcuacucuggaggcugaggcaggagaauccuaaagcuaguucagacccugggaaaccuauugcgcccuuggaucaacuaagaguaaacuagggcugcagaaugaaugcuugccuaacaacacacaggccugaguaaaucagcugugcuaaggcagggaggaaaggucaggacacacaucuccaauuucagcacucuggaagcaaaugcaagagaauugugaguuguaggccagccucagcuacauagcaggagucugucaaagagacagaaggagaaggggagggagagggaagagagagaaggggggcaagaaagagaaagaaaguuguguucacaaauguuuuuagcagcaucauaauaacuacuuaaagugggaaaccaaccacguaaauucacaugcugacuagaauugauauaucagguaguauauucuuauuugcaaauaugaaaauauuaaaguacugcuacauccuucaaaauggaugaauccugaaaauaugcaaaaugaaacaaaauaguaagccuggauauggguagaaauuauacaugaauguccaaaaugagaaaauccauagagauagaaacuacauucuuaguuacuuaguuacuuaguuacaaguguggauuuaauuuacagaacaucauaagucacuaugccuggugcucuaugcccaguaagcauuccgagcuaaagcacagaggaacaagugggcaucccuguccaccccugcuucacugcaccuuggugaacugacugcuggcuauuauuccuaaaugaguagaauccaacaaacccuguuauuucuuuaacugaaaaaauauaauaaaaugaauauuuauuucucagucucuaacaagaaaaugcaagaaaagagaagcuguugguguuuacccacccaugacuuaauuccaaagacuacaccaaggaccuaacauacccugucccagaucagucucuguacacuguagccucaucuagccacucaaaaguagugcgugcauguguacgugcaugcggaugugugucuguaagacagagagacagagacagagacagagacagagacagacagacccagcaaauaugcaugcggaagccauggguugaugucgagugucuucccuaauuguacugagaugauuucagaaaaacaaauuuugaaaaccugauuaaagaaccaucagugauauucuacccccaucauuuuugacaaggacaaauuagaaguuugagaaggcugaagguuuagcaguuguaaagagcagaagugugaaaaugcgaaugucauugucacaucuuauaagaaccagucaguauuuuuaggaauccaggcaggugaccuggccugcuauaacuuuuuuuuuuuuuuuuuuuuuuuuuuuuuuuuuuaagauuuauuuauugauuauuguaaguacacuguagcugucuucagacacuccagaagagggagucagaucucauuacggaugguugugagccaccaugugguugcugggauuugaacucuggaccuucggaagagcagucgggugcucuuacccacugagccaucucgccagccccugcuauaacuuucaucaguuuaaucucuuccagauaauuccucagugauuuuuaauaguuuacgguaagauguuucacuuucuuuaccuauaccacaggaccacccagucaacuugucaaagaaucuaauucucauuagaauuaauacggguaucaguauugaaucuuacauacaucaaagugcaacuugggcgggccacuucauguacuuaucucauagugaacacaguguaggaauugguccccaggguuaaugaggaucagaguagcacacagaagaugcuaauguuaaccacaguaaggauagggccuccacaccaccugauagcugaaaugccagaagggccacauguuaguagagaccauggaagcuaggguacaguaggguauagagaaccacacaaaagaggcaaccauggcuacaagggacaggacugacugcugcggggcaaaugcacugcuucuuuucuuugcuuuucaguuuuccaccaaggccucugauuucagagcuucuuacacugagcaaggguugugcuacauucuuccaauauaugucagaaccacgagaagggcacgaaugaauuacagauccuagaaauaucuacccucuguuacucauucuucaccauucuuaucuucuacccacaucuuagaaagccacgcucuuccucaguauagaguaacuacucaucauguaaagccauucucuacuauuccacccugcaggagagacucaaagucuccugaaucauugcauucaacugugggaccuuuacaugcucugauacaugcgugaggaugguuuuauuuaacgacaagcaauaaaaacaaucaugaaguagcaaauuuagcaaggauguaaggaaacgagaaaccuuguucaucuauuuaauauaacaaaauagcagauaaaguaaaagcacaaaccagcauugguugcuaccugucuuggcaugccagguugccacuguugucugucugcucccauaacaggagugagaagcacucacugcagccagccaccugccccauaucgcccuugccuguugccggugccucagcuggccagcgcucucuccugucucucucuagccuuuguuccuuaaagaccugaauuccuaaugagccuaccucugucuguguaccaugacuuuagcaugcuauuuacuaugaacaugaaauuacuaaaagcauacaugauccugcuaauccuauugcaaugaggcaacuuacuuucucccuggaaaauucggugacuccuaggcauucaaguaagcuuucuuugccauugguucagucaugugagaaguucaaaacauccaaagacaaguucuccuuccaacuaaaggcagucacuacuguaccuuccagcagaaguacuccuuccugggcaccaccaaggcugacuuagcccaaaucuggcggggaaagaacaaauuccaugaguaggauuccugaugagagaaaagacucuuccuuuaauccugaauccccagacucaucuuuccuuguuauuaagggauacaauaugguuggucuuugggucaaguauucccacacagcgauauuauaaguaguuuccugacuggcaagaacuggguucugcccaggccgucccacuauuaugacuugccaacaccuucugaauugagaguauggcuggagaagggaaggccagguaugcacuguuuucauccuuggucaacaacauuguuaaacaagaucuuguggcugugaauaagacccugaauagaccuaacagagggacugguagaaaaccuguuucaugugaaucuggcacuguccgguucaggaaggaagggucugucuaucuacacagccauuggcaugggucuuuguaccucccugcccuuacuuugacacagugguccuugcccuccaggcaacaugcuccacgaucugggggcugcuaccuccaagcugggcucagcacuaggaaaugguggggaaagaugcagggaacaagcacaagggaagagacagaaauggguaugugucaugucugacauagcucaaaucuucaaaucaaucacuuuuguaacuacuuaugauguuucuuucauaauuccauguagccugcugaaaaugcagauuuuuuuccucuuccuuucaguagauaacagaauuauuuaaguucuaaauggagacaauuuugugcauccuuugcaaaauucuuugaaaugaauucuugucagauagacuucuuuaaagauuauaauugugugguaaaauuaaguuaaacagauuuaacacucuuugcaaaauucucuuaaaugaauccuugucagaacaagguuuuuagaggguuuuuuuuuaagugugguaaaauucaagcuuaagaggcuuaacauacuucuucaguuucauagacugugugugcuuguuggccaucuggcuaugaagggggcucuucccgaagaaucaguucuuuaaacauaggacuuuaggaguuaugacuauuguuuucugucccuggcucuagcucuggcucgcucucucucucucucucucucucucucucucucucucucucucucucucucucuccauauauguguguguguguguguguguguguguguguguguguauguguauauguguguguguguguguguguguguguguguguguguguauauauacauauauacauauaauguucucucugagcagugauaaggaccuguuacuaccaaguaccuguuacaucauaauuucaacguaauuguucugucaccuguagcauucaaaaguauaucuucacuaaauaaugugcuuucaaaagaaggagaagauaaaaucuguaaaaauugagaucuagaaagaagcaugagauauuuacagaaacauugguugcaucuuuagcacacuggccacaaugcaaggccagccacaagccagccagacuccuccuaguaucauucuggugucuguaauuccuguguccuccugucucccuuccuaggguuccuagcaagccugcuuaaaugucuucucauguuugcugaagaaaguuaggaagauaaacaagaucuuaaaagaauguucaagucccuuaguugacacuuuuuggcaaauaaauauccaauauucuuuagauccauauauggcauuauucucuuucuauaauauacugugcacacaguguaauaauaguagagccaacuguauaucaccacuaaaaauaaggcacaccaaacagugucugugguauuaagaguucucuauuggauaauuucuaaugguuccauaguguugaugugguucaauuuaauaaaucaaagaguuuaaaaauaaaucugcagccaggcaucucgcuaagguuacuuuaacacauaagacucuuccacaggcucuuucacacauacacaaauccucaaaggaaugacuuugugugugaaaugguuauagcugucaaucaguuauucuccaugucauggucucuaugcgucuuccagguuguuagguggugauuauggauuccugucaaaugagaugucuacuauguauucaacaugaggcaguuuguauuuuucuaagucuauugcucuccugucugaggagguuaagcaaaugucacugaugcggagggaagagggccagcaugcagugccugggcccacagaccugcacacauggauuaggcuucugcauaaauacgcuugucuugauugucacauuccacccaggguuagaccugcaugcauaaaaauggcuccaagccuggcuuucaaagcucuuugcuuccccuguugcuuuguaaccuuccagcucggagacauacuuuguguuauaucuaucaaaggugauuaaggggcuggaaaaguugauuuauaaggacauuuuaagaaaaguagauauuugcagccuagcccaagggaagauauuauagauguuugcuguucucacaucaugaaggagccuucguuuugcuuuucccaguaacuagauuuuaaggacagccaaauucagaggaaguuuucucaggaugaccucacuuaugcuaauuagaugaucgugucagucagaaauuacauuuagcaacuacuagcaaaguagaaauagcagcagcucgaacaauaaggccuucauuuucucuucucugacacaaagcccagaaguguauugucuggggcugcagcguggcaccugugaugucacaaauaugcuugcaccaucuaucuuuaggcuccauuauucuuagcaaugacuuccucucgaagagucuccugcugucucagaagagucacuguaucucagcugcuauggcugcaugccagacaggggauagggaaaaguggucuuuguccaccaugaucacuucagagaguugucuccuacacagcucugauuuccuaucacauggcacucagaacuacaugugcaagagggauggggagauuuggugagauuguuuguuuguuuuaucauuuugacauugggcacauuuucacccacaacaauaugaagggccuguuacuaggcagaauuggaauaaggagcacuagguaggaaaccaggguuuccugucauaggaauuuaccucuauaguaacuguacugcuggaagguuccaucugcaauacuaucccugggacuucccucccacugcucacucuuauauagugcacuuaucaguacauaccuugagucauuuauaaauaacuagccuucccaauacccuaagaaaaauaauaacuaaaacuugauaguuuccagcugucuccugagaggcucugccagugccugacaaauacagacguggaugcucacagcccuccaguggauuaagcacaggguccccaauggagaagcuagagaaaggacccaaagaguugaagggguuugcagccccauaggaggaacaacaaugugaaccaaccaguacccccucccagagcucccaaggacuaaaccaccaaccaaagaaaacacauggagggacucguggcuccagcugcuuauguagcagaggauagccuugugggacaucaaugagaggagagacccuuggucuugugaagggucaaugccccaguguaggggaaugccaggacagggaagcaggaguggguggguuagugagcagggggagggggaaaggaugggggauguggaggggaaaugaggaaaggggguaacauuugaaauguaaauaaagaaaauaucuaauaaaaaacauuuuuaaaaacuuaaugguuucuguuaagcaauucaagcauuguguuauaugcuuaaauaucccuggcagggggugaagacaagaaacacauugcagugugaguugcuggugguaaaacugguggaugggcagauagagacuguguuuuuaugauuauugauaucuucccagugaaaaguuuucaaaacuaccuuaccugauccucacuuuacugcagaaaaggucggugccaucacuaccagaaguauuacauggggaauuucagcaccacaucuucagcaagcaacagacuaaggcuucaugccugguuuucucaacuuagaaaccugggcacuaauuuuuacccaagcaucacuuggaagcuaguuagagauguggcauuuggagggucagucaccuucagugccuuuccucagaccacagguagugucugucaacaugcucaaguuucccgugcacgguuuagugugcucuguugucccuuucaacacagcguacccaaaucagccacuccgcucaagagcacgcuuucugcugaaaugacguagugauguuggacaccuuuagcagcacuucacucaccacgggcuuucugucccagugcuggaucuggggcuggauuuuaaguucuguuugucucugguacuagaucuuaagugccugugaaaggggauaacaugaaauguaaagaaagaaaauagcuaauacaaaaaagaaagaauuuguuuuauuguauuucauguuacuacucacugcuuacucaaagcuuaaauuguguuuuucuguucaaauaucgccccccacaucuguucauuaagaugcuuugaguuuucaaagccuuaggacuuagaaaaggcucaaggcaccucuuucagccuccucugcuguuagcucugcuuauccacaugugugacuuaacuccgagugaucucuccucauauuagcagccucucccucuucucucuuucucucccucucuucuccucuucucccuuaaaaaaaaucaugaaauuuucaucccugcuaugucugagccagguggucucgagagucccuuccugaccuguccuuuauuacaccauguaacuuccucacccccagagcauuugggaaaccccaugaguuaaaggagccacgccuugcuuuugcaugacccuaugcuuguucuuccaagcauacauugaugcuuauauuuuauuugcuucagacucuuuuuaaccuaagugcaugaaaccugucuccauccuuuaccaagcaauaagugaggcgugguuuguuuguuuuucagggcagccuuuggcaaggagucugaaguccugauuggaaaccuuggugacaaacucauuccuccacaagacauucuccgugacguuagugaccucaaagccuuggccaacaugcacgaaagccuggaauggcuggcaggucgaacaaagucagcuuucuccaaccuuucuacaucccagaguaagugcccuggggggcggggggagcugccggaugauggcagagcugguccaagugcuuuuauuuggaauaugaguguguugccugucaucugaugaagcaugccccagacugucagagccauguuugaauuuuguucauacugugucuucucuuccuuugagauucuggggaagaacucaucucagcuucccucugugggguaggaggagccagaaaaggcuuaugucacagggcuccauauucaauccuagagacacuacacccuggaauauggaaacaccgggucucaagagcagaaagcacaaucccuuugucuuccuuccagcaacuucuccuagagccugagugcguggcugugccuccuucucuaacaagaggaaagcugauaaaaacguaucuaaaaagagaauaguagaagggcuugaaauagaaaauggaaguaauaaggaccacaaucguucagaaaaaaaaaaacaaaaaaaaaaaacaaaaaacaggagugcgagcugagaaauaccaguuacagauuuuuaagauacugagaauuaggguaugaaaugaaaaugagaauccuuuuuauaucaaggaucaaugcuucaaagaaaaauaauuagaaaacuuuaaggcacauaaacuuuaauuacuauagaauaagugcuuuuuaugaagauuuauuuuauauguguguguguuuccugcauuuguauauguuuacuauauguaugccuaguaccuguggagaccaaagaaauugcaagguccccuggaaguggaguucuagguggcuaugagccaccauguaggugcuggaaacagaacccaggcucucuggaagggcagcaagugcuaggacaucacuguggccacuaagacaugcuucuuagaaagcagcggcucaacaguaugcaugauguaaaacagagaccgaggaaaacuaggauggacaaagaagaaagcaaguuuagauguguggguggagggauugaaucagaauaaggaaaagcaaacuugggaaagagcagugaggucauccugucagggccagcagucggaggggcagcaggaggaacggccauguuuaucaugacugagcugugaguagugacguacuaucaguguccuuugagaaguuguuguuuugcgguaaucacaauugcagccuagaaguggaaaaggaauggauaaaaaucacuaaauuguuccuugaaacacaggcgcagaggcagagucugugagaucccgggaaggcucauugcuugugcccucuagugcugggcacuuuccccucuccacagcugaugcagagcagaagagggugcggacaaagagugugguuggcaauucugucaaagagucacuuacacuuuauguaaaauauuuuuaucuaacuauaaaauuacacauguuaauucucagaagucugcacaaauagaaacuguaccgguuugggguaguuugggcaugguauuacauuugagcagucugcaucaagagcugucugugaaaggcuacuccagcucuacaauuucauaaucacaguucugucucaagcagccacuggaaucaaccuuuucucuccuagacccacucuguccuuccucucucuaaaaauucagagcuaauuuucucuuuaauaacugcaaacugcucugaauagggaccaggugccgcuuuuccugguuucuuuuggcuccugugaauacagguauauuucucagugauguuuagaagggaucuguuuguuuuguggcagagcuauagcuggaucuauagcuauaaauauauacacauauauauuuauauauacauacauauuauauguguaauaucuaacauuuuauauacauuuuuuaaauuucgagugguacagcauauuggacuuauagucuguccauucucaguggguuucaugagacaaaacaauuuguaaccucuaaagcuagucacugcaugaauucagacaggcuaagcuaacuuggcauuaacuguuuucuaaaggaggaaagaugcucucugaguuacacuuaacuuuguaauugcucaauuuagcuguuguguucaugucacugagaguacccaguggagaugaugucuaauucacaucuuuaaucaucucuguuauucugacaaagauaucuucucugcacccauuacugcugugucucauguacuccguuccauuuuauaacacgaguugcaccuucucaguuccuuucagggugauuauuccacccagugagugauuuaacuaacugucaucguuuuaaaacucaguucaaaacccaagugaacuguaaucacuacuucuggugucuuugcuaaaacaaagcccaaagcaaaccugguguaucuuguuagcagucagcccgguucauccccgcuugccagcucugugacuucccagagacaugcccauugaugucugucaucugaacaaaggagauucugcuaauggccuacuuugauuguuccaugucagugugacucuccuacaguuauaaaggacagcucuuuauuuuuugucuugaaaaaagcgaaccaaaagauuacaacaucuugaguacuuccagaccaagagauagugggaagaugauaccuagcaagauggcggggguuggggggggggguugucgggauucaggcuuauuucuuguucuacacccugguaacuauuugcuaugguaaaugucagguugcauuaaacuuacaacuguaauggacuagagacagcuggcagaaagucacugucauaguaagcaucucuucacucaaggacagcagaauccucauccaccugaaacaugucauagccuccugaggagaguaucaccuacugguggcacaguaugguuggucacagugaguggcauuuccaaggguaauuuuuuuuucuauuucccgucacuccaucucuguuacauccaaaagggucuucuccccuuuucuaaaugcugacugcagaaaacauugcuuuuacuuuuguacuucuacguuccauauguaguugcuguuccaucuccugagcagacaaaccuaugaaauguggcaaacaacacauguaauaaggaguuaaugggcaggauccaucuccuauggauauauucucucccucaacccucgcuacacccgcuccccuuaaguuguagaauaaaacaguuggagaauaaaaauaacucccuaguucagagagcuagcucgcuacucugacagaggacuugagccugguuccaaacaagcagcucacaguaacuccagcuccaggggauucuaccuccuccucuggcgcgcgcgcguguguguguguguguguguguguguguguguguguguguguguguguauguauguuuguguugcaaaugaccagcuuucauucauuccuuucuuuuaaaugucuaaauagucuccuccccccucccccccccccugucucugggggagaggguguugagggagagagaaacagagauguuuucuuguccauucaucaguugauggucgaugagucugugaagguggguaugaagaugucucuuuaacuuaguaacuucauuguaucugggccugugcccaggagagugauugccaaguuaugugcuacuucugguuuuaauuucgugaagaucuuccauccugucuuucaaaacaauuuuauuaauguacaaccccaucaacaguuuacaaggcuuccuuccccuuuuccguuucuuuaacagcauuucuuauccuucaugcuuuugauaacaccuuucugaggcugaggagguaucucauugugguuuugauuugaccugugauauugaagugcuaugcuuucuuuaagaaauaucuacuuagguauauuacacacguuguuuucuguugaccuuuuacauuuccuaugcauccugucuauuaaccccuuauuaccugugcuguuugucaucucauagguugucugcuuacucuugauuguuugcuuugcagaagcauuucuucuguuuucuucugaaaguucgauauaguccuuucaguuaagucuuuagucuuauuuagacuuugcuuuggagacuggugggagauaaguauuuggugucaaccuucaguguguggcuauccauuuuccccacacugcuuguugaaaagucugucuuuucuacagugugccugccauuguuguugaaaaucagauaauuguuuaugcaugaguuuauuucucgacucuccagauggauaugaugguuuuaaaauguagacuacaaagagcugaagaagacuccagagcauguucugcuugggcuacuuucucacagggaccuguauucuaucuuggauuuuguucaaaccucuaggacuaagguucuagaacuuccucaguuauauacugcauugugugcaacacacacacacacaagcaaaguuacuacuuacuuaauauuucucuauauaaggcuauauauauguuuagucccuuauuccuguauucuauucaaaacuucaguacucaaucuuuucucuuuaaaaugcaucuaaaggauuggaaauguaauucauucaguggagcauuugccuagcaugccaacacuggccuguagucugaaaauucaggagguagagacagaagagucaacaagaucaagguagauuugaucaccauuuuauucccaugccucaacaaaauaucugugugcugggugcauggaauuacuguauauaucucauauguaguucaucugaguuguaaucacuauuaauaugucacccuuugauuuuguuacaaacauucucuaauugagaaauucugucuuguuaugcaauguaauauaucuagauacuucacugugccacacuagccacugccuguaugacuauuuaaauuaaguuacuaugucauuuccucuuucuaccacuugacuucaucguggggucauucuauugagcguggcuguggcuugucaucccacccacugaugaaugaauguuucuaacaguagcacuccauauacuccccccuugccacauacucaaaaugucuaaaugguugucuggaaacaugguaacacuccccaacagagauguauguuuggggcccugcauuuuuuaaacagcuuuuucuguugcuguuaauagaugcuaaaggggaagaaguaaaugaucauguaacucaggaaacauuauugugaaagccccaaguaugccucucuacccuaagucuacgaagguuuuuaauguauugacuaagauggaacagcaguagaguuucucagacauauuucucuugggaauccauccacucuuugcaaagaugcuuaugggccuuucucccauugaaccagcuucuugaccucacaguucagugcuauagugcugguauacuuagcggugccuguuucucccauauugccaggcaaagauguaccacuguuggagggacuuaauuucuuacuuuuuuuuuuuuuuaacaaccucagguaacuuaucuuguaaucuaauuauuucacuauucaguugguuuguuugguuugcuuugguuuuucauguuggugacagacauuauagaauggcccucauuuccucuugguuaucuuaagacccaaguugcucuacugacucuuuuguauucuucacauuuauuucacaguugucaaggguccaggcagucguacaccaugucaggccaguagauccaucaugaggcuccuaaguucaucuuuauuaagcuuaaaaaauaagguuucauguuuuuagacaucaaguuucaaagacaguacagagaaucuccauaugcccucuuuguuaauaucuuccauugagauagacuauuuaucuugacuaaugagccaauacugauguauugcugugaacuaaacucuauacuuucaguuuucuuugguuuggucuaguguacauuccuucccaggauaucacaguauacauaaccauccuguuuccuugcaucaugaagacuaaugguuuccuagacuucccuugugauuuuuaauugauuguuugauguuuaauuauuguuugaguaugucacacuuauguaguacguuuuaaucaacucccucuuaccccccccaccccauuuccuguuuuguuuuguuuuccauauguuaucuuuaaucacaucagaggccuuaaaauacauacuuuccagcucuugaugaccuugcuacauugagagaguaauacuggcuggguacuuacagaaugucuuucacugugggucuaucuguuaucuucuugaucagucugggcauauggauuuuagaaaggaguaguaccugauauaauacuauucucuucccaggaaccauucauguuaucaccauaacuuaucauugauaccauuuucaauuuaauuuccaugccuccaauucauuuaaucuuuccuagauaauuccuucaggguuccagaucaacucucuacuuucccaccacaaaguggcuuugcccacuuaaucuuucuagugaucuuuaaaauauacauauaaugaauguaccuauuaugagccaaauguuuagccaaguucaauacuuucauaacuggcuauccaguucaaauagugauguuaucgauauagauuguaacuggcagcucagaaaggcuccauaugggggaggggaggacuaaucuugugcuugcgguauuuuauugggccaucacuaccacuuagcugucaugaguauuaacagcauuuaauggacucauacagcuguauuauuucaaucaaaaccauguuggggucucuucacuaaaauagccacuuuuaaugcauugucaucugauuuuaauguguaguauugaauuaaaaaucuacuuuccaagcaaauauuuuggguagcacuucucacacuugacaguauauaagcuauaaucaguaggagagccgggccccacuccagagguaaucagugcgagggacaggguaugugugagcauugugccgcaccccaagccaguccaaugaaucuaagaacuacaguuguccauagggagcuaacaaccucagcucauauuagaauugcauuggcuuuuuaauagcaaaagucaagguugagaaccacugaccuagcgcccuuaagcauuucuuccuccauugcuauaguuccauguauauaagaaguauucuaccggagacuugcugguucuauucuuagaagaauguuguugacauuaucccacauuguaggcaggagcagcggccacugagaugagguacuugcauguguagcaagagucagcacagugacucacuuugacucaggaguuauuagccugacuguugcccaaaaugguugaaaauuauucuuuuuauacuucugaagguacuaaaugagaacaggaagguuuuucuuaacacaaaaggcucuaguugccaaaaccauuaagugaauauagaaucagguaccagccaguuauagcagugaaaacguagagagaaugaugcggguagccaaccacaccugcauguccacauggcuguguggcauaccacggcauguccauauguuacccacuauauguuacaaugcuuucuaaaguugauuugcaucuuuccauggaaaaacucacuaucuggucuuuuugugucuugaugguaaacaaaaaugagaugcaaaccuccuaguuugucugcugcggcacaaaugagaauaaaagugucccaugggauauaguuccauuucagcuuugcuuuuguuaaaccauuaagccagcauuccccuuguccuaauugcaucugauucuuuuuaauuagaacucucuguguggugauuccuuuccugcuucaguauuuacaaguuucaaauauuugugcacuguuaucagacaucccgccucagucugucugagccagcccuugugugcuuagcuucucuaaucaucuuucuguacauagguuuucuagucccgucaucacugucaggugucaguagcugucauuuccuaaaaugaacucauagcaugucuccauucuuccuuuaugggugguacaaagucauuguuuaauuucaugcccaugauguuuacuaagaaaauuaaauuaccauuggugacauuuccaucauaagugucccacccacugaccaucucugagucuguuuggggcuucucuaaucaacauugaguauauuucuguauuagccuuccuuccauuaaaauaauauccaaguucacugccauguuauaccaacuucacaacuaaucauguuuuguuuagacaaaagugccaacugauaauuuuuccuuuuuuuuuuuucucauuaauuguaugguauugguuuuuauaaacucguugacgcuuauaacaagaaaagaacaguagagaagcugcuguggucagaauguuugguccugaagacacugacuacugacauuaggaauggagauaauccuuucccugggugucauaaggaaagccaaaugccugggcugccuucugcuucucauugauaugcgcuaugacuguggauuaaugccaagcuucaggggggcccuuagagguuccccuuguacgcuuuuguuuugaacacuccuaaaugcugaugcauaagagcuacucuccuuuugagacauuccuacuaggaguggcucccaaacuaugguuacuuuugccucuccccacacugcuucuuuuaagguaaugucuagaauguguccuguucuuuguucugaacaccuaagccaguucgcugccuuuagucugcuggcguuuuguaaagcucuuugucuugugccaaguccugauuggggagcagagcuuccucccacucuguaaggaggcaguuaucaauugcagagcuagaggaggcuagugcugugggcguuccgauauaauuacgaacuucuaaguaucugcccauaaagaauuauguggcuauuucuuugaaagugccaacauuuguauccauaaggggaauauuuuauuaaaauaugauaauaucauggaugcuuaagugugguugcugggaacuuuccgcugaaugauugugucugcaaaacaaaacuauaaaauggaaacaggaagaauaaauauaaaugaaaaucucuggcaaaggugggaggcagagauuuaaagaaaauaaagaaaguucuaaaguggcaugcuaaaauuucagggccggccucaggagaggaugugaauucccuggggcugagguagcacccucagaauaguaaggagggauggcaacugucacacacagcuuaaacacuaaaucuaaagggaucaauuuggcugccaaaugguccaaauguuacagugaggaacaguaacagacaggaccugaaggcacauaguguacuguuagaucuuggcuccugucaaugacuuaggugcuuuuaaacuugagguaagcccaagaaccaaugugaauucaugacuuaaugaacucaauugagaaaacuaugccuuuuaauuuuuuuucaccuuugauacaaaguucagcuguguuaggaaauguagugagugaaaagagaugaaucuugacaaggaauucaagaagcggaggggagaaaggacuggcugcuuacaucuagaaauuuccaucauuggguaggauugaauguagaaaaauaccuuaaauuuaaacaggauauacuucagaacguuuuuguauucaucaguaguagacacagacuuuucuuagacuaccaaaggggugugugugugugugugugugugugugugugugugaauguguaugcauguagcagcccaaaagacagcauaaugacauugauggcauuccacagugagagcacacuucaugguuucaaggaccuuuauagacauuaauucuuaacugcacauuccugccucaagcuauaguugacagcuuuuacugaaggcuagccuuuauucucuuaguuuaacaaaguaugaucauggagcacaggaauuuggccauuugcccaaggucaaaaaacaaaaacaaaaaaacaaaaauugaugaguaaaucuguuuucugaguguaucaggauauccagcaaucaccugugguguggguaccucagagcccagacagacagacagagccugucccacauaaacaagcagacacauucuuaggcugaaacacaaacaggggcauucuuuaccccauaguuacagcaacaaggugaaaacuaugcugagucccugggcugcccggauugcaucuuguacacugaaaggaagugugggaggaagcaaucuuggcauuccccauccccacacacugugacuggcccugucugccccucccccacuguggcuggcccugacccccccccaccccaccccccacuguggcccccagaggaccuguuuugaaaaacucuuugucauguguucaaggaaaguuucuuuuauuaucuuaaaucuaugaauaugauuuauauuacaaauuacucugaaaaguguagaagaccucuauugucaugugaggaaaacgaauaugucaggugugagucuccaaggcaucguguugcuuauucauaguguaguucuggacacuaacaucguuauacuccgguuguugaauucugaguagauuugacugaguuuuuaccuaacaacuuaauucaauuuuuaugaaaggaauaauaaugggaacuuuucuauaaggcuuaugaaaaacccacgugcuucacagaaacccagacuaucugaucugauccuugagaaaagcaaaaaccugcaaaugucagaaagaugcuacacgccagaaagccccuuuggacaaacucaucuaaagcaggugcuauuuguaggugacuuuucuggcaagucugucaaaagcuucuucugcagauaaaaauucaauaaccuuucacuguggaugugccacaauuaucacucauuuaaaaacagucccucuaauagagcauuuuaucacuccggacagucucugcauuguucauuauuuaguguuugcuaagcugauggcucuuccgcugcacuuuccuuaucucugcuucuucagaauuggauuuuauauuucuaaaccagccagauaugacaagucauuuucuuuccucuugucuuuaaaaaaaaaaagaagaagaaaaaaaaaaacgcaaacuugauuucuuuuuuuccaacaaucaccacuuagagauuaaaguuauuggaaguguguguauuacccagcguugggacgcagugaaggacuguggcauuuuaauugcaguugggguuuccccucuucucuuuaucguuuauuuuccagcaugugcguagucugugcuucucuggacuccacgucccucccuugcugcccaaacgcacagugugugguagguaaagacaaggguauugcagugugaugugcauagcagacaaggcaaaggagguacuaucagaauuucuauauuauagagccucagcgcgguggggauaagcaggguaaguagaucucucuguaaacacagacggucuccaaaugagaaaguuccugaaaggaagaugauaaagucauuagccugacaccugggaggagaugccagcucaaacaccaucuccucuaugugaggcucucauuacugagaacguuaacuguccucauucugagaaguuauaccaccuaugguucuaaaaggguugcuuuuaaagcaagcauagacuucaccugacucugagccagaccuagaacacauacuuuuuuagguguuucagacuuuuguccugugcucuuucuaacuggaggccaaaucccuuguuuuuuuagugagaaccugcuagaacagugaagcagaacaaagcggccacaucuuccuccagcgguagcugucuccugggccugcuaaggacacaugcauuacaagauguguuuagagaaacaacagaauugaauuugauggcaggaauaucuguacagugaaaucaucucaaaaaugagaaaaagaaaauccacauuuuaauuucaaguuuuauacauuuugugaacaaaauaaaaaugaccuuguagucuccccugauauucugauaauaagaacuuuuggggggcuggcuuuaugagaaaaauauuugcucaguuuucagaggcaggaggaugcuuagggauuccuucaagucuaucucuggaaggcagugcaucuaaaacucaaccauugugugucauuugguuaaaggcaccacaagcccaauuaacgcauuaacucaguccaacagccuuuuauuuucacggaaaucuugaaagugugguggagaaacacccccacaagaguucugcauaugucacugcgccagccucucuggaaagcagagcauaggucacccacagacagauggcugccacaagugucacuauuggccagaaccaccuccucucauuugcacaaaauuuucuucagcaccaugcugauuuucucuccacugacccagccuuacccguggaacuuggaagccgacucaacaccuaauuuuguacccccuugccugacuugcacuucagucccagcauagcccaagagaugaccugggcaaaguacuuaacauugcuaacaugucauuuauauuuuaaagcccgguaggauugcucaggggaucaagucagcuaauguaugcacaccaccuguuccagugagcgcugaugucuguguucuccugccuccugugaagcccuuuccuucugagaucauuuuccuugccacucucaccgcacugcagugugugcccacuucucuugaugagaagugccccagucuggguccuguuucugugucucuuauucuccccauugauggcccaggcagucugcuugcuaacuugacuucacugucaagggaaucuuugauguuuugcaucugaaauuagauuuuugagcucuuaauuuucacagcuuuccaaauuccauguggccugggaacucaggcacauggaagguuguauuuauccguaacgauaauaaucggggucugaugugaagccccgaguucuugugaguaacuucucuguaaacuaacuucagucuaucaggccagaugggccugaagacgcugugcuguuauaacaagaaaacaauaguucaucuauuuccugagcccuuaacaucgaggguucuaccugcacugcuuacauaaucacuguccuuaaaacaugcccauacuucaacugggccuggcucucaagaguggcaggugauagacagagcucccugcugaccccugcucugcugcccgugggguccuaaaacacuugaauuguugcaagaguucagacucugcuccucuuuuaggaucauugccuaggaaaggcacuuucucuccuucguuacuguuucagccauuguaaugggcaguuggagggcuuuaaguacauucccgaauugugcacauuguuguacaaacaucaccaccaucuagcugcagaacuuuccucuccuuugaagauggaaagccuggguaucuauuaaauuauuucuuuuuuuuuccccugccccaagcaaugagcauucugcuuucuaucucuagaaaugucgcuauuuugcuacucucuacagguggaauuauauagaaguuuauuuuugcggccgguuuauuuuauuuuucaucugucccuuucaaauuaauagucauuucuuaugucuaauuauaaugaaaaauaaaacaaaaccuucugaauaaugccuuauuuuuuuaauccuaagaaauucaauacuuacaauuaaacuuuaaacuuccuggucuacuaucagucuggacuguauacccccuaagaauaugugaagcaacacauuggacuauauaugcuuuuuaaaacuaaacaauuacauuauugguuuuaguauuagaaauggcauagggucuucauucgggcaauauauaaaguccuauuaguaaagugucuugagaggaaaaaaaaaauuuaagguuuccacagagguaggcugacauccuuugccuauuguuguuguuguuuuccuuuucagcauuuuagaaaacuaucuacugaacuagauuucccaauuuucuauucgauauuuuguugucugguuaauuggcugguugauugguuggcuggcuggcugaaaguauaauacaauuauauuauuuuccccuucucuuccucccuccaaaccuuccuguauaagcaccccuacauacucuccuucaaguucauggccucuuuuccacuaauuguuguuguauauauacaugcauuauuauauacauauaucuuucuauguguaaccuacuaaacucauagacuaugacucguauguguuuucagagcuggccguuuggcccugagcaaccauuugguguggaagaccaccucccugcuucccaugcuucucaguugccuuuaguucuuagugcagaguuggggccuugugggcuuuucuguauccacucuggcagguucauuggugucaucuuuguucaucucaauguuugggugcucagucugugggacauuuuauagcuucugagauuacuaggagacaccgucucacugcagacucccugaucuggcucuuucugugcccucuuucacgguguuuccuuaggaguguuggcagauguuagagcucuaguuuucacuaaacucacuuucacaagaaaauuauuuaaagggaaaccauugguuaaaaauccaagcaagaaaaaaaaacaaaaaaacaaaaaacaaaaaaaagcaaaacaugagaaaaugucaacccugaccccuaguaaguaucuuugugaguuuguugugugucugaccuaaaauggcagccaaaucaaauaucuaaaauuuggccaagaacuuaaaugagucaaagaaguuacuugaaauauggauuuuuaucuaaaauccucaauuugaaucuugcuuguccuaacuuuuuuaugccuugagcuauugucuagugugauuuaaagcucaugauuggaaagacauuuuuuaacuucauuugucccaucuuuaacuugucuaagacugauuucuuuuuagguuauauuaaugguuauauuuauaacauuauaaauaugcauaaauuauaaaugacuaaauauauacauacuaguaauuugaauuccagaaucacuucuauuaggauauauagugaaaggcccucagcuaugaaggacucuaggaacagcacuaccauagucuuggcuauccuggagcucacuaacuaggucaggcuggccuuacacucagagauccuccugccucagccuccugaaugcuggaauuaaagcuguuaaaggugugcuucaucacgcccaacacugcguuugcuucugauggccuuauuguuugggaguuuuaucacauuggcucugugaauugucucagaaaauauagcauaauuagaagauaacuugcagugaguggaagaggauagaaggccaugagguaggaaaagauguuuccacaggaaagcagaggguagcgagcauccguccugcauggaagcucucuguccacuuuagucauuggagagugaagcauagcauagccaaaaacaugcaaaaaaaugacacuggagugugugggaauucgaauuuucuguuguuuaucuguaaguaaauauuuaccagaguucaguaugcugccuggccacucuaucuccaaagcuccucagagaacuagguucagcuaggggcuaccucacucaggaaagcagaccccuccucuccuguggccuuucaucuuuggcugcugcaaaguaggaaacacucagggaaacuccacaaaggcaaagggagaagcuuagauaccaaagcccauguuauagaauuuguccaaccugucuucaaccauaucuugucagucaaugucagccaucagccacuggagaauuaagguacaggaaaagacuguuuccucgaaggaaaacugagaauugggucuaugcguguuuuacuccacuaauauauaaugaggaaagcuauguuucuuauuuauaguuagucagucugacucacaaagaauguuuucugcccacuuccuuauuuaaaagaaaaacuccauuuuugaacugauaauacaaguacacuugguuuuuuucuccuaggguaaagacuauagagaguaaaacacauaauuaaaauuauucuucuuuuuaguauuucucuguggucugcucaauggucuucauauacuugaccacuaaguguuuuaaacauuccacuauuucccuaaagccaaaguuuuucaugcauccuuccacuagauguuaaugugaggcaugucuuaguguaaggauuguucauaggguuuucuuuuauuccaguuagcccucuuuuaaauaauuuuccuuuaaaaggcaggauaauuucauguaccguuaaacaucugagugacccugagcagauugaggcagaugggcugaauacuaacaggccaauaacacuauucauauuaaacauuuucaaauaaauauguauuaacuuaaacaccuacaauaacuuucaaguccuuaauuuuagauaacuauauucuuuagucuuuaauuaauuccugguagaaaaacauaaacuaaauuaccauuuuucuuauaugggucccaagaguucaagauauuccggauuugagauuaggaagucaagauuccuaaauguuaaugagcugguuuuuguguccucuacguggaugauggauuaguccgugguucccuguauaugcuaacccucuacuaaggcgucacacacaucauggaacagcagaagucuuaucggcuggcuucagcaggacugcucccaacaccuaaaggguugagaagcgcaucuacuccauguagauggaaagccuuggcaacaugaauagugaaagguagauacuuagcuaggauuaacuaagggccaauuacauauugcaauccacucguuuuucugcuuucugaguagaaguagacaugugagcuuugcuaaaaaggccacuguugccagauuguugcggcuacuguuccuuuuucucaccagcacuucacacccacuuaaaucgaaagccaauggcaucaggcagcagucagggccaaccucaguaugcugcgugugacuuaccagcauugauguugaucucgauguuaacaaagucagugugcauguugacaaccgcagcaaacagcucaugaugcaaaggaaagauagaaguagucugcauaugucucuuagcuggaacucagugcugccagggagggccugcugugcauucccuugcuucuguuuacagaguuuucccaaaugaaccuuuuccugguuuucccaaacucuacaauuacuuuguucuuuucccauacuaagacuaacaguaacaauuauagcauaggaagauccuucucuaggaauccauuuaucucuguggagaguuucucuucacauaggcaaucauaaaugguaugauuaccuuuaaauucccaccaugcuucagucauuuaacuuuaucauuugaugcaguauauuugacuauauuucuuguuuuucuuuggggauuuuauuuauugacaauguuaccuccugccuuccacuuagguuucucuuuccuuauacaguuuuuucuucagcaccaacuuuggcacaaaugugcacucaaugaacauuacaucuguaauaguccagaaacucuuuagaaaugaaaaauccaggcuauuggcauagcucauuacauugaaagaagaaauaaagaggaggcuaaaagcaagaagacuuguuugagcaagucuuuaagagauaccucagauuuucccccauuucaccuaguuguaccauuauuuguauauaauagcaggagguacaguagggugauucaguuaguaaaaugcuaugcaaacaugagggucugaguucaauucucaguacccagguaaaaaccagacauggugguacaagccugugauccuagugcugucuaggcagaaacagaaggaucccuuaggcuugcuggcuggccaguguuugcagugagugagcuccagguucaaugagugacacuggcucaaagcaugucagacccgugcaugucugcucucuagaggagaaagugaguccaucuacacuguugcugaagaugauuacguccuucacuggcaucaggacccaccuucuucagccuuccaacaugggccuaaaugcuaguggcucuucaggagcccccagcccuccagcaccacauuaggacugcugacgcauccaacaucgugaucugagcagcugccauguucucugcaucuucagcauuuagauagccaucguugcacuaagcaguacauauuguguaagccagguuaaauaaauccucuuuccuacaacaugcccacaugugccucuacacacacccucaagauuuagucucuaaaccugauaaagccgaaaacucauuggcuaaaguauaauaagucauagcuaaauuaggcaaaguuuauacugaugacuguucccuuuuguucccuguggccuagcaucagaguauauaaccucaggaaagagacuaagagaaucucaacaucucccaaaaggggcagagcagccaaagacacuaauguuagaaguuguccagugaaggaggccugccacaagaacauggaaagaggccuugagggaggagggaaagauggaacagaaugcaugugacauggggaggagcuucagcaaguggaggagggagaccagcaggagugggcagaaggaugaggcccuacaaaaacaaaaacauguaugaaagugucaucugagccguuacuuugugcacuaauuuuuaaaacuauuuuuacauuuauugauugauuuuuuuuuugucugcaugugcacauguauacauguaucauggcacauauguggagguccuucuaccacgugaguucugaaacuugaccuaggucauuaugguuuaguggcaaguacccuugcccacugaaaaaucucaccaccccugaaaaggucauuuuaacaauaaaaagaggccugccaagucaucaacgaggaugacuguaguccaccagcucuaucucccuagacauagaacuuuacuuagccccucuaagaagugggcacacaaccagggacaguagcuauuuaugaagacuguguaauauaaagcaaggaguccaaaacaagcagaaauaguccccuagaggaaacagggauucuccagaaagugaggugaggagcuuggaaaaguuuaguuaccuguaaguaaaauaucacaucugugagacaagaucaguauccaguaugauagcaagacacccagaacauaagaaaccuuagaaguagcuuugaugaaagugaaauuaaaaucuuagaaagauuagaaaaaaguaaaacuuaauaaaacaucuaagaaaauagaacaggaaaaaaaaggagacaaaggaccgugaagaacagcacagucuuugacaaggaccacaaagaggaggaagagggauggaagggagggagggagggagggagggagggagggagggagggagggagggagggagggagggaggcaggcaggcaggcaggcaggcagggaggcagggaggcagggaggcaggaaggcaggcaggcaggcaggcaggcaggaaggcaggaaggcaggcaggccauucaaaaauguauggagacuuccaaagacagaaaauacaaaauucacauuaaacuacuaaauagauaaaaacaaaccuacguucucaccaacauguuuaucacaagguugcagaauccucaaauaaagagaaaguacuacgcugucaaaagagaacucuuucuuaaaagagagaggauaaaauuagcacagaaagucagaggauagaagaaaaauaccuuuagggaacauaagaaaauuuauuuucaauaugggauuuuauauccaaucauaccaguucagcaugugagaagauaacagauaacuucauguagaaucgcagaaaacugguacaccauguaaacccaagguugggcuauaggaaagagagagucuagaauccucacagagagagcuccucagaaugacaggugaggcuaaaucccacuagcccaggaagagccuagcauaucucuggaguguuugccugaaucccauguguggaugcauugaaaggagaauuguucuaucuggaaagaacccaagguuggauaucugcccccuccccccaccucaguacaccaaacaguaaggaacaauugccucaucauagaugccuguacccaaauacccaaaagcuaggaaucuaggaggcagagaggaauuggcguuacucacgagcucaccuuaaaacagggagauuaucccaguccaugcacaugaacccagcgucgucacaaguagagagagaugagaguagggucgugggcuacacugugagagagguugcacugcuggcuuugaagaugaagggagaggccauagggugugugauggggcaaggcagugauguguauuugcucuagggccucuggcaccugcucaagagugccucagaucuccagugcagcauagagaugagacccuaagagcauaaacacuugucacaggagcagguggaagcacagcagugagcauucucaccuccauuuuuccagaaaccaaaaguaaaguucaaagauaaaacaacuuuccuaagagauaagauaguaggugcuagagccagagcuggaaccuagggcagccugcucccagccuaggguuuggacuacauugugacuggcauuuccugaacagcagcaagugggagacaggcugugucaucuugucucagccuuuccagcagccugcacgggaugggaugggugcccucauuucucauggaggaaauggaggccaagaguggugcgggcaggaucuaaacagcagguaagcccagugcccuguacucuuccucucaucucacuguauguccugaagacacccugcuagguggugccacagccaagaguagaaccagagguuuccugaguaucucuggcuguguguguucuucaaacuguggaaauauacagcaaggaaccaauaaauggccacucuaaaugcauagccauauauuuacccuguccucgguagugcagcucuguuuccugagaaauguuacagguaccuaaagcucuccuucuugucaaaacaaacuuugcagcccaugacuguuaguugggcucaguagcaaacuucaccauagauggguuaaauucauucagagaggacugcagucccaaucuggcacuagucauagcagacaggugcugcugugacccucuguucccguuagccaucaagugguaucuguggagaccccaaccugaacacuugaaaaaccaugcucuuauuuucugacacccuugaucucacacaaacaguuuguaaccaacaagucagacauuuacaucugagcaaaagugagugucaccacacaagcuuacaccacaucuauauaaugcucuugaggcuucugaaaacaugaaccaagccauuuaugcuucauagaaacagauuauaucauuugaaauccucaauaaaaaugcacucucauauucuacagaugggugucauuuaauuauaauauguauuuaaaauucaaagggcuacauuaauucuguacuguggcugagauuuuaauugcacucaaguuaggaaauucugaguuaauguuccccuggcaucucccauucagccucuuagaacagaugcauugugcuaugaagaggauuucaauauguuuucacacgcugugcuucagggaugccuuugcagcacagggguggcagguacugccacggcagggggccgaucccacagagugugcacagcagggugggggcauggcugccuugcaaagcucuuccaguugacaagauggccguggccaacccuucacugcaucuguggcuccucuuacuccccaagggcagggaagucauuguggagcucuuccuuuugugagggguuagcggagagcaacuacacguaaaguguucaaaacuugaaacucuugaggaguuaaggaaaaaaaggaugagugcuaguauauuccacagcacauucugaaugucuaagaaaggcuaaucaaccuacagcaaaaccaucagcuucacuuaagagcuguuguaauauagugaaggaaaaaccauaugugugugucacaagggaaagcagaauuuugaacucuuaggaacugaacuucucuauaaacuggcgagaguccaagggcaaaagaaaugucgucaccgggauguuuuugacaagcaaggccagcagugaaggcaaagugacagcgugguagaugugaggaccagcacccaugggaugagcacagugugggaagaacaauccucuacuuaaauguaugaugucaugaugucaggggaaaaaagacagaucugagaguucccguggauggacgggugaagauaaaaucgacacuaacacaaaauacaccgccccuuccuuuuuucuuggcuuugucauucugccugcucugugcccagaauugugcacagcauggacgauucauggagaugcuacaguguaaggacucaugggagcacagaaacagaguccugucuaugucagggucuaccgccuagcugagcaguuaucuacauaugugugaguuaaaucagugcagagguuuuugguuuguuuguuuuuuucuuuauuuuuaguagcuagcuuaggaaauacugacuauucuagagagaagaauaaaaggaguaguucacauggaaggaaugaauauuaaggguguuaaguauagaaacaggaacuugucuuauauauuuuaugagaauguuuuuauuauguauguaugccccugugaaaucuuuuuaauuaaaaucugcaaggcuaauaagauguaauauaugagaaagaacuugaaguucuuaagaaaauagguacauauaaaucuuuggggaagaaaaugaaucgcaagcccucuuuaaaaagucagcaaaagaaccagucagaacugaggccagcagccucccugucuuuaugguaaacuuacaacuaccuuuuuuuucuuuuucuuuuucuuuuuuuuuuuuuuuuaagccagauaaaguugaagaaccuaccacauuuuuccuccugguuuuuaaguuuagcuucuucugucugugcuucuaugguuuaagaucaucagugguuuaguaaacugucacaucagaagagucugguuuccuaaccaucuucccugcagaccuugaaaugauuaacagaugacuucuucaucauaaggcaugacuuccggauaaagggcccaauggaagcuggcuaaaguuugaaaagagcauugaaacauaacugcacaguucuaagauacaggaagagugcuagaccccagaaacugaaacacugucaugucauagacgugggcuuauccaucuaauucucaggguagagaaggcauggaggcucucagcagauggagacacccccuccccauggcagguaauauguaaguuuagucaggaagagacugccuuuccuuuauuguuacggggaaacaacaaauaggccuucagagguguucgauugguuugguuuugaugguuugcuuuuguaagaaagggucuggcugcguagccuuggcugccugagaacccuuuuguagauggagcuggcuuucaaaguaugggauucuccucccucuucucagaguguggggaaugcaggcuuuacugccacacccaguugacuuguuagggcuuuuagggguuaaggauggauuuuccuggggguguuucauuugguuuggugguggugguggugguggugguggugguggugguggugguggugauggugauggugguuauucaauguuucucuggguagccuaggcuguccugaacccacucugggccuagaacucaagaaaucuaccuuccccugccucccaaguucuggaauuaaaggcgagugccaccacuacuuggaaaggguggauuuuccuauuuccauuuuaccuaggaccuuuggauggauggauggauggauggauggauggauggauggauggauggauggauuccuaugaaggauuuuuuucuuuucuuuucauaaaauagacuagacagauaguuuauaagaaaacaguagauuuuccuaaagcaagauguuugcagagacuaacagaaaaugacccucuuuuaaaggaaugauugccuccuuaaaagugcuaauuuccaagugaaauguaugccugcuagcagagucagugaagaguagccugggcagcuggaagaagacaauucauuaccaguuaguguacacgcuccaugaaggacauuaauucacaaaaugaaaaacuaaucgaguguuuagcuggcccuuuaucacugguggcggucuguacuagcuccaugcuugguguuuaccgagcugaugggacugugcgcaggccugcuuaucacaucucaucucaaaugaguuuugcaucacuuucugagcuucacugggcauuccuucuuccuuccucaaaaccaacaaugaggggugccaaggaagccaugaaguaacaggcccauuucuaacuuucuccucuuucuccuugacuuccugguacauccuagccaaaccuuccuagcccugcacauuugcacguuauaguagucauacacaggcugauuccuagagcugcugcgcuaauuuaaaacuaguucuuuuaauuccauauuacagaugauaaaccugaaagcaggaaaggugccugugaucugauggccacagugcuggaaaugagagcuugucuagcgugguguucucccuucucuggcucugugcuuuccagggaagcucugugcacucuucacuguagacauuuggucuaucaacuguguuuaugauuucuauuuuugaggugauaucguuguuucccagagauaaguacauuuggaaauguaaugugcuagucuguauuuuagagagaugcugccuacacuuuuauacuuaaauaggcaccucuuagauaaacacuaaaaaugcaaaaacuugaagauguucccuguauaguugggguuuuuuuguaacucugugguguacgguguuacuuggagggaggaauuuggcuuuccuccuuuggcuguuccugccuccucuguugugcucuucuggcugugccagcuguuuccaugucuagcucuccaguaggcaucacagcugagcaaagagauggacauguagucagucagcuugacaaucacaagggucacaugcauagacaaggacucauaaauuguguguucccugaaacucacccaggagaaguggcgaggcacuaucuuauggaaccaucagggaagagaagucuuuuuguagaaauguauguguuagugaauuauagcagcaauacuacccaugugcuaggauguagacccagucuuugcucauauggcuaguaagucauggaaagacaacaggaauguaguuguauuauguuugccaaauacgaagugagcucaccauguugauggagauauaugaaguauggcucuuuaggggaauguacaugucaggcaagccuuucugaaaaagauggccucugauuuacaccuugacauauaaauagcaauuagccauauuaagagguaauagaaaguuauauuaaaaugcagaaaucaaguaaaauuaagagaaggcuaugaagaaagcguguucagaguauuccauguauucacauaggggacuuacaaacaaugaagcuaaagaggugagcaaaggucagggucaggcuccugggagacuuaagacauaaggaaagauaagacugcuacacaaugaacauaugaaucauauaaugagcagaugaaucauauaaacaaagagccagaacugaugcaucaguggagaaaauagugaaaacugucucugcuuugugcuacuaaaacaaaacaauuagccuuucguuuccuuguauaucaaaccaucucagaucaaacacauucaagaaaaaaaacagagggacagggagaugggugggguuuuggcucaugaugugaaauucucuaagaaucaaugaaaaaauuuaaaaacacagcugcacugaacauguauagacaguuuucauugccauuauuuccuuaaaaguaaggcauaguaacuauuugcagagcacuuacauugcaucaagaguuguagauaauguagaaaugauaugaacuguauggaaggaugcgccccgcacagaagggagaagaagaaggaugagagggaugagaagaugcuaaguaaauuuuagaagacacgggcuugaaagcagaaucauuuuggaauuuuggcuuucuucagauuuuuuucagcuauugcaauauuugcauauauaguacccagacaaugacgcccaaaucgacacacagauuuuauuauuuucuguacggcauauacacauagcuugaagguaauguuuuacaguacuuacagggcacccugaguuguuacuguagcuaccuuaggaaagguauagaacugucuagcaauucagauuucaaacauucaaguuaagaaugaucaaauggcaauagcaaauacauuaugauagaaaguuauaacagaaucuucccccaauuaauuuaaauauuaauauaacaagaagccugugauuggacagggagaggggaggcggagcuaagaguuucagagacagagacagggagaggacaaggaggagggggaagaaaggagggagaggaagaagauccagauuccugguggcuuuaaauagccccagguagcuaugaauaucauaaaaggauagaguaauugggauaacuugucuaaucuaggugggcagcuuguauuauuaucaauugacucugaaauuauugugugggcaucuugugauuugagaauuuauugauauauaaaucugacugauuacuuauuagcuucuacaguuuugauuuacuggauuaagggaauuugugaccacuagcugcaggggguagauggcugagaaggaagaaguggcucugaggcaggcgaaccagaucugggaagaccacugcgagggccuggccuagagguggcgagaccaccagggcagagaguagcugaguauagcaugggauggccauacuuuuuuuaaaaauauuuccagcaacagaaaggguucuaauauauccaucugugcacaugggcauacccuguauguguuaucuccauaagaacucauugcccagauucugaauuaucauuguuuuuaaguacagaggacuguggcgcugaggagugagaucauuuagcuggggcacacagccauugaaauauugagagcuacuagcagaauucgguccuauuucuuauuccucgcaguccauauguuaaauaacacaccauguagguaucaccuaggaaaaagcucucaugggaacaaauagaaaaguuugauuaaagccugagagaaaaagauguguucccauagaugagugcagagcaugcacacacagugugaaccagaggugcagugccagggaagcaaaagcucagaauaaccaacagccaucuugucugcugaggacaggaagcugcaguguguggcugccuuccgacauggagcaggagacagagaggccacagcacgugguacuaauagacagaauaccacuuuucuuuuguucugucuucuguagaaaaggagaaacauuucugagggauguauucaaugucaccuaacuucuuuaaaagugaccucaaauggauuuaagaguauuaaggaaauuugguaaaguugaaaauuguagacuuuguaaaagauaucacaguacuaggucauagcagauauucuuguucucagcacaaugacauaaagauucugaaaacuaugaacucccuugaguacaguuagaucaugacccguacacucaguaugauugcuaaaugcagaggagcuggugaugguaaacggagccagcaugcuucagagagagagagcagugucacagcugcccacaacaccgaagacccagguggaacuaaccagggacuuacaaggacuaaggaacaggagcuggauccaggccuauaguuuuggagcauuucaaauuuuucagaaggcugucaagucaguaaaaucuaaacaaauguucaaggauccuuaaaaaucugaaauaaaaaaacauuucugguuccaagugucuuggaagggaaccucaccuagaauucauuguuuaaaggugaguuuucugaugaguaaacacagcuaagcuugucugccucuguaagugauucauccuuaaugccaaguguuuaacccaguagguauguaagguugguuuauaagccauggaccagaaguugcagcaucccuuguguccucaaggacaagcaauuugacuggaagaugcauucaauguuguauggaaaccuuuacagauccauuacaagcagcuccaugaagguaucccugaaguauguuuaguucaggucugcaucuuuggggacuggcauagaguacucauacacauguguaggguacugugagacacuguaacaggcaucugcgagcacauagguccagcuagggcaguguguuccaccuccuuuauuucuauuuggugcuucucuuuggccucuuccaggucuucauaaaacacaaaauagaccguagugaaccauugucacuucccugugacaugagcacuugaugccacaguccagccucccucuagcccuucagcccccuucccaccucugauaacuacuauuugacguucacauugaccuuuuuaguuuccaugugugagagaaaaccuuucugugucuggcuuauuucucuuaacauaacauccuucaguuccauuugcuuugccucagaggauaggacaucuugucuuauaacugaauaaacccugaguggguagagaaugggagagucagagauaugucuucaucaguccagcuaguauaaugcuuccucagaaaucuaaaaacuauauagcucauuuauuugaugcagcaccucacuucugggcacacauccagaagcaaggaaaucagcauauuaaagcugcaccuguccauguccgugcugaugucaguauucacaguccccauaugguaucaaccuagcugucugucaaagcuacaucuucaacugguguauauuugggaauaguagagaaacuuugggcacagucuucuauaaaaccagaaaacagaaguuuacuguucuguagagaaggcugaaucucuuuuccaaagaaaugcuacaaaguauuauugauaauaagaacaacucauaauuugugaguauuaaauagauaccaaaaagguaagguucauguaagugaaacaauguacaaaaggaagaugguguaaauaaaacagugaaggaaaagaagaaaacagaucccuuauauccaaccaauauuuauguucugccucuccccaucagccugugacacuugugccuaacuuaaauagaggucuuucgcccucacuuuggcuaacaacacagaaagugcaguagaaaccugcuugcuugugaccagaguugucuuuuucaagguccauggcuuagaaauacuuuuuuguuuucauauaucccaagcuggccuuaaacuuaccauguagcuaaagauaaccuuaacuuuugaucuucccacuccagugucccaagugcuggaauuauagguauaugccaccaugccuuccuuauguaguacugcacacaaaacccaugacuuugugugugcucaacaaguacuugacuaucauugccaagccagaaguucuuagugacccuucaucccacucuuuccuguuccaaauuuugccauucacaaauaucucacaaguagguuaucuucauucaucagggcacagugaaaaacacagaaagcaguuuagcuauuucaagccagaaaaaaauuagauguuuuaaaaagugcugagagagcuuagaaaacaguuggaaggaagcaaaaagccaggaaaggcgaugucaucuuucaggaaaucaggaaaugcaacccagggauccuccuaccuagguggaggaagcagcuguguacagugggagcugcugcaggcugcuucucugccagcugccaaagcaccuccugauagcccugcaaggagagagccaagcuuuccuuuucuuuaugccuuacgcaucuuuggguagcaguuucaguggcagaacccaaaucccaaacccuacuggcaagagguugaaaaacgacccuaugcuuccacagaagcagcuggggaacauuccagguugucagcagacaaauaugcaaggggauucccccacuucacucccagucuaggguaauguggugggaggcaugcuuccaacaaaacaaauacaaucauagcuggacuuggagcugaagauaacucaguccuuagaguacuugucacacaagcauggggaccugauuuuagguuccccagcacccacaugaaaacaaauaaugcuggacacgugugugaucaagagagagguacaucagagacaaguggaucucuggagcucucuggccaaccuggcuagccaaauggugagugucagguucagugagagacugucaaaaguuaacggggaaagugaucaaaagagacauuugacauugacuuuugaccuccaggugcaugcacacgcgcaugugugcacacacauauacacagagaacaagacuccugugacugaguauaugucuuagucaggguuuccauuccugcacaagcaucaugaccaagaagcaaguuggggaggaaaggguuuauucagcuuacacuuccacguugcuguucaucaccaaggaaguucaggacuggaacucaagcaggucaggaagcaggagcugaugcagaggccauggagggauguucuuuacuggcuugccuccccuggcuugcucagccugcucucuuauagaaucaagauuaccagcccagagauggucccagccacaaggggccuuccccccuggaucacuaauugagaaaaugccuuacaguuggaucucauggaggcacuuccucaccugaagcuccuuuuucugugauaacuccagcugugucaaguugacacacaaaaccagccaguacaguauauaaaaagccucuccacguuagcuucauuuagcucuuucuaaaccuuaaaagaauacaugacuuaucguugccuucauaugcauauuagauaacuuagaacccaauuucucucucuuugguuggaaacuaacacaauuucugccauuucaggguuaaaauugaccagaugucaguaauggcuauucagauucacauguggugcccccuguaccacaggguccguccaugcuuugccccaucuccucauugucauucuaacagaagagaaguaaccauggucacgaaauaaauaccgguucauaauauaacuauccacgugaccuccugcuggcuccugaugaguaagguagacauucugucuuuuauguagggaacuuuccucgggaaaaguuuccucugccuccuccuaggaugccaucaagugccauuccuugccugcccucaacccaugagcccuauacuuacugcgaaucccuucucuacugcugacuuggcagcuccagggacauuacccucccuucuuauagauggaaagacgacucagcucugccccugguaguccccuucucccucugugucuuuguugacuugaacacaucuagaauucuauacuguucuuauaguuuuguaauuaacuucaaaaugucgugauuuuauccaguaccaaugccuuaagauaucucuguaucacuuuuaucugaccaucacccuuaugaacaacuaaaccccaacccucagaggcuuuaauagagaugaaucuaggaauuucugucucuugggauaccucgaaggaggcuuaacagcaauaacuuacauuuucugagcauuuacuaaugcacuuuucauuguuuuaagugcuucuguguuuuuaaaaaagauuuauuuuauauuuuauacaugugaguacacugucgcugucuucaaacauaccagaagagggcaucagauuucauuacagaugguuguaagccaccaugugguugcugggaauugaacucaggaccucugguagaguagucagugugcuuaaccacugagccaucucuccagcccacuucuguguuuuuaaaucucacugaaucuuuauaaagacugaaaaaaaccauuaccggcauucacagccuuaacuauuuuguccaagaucauugcuugaaugcagaauuuaaccagugcuuucugagugacuccagaaaauacugcccccaaaaaaguuuguuuauagcugaauauaagaacauucacacauacaaaguguaguggcgcaggccuuuaaucccagcacucaggaggcagaaucacgagugucuuuguggauucaagaucugccuggccaagauagugagcucuagacagcuagggcugcuacauagagacaaccugucugaagaaagagaggggggaggagaggcagaaagggaggaagguagacaggaagggaggaggaggaagaggaagcagaaacaaagaaaaaaaaccacucauauuguuugacaaaauuacuuagauuugagagaauaucuuuuuuuuuuaauacuuacuucuuuuugccaaacaguggugguacacacguuugaucccagcacuugggaagcagaggcaguuaagucucugaguucaaggucagucuggucuacagagugaguuccaggauaacuuguacuacacagagaagccaugucucaaaacacagaaauacaacaaaacaacaaacaaacaaaaagauuuauuaguuuuauuuuauauguuuguuuugccuguguguauauuucugcacuacuuguaugccuagugccaguggaggccaguggagggcaucauauuuccuagaacuggaguugagcaugguugugagcaaccauaucgaugcuggacaucaaaccuggguccuccuggagaacaaucacuuaagcacugagccgauucuccucuggccccuuaagaauacuuuguaaugauauugauuguggaaacauucagggacuggauuacuuuagugaugauaugagaaugaauagaugaacaauauccauguguuacuaauguaugaagacagaaguguguucauacaguauuaacuuuuagaagccauuauuucauaugugcauggcuagcacaucugacacaugggagguugaaggaaaggaugcagcuguaaucuuuaccacaugcuaaaguuguagccacacuuguccucacuaaagagagauaacagcaagauuaaggccugcaagcucugcucuguaucagcagguuaauuuucccugcauuccugaccucugaugcagcagagaagccucuggcacguauauagcuagccacagugacaucuaugugucugauggcagggacaacucuaucuucaguaaaccagagaucugcacauuguccuaaugguaggaaggcaucugaggaccaaguuucuaggcuucugcuagcuguucccugaagucauagucaaucuccaauuuuagcauaaagugccaagcuggccugauguuccagugugugcauaacucuggagaguaccuagcaguccaacaugccuuuacuaggaaagcuguaguauuagugacaggaauacuaauggucaugacuaagugcuguacauuaaacaguuccaguguuuuaugaauuuuauuuaaucaucagaauccugugaggauaaugauaauccuuuucuuacagaugaagaaucucguaugaagaagaugaucaaauacaauaugagacagugaaaucugaacucaggucuuucugaggacauugucucauucaaugugcuuauuguuccaggaaccacauuauuaacugaggacagaaagauaaaaaugagauuuuucccuacugccaaucaugaaaauaaugaguauuuccuauuucaaacccaauuuaugagugauacagcuuccuggaaggaaucccauggacaaggcaaacugugaagcauucagugaggaggauccacaaugggcuaugaaggcucucacuucauucuguccccauuugugguguuugucagcugggcuguguauuagggaaacauacuguuguuuucuguuucgccacuugcaaaugagccuaauguucucauuuguacagugaauuaaugauguccuaaggcucuuaggaauauuuguaggugauaagcuuuaagaaacauguuuuaucguuugguauacaguggugcccugccugcaaguaugcuagugcaaugguggcacaaagcuuguuggaguaaccaaccaaugugugaugugcuuaaggccccacucacauacccacugcuuggcugaccaagaaccugagacuagauggcccagggaccuguccuuaaaaagaaauauacacuuuuaaaaguagcaauaaaaugacuucuaaugaaguucugcuaugcucauagaucagugccuuuuucagccauaaucagagacgcuucugccugcagaagagagaagcaaauacagagaaccaaaaccagacauuauucagaaagacagacagacagacagacagaccuuggaacaccagcucaaaaugggaugucuugaucaaauuuuucucuucagggcucagggaacucuguggaagaggagacagaaaaaauguaaaaagagcugaagggauggaggacaccaagaaacaaggccuucuacacacagcaggccugacacacacaugaaccuacggagacugaggcagcaugcacaggaccugcaugggucuguaccacaugggguccuagagcuaaaagaaguggacacaaggcccacaacccuaauccagaagccaucuccaguugauaaccacuugcaaaugaaaauguaguuuucuccaagcgagucucacuggggaaacaagcuacucuuaaguucagucugcaugcccagcaguugauggccaacggaaaacgagugcaacagcagcacuggagaauccugucuucucauccugucaugcuagggucaggcuugugcuguugugaauauauaugaaugcuauauauuuacguacacauucucccuccaucucuguuucccucccucccucccacucucccugucuccucccuucccucucccucccucccccuugcccagcaagucuuuuguguauauaugaugcuucuaaauagaguguuuuugugggauaccugaguaugggaaugaguuggucucuguaucuguauuuguuucaugggcauuuuccugggcucuuuuacauuugucugucuguauguauguguguguguguuuguuuguuugucucguccuauucggguauauuuguuauugucauuuuaucauauauuuuaguaucacuuagaagccuguuuucuaaugagagacagaaaguagguaggucugguuaagaggggcgggguuggaaagaaccaggaggaauagagggagggaaaccauaaccaggguauauuaaugugaguaagauuucaacaaaagggggaaaggagaauaauuccaauauagagaaaaugucuauguaauaauggcauagcaacuuguggggcauuuucuuacuuaaugauuaguaugugaaggcccagcccauggcagaugugucagcccugggcugguaguccugguucuauaaguccugagcaagccaagagaaacaagccaguaagcagcacccuccauggccucugcaucagcuccugccuucagguuccuguccugacuucccucagugaugguguuugacuugagaguuguaaacugaaauaaacucuuucauccccccaucuccaaaaacggaacccuccuuaaaugaagaaaaaaaaaaaacccuuucucucugcuauuuaauaucuuugccucaaaaaauaucuuaaaacuuaaaccugugucuuuuucuccuaacauuuuaaggucucacugauuugaguuguuuuuuuuuuuuuaaacuuuguauuagguauuuuccucauuuacauuuccaaugcuaucccaaaagucccccauacccucccacccauucccacuuuuuggcccuggcguuccccuguacuggggcauauaaaguuugcaagaccaaugggccucucuuuccagugauggccgacuaggccaucuuuugauacauaugcagcuagagucaagagcuccgggguacugguuaguucauaauguuguuccaccuauaggguugcagaucccuuagcuccuuggguaauuucucuagcuccuccauugggggcccugugauucauccaauagcugacugugagcauccacuucuguguuugcuaggccccagcauagucucacaagagagagcuauaucuggguccuuucagcaaaaucuugcuagugugugcaauggugucagcguuuggaagcugauuaugggauggaacccuggauauggcaggcucuagaugguccauccuuuugagguuugagguuuuaugcagucauggacuuagcucugcgguugugcauucagcaggaccagagcugucuauggcugcccaucccauucucuuucauaucuggaaggaacaaaauuagccacaccgcaugccuuucuaguagaugaugagguuuccuugguuucuuuuuuuuuuuuuuucuuuugcuuuuguuuuuccagccaagccuucaggaagauuauuauuccccuuuauagaauaaaggggggaaauaaaucuuaauguuuugcccaagggugaaagaggcugaggucuguaccaucaaucacaugcuauaaacaucauguguccacacugguuuacacucaaugcagauagaacccucaagcuaacugcuccaggaccuagagcuugcucagacuuguaaccaucaagcaguauuuuaugaguauugaauacagccaccucuucacagagcccugcugugugcaguguguacugugggcacaaaguggaccucaucccaugguagccuaggggaacaacgauccguuuuaacuuggcucuuauuuuuguuuuacucuucugaaggccacaugugugaaggcccuuuguucuuuguguguagcucuucauucagauguucacacuccuggacuucaguuuucuucccugaaacagaacgaugagccaaaccaaugaaacauuaggaagaugugagguuaaaagcauuguaaagauaguuuaauuuuuuguuuuuuguuuuuugguuugguuuugucgguagugggugcuuuguuuuguuuugguguauuguugaugguggugguugguugauugguuugauuugguuugguuugguuuuuaguagauauaaaacucuuugguuuguccuuaacuugaagguuaaauucagcaaguauuguuggcgcucugcuggauguaagcaggagcuauauccugugaauugugccaagaagauaaguugucacuuaucuaauucuuuccgagggguucuuugcagguagucaaaguauuaaaugaacuaggucaagugcacuggagaaagacaggggcgaucuccagugcacaccucuagcuuccugguaaguucuagaugcugcuuuccuucaugugauccacacaacaaucgccaagguccucucuguaaggaaaagaaagcuuagaauuugugacgauuaguauuaauuugucaguuugucacaaccucaaaucacaggagucuuugaaggauucucuugauuacauuaauuguccuaugaagaucuacucauacccuaccuaggcaggcuuccugacugcacaagaguagcaaaggggagcugaacacuagcaugcaugcauaauccauugcacuugccuguggauguguugugcuucaaguuccuguugccuugacuucccugcagugauaggcuauaaccuggaauugugagccaacaaaccccugugucuacucugaguagcuuuccgcaagauauuuuaucacaggaggaaaaggaaacuaagaugcaguuguuaagaaguuuguucugagccgggugugguggugcacgccuuuaaucccaacaccugggauugcagguugacuaacagucucaaaggagaacuguauuucuagaauuuacugauaagcuugucugugugugcaagauaaucugagcagcagggauauguucuuauccuuuugaagucagaauuuugcugguuaaagaacacaacacgccaguucccacauugguuucagaaucgauugacuuugcuaguuuaaaccuaguugcucguuauuaauugcagaaaacgagccuugucuuuuguacaggaaauaaaaugaaaaggaccaacauaugucuuagcuuucugccuuauuuagaauccuaacagaggaacucaaaacuagguuauuggagccuagugugguggugcacaucuauuacccuaguauguggaagcagggaaaucaguucaaggccaucuucagcucuagaccaagggccaaguucaaagcugagacuuuaacccugccucaaaaagcacccuugaagaaaagggguucuagaaaacauuaggaagaaaaugguuuggaaguuuaggaaagaacagcuaaauaaaugagcaaaaugagugaggaacuguggggcuugccuguaauccaggcacucaggagacagggcagggagauuacugccaagugagcucagccuggucuacccagugaacgccagccaccuagugguacuuaacaagacgcuauuuuaaaaacaaagaaagaaguaaaugauuauauuauugcagauaaaugaauuaguaaugguggcagaacccgaggucuauggguaaaguacaccuaaguauaccuagaugugggaauuauguguauuauaaaagaguaaucgguagucuauaaaaugcuuaccuuacaagcacgaaagacagaauucaguccccagaaacaacaugaaaagguugggcaacccaguucugcagggaaggaaccagaaggagcccuggggcucacuggccaagcagucuugcuuaaucagugagcucccagccaaugagagaccccaugguagucaguguuccugaagaagacacccaaggucauccuccaacuuccauaccugcacacacauguaaacacaugcauaaaaauauggcugagaaauuuccauuuagaauaauuagaaucacuuuuuuuaaaaaaauaaaaguugaagguaauagaauaagagauaccugauucagugaagaucucuggcauauuucagagucuaagaagcuuuguaaauaaccagaucgcuuaacaguuauaaaaugccuacagugcccaaagcaugggaguagaggaagauaagcaaguauuucaagggucuggauaaaaaguauggauagugauacagagauucuaaagacaggaguaaagcuagcugcauuggagucuaacuuggagcugugaauaguugacaguuuaaaaucuacggucagugcuuggcucagugguagcacgugacauaggcguuugaagacaggacggaaguuagauggagggacugccaucaccauccccacuaacucuguaagcucacacaccuugucaucauuccuacuuuuauuuuuuccaaacuguucagccugguaacacuaucaaaggaucucaaaauuauuuacaaggccuaauaacauauuacucucagagcuaggaagauguaauugccauaauuuucuaaauaggaaaacugaagauuggaaauuaaguaauuugaucucaggugagagcagagaucauuguguagcggcugucaucucuguacacauaagaauaggauucagaaauaauuacucuaccaacauuugaucugcuaaaauaauguucccaaugagaagucuccugagaucauucuucagugucuuuuucuagccucuauaauauuugaauuuacgggguuaaccuuucuuuuccugccaugauaacuaucucuccuuuuucaguuuaucacuuucucgacagcugauagcagccuaagcuaauauuguaacaauuguagauaauauugcagauguacaaggacauccucauaugaaucaauuaaagaagucacuguaaguugccauugaaaguguagcagcugcauccuugagaacagaugcucuucugggugugaaugaguccaauuucaacuaauuuuuaagaccuaaacagauuucagucugcuuaauguugggcuguggagccacuugagacauccuaaugcuuucgacugauugcuucuccaugacaguuaguguguuggcuuuccuugagagaugcagaguauuugacaugccaaggauuuuaugucaaccaaaaaaaggggacccaaaucucuguuguaacaagguggacugacuaguucuaaaaauaaaaaggcuauaagagccaacacugcuugcaaggaaaguucaugagcugugggaauuaacuagaacugcaguaagcuuuauaucuguaagauuccuaaacagcccagaaaaccagcuauaacaagcgacuuccucaugcccacucucaucccauauuguacccagaaaacugagagaguagugaauggugaguuguucuuucuuuucccaaucuuuacaguuaauuauuauaugcauuauuuguuguguugugcuagucaauuaaaaucacuaguucaauuuaacuaaaagggcauuauugacuuauauaaugccuccaguuauucuccugaccgauuauggaaaauauaugauucuugcccuaaaggaguuggugaucugauugagagucgagcuaauaauaaacaaucaguuuauuaacagucacaugaaugggauuugauaacuacucuacuagaguuagauggagaaauaaauauagacaaaucacuagcucugcccuaggauggaugaguaauuauuuaaaaaguauaaaaaccacugcaaguauugagcgguagaaccucaugauagaauuaagagauuugcuuuaaaguguggaggucaaaaaguacgauuucgggaagggaugaacuacagaagagaaaacggugcacauuugagaagaaccagaaugguuuacagagauaaaucauagagauuggugguccagcuuagugguggagcaugugccuggugugaacagcucugugacccccagaaaagacagcaggcuuggaaagccuggcugcaaagcccaugcuuggacccccuagcacuggaaagugcuguaaugacaauguuguaaugacccauacuuauggcucaggcaauuagcucuauauaacuuguguuuuguuagauuugaaagggcaagcaagaagcagagacaucaguuacaggauccaccgaugagaagaugucuaaacuaaagaaguagcacuuguguagaaaaaagaaaauaaauauuagaaaaauaaaugcucacuaguauacgcaaaaauuagccuuaaugaaaaagaaaaagucaaagauaauauaguuuagauuucucugguaagaagguaauuuaaacaaauuuuacaaggaacaauaguguguuuaguuuugagaugccugugggauguuauacagggacaggaagguuauauauaaagaguuaaugaaaugaaguuuuaaagccacgaauuuaugaauucauaaacaauacaagaggugucagaagugucugagcucauccacacuccauggaacuaagggaaacuggccaagcaaaguggucccaggcaacccuggcuggugguuauaagaaggcuggaggaagaggaugaagagaugggaauuucagaggaugaagaguguucaggugauaaagugauaucagccaaagcagauggaaauggccgguggugcucuaugucacagaaaccuuauauggcauuagcgucagaaacuauccuguggguuuggaaauucaaauuuuacagauagacaucagaauaauuuuuaauaauguagugaaaauagaaaucugauugugguacacuauggcauuaguaggacucaggacugcagagaaagcaauugcugagagcucucucaaacacucagcaagaaccugagaucuuaugaggggaaguaauaagggcuagaggaggaggguagucugaguguggagguuacuaagagaggguagcuggcuggcaaagaacagagaaguggugugggaacauuuuaauuaaaaaauauauacacuauauuuugaucaucuuuucccucucuuccaucuccucccagaucauccucaugucccacccaccuagcauucuguccuuucucugagugcuccaaaguugcucacucuucuaagcauugucagaaugaaugucuguguuaguccccauuuacagcaaagagaggcuucucuacugaaggcugagcgaggcacuggucuauagggagagcaaugugccacuaaaagucaugcaugcauuuauuuacuugucuaucuaucuaucuaucuaucuaucuaucuaucuaucuaucuauuuauacuugcagaaugauaguguuaggcuuuccuccgcgcccaggaccuaucaucucagggucuuggccauguuagcaguguuggguauggaugcuauccaugcagugggccuuaaauccaaucaaaaagugauugauugcugucaauaugccuauguugcuauuguaccagugcaucuugcagccaggucacugguguggguugcaggguguaugacugggugauauugaugauuuacgucuuucaguaucacacaggguuccuuccggcaccaugagugcuagucuuuagggggugaagcuucuaauuuaugugacuccacuucucaauaugccuuuaccaucagcuuguggaaaacuuuuuugagauuagacucaaaaacuuccuuuuggcaaugaucugcucuucaguuucuguuuuccugucagugaguuauaaaacuagcccagggcuaaggagagcuuuaaggcaguuagaacaaaggagaggagucaagagaauugcaccuuguggugaaaggguaacucaaggccucagcucugugguccaugcugagggucuucaaaggggaaagugaagcacuuccagaguugaggcugagugucagguguauggcaaaccagcaagcauaggagauggccaaagaaguaaagcugugacuggcugugacuccagaccucacuuaccacugagcuaucacucuuuccgauucuggggcuuugagagggccuuuguuuuccugauaaagcaggaagucagcagugcugaggcuggcugauaguuaaacacuaaggccagcacccaccugaauuuuuuucuugaguagaacauuuauuauagguaaaugggagagcauagccagacagagggacaucuuggagaguccugaauggacaugacccugagccacauuaagagagggagcagguagagcuagaucaagaggccaggagaguaaaugagaaauaagaaagaccagguaaccaggcuggauuauguguggaaggacagcugggagaagagaugcccaacccuugggauagaaggcaggguaugccggaaacagccuguaauagguagggaguagggaugcuggcagcaccuggcaaccaguucuguuucguuugucaauuaggcaucuccucaggguuugaaacucagcaauagggaggacugagauugaaaugauuucauuauaaugucaaaaguuguuuuaaaaguuugaaacaggcuuucugguccuguguucuucagggacuagacacauguauuagagcauaccaagaacuaccccuaccuuucucucggguugugcauuuucagacaggaaaaauuaccuuccuacuaggcacagcuacaucaguuucuccagauauguguugguuuaaaagaaauuugguuucuagaaguaauuuuuccucauccagaaugcugaauaccuuggucuguguuuacccgaacguggccaggcuggacuuuugcugauugucuagauuucauuaccugacuacuauuccuaaugccaacgaaggccaaauuaggaaaguucucuccuuccuuccucuucaucccuucuguucuuggccacaccacuacaaagguggucagugcacucaacacguucuuacacagccuaccucauucuugaccuuuccuucccguaucaggaaaaggaggaguagggggagaaagaagugguaccggccucagccugcuucuuuuaccacaaaaaucagcagucucugaggggcuccauaggaugcugcuugaagauuuaccagacugggacacaaggccacuucuuucugcaagcccagggcugcagauagugaacauuucauauguucacuagagugaagauuggagaugagacugcccuguccauugucucugcaaaagaaaagcuauuucuguuugagagcacaagguugaucuuccucccguuagaccaauugaauugauagagagagcuccaguuaccucagcgucagaguaaguuaggaaucuuaagagauccauacuuacaucuauaguggucacacuaugaaugaucagaugucaaccuuucccacgguuagaacagcugcucagagcgcaugucuuaaagaggugaucaauuacuaacauuuucaaaguucaggacacaugggggcuguggcagaaugaagagcagccucugcgacagauacauaaucaccuagucuccugaagggugugugcagaaguggggggggggcaagacggguauauguguguuauguagguaugagaugggugagugaguaaauaugguguguauagguaugggguguggugugaaguguggguguccaauaaccucauuuccugcucauaaacagaaucuaucagcacugucacuugacauuuaagagccaguucauucuucuaugcugucuuugccacgcucagcauuucuuugaucaauauaugccuucuuacuuaagaaagcuucagaaacuucaggaagccuccaggaauguacaaaccagcauuucagggaagcucuagucauaaguuaucauguuacuuuaauaucacaucguagauuugcuauaacuuacacuagacagaaugcacaguuuuccauugcuccacacugcuccugucguggccacugcaagcugcacuuggcagcugaaccugccauuuaccuagucgaucuuggggaucaguuucgcugcguucauuuuguuuguuuguuuuucauauuuucuguauggucaguuuucacauagugaaauuauuuauuuguauaauaaaaauggagaauuucuaccuuuuuaauggauauuacccaaaauauuuuugauagcauuuggucaguuauaauauuuuggagcuuaagaccaugagugcagugucagaguaaucucugccucuuccauugaugaauacagauaguucuauggaucagacuuugugucacaaaagaaaggaauucagagccuuaaaagcccuaaagugcuuugaaauauuauaauaauguuacuuaaaguugcuuucaucuagccugccacaugaaacauuaugauggcaaugauguugccuugccauaaaacaacaugaauaauauuaucauuugagaggaaaugcaguguuuuauguccacucuccagcagagcgaguuagugaagagcgaggauagugcagggauuauuagaauuuuaaaucuacaccacuauagucuacuccgccuuccaggucaguucccuugagucacguucgcuuguuugugccugugcugcaguguuuuaaucuuagagucugguucucaaaggaacuuuagccuuaaagguuacuuacaugccuggaucacgcuucuggcccucucuugggcuugguaaucuaggaaaagaguaaucacaauacauacuacuugggccauguugauuccuacccuauaaaguaaguuaguaaagucucaguggguccuaugcugggcuccaagcccauacagcucuuucugcaaaggacccacguacugcagccgagaaaaggccucucugccaaagaggcaaaacauagaugacuggaaacggaacuuugagauagaugggauuauuucuggcugcaauuauuaagauauaacuuggacaaauaaaacacuaaaggagaguaauggcuguuuauguuucugguuuauaugaauacugagaaagcuuuacgugcuaauauuuuaguuuuccuaugucaacccauguaccauuauaugacauaauuguuccuauucuacacaagauacuaaggcagugauauuugaagaaauuuguucuugcaacaugcuagagacaggaugcaaguauggcaguugagaguccuaagaccuaaaaaagaagucuugacuaguaugaccauauuauuguugaugaucuccaagaaaccaugagaagcuuaaauaaacaaaacucccauucggcuguuucaguauuuuccuaaggaaucuauuuaaauguuguaauauuucauuuacuguccauguacacacacacacaacuuguuuggauaaaauccauucuccaucucuucucauauccccaccaccauuaccccuuauacaaguucauguacacucuccuuucuuuuuaaguguuuuaauacccuuagucuauuuaguacugccuguaugugcuagguguaggaccaucuacugaaggaugaguaacuacucagagcccacacacuuuaagaaaacugacuuucccucccccaaauagccaucagauaccagcagcucuuuagauacagguggagcuucaugagugccuccgccaucuauuuuagaguuuggcugacuuaaaccuguacaaggcuugugcauacaguucuagccacugugaguucacgugcgcagcuaugcugccuuguccagcaaacacuguucccuuguccaacagacagccaauuccucuaacucuuaaaucccuccauacccucccuccuucucagugaucuucaaaccuuuauaggaaaggauaugauauagauguccuauuuagacacagcaugggcaguucuugaccuuauguuuccagaguuaguggugucucagcagauccuguaggcuccaaguccaggaacccuucuuccagaagauccaagcccucuggcagagagaagaguuuucagacagagaagcaaaaacauacugacauuuaguacugagcacuccacagacucagcauauuggccaguugugguucuucuuuguauuaaucaccaucuacuguaaaaggaagcuucucuauuuuggguugaucauggaaucaguauguggauauaaagauuaaaacuuaaagucauuuguuacuauguugauuuagcagaauaauaguaguaggcuuaugacuuggccagucauaaaauuuuggcccaguugaugguacuagaaaugaagaccaucucauaggaugggcuguaagucuaagcagaaaguaauugguuacuccccuaguauuccuaccauuauuauacuguuguauauaucuuugccagaccagucaucauuauagcuuacaagguucauugggugagacuguugaugacauuucuugucucauagaauccauagaaccuugcaacacuaugaauccuauagggaagacccagaucauaauuagcuugauuuuuuuuuccauguccuauaauucagauauguagugucuucagcaggagggucuuaaugaucaagcucuagaggguaaccaaugacaauagccuuggcaauguguaugaaauccuauugaccaguaaaucaaaaagauguaaacaauagccagaagcugaagagcaacuuaaaacauauacaggagacacacgcuacauguucaggccacaggcucugaagcugcuccuguuucaggaaauugauugaagcaaggaaaugacuaaggaagaacaggacaggacuggugagcugccucaguggggaguggcgcuuucuguguaggccugacaaccucaguuugauccccaaaacucaucaugaaagaagagaaugagguguaggauauagagcagucagagggugcauggggaggggugagaaauggaauauggaguguaaaaaaugaaaaaaugaauuacaaauaaaauuaaauuaaaaaguuguugagagagagagagaaugaacccucccacguuuaucugaccaccacgcacacuguagcacacagaaacaugcauucauacucacacauagcaacacacuaagaagaauaagaaguaguaaaacaaaagaaguagacacaagagucuagugugccuuagacuucuaaugcugcccgaguagugaaaacagcaagaugacuggauacucuacacuccaggaaaccuguagcuaucugaugaaaugauguuuuuuuuugccuucucuucuuccagugcuuuccccugcucaagagagccacgugaacauggaccuucccccagugucugaacagaucaugcagacacugagugagcuugccaagaccuuccaggacauggcugaccgcugcuugcucguccugcaucuggaagugagguaggccaacuaagcacagaaaauuauggugucaugaaccucugugacguaauucacauguugucuugggggcuggagggcggggaaucaagugccagccauaauuuuaguuuuugcuauuaauauuguccuguucuuauccugagcuugauguuuagcaguauucaguguucuuaaagaaugugaguguaugcuggacuacgagugagaugacucaagaguguguggccugugaugcaaccuggauuugcacaugcacaccaaccaugugggugaucugagggcuagcuaccaggucauuuuuacaaagcuucaauuuccucuuaaaaugagaauaggaguuccuaccucagauguuaugaaggaaagcuugaauaauuuguaccauuucugccauguauuaagucaaaaguguugauuuuaucaucauugauauuuuugaaaguuagaaagaaguuauaucuaagaaccacaaagccccucuucaacagacuuaaaacccaauugagaagauuaaggccaagaaugauccuacagaaggguuuuaaguacgccuuauuccuucugcugcagcaggaggacacuccgugcaguugcacaucuucagcuguccacucauuugcuaagcauuuuaauaggugucuucucuguaccaggcugugcucgaaacacucugacacagcuaugagcaaaaugcugcaggucccugugccccuaaugaugcagccagccacugacagauaaggcagcaaagauacuuuagauagucauagcuagggcaauaaauaacaaugagaggccagugauggcucaaaggguuaagccaccugucuccaagugugcugacccgaguguaacccucaggccacaugaugagaggaaaggacuggcucucgauuguccucuggccuccacacuaguuagcucauggugugcucacacaaaucaauuaaauaaguaaauaauuuuauagcauggacugcaaaugcaagccauguagcucauguaaauuagcucguacaggauaagcauccuuaauugaaaauucagaccuacaacuguucucuggacuuaagcauuucauaugcccugccaauaaaucugugcauauauccuaaaauucaaaaauguuugauuucuaguauuuucaguaagggacuuacaaacaauagcuacauuugaaaauguagaaggaaggaaacaaaaugaagcauauuuuguuuauccauacauaaugcauauauauauacauauauaugugcauauauaugugcauauacauauauacauauauaugugcauauauauauauauauauauauauggauuguguugacacaagguuaacacagaaacagugaguuacuuuucauuuucugugguaagacuuggcaucuucacauuuucuacuuagagugcaucauggugaggacauuccacaugcucaguagcuacauguggcaaagguacacuggaaaauacagugcauacaaguuaacuaggaagugaguuguuuagacaggacauguggcaaagugacaauagccauccaaacaaauaccuagacaaaguuucagggaggagccgcacucagaaagcuccuaagacacaguccaggcaaguuggaggcacugagaagagccuaacacaucugcaaccagaugaacggggcagguggaggguggguagaauacuguaaaggacaaucuggggccuaauuguaagcagucguagaucugauacacuggagaucgucaagaccaagagaacaaacgguuccaaauguguucuggguguauuaggaagccauuggagaagcuucuccaguauaggaggggugcuaguaauuaauauuuuuaaaggacuguucuggauguuguauggaaaugggacuacagaaaaaguaggguuaccaguugaggccuguuaggagcaucaaagugacaagguagaaauaggaaagauguagaacuuggaacauacacuaaaaguagaaaucacagaacuuauggacagauuggcuuggguucaggaauggguggcaaugagaaaaaaaaaaaaagacucacaaaaccaguucagagcgauuuguggauguaaaagauaugaacaccaguaggcagauaaugaagaggguaagacaggaacauuacauguucgagggcagccuggacuguaccucuguggccacaucacccugugagugccugauaucaucaacugaagcaggacagacugaaggaguagaaaggucagggguacagauuagacguuucugaauaggagaacucaagguguucacucuaagaagcuuaucuuacaccucggcagcagugccagccacuggaucacuggauaccucggagaccccagggccagaaagccugcugugaccugguaguacauuuucuucugugguuuauggaacaguauuaaaguugauuaaauauuuucuuuaauuugaaguuucucuaucaucuauguuuuaaaaguauaaacacgaguuugguuuacaguuaagaggaauauauuuagacucaguuaaaacuuggauggcuuugaggcauguuaauaucacuuccuuauaugccacuugcuuuuggcauucuuugccuuccccacaaugaacuacuuaucugucgcuuguuagcacccugagaguggaacaaaagaaguagccugcaggcuuagaaucuguugugcucagcauuauuccugaauuuauuccuuauauuaacuugucuugaaauaaagcaucucgcuauguauuuucugauuuguuuuacgaaaauuuuuagauuuguuuucuauuuauuuucaagccgauaaugaaaugaagcaggcauuuucuaugaauagauaaauucaguggacagagaagaaagaaaaaaagaaaaacacccaguaauauucugaggcgacuguuacccuggguugcaaagcaaaacaagagaacagcaaauuaauuacucuuccagcuccugggauuuuaugcuauugauugugcagucucaggacauguucuacauucggaaucaccgacuuguguguagcuaauuccaggcgggauguucucagcacgucugaguaagaucuuugaaauccuuaaccucuguccugucccuuuuauuguuugugcuucuuaccaguacuguucuuacaaugccaagcgugucucaucaacucgauaagcaaucgcacaauuguaauauucaauuccaugccucccucaguguuaauuuaaaaaugggaaaggaucauuucagccucaaguuuaaugcucuagauacagaauuauuuuuccuuugcucugagaauacuaaacauacuuuuuauaauuuuuuuuauuucuuguuauaacccaguuccaacauuucgcuuguuuucuaugaaucuuucuccauucuguccuuauucuugcuguguguggaucacagaaauaacugacuucuccacauauggcugaggcaauaaaugccaacacucucucuauccuauaacauugucagugcggggaggggagcccuagugaggauaaaaggaaagagaacagauauugugcuaaucaucacauugugugaaccaagagugcagggcugaagaagagacugcucacgccucaggugugucucguucauuguuauaaauggccccauaauugaaccagucaggauaucuguaugauuucuucauaaaaauaagcucuuccuauuuuccuacacaagacuguauucuggaagggaaaugagcuguuuuaugaacugcaguuuuacaugauagcccacuuguaagucagccagaugcgucugcaaguacagaggauguauuaacgacuucucuguugcugcgauaaaaugucacggccaaaagcaacuuaagaaagaaagaaaguucaucuuagcuuacaguucuagucagucauggcagauaaggcauggcagcaggaacaagaagcagagagaccacauuuuaccaacacacaggaaacggagaaaagaaauuaggggaggggcuacacacucucaaggcccacuccaguaaccgacuuccuccagcagggcuccaccccuuaaagguucuauaaccucugccaauagcacuacuaacuuggaaccauguauucaaauacaugagccugugugagacauugcucauucaaaccaccacagagagugggugaccaaccucauccuuauucugauacuuaaguaauacuuauuuuauccccauccuauugugauagacaacuauaauugagacccugacaggaucuggcaugauggaaaaugauacucucucuagcacuuucagccaugaaaacacagcaguaagaaccaaacuaaaaaugaaagccaugugaaauauauuaauggauuaugccagcaagggcccagaacaacuucaaaugccaaacuuuaucagcccauauaagucuuuuuuuuuuaagauuuauuuacuuauuauauguaaguacauuguagcugucuucagacacuccagaagagggagucagaucucguuauggaugguugugagccaccaugugguugcugggauuugaacucuggaccuuuggaagagcaguugggugcucuuacccacugagccaucucaccagccccauauaagucuuuaauacuguuuaaguucaaagcaaaagagaagaaaaaguucuugagucuuacagguucuguguugaagaacccauccacagaacaucugacauuuuccccaugucacuguagaucacguuuaacuaccaaguccugucuuuccauaguuugaggcagaaggcagaugauaacaccccucaagagaugaaaggcauggugagaccauuaaaaguuguugagagcuuuuuuuucauauuugaacuuuagaaaaggaaaauuaaguugccauuugagucuacaguaccuagaaugucaccuuuaucaucugauuucccuuaccaucaggagggcucuaagcgggcucaacagcaacugccugucaccguugggauccuaaguguucacuuucugaaaaucaaccauccugcugugcaaucagcgguguuugcagaaaaccuuaaugccaaagucaggugaaggucagcaacagcacacuagaacccagagaaaaauaaaacuuuauuugaauuugauauucacuggugacauuuuuuucugaucauuugggaaaagggagauagcaccuuaagcaguagccauuucuccucccugcccucagcuguagaauaccaucuuaaagauucaccugcagcgucagaaucuucuagcccaacucucuuuugauuugccucugaguucuaccagcaggcuacuccuucuuugugccaaagcuagucuuugaucuuaucauugcacugcuuaaaguucucuugggauggagaaauggcuuaaugaucacuagucagcacagaggacccagguucaguucccagcaccuauaucaggcaccuacaaauucuucauauccacuucaggcacgagcauucgugugcauguggagacgcacacauuauuuuuuaaauuuuuauuuaaucuguaaagcucucuuaaggaucccuaaacauucuggcauaaaauccccacgacuuggucucuacagcuuaggaugacauucuacagcccaugucucuaaccucaugucacuccucucucaugugaucugcauggaacaaaaaggaaccucucacuuuugcucagagccauugucccauguucaaauucaugccuuuuagcacacacuuccuauugaguguggcuaugcugcuaagacuuuaagccuacuuuaaaaauacuugaguaaagaugcuuauauuucaacuaaugcuacuuccuuuuaauuucugcaagguagagauuaauugcacuaaucaagauuccuacucccuagugggucauuuuucauuaauuacaucaggaagaucacauuguaaaggggcuaugaccugagccuuuaguugcaucuugaucaaaacuagucuuuuugccaauuaacucaggaaugucagauugggcuuuuuguuggugacauuacuuauuaauuaacagcugugaggauaaucugaaaucaaugaaauuuaacuauagucauuuauauuuguauuuccucauauggaacguucuaaggauauugccugagaauggacagauugcucugugguaagaccacuuguauaagcauaacaaccugaguuugaaucccucgaacccauggaacauaaaaugucagauguggcuaugaguaccuaaccccagcauugggggaaacagguaaagauagguugauccuugaaucuugcuggcuggucaggggagccaagacagcuuccaguucacaacaugaaaaaagccuaacaugguuacuguuuagaaaaaugguggugggggggggggaaccacuaugagauacuauaaugcaccuacaugaccaaaaacaaauacuuuugaacuggcacacagugcuggcuacgauacagaauaacuagaaugaugugaggaggagagcaaaacaauaaagcucauuaacacaugguucauuucuuccgaaacucgagcuucccuuagccucugacucagcaaagcauacuucuaaguaauuagucaagagcaaugaaaauuuauauuuacauaaagcuaagaggaacuuaaaggggaaauuuaauucuuucagcucacaguuugaagggauacagcccaucaggacaggaaggcgagguggcaagagcgugagguggcuaaucacacugcaucuacagccaggaagcauagugagaggcaccaugagugggaccugguggcuuccuucuucuucccuucuuauucggccuggauuaccaguacauggaaugguaccacaaauauucuuuccuucucacuaaaugucucugaaaauacccucaaaguuguaccuagccguguaucuccuaggugauuccaaauccagacauguuaaagaugaagaacuguaguuauagauggcugugagccagcauguaggugcuggaaacugagcccagguccuuuugugggagccacugagcuuucucuucaaacuauucuuuuaggcauucuuauuauucugccccauuaagcuguggcaucuuuagugcugcaaacugucuuagaguuccagguacuagaggaguuccuagaaaauuuauacauguucaguaagugacucaaucgcauaauaagcuggcaacgauuaauguaaaacucaugacaguugucaaguucuuacugugugcuucuuucacaucagacuccauaugauaugcuuagcauggccccuuugaggcagaaguuacuauuaugccuauuucaagggaaaccgagacauagaaagauuccacuaucuugccuaaagucacacagcuaguaaguaucaaaacuggguaacaagaccaguggucucccaucaaggauggaaauucagccccucucugccuucauaacaacaucucucaaaagaugcucuucacugugcacauaaucucgccauugaaaagaaggucagaaguugucuauuucuuaccaagagcauauguauuacaugagcaaaccucacagacaccugcuugcuucagaucacucagcuauguauaacugagauggcaucuugguuaagaaaagaccaaugggagggagggauagguaaaaagaccguggccgcuucaaauauuucggugcucuuucccaggccgauccaugaccucauggggaauuuuauauuaauuacucugcccauuccucucuuucagaguucauuguuuccacuaucucaucccucuggcaaaggaggggaacuaugccaucguugccaauguggagaguauggauuacgacccucuaguggucaagcucaacaaagacaucagugccauggaagaggccaugagcgccagccuccagcaacauaaguuccaguacaucuuugaaggucagagcugaccucugugucuagaagccugggagggaagaagggucaagguguucaugaaugucuguauuagaaaugguuaauaauacuugucaggaaaagcgguuugcuaguguguuuggauuagaacugcugcaccuagcuuucuguauggguagacagaugcugacugccacuugcuccuggcugauagggaaauuuuuauuagcuaaugcugaugucuaccugcuacggagacuuggggacaugugcagaguggaccacaaauuaacucgagaggagcuuguuuaaagaacgaaaggaaggagagaaaaagaaaagcuccauaccuacacagacagggaguagggaaccuugaaaagccuucgucugguugccucgucccuagcagggagguuucucggacagaaugcauugcucgcugaagugaucagacuucuugcucugccgauacuuagggcagcugcuucagugcccucuaucagcagccuccaucagcagugcugugggaggcaguaguauuaccuagagauauuugccuucaaacuuuuaaaaaauauggugccagccaaauaguucuucauguugaauucuaccacaaaccuuuucucuauaauccaguaccuaaaauaaccaagcuaugaagagaaaggcuuauuuuuccguuuuugaucaagggucuccacugcuuuuaggugaggugggagaggugaggagucccagacggcagagaccaggagcuaauuaauggcagagccgcugaccuuguggccagagugugaauaaagagaccaguaucucaccgugcuccccacuaggccucaauccuaaaggucucacuccucccaguaacauccacaagaaccaggcccuuaacaaagauucucuggugaaauuauaucauaugcccuuuugauuguuucucaaagcauggaccuggauauuagaaguugucagugucuucacauagaguaggacauuaucuaaagaucaugacaagcugcagaugacaagauguuggugcauggccacugcuagcuuuaugaacacacuguacaacagcagcuuugcaaccuuugcccccaaagagguaaaauccucuucuaugaugaaaguuuuaaaacggagcugugagaauggaacauuuuaugaaagagauucuaccccaaagggcaaguaauuaugacaugugccauuggcuagccuugagacacugacuggagacugccuuuacacgugucugcagcuucuagccucugugucucucagagccucugccacuguucucuuaucccacagagcuuuccuuuuguuccugauguggcuuuuccaagcccugcaccuccacaaugguccuauucaugugcuugaauuuacuuagugauauuuuaauuuauuaauauuuuaugucuuaaaaaugagacacccccauuacuauaccauauuaucauuuaucauaccguauuauaccauggcaggaugugccguaaccuagaaagauuuuucuuccuuaaauuucacguccauauugugucucuuuuucuuugagcccaaaucucuuuauucacuguaaacagcauaaauaagcccauagcguacuaaguuaauccacucaaacuccccgguuucgugugcauuucucuccaccugccagauguuguggauucaugaauaaaacacacacacacacacacacacacacacacacacacacacacaaaccuuauuuuuaauaugccuuaaacagugcaauggcuggacauuuucaaaccucccugcagcuagcacacucuccccuccaauauuccugaauuauuacuuucuaaaaucuauauuccaucucugcuaccccagaccccuggggccaucuacaccaagucuuacauauugacugguuucucuccugcagcucucgggcuuacuuggccugcuuccccaucaugauacuucuaaaaccuucuuccucccaugguuccuugcucuggaacucuaaagucccaccucuaucucccuguccagccauuggccacugacaacuuuauuuaccaauuagaaccagcugagggcagaggccaucaaugucucacaugcagauguguaaauucuugugugauuuugagacccaaauuaacacaaauugcauuagaaccaauccacaacauaagccuguggucuugaagggauguugguugagaauagcuaaggcaagagagagaaugucuuggccaaggagaaacccacagugaagccagaaggaagcuauugaaccugaguguuugcugaucugauucugauugcuauuaagagacucagacucuaggaaaggaggauaacaauaagaguggacaaucuuugguaguucuugaguucugaggaaaauaaccugcuggaggccaucugugcgaaaaugggacauucugaauaaacauuuaaaauuauauccaccuuuuaaagauaguuaccuauaacuacuuuauguuguauugaaccaucauuucucagccuaaauagaaauauccaaaaggagucaugguacuaaaaaagauggcucagcaguuaaaggcuagauucacaaccaaaaagacaauaggaauccuucucauuuauugauguucucuaaaucucuguagaaguauucuaaggcuuuugccagauuagcuauugcaaaugguuacauguuuucuugaguuauuuaaaccuguagaagaugaaaaagaguuauccucuguauuaguuuaagccagaugccauuaauauaucucuucuucucuccucacuacucugugcucaccccucaggucugggacaccucaucuccuguauccucauuaauggggcccaauacuuccggcgcaucagugagucuggcaucaagaaaauguguaggaacauuuuuguucuucagcagaacuugaccaacaucaccaugucacgggaggcagacuuggacuuugcaagguauggaugaauugggcuagauuucuuauccaaaggcucaugccuauagugagcuugucuuacaaaacaaaacaaaacaaaacaaaacaaaacaaaacaaaacaaaacaaaacaagaaaacuuaccuuuaaaaaagagagaaagaugucuggagaaauaguucagucaagguacuugugguacaagcaagaggaacagagcucaaacucugaggauccauguagaugccaugugaguggguuuggugacuccccugugauacuaaccuugggaaaaagagacuaagacuccccagaccaaggccugggcuuuacuaggagacccgccucugugagaaaggacagaugguggagggccuccacaugugagcacacacgugcaaacgagcacacuuacaugcauuccauacaugaagaaagacaaaagggaagcaguauucuuaagugacaaaaccagccacucuauacaauccucuucaaagauucagaucccucaggaagguaauuuucccacuguguagccuaagcugugucuuguuuuguuuuguuuuguuuuguuuuguuuuguuuuguuuuacguuuauuuauuucauggcagggcuaggaaggagcaaggugagggagugagugcuggagaguguguguggagauagaucagaggacaacuuaugguucucuccuuccaccacguaggcccuggugacaaguaucuuuaccugcugagcugucucacugggcuuaaacuuaaguuccucacccuauaaaccgacagugacuguccucugaguaagggagcacuguucgcaacaguucacaagaugcauaagcgaguaggcccugcguuagccaagagacagugagugccgcaugcucuaccgcaggcuuucaguacaugugucgcaugugugcauaugauuuccccucuuacaaaauugaagcuauguuaauguaacuuaaaauauauucauuucauguugucauauaguaguaaucuuugaaaacauggguuuuuuuucaaauacucacuaauauuucuagaaaauuucacuuucaauaagugaauaaauuugugguauaaauuaacagaaauuuauuuucuaaccgcuuuggaugucggugguuugcauuuuguuucucuccugguaagcaaguacggaacuugccuuuacaugagccuguuuggacaccguuucugcauugacccaguuaaaaccuguccaguuuucuucccacugagagcagagucguuggccuuuuucuccucaagguugcucaucacaauucuuagugucccuuaaugucuccuucuaaggcacuuuuucaaaugguaggguuaauuuuauuuuacaccauuugguuuccacauuauacgauaaauaaucaaacccuuggcgcuuuguuaaacuguuuuguagaauguggaucgcaguacguagcaacuccucccacccuucccccacgcucuguuacuuacaguuagaagaacuggaccuuaaacugcauuuccaaaugccuuuuuagcuggaaaaacacuuguuuuuaguccagaauguucuuguuuagcacuucugguuuuuuacagaaacagacuuuacauuccucuagaaguucgggaaaaaguaaaauaguuuuuugaauaguuaagaaaaugacacguguaacugacuaugauaaagacacgugugcuggggucuuugcuuggaaaguggccugcauguauuccuuuuuaacuuuucuaaucuaguggguugauacccacuugcuucucugccacucuaucuucuccuauauuuuuuacuguuugcagaaaaguggugugugugugugugugugucugugugucuguguguucauuaaauuccauguuuuaugauaaauuugguggaaagccuuucuuguucagauuagggaaaccaggugugacugaaugcugcauuuauuuggccgcucuuaugggaaaugaucucauuauugaauuagucuauccauaauaacauugacaaggggaaguuaagaacauggaggccugagggauacaaagagccauuacuaauucucugaggacuauaauuccuaaauucaaucauccuuuuuuaaaugauuuuuuuuauuuaguugaaauaaguaaauuaacacaguccuuggcagacaguauggggcccaaacaaauacugagaaaacagcgucugcaucaugaagcccugacaggguagcacugagauuggcaucagugggcgauguuccagugaaggguuucugcaggacauaauugaauggcaacucacucaugccuuucacaguuggguuucugaauuauauccaaggaguggguaaaaggugaaugugaccaccagggagggugugucugauguuagcccuguucuauaauggauuaugcaggcugguguacacauguagugugagcagauucugugcuccagauccugcagcagacaccaucucuccuuacuuaaaugggaagcuucuuggugcuuagaacagaguacaugaucacuagauguggugagaaaaugaguaaaugccaaaccaaagcugaugaagaguuugcaaaauaaccaggaaggugaucugcccugaaaguuuuaaucaacaaauauagucaauuuucuaugcccuccuaggaagcaagagugugucucaauguuggaaagcaggagauaccaaauguuguaauguaggccaucaggccguggucucuuuccuccucauuugcucuuguucucauguggcuguauuucucagccuuaucuuccccuucucuuugagguaggacauaauguucugaaauggucuccaucaauucuaccaaauuugaagcuguguaaaauaaauaccaaaaacagccaggacuaagagacugcagcagugugccucagcauuccucaagcagugucuaaucaagcauggacaacggcaccuguauuuccagugaaucucuauagaaauguuaucuucuaacaaguaauuaaucaccagucgccaugugucagaaaacugacuuaacgagaaguuguacaacaccuguagguuuuuucacugccacgcauuccuggccggucaaaacuauagcaccuuucuauacuaaggaauuaggggauguggagugguucuacuucuguugauuuuccugcccacgucgagguugucugucucuuuauacacgcuguacuuuaaucucuacugggguagguuaggugaacagagaaucaagacagccugaacauuaccaggaucacugagagcucuguccuccauggugaagaucacuucaauguugcugucguuuugacucuucaucccaccauuuaauuuucagaaucaaaaagauucacugcccaagaaaaucauagcagauuaacuggaaaguuucugggucucuaagugugcauggcuguaguuaucuaucaccgcucaucuaaacuugagcugccauguucauuuacagaaauaagucaccaaggccaccguggaugccaugugguaggaggacagagcucagcagaaggguaaugagcugugugacaggauuaucugccaaucucuguagauucaaaaagaacaucccagagugguuuccccgguuccucuucucuuucucauaucuuccuuuucgcagagaauagaacauuuguuugaauuuggauuuagguuguguuggggguuuuuuguuguuguuguccuugauuuuuguauguuugguuggcugguugguuugguuuuuaggagggaacugggggauuggaggcuuuuuuggguuuuuguuguuguuguuugagauagggucucacuauacagcgcugacuggccuagagcuuucuauguaaaguaggcugcccucgaacucauuggaauccgacugucuuaaagguguagcugcuaagccugucuacucuuccuuuuguucuaucuuucccauacugcuuugcauucuacuuuccucauuagcagucaugacucauuacccccccacacacacacacacauuuuguauuucuuuagacaaaugucuucauuuaaaccuuucaaagauaaggaaaugaaagcugaaguuccagaggugguaaggagaccauuucuaagauggagaacagaacauuucuuuacauuauuauuccuuuauucagugaacacuuauuuucuggaagugucuccucucucuugguccuacccuggaggaacuugcauuguuauaagguaaaauacaaaugaauagauagguaaaacuaugauagauaaacuauguuagaugaugcaagaaugucaguucugaugaacuugcaaauaugaacuuucauauugagaggcaaaaaccaaacuaguaaguagaaugcaaaauaugucaguuuuucagacaugcuaugauuuuuuuaaaaaacuaagcuuaaaaaggaaaauugagaguacaggguuuaauuucagcacucaugagaguucuuaaugaaaugaucauaguuagagggugggaucuauaggaagaaugggaacaagccuuuacuauaucuaggaaaagaccauaccagaaagaccaaagggacgcacaggaugaagacccagagagaggaguguguuuggugaggaaagcagaaaggugaggauggauagagcaagaagaagaggugggaucaugaauguaugcaaaggagcuaagagcucaaggccauuguagugacaccaacuuucauuagaaggaaauaggagacacuaacacggagggagaagugugucacaaucugaacccuccugucugcucggagaaucagaggccuggggaggaggccagcauauaaacagaaggauccaucagaaaagcacccacagucauccuucaggucagccauggugaccaaucagcgcuggagaaagugagaagaagcuuaggcuagauuguaauagucaagaggacgaggagaaccagugacuguuuccuucugagcaauucaaagcggagcuuuuaauguaccgaaccagacgauggcuaaagcuaaaugaguuuggggauggaagauaccaagaguuugaguguguuacaauauuuguuaugccucuuacagauaugaauggagacaggucuugaaagaauggaggagggucuugagaaaaaaccuagaguauaagagucuggucuagagaaaagagcuugggaaccaucagcuuacacaugggguuugaauccagaagacagaaugagaagugaguucuggcugggaaaacaagcagagaaaaaaaagagaugcugucugagaaaugggcuucgacuggcccacuguuugugugcugggguggguacugaaaaagugccaucggagagagugagcaaacaucccuaaggaagguaaauaacgcaggaaagagauauccuggaggugucugugugucaaaugcagcccuggguuacacuagcucaguagagagaacuaacuggcugcugguagacuugaucagaggccuagaccuugauuuauaauaccccaucuuuccuauguaauuugucuaaaauaggagccagccucauguuaaacauguuucucuugguuuauaguagguuuagaggugacuagagcaaacagaaauacaccggaaugucugugguaugauauggaagggccauauuggcagcaucucguugaucaacaucagcacucaugaacauguacacaauguggagccuugauaccacgugaugaaauugucucuuuaucucugagcucuuucuccaagaaagacaucagagauuuuuaugcagggauaguuauaaaauaccugaccaacacuccuccguaguauaaaagccauuaaaaacaaaccaaacaaacacgauaguuggugaagcuaucucagccaggacacaugacaccuaauugucucuccuauccuggauggggucccaaaauugaaagagcgugcaguaaaaaugaaggaagucuggaugaaguuggguuguagauaaugaugguauauuaauguugguucauuaguugugauaaaugugccauacuaauauaagauguuaguaggaauaaugaauauaaguuacuugagaacuuuauacuaacuuacuuuuuucaacuuugugugacuaaaaccucuuuuuaaaaauaaucuguuaaaauguuaucaaagacauuuaugccaugaagaucugcauguggaugauuuauggugagcaugaaaagaugcucaccauaaucuguuauuagagaaaugaaaaucaacaccacacugagauaagccugccugcacaguccaaauaaaaaaggggggggguagaguuggcucuuuggcuaagagcacugacugcuccuccagaugacucagguucaauuccaagcacccacauaguggcucacaaccauuuguaauuccaguuccaaggaacucagugcccucuucuagccucuaugaacaaugcacacucaaggugcaggcauacaugccagcaaaugcccauauacauaaaauaaaaauaauuuuauguuuugauaagaauauagaggaacuagugcuagugggaaaauggaagguacaguggccuugaagaacaguuuaucccuucuucaaaaaguuaaaaauagacuuaucauaugauucagagauucuacccaagagaaaucaaaaauaaaugcacuaaaaaaguuuuacccaaauuuuauaacaguguuaacugaugggugaaugaaaugugaauacauacaauagauauuauguggccauaauaugaaauuuaauauaugaugaaccuuuacacaugaggcuaaauuaaagaagcuggccaugaauggcuacauuguaugugacucugugcgaaauaucaaaaauuggcaaaucuucagagcuagcaguuacuuacuguuuggagcuugugagaaaaugaagauguggacucaggauuucuuuugggaaugaguaacauguucuaaaauagauuuugcagauggcuguacaacucuggauauauuaaaugaucuugaacucuauacuucaaauauggaaauuguaugguagcugaauuauauugcaguaaguuuuuuuuauguugagcuuuaaagcuuuaaaagucccaaaugauuugucauagaaaaugaguagcucaaguuuuauaccacauuaauagagaacuuugucaaggaaauauccuacgcauuuucacauuucccuaaucauccugagaggugaacaaucaaggaagaauuuguaaggaagugaugcauaauuuaaauacuaaguggauuuauccagaguuggggaagagccauucaagcagaaagugagggacccugaaagaugaggucugggggaagugagauccccugugguaagcugugggugccacuuucuugccuauaacucgaaacauccccuucaucauuucccuugcccucacuuaucuccuguuaucauauaccuaaccuauuuuauaucugauuguucaccuugucuacccacaauagaaugggaccuccauaggcaagggcucuuuuuauagcauucacugcaguagccccaacugaguaggaccucaguuguaaauguucucaguuguaaagugauugcugaagguguggucaugauucugcucagagcuagcaggaauaaaaacagauaugggaaguaagacggaguuuaaaaaccagcucaacuuaaguaaugguugaaugucagaggcagaggaacgggaguuaaggaugacccuggagcaucuacacacagaaucagcaaguaagguaggggaacggggaggacugggcuacagugugaggauauguguaagaugccugugggacuucagagcagaugugucuaagacacaacaggaagcuuaacagaaagggugggaguaaacaaacagaccuggggaagcgucagcauggagccauccaaccucggaaaggaaggguccauaggccaagggcaguaagauggugaugcauaaagccagcagagcacagagcacacagccaugcugcuaccugaguagaaaugcuacuuccccugucagugcacagaucagccuccuucaggaugaaugaaagccaugucucuuuuuaagucacccacaucccacgugagcucgccuacccagauucuuccucgagguaccaggagcccagcccagaaacuaaacgugcuaagugggaccccugcuucauccuugaccuuuguacuuugcuaagucuaggaaugcccucggccaugacugagaaugucgaauuccucccuugggggcuguuguguauacuuaucuucuacaggcuuauugcagagggacauuguuuugguuuuuugcaaaaagguuaaguuuuccuggagugaccggggcauagcuugcuauaggauuagcgaugccgugcugccaccuacuggaagcacccacagcugucaggacagaccugugacugaagacuucagugccugggcugaacacugacugcuuccccuugcagacuccuuugcucggccagaaacaaaauauucccugcaucuguuuccgcagucauuuugaaaccagcuuuauccugccaccagucaugucugcccuuccaaucccaaccuuuuuugcaagcuucgcuuuaaagggcuucaucugaccaguuucuguuuggauuuguggucacaugaggccagucuucugccaaacauucuuuuaauaaugaugaccucuagaagcucugagaaggagcuuuaauucagcggugauaauaaagcuagcucugacuccuggcagccaggaaaaacaggcaagugauggguuuuauagcuuuuacugccugauauaaaaaaaagguaccuguuaauaaaagucagugauaaaacaaaaaugaguauaauuugauauccaagaguguuuucuuaaggaccgucuauuacauuauuuaaauaauguuacuuuucuugaauuuaaccuucuuuugacuuugcuacccauuucugccuauaccguuuucuucuggucuugccucucuuaaguuuauuauacuuagaguagaucucauacauugcagaaacuaauuggucucuaauuaaugguuuaauuggggcuuuuuggaugcaggugagcaugccucaccagccugcauagccuccagagcgccugaaaacaaugagaacucauaaucuccccagaaaaaugccugccucuaauuaaggucugaguucuccgagacaugccucacgugugaaggccuuaguuaaauaagauuuccuucuugucgugauagcauacagucaguuucuaacuugggguuccucccaauuccuggcagacaauggaucuguucacuguugcuuauuugcuggcacuggcauugcucagagaauaccauagauggcagaugcuauuaugcaaugaagaucccagggaauagaaaugagaaauaacuugcccaagaucucccaucagauugucuuuauguauccuucggugccucuuuggucucgugcuuaagaaauuaaguuagccuuccgugugaggcuguucuucugccugaaaggacuggguuacauuguucuauguaaaaauuccaagaacuaucacuuauugauuuuaguagaauucuuacugaaaaauuggaagcuggaagcugacccccuucuuguuuuauaaauaaaaguuuaguguugaaacuaacauguuuaaaauucagaaacacagaccaaugagacagcucauccaauaaguggcugaggcaggaguaccugagcucaguccccagaacccguauaaaaauagcugagugugguagcccacacuuguaaucccagcacuggggaagaggagauagguaaauuccugaggcuaaguccaaucccccucacuuaauaagcuccaucuguccaaaaggaaguuagagacaccugaggacugaggcccaaggugguucugaagcccacccacacccuaguuccccaaaauaaagacucugagacuucuuauauaugaauaaaugccuagacccuuuggcuuguuucugcuagcugauaacucagcuauucuguuuaaacuagucugaggccugccacaugguuaaguuuaucucaucucagguucauaugacuggcuuccucaaaguaaaggacaaauuuucccaagccugaccacacauacacacacacacacacacacacacacagaguaccuucugcauuccucugcauugcuuucccccuuuccuaaucugaaaagaccaaacccagaugcugaaaggaagccacauggcauggugagcaaaauggcuuugcucucaagucuucccuaaugugucuuuguaagcuagagcuuucuaauuuucuauauucugaaauugauguuuuaugugcuuaauuuucacauuuuccuauauuuuaauguuuuaugacucauuuuuauuagcacauucucccuccccacauaaucauaaaugucuuauaacuagucaccaggauuguauuuaguuucauuucuggguaucuauaguuuauuauguaguuuauuuucucuucucuuuguaauaggcuuauauaaauugaaaguauuuauaaacauggucuagacuugaaaguauguuuaguauacacgaauuuacauguguuuagagaacauccaucaauaaauacaaauaguuugccaagaaauuauuuuuauaccuagccuuauaguccugugggaauaaauuguuuucucuaaaacaaggguagcuccaaaauagauuugguguaaauuguccauguaugcuaaugaaaauguacuacuaugguaaaaaugagcaugcuuauagcugagcuugauauaugcacuguagcaaaugcuuucuccacguugguucuuugaaauuguguguagauguuacagucacauguugugaauaaaauggaaaauauuuaagagguuaaauaaauucccaguucauaaaauaauagauauaggaucacguauagaucacuggacuucaacaugugaagauaaagcuaucauuugguaaauauaggaucuaucuuuuauauagcaucauuuucaauuaaguucuuaaaauaugaauauauucuuuuccuuuauuuuuucuaguuuuauuugucccacuuauuucuguagauuucugcaggcuaaauauuuuucauuaauuauuccuguaguauguauguaugcauauaaguguauaaauguaacugucuuaguuaggguuuuacugcugugaacagaaagcaugaccaagacaacucuuacaaggaugacauuuaauuggggauggcauacagguucagagagguucuguccauuaucaucaaggcaggaacauagcagcauccaggcagacauaaggcuagagaagcugagaguucuaccucuuguucugaaggcaacuagcagaagacuggcuuccaggcagcuaggacaaggauauuagagcccacucccacaguggcacaccuacuccaacaaggcuccaccuccuaacaguuccacucccugggccaagcauauacaaaccgucugaguccauucaauguugcucauguguauauauuuuuagagcugacuucuugguguuaaagaaccaauuauggggcugguuccuggggaaggcuaauucucccuaucccagcagucacuaauugccugaagaucuagggguggaguccuugugaugucuccccagucugcaucacauaucaacugguguucaggucuuguuuaggcuccauauuguugauauauuaagggugcagcuuuucuguccuauacagaagacagccucucagcagacauccucuggcccuuacaucuuucugccccuucuuccuugauguccccugagccuuggguauugggcuuguaguguagaugugucaacuagggcugagcacccccccccccagucauuugcucuuugcaguuugaccaauuaugacuugcuauaauggucucuaucugcugcaaaaagaaacuuuuugaugagggaugagagaguuucauuuaucuguugguauauggacaaguuuuuagaaucaaguuacagauccuacugguaauuuuaaauaacuuuccauuacaguuuaaagagaguuccacagaaaaauauuuuaauacccuggccucacaggguuagcuuugcucaaccuucuuauacugccuucucaaaugccugucauagaguaacgcuugcuuauagcccuagaccaugcuucagagccauagcacagauuagagccagugauugaucauccauucuccugacaaacucuagcuuugcucccaaauucuuaugcaugcauugcuaagacaacaagcagcauagcaagugguucccaaaggcgagagaauauacagguuuccuggggugaugucuuacaagggaagucuuuuagcucuaucccuaaaaauucuuagaugauugggaguuugccuaggcauauaugugcagcuugacaggcgcccuggagauccccaugugggcagcucauggagagucuaggagacaaacugaccuuaccucacaucuuuugaaacccauacaguauccuacuaucagagcuacacucuguucuuguuuaaggcuugcucauguucucuccccucuccccucuccccucuccccucuccccucuccccucuccccuucccucuccccuucccucuccacuucccucucccucucccucucccucucccucucucucucucucucucucucucucucucucucucucuccuucuauccuucccuuucucucucccuuccucccucccucuucuuuccuuccccuccccaacuacuguagccaaagaagucacaaugacuaaaauguuaacuggaugucuagccaacauuucaguuuuucugguauuucggaggacggggauuggugcucaggauugcacccaaggcuucucacauucaacaguuuuucacuuugaguaacauacucagucaugugccugagaugcagagcacuacugcagaacagaggugcuguaucaugagucuccccagcuagaggugaauguaaauguuuugagcacaguaaaggcuggcuaagcuaagugagcuaugacaagccauugguuagauagaguaaaugcaugugcauuguacaguauuuacaacuaacaguggacucgggacauaacucugucacaagaaaagauguguauauuucauuuguguagaugaccagcaaauuuagcccuuaaucauuauaugaccuuguuggcaucagugggaggagaggccuuuggguguucgaugccccaguguaggggaaugcuaggguaggaagacagggguggguggguggaggagcacccucauagaggcaggggaggggaugggauagggaguuucugaaggggagaucuggaaaggggaaaacauuugaaauguaaauaaagaaaaaaauguaauaaaaagaauucauaugaacuugagcgagugaacuucacuaguuuggcugaaguucucccuaccucuaaaaugauuuuagcuagaagaucaguagccacaugcugccaugccagaaaugggauccagaggacugguguucuauuuccaucugcagugcucaaaagaaaaagaaaggaaacaguccaugcuaaucuauuuccauaaggaaaccaaagauuucugagaguacacuucuccaugggcccuccagauaaugcauguuugaaugaaugaaugaaugaaugaaugaggaaacaaguuguauagggcucuuucuaaucauagucaaaaucaugccuguagcacuuacucauaauacuagcagaagagcaagacagaugauagaagcuagcuccugccugugcaugaccuauaaaggucuuaguagacuccaaacaguaauugacaaaauaaacauguggauacucaaaaacauaaaugucaccuccaccggagcucuucaucugcugugcugugcauugccaguugauggaaaggcuuuauucagaucagccauugcacuuuuucccggggggcauucuuaaucuuuguguucuaaccuuuaaagacacaggcuucgguugcugcuguaaugauuucuguugccuggcaucugcauguucagauuccuccaaagagcugugccuucuauuuuccucuacugcaaauggagcggaaugagaaaaauccaaguggggguaggagaggccagccuuugauugacuucucucucuugauacuccaaguugggaggagggaucaauggccgaaacuuucacagaccugagcacugcaucucauucuccucuaggcuaucuauuccauagagaagcugauuaaauauuuuggaaguauugggauugaggaagagggaagcuggggauuuuuaguggcuagagccuuuuauugacaacauuaaaggcuucaugauauauucgaccagaaauuaauuacagcccaguuccccauuucucccuuaggugacagucuucuguugaugugugccgcugugaaaguaauaauagguuucaaauguuugugagaaacauaaaguaauuacuugcugugguaaaucagucauuugaagccucagcuucccucugcuccguguauguggcagucugucuguuuucuuuuguuaacuuuaauuaugggguagaggaaaaaaaaauuuuuuuucggaaauuugaacuuuuuuuccacuucuugguuucuuaguucuccggggacauaaguauggaaauaguaaugacacauaaguagcauuucagcaagauaagcauaugucuacuggggagcugauugccuuaguuaaaagcuuuaccuacuggccagcagcuauuggccagguccccuaaugagccuccaguauuuaccgugugcugugcagagguguguuuugggucucaggaguuuaaggcuccuucucaccagcagcacaggcugaaaugcugggaucuaagccacagccuaagccuccccacccgcuuugaaugagaaauaauacauuucccagcaguaccugcagcuucuuccuucaggcaccuuuauuccagcaagaccauacagagcagccuggaaaauccuggcccucuguuugcucaccugggcaaggaguaagauuucuuuugccugccaaccaucaauaggaguccucccaaggcagaugcaucacggggaguucacacuaaccaacauaaugcaucagcacaugguggcauccgucggcuuguacuaaaguggccaaccccuaaaaguaagaacuguaaauauucacaucuucucaaugaaccuucauaguacgcuuuccugcucaguccgaucuguccugcuguuggcaguucggagguuugccuugucuccuagaccaugcccguucccucugugaagccguuaagcuuaucuucuuucuaaugcuaaucucuuucuugggucacuguuuauguucagaaacaugaaaacagaaucgugcugacuggaaguaugacgccuuucccugcagugacaauuagagcauauguuguuuucccucaaguguagaagacccucucugucaucaaggaaggaagggcacgcuacauggagauaguugauucauugaguaguauuuccuguauucucucaguguguuagcgugacaccccagcauaggcaguaucugcuuacauccuuccuucauacucuaucauccuucauucuacaucauggagugccucuaccucugucaaagcaucccaaguuuucuguaagccuggauaggaacaacaaauugcuuaaaauaaguguuugauuugauuuuguuacuucacuacuauuaguaacaguaauuaagcacauucuuuguguaaggcacccuacuuaugugauuacauguacuaucucagugaagcccacacuaaccuagugugcuuaaggcauagcauuuucuuccugcaaaugggaaaaccaagucucugaaagaguagcacuggaucuacacuagugguagauggcaggaccaugauucagugacaagucucucugcagcuuggucauguuauauggcuuauagugacauacagcauuauuucaaaaagauauaccauagccaugaugcuuuuacugacucuauuaaaacaugacgggguauuccuagagcuuaagggagguguguagcagccuuuucucaucccugagagaaacuggcaagagguaaugggugagaggguacugagcuuuggaagugucugagaggucaucucaaaagcagcuugccugaggugggaagacccacuguggauagaggcaacgccauuguacagacuggacagcaggagagccauaagaagcaucagcacuuacgcucucuccccuuuacugugaaggcaauauaaccagccacccccccacuucugucgccaucccuuccccagugugaugggauguacccucaaacugugaacaaaaauaaaccccucuuuaaguugcuuugucauggaccugucccugcaaugagaaaaauaucucauucaaggguaaacaaaacacauccaaaagauuaugagaaaggccagucuugaggcgaucaccaucacugauggaucgaaugagacaggaagaggugugagacuuccagaaaagccuggcacugcagcagcaucagacagcguccaagucggggagaaaacugggccaggcagucugaagaaagugaggcuacaaccaagagcaauucccaaagaaucagaaaacucuagcauaugguggucauggugacagcugagauucucacagacucuaggauguuaggcucacaaggagcugugucuuuuuguuauaucaauagaaaaccaagucuuuuuuaaaagaaaaaugcuacauaugauugacagaugucauuuugacuaccuaguuucuaaaucuauuuagagaguuccuuagugccuggguucggaagggguuugccuuccaucauaagaagucuagaaaucaaugucuggacccuuuguggaggccaggcuagaccugacuuugggaugccaacauccaguucuggcugcugaagacauagcauucuguguuuccagcggcagugcugccuccauggaaccaacuuugaagaauuuuuaggcgacugagucaugauucuagcugcugccuggaugacuugcuccugcucacuuccuauguucuauucucuuggaaguaugaguugcccaauguccuuucaacaaucccuucucuguaacugaggacuccugacagagacacacauauauacauguccaggcuucccauaucauggauugcuauuaaagcucugauccuaucccuuuucuucaucuuggucaacucuauaaauacccuuauacauaacuaucaagaauuuucuuuuuuuuuaagagcagaccugacugaauuauacucauaauucagucccaaccaaaaccuacuuauuuaaucuacacauuuauuccugcugucuauaucuguauaagaaaccaccccauuacccagacccuaaaacagccacugauauucauucucuugaaauagcagccccccgagguucaacuaugagcuucuuugguagacagucuuggucucucuguagucuguaguugaugucagccaggcuaaaaugucuaggguggcuuaccucccaggcaugcugacgagcuggggcuagcuagaguaccaggcucagcgggggugcaggauccuuaggucuaugaucccuuuacauugucucacaaugcccccuucucaauguaacuuucacaugucacucuuagggcaucacacacaugacaacaugagacucugaaagcaugacacagaagcuccuuuaucgggcucggacacaggaccugcacagaaucacuucuaacauuccaagucacggagcuugccagguuugacauagcagaggauuaaaggcaggcauaaugguaggaagcauggcucguuagggcuuaucuuuggaugagcuccagguuaaauacacuuagcucagccugauauaguuagaccuauccaaugucuuugucaagacucuguccguuucauggaauagaaaccuaauucaaagacccuuaauccagaaggggaaaaaauguacuggaucaugaaacugagacuuacaugaaauaguugguuuuagacuugcuuuuaucccaggauucuaacuguaucagccagacuccuuuucucccugcagcucaugcguucauuugaauugacuuagcuguaccacauagccugucucccaguaguagcaaaauaguagcugaaaugcauugaauaugcauagcuagaacuucaaauuguuaccuuuucucuccuagccggauagagcaaaucucagagagacuuuucccucucugcguccaugugugaacaaguggcuagagucaggagagguaugcacugugauggggcugucugaguuccuguccaccucugauguggagaucugaugagucuagccuggaccucagagaacuugcuccaaagauaaggucaguuacccaucaguuacccaaucaagaagggacaaugccagguacacaggaagcagaaaugaagcaacccccaggagcaguuugcugcauggauacaguuuaaucaggaaauaacacugaaguguagacagacacuucaaaacaaucacauuauagagaggcauuuuuauggaaagagagaggaugccgaggaccuuauucaggguagacugaaauaauucagggacauguugaagaagccugucuugagcuguacuugaaaguuaacauucaaaaagagagagaauaaaauggacagaggagaggcugaaagugugaguuucccaguuucaguuauaauucuucucuacaacugggaccgugacuguuacauaugacacacaacacaagcccaucguggcauauuaugcauuuugaggaaagcuuucuccuuaugcuauuaaaaugaauuuacuaaguguaauuuggggauuucuuuaucugccuucccaacacuagaccuguaagaaaaaucaagaguuggucgauuauggcauguuauaugguauuguuucaggcucaguccacuccaagaaacauaaaauuaacccugaaugugacaagugaguguuugaggguuugagaggcccauacaaauguaaaguggugauugcugucaaaggagagccuuucucagauguguauucauuuuguccucugacacuuuggcuaacaacauauacuuaaauuaccagaaauaauaguuuccuguguuauaucccuccugagaagcuuaaggcuaucaggaauaugaauuaauuuaacaccucuucugagguaagaaaguaaaaugguaaacacugcucaccuccccacccucccccuuucuuucucccucuccaccaaaagaucuuguuuuccaaguauugcugcauuuauuuuauacugauuuuuuuuuucaguaaaaggaguuuuuguuucucuuucuacucggguaucuuuuucuucuauacaaucugcuuuuguggcuuagaaaauguuugucucuuuuuuaauaaauaaauauauguuuauggguagguagguagguagguguuuuaccuacauauguuuguguaccacaugcauucgugacuaaaagaccaaagaccagaagaagaugccagauccccuaauacuggaguuacagaugguuacaaacagccauguggguucugagaauugaacacagguuucccagaagaaaacccaguguuccuaacugcugggccaucauugcagccccucaauuuguuccuuuucagugaggacucuuuuuuuuuuuuuuuuuuuuuuuuuuuuuuuuugucuuguuguggcaggggaacucuagugugaguuacugccaccauuaaguugaaaaaaauaaucuuaaauuccauuuagaaaaacaaaacacaaaaaacaaacaaacaaaaaagcaggguagccaagcaaccuugaacaacaaaagaacugcuggagauagcaucauccaggguuuuuaguucuacuacagagcuguaaauguaaaagcaguguaaugauggcaaaagaacagauauauuacucagugcacuggaacugaggacccaguuauaagucuaccaccuguggccaccugguuuuugacaaagaagucaacauuacacacaggagaaaagacagcaucuucaacaaaugaugcuagucaaacuguauagcuacacguaguagaaugaaacuagauccugaucucucagccugcacaaaccucgcuuccaaauggaucaaagaccugauacccugaaucugauggaggagaaagaaaggaacuauguaugugucuuagucaggguuucuauuccugcacaaacaucaugaccaagaagcaaguuggggaggaaaggguuuauucagcuuacucuuccacauugcuguucaucacuaaaggaagucaggacuggaacucaagcaggucaggaagcaggagcugucauagaggccacggagggguguuucuuacuaacuugccuccccuggcuugcucagccugcucucuuauagaaccaagacuaccagcccagagauggucccacccacaaggggaccuccccccuugaucacuaauugagacauugccuuacagcuggauucauggaggcauuuccccaaaugaagcuccuuucucugugauaacuccagccugugucaaauugacacaaaacuagccaguacauuaugcuucaacauacaagcaugacaaagauuuuuaggacccugcuagcauaggcauuuaagaccaacaaaugacaaaugggaccacaugaaacuaaauaaauagcugcuguacagccaaguacacuauauuucaaagaaacaagcaaacuacaaucuuugccagccauacagaggauuaguaucgacaguauacaaagaacucaaaaaacuaaacaccaagaaagcaaaagucccaauuuacaaauaaggcauagaccuaaacauagaguucucaaaagaaggaagacaaaugguugagggagauuuaaaaugauauucaauauuuuuagccaucaggaaaguguaaauuaaaacuacuuugauguccaauuaggccauccucugcugcauaugcagcuggagccaugagucccaacaugugugcucuuugguuggugguuuagucccugggagcucuggggguacugguuaguucauauuguuguuccuccuauggggcugcaaaccccuucagcuccuuguguccucucucuagcuccuucauugaggauccuauguucaguccaaaggauggcugugagcauccaccucuguauuuugaggcacuggcagagccucucaggagacagcuauaucaggcuccugucagcaagcucuuguugguauccacaauagugucuggguuuagugauuauaaaugggauggauccccaggugacccagugugggggaaugccagggccagggagagagaguggguggguuggugagcagggggaagggacagggggaggguuguuuucggagggaaaaccaggaaaggggauaacauuugaaauguaaauaaagaaaauauccaauuaaaaaaaaaaacuacuuugaaauuucaucuuccccuggauaggaugaccaagaucaaagaaacagaugacaauagaugcuggcuagaugugggaaaggggaguguauauucacugaugcuagauagaugugggaaaggggaguguauauucacugaugcuagauagaugugggaaaggggaguguauauucacugaugcuggauagaugugggaaaggggaguguauauucacugaugcuagauagaugugggaaaggggaguguauauucacuggugcuggcuagauguggaaaaggggaguguauauucacugaugcuagauagaugugggaaaggggaguguauauucacugaugcuggauagaugugggaaaggggaguguauauucacuggugcugggagugcagacuggugcagcugcugguucauuuuccccucuuagucuggaucuugguacguagguugguacugccaauauucaggauggugccuuggacuagcagaucauacauuaaugacacguuccugagaaugagaaccaggagaucagaaagauagaagauaaauaacuuuaggauuaugaggucuggcauaagcuauaucuuauaccaagcaagcuuauuuaaaaaguacaguagccagguggugguggugguagcaacacaccuuuaaucccagcaguagggaggcagaagcaggcauaucucugaguuugagaccagcuuggucuacagagugaauucugggacaaccagggcuauauaaaauaacccugucucaaagaagaagaggaggagagggaggaggagaagaaggagggagggaaggaggaagaagaagggagaagagcaugcacucccaacaucagugaauaaacacaccccuuucucaugucuauccagcaucuauauacuauuucuaaggcagaaauaagacaaacccugcagaaacuaucauacaauggaacuaaguuagugagaagcuaaucaaacaacuuuacauaaggggaacacuugguuucucaagagcaucuuagacagagcacauaaacacccuugggacuccuaguuuuagagauagaacuguguuccuucucuauacaucagguuccgcagagaaagccuuagucagucguucagccuucacagacaguuuuccuccucggaggaaaacccucagaggcguaccucaagguaugucuccucaaugacucaguaaauccaaucaaguugauaaugaagauuaaacaccacagguuccuaagaaugacgugguaaccacuaucaugugacccuucccuaguacaagacuaguuaguuucuuuuauacaaccagaaacuccugcauggugauaauugugacuucuauuugcucucuacacauaccccuguccuuguuacuaaguaaauguaggcagaguguuaguuuuauuagcuagcaguugauauugauaugacccuguucucucuccuggcuauaaauaucuguucugccuacaucaauuugaaucuuuuucccccuaaggaaauuaacauggaaacuguagcacaauuaauuacaucuaaauucuacuaaacuacaagucaaaacaaauacaagaacugggguuauauaaggauaggagaucauaggaaagaauucuuuccagggaaauaaugugaaauccugcgcagagguagaaagugacuugauucugaaguuguugcccaugagcacaugagugcugucaccuaacucauccggugauaaccuggcaccagucuccugucuccaguuaucauuucuccccaagggagaagguucuaaucuugcacucccaaguauaugaucauaauguagauucuaaaugccaggauaagagaggaucuauguaucuccuaucaguccaaagaaguccuaggguuuaucugcaaacucuuacuuucucucaggucuaaacuagacaccuucugauugccauaaaagauuauucuggguuagccaaucuaauguguagauauaaagaggcuccugaggccccuucagcagucuucuggauaacucagagggacuagaaggaagcuaaccucaugaccacaggauacucuugauaguuuuguuacuacacuaaggggaagacauuguaccuagaucaaggcauucauuuucugugaagagauaauguaaccucauuaaauauaguguguucucuguaccccugcacuggcuauacaguaggcuuucccuggcuuucccuuacugguagagccuguugaguuagccuguucucuaguuuuacaucuugggaaccaucuaucauuaggagcuucuuaacacaaaucugucuaauagacagagcuaaguaaaaccagcuuaugccaaugacuucagcaucugaagcaauucccagaaaacucacuuguuugggguggauaggacauaucagcuagggguuagucauucccuucauaaaacugucuauugaugguauauaaaagucacuuaauucuuggaguuagaaagauggauauaugaccccugcuuauccacaguaaggugagcacauagugagcaguaaugugaagaguuagaauuuuaagaacaaaguagauaaaguacagcucagacaauucacucucaggugugcacccaagagaacuguaaccagaaacaucuguacacuuagaaccgcacucuucacaguagccaaaugugaaaaccagccauauguccaucugugguaaaaguagacuuucauauauaacauagccauacaucacaauuuguggugugauaagacugaaucacuaauagauucuguaugcacaugaaggauuuaugaaauauuauucuaaaugaguuuuuaaagagacuacaugucuccaauuauaaaaagaccagaauaggaaacaccguguaggagacagaaaguaaacuagugcuugcauagggcuuguugggaacuggaggcagggugaugaagaauacaggauuucuuuuuaagaaaauaaaaauguaaaauucacuguggugauaagcccacauacuuuaaauauggaaaccccugguguauggaauaccugagauggggagugguguguuaggaaaaguuuaucuugauaaagcugauuaccuggaaaaaacaaaaggaacagaaacugagagugauuagcaacuauucugccccacucccacccugcagagaguuggggaggggagcacaaaccugcauuguugaggcaaggcaggcagagucuggaaaugagggaaucuuuucaggaauccugguaaggucgguacuauuguuguagagcuaauuaggacagugcaacuuacagcuaaaggaagagugcuuugaacuugggagaguggggcggcugucccuaguucaaagucugaugggcagcuccucaaagcuggaaaacugucucacacuagaacgggaaauccuauuugcaaaugaaggaauucuccccuguaugacuagcuccaucaaauucaaggugcugaggaagugugauggaauuccuuuguuuccuguuugcaaugcuuuguguuguacguuuucaucuguugcugaaucucucagcuaucuauggucauuuuaacaagugaguuuauaggcauggcauaaaaugcucugugcgugaucccccagugaccacagcauucugggaauauggucuaggacucuuuaucgccaccgacaacaacaaagaacauauccugcuacagacacugacuuuccuagaaaaaaguuaacucucugaaagguaaggcuggggauuggcaauacagagauagaaacaaaggcuuccuaggucuuuugccuuugaaaucagaaaacggcuccuugacagagagcauauuugaacuugcugaagucuuucuuuauaaccacaucaccucgaaagcaauaucuuauguauagaaagcaauuuugcucuauuacauuaaggcauuaggcauguguggccugugucugucagcacuuucuccuguggcuacagcugcugucacugcccagugacugucucagugucugaggcucccagcccagucucacuguuuguggcugucaucaccaucacauacaagcuguugccccugccaccgccuuccugcugcuaauggggcugacuggcaccucuccaugccacaucaaggugcagauguugucacccugccaggcucagagccaucuaacacccucuccuggcagaauucauuaucacuuucccagaaaggauaggaugccagcuaagaccagccuagccugagcucaccagccuuuugguggggggacuaugguagucaccuugcuaccugugcaaucugguagcugucaaugagacagcaccuagggacuuacagaauccugcauguuuaagaguuuaccauagacuaccacagugggcccaacagucucuuuaguuucuggaaugaaaagcuauucuguguagcuucaauagccucuuccuccucccaguguggccacuuaggucccacagguaaguaguaucuuuccuccuuuagcacuauuugggaaguuacugccaauuuggaacucuagccagagcuaugcagugagacaccgucuugggaggggggagugugugugucauaugacagugucucacaugacacuuuugacaaugccuacaagguccgcauuaaugucagguacccugugguagacugcacagccagacaggaaugaaucacaagugaaaacaaacaggaaauggguuuccacugaaccagagacagagacauauuccugaaacccagagcacuggagcccuggagaugugaacacaugcaaagcuuaccaacacaagacagaaaggaaaacagugagaguggaaagaaagaccgugauacugcuucccucccuucacaaagauuacaacauuuacugugaagguuccauguuaggaaauacauagagagcaucagcacuccagaauacauaaccuucuaaugcaagauugaagaaaacaacggccagacaguuggaaucccagcuguucccccagagaacuccaccuaugggcaccuuucacaccacucccauugcccucccaggcacaggagcacugaucauguccugcuagggaacuaacaaucaaaugcguguucaagcaaaaaaaaaaaaaaaaaaaaaaaaaaaaaagcaaaaaaaaaaacacaaaaaacaaaaaacaaaagaaagaaagaaaauagcagugagacucagucgauccuggacaaaccuggacaaacagugaagucaggaccaugaggcaacucagagaugaaccugucacagcuggaaaagaaggaugcagcucccuugggaaagucugggguagugggggacacccaaaaauagauacugcuacuaaggggcuaaaaggaagcaagaucugauaaauauaaguaauauaagaaaaagaacgcaggauuggaaauguucaaaggaaaaacuaaucauucguguaaaacaauuuuuuguaauaauugccuuugagggacuuagggauuguuucuguccaugaagaaauaaggccuuacccugugccuucccagcacuaaccgguaauuguguacauggugacaucaguccguugguuucucaugaauccucaugcacacaaggcauagcagacucugcugugcucccacaacaauguggaauguucaccuucacacagcaaggacagguaagacugggaaaacaucugggcaguuacaggugaaaugauuuaaauguccaagaauagcaucuucacacuaacccaugacauaccgaaagagcucgaugucauggccaaccccgaucuuccuccucuguuaggaugcuuucuuuacauuguucuccugcuuuauuuuucucauaugggagcaugaugugccugcauguaugucugugcacuguguagagagaccguagaggccagaaguaucagauccucugggagugaaauuacaaaugguggcacgcuuacauauaggugcugggacccaaucuagaucauccacaucucuccagccccuauauggaugcucucacugcauguagcagagacccugacuugaaacugggcucagugugcugcccaugcuguccucacucuccagaugauguuucaaccuaccucagucuugagggccugaguacuguccuauaccaccaaccugacuaaaauguguauuucaaaaauagauauuuccucuccuauaguuugcagccccaaaauaggcuggccugaaggucugguaacucacuguccuguugaugucauuaaagaagcaagcucaugcaucccccugcucuuccaccuucugggcacguugccuucauccccgaagcuccuucugcagucugaggcuagcuacugaguacucaaguggcccaaaacacaucucaugcaagaggaaugguuccuuuucuguuuuauuuuggccaagaaggaaacauuuuuagcaguuccucagcugacgucuuguggcucuuacuggucaaaauuguaucacaugcacacccuaauccaucugcucacacaaauggaagaugccuucucaaaggcaguccgaagcagacugcauuuggugggaggucccugggaacagcgaugucuaccucagcaugacuguaaggucuguacauguugucuauuaaucucaugcucauggcugauuaguguucgagccagcagauccauuggggaaaaaauguugucaguguuauccucguacucaauuacagaacuaaugcagaauaaagaggccacuggccagcgucuagucucuuugcucagaaauucucccuuggaauacaaguuaaugcgucaacucagcauccucagagcuuccaaaagauuuuuucccuuugagcaauuauuuguauauaauucauauaugcuaaaguaucuuauucuguaaucugucauuuuuuugcauauuauauagaugcugcagggauagauugugugcuguuuacacaguccugguguuugaacccgggccccugcaugugcuaguagcugcauaaccaacagaaguuucuuaagcaucuauuacuucuuuuccuucucuauggcuuggagguacuuuguuuauacucuaggcaaaucaugagcuuuaaaacugcaguagaaaacaguacagugggcuggagagaugacuccguguuuaagaacauaggcagucuuccagaggacccggauuccaauucucagcacccacaugguggcuaacccagcuguaccuccaguuucaggggauaugacacccucuucuggcaacugugagaacugcacaagcaugcuauacagacauacaugcaggcagaagacucauaaaauacaaucuuuucuuuuuuaaaagaagauuuuuaaaaaaauaguauauauacaaggaggaggugauucacuuuccagccuccuuccuauuguaaugugcaggggauuagcccuugguucccuaguuuuuguaauuuuauagaaggcugauauuaucggaaaguaagucaaauuaggggcuaggcagcggaauuuaacucucauugaaacaugaauguagcaacaagaagggagaugaaagcagcaaggauaaagaccaaagggaggagguacccaugcuuuugagugugugucucagucaaaggacaggcugcucucgcugugugcccugagcuggacccugcagagccccucugaagaugcuacaguggaauggcuuccucccggaaggagaucagggcagcuuuaugucuucaccgaaacacuuugaauuauaaaaagaaaucagaggaucaaaagaugcaagaugguggauaaaauauguuauaagauuauaacucaauaaucauugauuuuucuagcauuuucuccuggcagagagguacagagcaucuuaguuauuuagcacaucuguugguugagacgagugccuagugcugguuucugcccuuuuucucaccccaccgagacugagcuaagcagcagcgcugcggcccugguaccugcagcuuuaugaauguugccaccaacacuugggcacaauucagaaguggacuguccccaucccuccuccagagcuuuccugguccccagacucagcuuccugguuucuucacugccuguguucagacgagaagcucuggcuucaaucuguugagcagugccacagcagaacaguacaggguguccugacucaccugcugaucggaaucaagggaacucuucucaaagugccuagaacaucaaguaagaaggaacugaagagucucugucugccuucaaaagguccaggugggagugggaaucggugcaauugacuccguuagccugccugcugucaccacacaguggucccagcucccacaguacugacuggagaggcguucacucaccgggaacaggagggcugucugcauuggugcaaucuaggcagacugcugaaccuccacagggcagacuugggacuuuaacaugcagucugaugggcuggagccugggacuucucguaugaaaaagcuaguaagaacaauaaaaguuuuaaucuuguaauaguuccgggaugugcuaagcacuacagaauagaaauauuuccccaacugcuauaccaaucucugggaaccucuguugauauuccuucucucugagaaccccuguauguagucagguauuggccucucugguuugcuuuauguccuuuaaaucgccuuaaaguaccacccuguuauguggauaaguuaauagcuaugagaaaucauugauaacacauuaacuuuauucucucugagcuccucaucugacaucucuuuccagguccuggucucauagcucacacucaccucuaugcuaggcuuccucugcuuccugcccuguguuucucugcuguacuccaugccccacagacccucauagcauucagguaaccaucugugccugcuucuccaccauaacuaggagcucuuccaugaccugugcauuguucacugaacaaagucuuccuagggcuugagagggucugcauaugcgagcacugagaaacaagaugauugcagccagcaugcucaaagcauugggcauguaaucaagauccaugcaaguauacuauaaacccaguaugucauguucgccccuuauguuccugggcaagaacugcccaccuuuauauuuuuacacccuuauauuuucuucuagccuagacaaaaccccacauaaucagaaauagaaguuagacuauacaaccuaaggccuaaauaacggacaagaagauggaucuggggagauaacuuaguugauuauuaaguacuuaccuuucaaguauagggaccugaauucaauccuagagccuauguagaaaugcugccauguuagagcaugcuuauaauuguagucaagaagacagaaacagguauaucccugcacacauaccugcacucaggaauguacacacaaccagagacacagaaagguuagauaggaagauggguuauaagcuuauaugcacuaugguugcacauuguguagaaaagagugugugaaggcaugcacacauaaacaugcaauccuuagagagcauggaaggcccucaggagccuauaaaacaucuggugagcagaucaaaaucucucuauauacaugugaguuuuuuuuuucuucucugacaagauaucugugcuuuuagaaauuuuucaaaugaugcuauaggauccuaaaucucuucucuucagccaucucuguucacucucauacuuaccuuugagaucaaacagcuaggaucagagaauguagccacaggcgugauaaaguaaugcagccuuccccggccugguagugugccuuggggcucccccaucagagccccccauuuggcugaccucaccucuccagccuuucaugccauuuugcuuggcugucccaugagaagggacguaggugagcuggagcugcagagccccagggcucucgcucccuggagggcuuaggacaaaggaguccaaggucuucucuccuuaaacaaguccccaugucuaacuuugccaguacccugcuuugaggagaggagucuugccaguuccugcuacuccuccaucauccuuacauaguccucacccagguuuucagcucuuacuaagagacugaagguuuauucccucugauuuugcuucucuguaauagcagcuucgaaaucugccagaacugagccugguuccaaccugaucuuucaauuucaccugacauuacacgagucacuaacaccuccauggacugucuucugacucacacuuacucuuccucuaagcaguucucaugucugucccuguuacuguccaugccuccacugcucugucauauccagaguaaagcaucuuucggcugagguucacacuuccauucucuuccccucagccauccuaugaaugaguugggauaauuauacccacaucucuucaacuaacuuuuuggcucaguucuuagaguaacauguuuauacuguaacuagcccauauuuuuugcacuuaaccagauggcuucucucauaucugcccuggacucuccuguuccugugacuuaugguccauccuccauccuuuguucucccugguugaaugacuuacucuuaaauuucuauccuccaauacaucuggaaguccuuacucuccccugaaaugguugaccaguucacuuuucuguucucugaggucauuaacauauuacuugcaucucccauauaaugcuuccauauggccuaugguagguauuuaauaaagcaaucaucauuugaaagauaaguuagaaucuacaaugacaaauauaugucuugggaaaaguucuaauaacaaaggcaaagucaucagcgcacacauuauuacuaaaggguaguaauucugagugcagugaaauguacuuguaaucauauuauugucaauguuuguauaugucaaccaagaaaaagauaugagccaugcguaaggcuagcacuuuuaagaugcacccaauucaauauggaacugccugagcauaauaccauuauugauaaaauuacaugguccauaugguuggcucuuuaauugagcaguuauuugccauagacugcaggaggccuacucuuugcugaccuguuaaaggcaacggaacgagcuguguaccauuacccucugugaaagcagaagcgccugucuucuuuccccuccccauccugacagugaaugccacccacuuugcauauguccaccucugccugugauuaugucaucagauguuuguggaugguuuuacucuaguugguccuaagagagaauuuugccauugugauuguccaugaaggacaauauaaacugcuuuaguuggcaaagauauaugucaucuuuauuugcuguguguugaauugcugacucuucuuuagauccaguggucauuuuccaacucuuuaauuuaugcaugagucaaaaagaaaaaaaaauuuacugaauauuuuuaacaaaauagcauaagguuuagauaauuuuuuauuauacucaguaaaaaugcaaauguguguggcuuauuugcaaaugcaggcauuaauaacugauauuuaaguaggcuagauuagcaauuuuacugauauauuucagagauuuuuuccaauaauuugcacacucaaaaucaauuugaauauaacauguaaauugaauuuaauuuuuugauauaaaauuguaguuaucagcuugaaccauuaaauuuacuguuuaauauaugcuuuccagcucacuugguagaauuucauugcgccuuaucuauauaaauuuaauuaggcuugauaucaucaguauauuauagaacuaauuaaagauuuagauaagugcugaggggacuuauugaaaacuccauaaaguuccauuuggaaaaugagauauuccuccuccagucauugugaggggaggaaacagcaagaaguaucucuggugguauuucugaaaaauuauuuaacuggauuuaauggacuuauucuauucuuugaagagcuuuuuaauuacucuguaucuguguuuaguccaacaacagcuacagucuucauuuaaaggcuuuaaaaauccucaucccccugcugccucaaggcagcuaucugugggcaugcaugagcauguguguuugagagugcauaugcgcacacaaguguguauacauauacuaguagacagaauagggcaagagauugugaucacagagucuauggugguauuuacugagaagugcucacaaagagacuaaaacagaaagaucagagugcacccgccucaaacaugcuggggaaggagaacagguaagcauccagcccaauccggaaaacgagaugagaaacccuggcaaaucuugcaugcccacuuauugauucugcuauucugggugaaucguguuguagaaaccacuuuugaauuccccuguaucugcaucucugcaauagagucgaaagcagauuaguuuaaaagacugugauuuccacuaagugcuuugugucuucauuacaaagcauaauaaagcuuuuuauuacaaugaagcugccauuacauccaauugaauagacacugaaauaaagcugccucacccacauuucccagcacacucugugcucuguguucuugucaaagcugugugugugugugugugugugugugugugcucgcgcgcgagugugugcucacgcauguuccuguaccaacugagugacacaaugcauacuagaaaaauaaaguagaagaacaaauaacaaauggaggcugccugcaaccuggcacacugucguuuaguacagaggcccugaggaaugcagggaagcagauaaauugcugugaacccgugugguguaauggaaggguacaggcuucgggcucaggaugcagauuuaaauaaaguccaaccucaugcugaugagcugugugacccagggccucaucucucccgcucccucugcauaaauugcacuuccuggaacauggaaauacuauuaauaauguugcccuuucuuccuucuccuccccuccuauggcuuacagcaguuuugagaugccaucaguuguagccuaauucaguuaguuuuccagaaauggaaacugagguacgaugggauugaacagcgagaucacgauucccaacuaguaguaaaacaaggacuggaagagacaccaugggaaugucccagugccuguacugccacacggaaugugagagaacagacagacagaccuuaaggacauccuggcuacacugcugagaguuuuuccccucaagcgacaguuucugaacacuugccccuccaccccccaccccccacgccccaccccccacacacacacacaguuuuucugcccaaaugguuuacaaacauucacacacacccagccugagaugugcucuguagaaacauuugggucacaaacuaauguuuguuucaucacaucugaaauguuucucucugaaaaacauuacaagugagcgccaggaaagcaggcuucuaacagaagcgucagugugaagugaggguacacucacacacuuacuuuagaacauccaagguguaauugucugcugcugacccauaagagauguagggugucacccagugucaccuuccauguugguguucuuugacuuaaaacuuuaaaagcuguagugaguggugcuguggucuugaguggucuucuccuccagguaggaauuuauugagaaggaagugggagcguugcguuugggaaacaggccagagcugugucacugaaagggacaggcagagguuucuuuguuguguccuucccacacuccucucagugacuccuguaguguugaugugaaauacugaucuaacgauggcgccuggucucaucauggaaccagcaacuugaagucuaggcagaguaggucgaauccuauuucugacccauggauaacuuuaacucauccugccacuggauggagcggguuggaaaagaggcuaaaaagaguguuugcucuggagaccuccucuccagcuucuuuccuuguagcuuuccucucugacauagaggucaugugagcaacguguguuugacagagagauaacaaagaggugacauacuuccugucaucgacugugacauguagucuacuacacaauggacggcgacagccucugauaacauucuguauauuuucuuaaagcauuacaaauugaggcuguggcuauaaaggcugcaagcauaaaggaaauuagacaaacagucccaucucugucugaccuuugguucggacuucuuuuccuuuuagggaucagcaguuauuuucuuuaaaaaucuguauccuuaguacuggagaggauaucgcaguuaagagcaccuacugcucuugcaggggccuggguucaguuuccagucacaucaagcagcucacaaccaccuauaauuucaguuccaggcaguucugggcccucuuuuggccucugcaagcacuggcauguccauagugcauacauacagacaaagacguaggcacacaccauuuuaacuuuuuaaaucuauaaccucugagaccucaggaucccuguccucuaucuuccuccuaccauagccucaacuauaaagcaacuauaaagacucaguuaguccuggcuauaagugaggauccaguuuaucuaugcaaacagccagguagcuacaagacguaucucugcgaacugacaguggcaccacacgugucacacuuuggcagccaccagcauccuuaauacauccuugguagguuugugcacuuccaccucaccuuacagcuucccacagggcugccgcaaaggagaccacagggcuucuccugcucuguaaguguggauuuugucuccuuacuuuugauuuccguuccucguaagccagcucaaauaguuuagguagaauguucuauguagucgggcuagcauguuguuuuguuaucaaaauucagucgugaaagagaagauucagucucgaugcucauuuuuacccggugaccuuaggcagguagcuggcccauaugagcuuuugcuaagucaggugugccugcaaagaguaccucaggaguaacugucagaugcuaauugcuccccuuaauuaauguccuucuuaauaaugaacauuaacacaaucauuagugaaucuuuggcucaauuauguuucuauuacucuguaauuauacauggagaacugucgcaauucacacccauuuuucuaauaagggugagccauuauuuguuacuauaaaguuuucuugagaacaguauuucuugagaacagugcagaaggauaccagucacuuaaccuauggaaguguggaguccugagaaauggcuuucgcgcauuucaggggcacuuaguaaaaguguuuccacaucugucaguuugggagaucuuagcugcaauuaccaaagggaagcucugaacugcagccaauguccugauuaauggguaaaugcucgcagcaguauuggcuguggacuaaugucuucuguguacuuaagucaggguuguaguucauaaaauuugcauuuuuguaauagcuuuauugaguaauaauuuacaugccauaaauauuaacccuuuuaaagugugcaauucacugguuuuuaguguagcuagaguuguacaaccaucaucacuggcuaauuuuagaauauuuucauugccccaccaagaaaccuuguauccauuagcaaucacuccucauuccucugcaagcccuaccccuggcaaccacuaauuacuuucugucuccucuggacauaucauauaaauggaauuaugcaauaaguagucuuuuacagcuagcgucuuucaauuagcauugcacuuucaaaguucaaaacauuagcauuucuuaaaguuacaauaugaaacugacaguuaaaauauguauccagggacccacuccaaccccugaccuuucucuuuucuuucuguuuucuguuguuguuuauuugaggggguagagcauagggaguaagaagguaauguggguuuuguucuuauuuuagauuuugcagaguugaagauagauggcugccgcgugcgcuaggcaaacacucuaaccugagugaugccccaagcccuguguuuguuuuuguguuugguugguugugggguuuuuucugcggggggggggggaauugaggcaagcccuucugauauaacccagguuggccuugaacuugcaauguagccaaggauggccuucagcuccuaaugcuuccaugugcuaagauuagaggcguguucaaccacgcuuugaauuguguuuuuuguuguugaggaguuugucugguugguugguuguugcugucuggugcuaaagagugaacccuuggccuccaggauguuaagcaggugcucuaccaauaagccaggccccugguacuguguuuuuaugguaauauaacacacaugaguagaacccacacaucugaaguacacagcuugauuauaucuugggaugugaaugucuccuggugagcaucaucaggauaaaaguacugaacaccaaaucacaccaagaagccuccuuuuugguccuuccuaggcaucccaaaccaggcauuucuguuuugcucagugcucuucuguuugcucugugugcacccacauacagggcauagcagucaagcccugcugccugccccacagcaagcccguccuggccuugccuuuggguucccuccuuucauuaccauuggugcccaagggagauaaagcugcaccccagcucuccacacgcagacacacguccuuucugaugcucugagcagcugcccagccuugguguugccuccuugcuuuugccccccacuuuccuuccagacaccagagaucucuucacaucaucucuucacaucacagugugguaggcaggcuaaccaucaacuucccuccuggaucaugugugccagcgccagaggggaaccuaggcagacagcguuguagcccugugcuggccucucuaaagccuccucaccugccuugcuaccauguaaauuuuuaacuccaauaaaaauguuauuucuuguaugaaacuccaugccuugauugcucuucacuaguaguaagucauuucuuaaacuaagguuuuauuuuuaaauuauuuuuagucuuugaaaaaaaaaaaauacuggguguauccuagggcuagcauuaaccagguaaacagaggcauacacugccucacauuuggccucuuucuauagaaggagggcaaaugcuauauagacuuucuaucuucaaaggcccuuuuauauauagacuuaagagagucuaugaaaaauccugguauuagucuuuuuguuuaaaaaaaaaaaaagccuuuaaaaaaaaaucgucauucuacuccucaaagaguuacagucuaguccacccaggacuccuaaaauguauuuuccuuugguuaaucuuaugugcuauauuuuguuucccuccagacacuguauccagguucaaauuucccaauucuacaccaaaacuccagcauccaccuuaaacuccagcauccaccuuugcugugaaaugcuuccucaguuuccagagcuucaguggaaacucuggaggugucuuaguuagaguuccuauugcuguaauaaaacaccaugagcacagaaacuuagggagaaaggggauuauuuggcuuauguuuccacauuauucaucguuaaaggaagucaggacaggaacucaagcaggccaugaagcagugcugcuugcuggcuugcuccucauggcuugcucagccugcuuuuuuuauagaacccagggccaccagcccagggaugacaccacccauggugacuaauuaagaaaacaccuugaaucuuagggaggcauuuucucaucugaggcuccuuccucacugaugacuagcuugugugaaguugacauaaaacuagccagugcaggagacuuuggauucuggcuagcuggaacuuuaaccuccgucccauuacuuagucacugcaucgguuaccuuuugcugcucugauaaaaaauaccaugaccaagaacaacuuagggaagaaaguguuuauucuggcuuucaguuccaggggcuuagcauccauaaugccagggacaguguggcagacugaucccauucagcagcacaccaggagcagagggaguaaaguggaagugggacaaggcuacaaacucucagagcccacgccaagcacugaacguccuccagcuaggcccuacucccuaaaagucccauaaccucccccaacagcaaccgacagccgggaacuagauauuuaaauacaugagccucugagggacauuuuucacucuagucaccauguccaccaaguucaggugaaagcuuccuuacaugguugucagcgagaauuccucauuuaugcucugugaauggcaacugucccucacacacauccuagcaagaucaguugagaugcuggguagaagggaccuaugagaaaagauagucuucuguuuccuguguucuuacuaccagcuuacuguguccugacccagucaagcauguauugugcccaguaaugaaggauauuaaugacaguagucucugcugagguaccaguacccuucucccucuuggagauugauuuuguugagcucuaaguuuaaggacuuaaagcugugaggaagcuuccagaagguugcuaugaucugauuggcagagagaaacugucaucagcugucugaggcuuucucuuaggagucccacccuugcuguagccgaagaggccucugagacaggcugacuucuuucuaaaaucucucuugagauucuccaucaucacugcacaggcuuggccucaaaccaccugaguguuguaaccugaaguuagacaguguccacagaagucaggaaacuaaugauaaguagugaauuugugaguuucucauaaggggaaguaguuagccuuuuguggcgagauauucuuuuuccuuucuuuuuaggaaugcugaaucucuucuuuuauuaaguucugauacuaguagaucauaacuauuuuaauaauguagacaagcuaaaagauagucuuuaaauuugucuccucacaucccuuccccuucucuaggacuguccuuuauauggcccucaggucucucacaucuggcuccaacuuccuggcuagcuucuuuuccccuccuucccucucuacacguccuuuguacuccaguggggaaugcuggaggauccuguauucauauuucuauauaaaugcuuguacaaccugauggugcagcuugggaucuuuaccaucucaguccauguugcuaguucucuccugagaagaagaaaaguaguauccgaaagacuaacuguucccacaguaucuguccaacaucagacaaacccaggcuacuaguucucuguauguauacaccaagagaugugaaaauauguacuaacauuuauuuuggugagaaugaggccagagagaggaaaccuagcuuauucauaggcugacauuugaacagaaacugaacuaaaucucucuuaauugauuccccaacccuuugucccuuuacucccauuugauguuccuuucugagcuuuuuuuacuuggcugugguacaaaaugaaauagagcuaugaagugcaucaaaggaaagauugccauugcuucuuuguccuaaaacgaguccuuguguuuauagcccuggccuccccaccagccauggccagacugguuuccaggucugcucucacuuccucccauccuuugagcgcaggagguuaaaaguccuccugccauggucaugugggccuuucuaagcuggacuuccuuuuguaaugauucguucuaaauucucuagagaccauuauguuauuucuccuucuuuauugcuguucaccgcccuucccaauuuacuaacauuugcccuuuccacugcucccuuaucuugcugcacacuaauuaaggcauuaagugagaucaguuguaaagccaguguccuuaguauuccauagaugcuuccuucucugagguuguugucuugcauuuagcauuacccuuuguugggcuuucugccuguguccugucagggggagccauucagaauaaauguauuuugcuagcuacaacuuuuagacuuaguauaucaaacaguuugcugacagccaaauauguaucacucacaguggucuuuucacccaccaaauucacaguucccacagcuauccaucacguaugucagagucuuugagucuuuaauuaagcccugcuggauacuguacacacuuccauuagcuccguccucuuuacuccauuacuuuccuaauugacauccauccugagucacauguccuugaaucucagguggcccauuuuguagcuuugguuuauuuagguuuucucuccuucauaaauaaccuaagcauuuaguuaauacacccucaaguguuugcuauugggaccuggugauuugcauaugcuuacacuucucaaauaauccuggauuucagagggagcuggguuuccucuagcaacucucucucucucucucucucucucucucucucucucucucaaccugugugugugugugcgugugcauguguguuuuagauagacucaugaaagucagaacuacugaucuuccugcuucuaccucgaaagcaggugauuacaggugugugccaucagacccagcugccagccuuuuacuuuuuaaucaugaaauacauggucuuuguucguacuaaguggagaagucuccuaacaauauugacaaguguugagaucucgaaauagaaagaaaaggcugagcgagugucacaugagaguccagcaaaugcugccuggaaagcagagagagaauggguuuccguaaaccaccuccucacccucaccggacugucuccacaguuguguaguggaauggaacugccauaacugucagcugcuauaaucaagccaucaccucggucucuucagcacaaaguccuaaugagugguuuccaagcaaagccaagcgauuccaugcaauuccacagaucuuuguucugaaacauuuccagguagacagaaucuucacauuauuaaugccgaagccaagguugguauacacggcccagcaguucaguccuugcccagaaugcaugugaggcucuagguucaguucccagcaccacaguagagaaaucaguggauggacagauggguggguaggugcagaacccaugccuuguuaacccauucacucuuucaucccauccucaacacuagccauucuuagcaccaagcccugguuuuugucucguguucauggcccccuuacucuucuaucauuccccaagugucaauacaugaggaauggccuggaccaauggggagacugaaacccuggcuuggcuuggcuuuaaauuuaaacauuugacccuaucucgaaaaaccaaaauaaauaaauaaauaaauaaacauuugacuucugccauggacaccuuugaccuaggccuagacgugauguuauuucuaaagagcaaauacgagaaccccuugaggcuaaggagcaugccuuccacacggaguugucaccugugguauuccuggauggcucagcauuguuaacaaggucaagucucccucugaagcagcacuuggcauuaucuauugaaaaguuauuguuuccuuuacuuuacuuaaagaugaaagggccacagggccucuaaauuauuuuucaguuuacaccagcacuugccuccagauuucuaguaugugaaauauagauaauauauaauuuaagauuuucuuacuaauuaguaaacaaucugaggcuuuguuacugccagagggcaauauacgaugugccuuuuuucacccugugauaucagauaaauuauuuuuuaaaauugaaaacucuccaaagugcuauccgauaaacuauuuuaauugaaaagacucuaaacugcuauucagcaccgcauagcucuucuuaacccaggcucaccuuuugguaaucaaaagaacauuuacagaaguaugagacaaacacaauuaugaaaguaaaaugaaggccuaaauaaaaaaucacagaacaagaggguaauucuauucacucuuucauauuucauuauuugauaacaucagaugaugaauccaucagaauugcuuuggcaagugcaaacaaaaaaugguccugaucaauauuuauuaaaaccuucagaaugggagaaggacuugagcugacuucguaauguaguaaauaauuauucauauaaacaggcuccgaccaaaggcaggacuagaccaaagagacacaguuuuaauuguacugaauguaaaauacaaauuggccucuaguccucuugcagaaaccuuaauuuuaaaaauuaucugauagaguggagagugacauauaaauccuuaauuguuggagugagaauuucaaccuuagauauuuuuaaauuuagaauguauuccaaaaguggaaugaggacagaguuaccaacuaagagcauggggagacauucucuccacucucagugacuguaacaggaacgcugccaucaucucagcagcuacagggauggacucaucccuguuaggacugauggacuggcaucaguggaauuccuuuguuuuaagcaacugcacuuucugaagggaaaugaagccagacucuggcuacagcugcccagcagaaguuuggagagagauacaguccugugggggggggggggagcacagcuggcuuggacuuuugaagucuccaggcgcaacaccccagaauugugaaagugugcucacuccagaauaaggaugauaaguaacugcuugucugcccuccucccccaacuuuggagugccuugggaucuggcuucaggccucacauuucaggaaguacucuaccccugagcuaaauccucagucguuucaacauugaugaaugugguagaaaaaaaaaaaaaaaagaaagaaagaaagaaauguaaguaacugagccaccaaaaagacaaagcaagccuugaaaacacaaaauuccacaccaugccuaccuauggaaugauuaucugugucaucaguggggagaauaugggcaaaaucuuuucuaaaauccauucugcagcagccugccuaggacagaaaccaguguaaucugcuaaaaguauuaaaacccaucucaauguaaaaugcucaucugaaccugccaucggcuggcugccuggaacuuagcuagcuucucuccugccuuuucucauuccugaaaggcaaagaacuuugcugcauuucaaauuaaaauuuucaaucauguuuguaauaaacucuaagcucuuugaaggagaagacaaagaaggacaauuauauuauauuuuaauacaccaauuuauucucugauacacaggauuaucgucugcuuuauuaucggccuggaaaguaucugggcuaagauuauacuuguucauagugucugcagaucaauugcuaaugcgcuugccugacauugcuuggcaacaguuagcaucagcgagcccgauggcagcuccaugaugugaaagggccagucaggggacuugguaccaggguaaaacuccaaagcuacccgcagcgcauaaagagcaccucuagaaccccuccggccaucacaggaagccagccaccagggaauugacagcauuugucaaaaggcacaaggccaguuaagauggcaugcaagacaugcagaauccugacuuagcugagucuccccucuguaggugccccucagguauauacgggaugguuaaccgguuuauggcguaaugaguuccuuucuccucuuucuucccauuuccuuguuuauuauuguauguaccauuaaggagguggagaaaacaagaauugaguguuucaccugaucguggaguugcccuuuucuacugggucuucauuacagugcuugaaguacccagguguagguuaaagcgcccuaaucugacaucugagaccuaaaauauucuaaccucccaaauccuuugugcgcuagcccgaugccacaaguggaaaaugccuccugacuucauacauacucucaccaaugguaagggcuaccccagguccaucacacaugaugguagccucucuuuccagaacagcagucccuucagagggcugcacccccagggacccaagaaccugacacaagagcccaccacucccagugcugccaucuugaggacaaagccuucuuaccuaaaggacuuuuggagagaccucaggccaagccacacauagcagguguguaggaaacauuaauuuagacuuaaguccaguugccaggcuagcucacuauaugcauauauagucgcaaaaugaaaucaacugaagcaaaacauuucugguucuaaacauuuagaaaagcaguauccaaccugcaggcacacacguagccacagugagcaugugguggucaaagccaguucuuuccaccacauaagucccaggaauucaacucuagucccuaugguuggaagaaagcaccuuuuuaccuagugagccaucucaaauacuguuagauucaggucaguuuuucauaucaggaccccauucuuccuuguguaacagccugucaaguacacacaccauaguuuccuucuucagacauucagcaauaagcacuguaauuaauuccguaucuuggcuauugugaacacuccugcaauaaagaagaaagugcaaguaucuauuugaccuaaugaccuuuuuuccuuuggauaugaaguccagagugggacugcugggucauaugagaguucugugugucucaacucucuacaucuacucuauaucuacugucuucuauaauggcuguacagagaggcaaccaacuuucaaaaagaacacuuaccucauccguuaccaccuuggacagacagacagacagacagggaaaaguaaaauagguaacaaaauggaaaaguuaggcccugaacucuaaguuuggagcccuaaauuucagguccacagggagcuauucagccauaacugugagguuugucuaaacaaagugugaacuaccacagggcuggcugucacuucagcagaagauggagcuggggugaguuagucugagaauucuguccaguuacacuaaagcacagccaaauggacucagacaguguuugcaguuagucccuuugccuuuuacacuuucauccucuauuaccugggcuuuggaagacauuuaggccuugaaauccuuuaguuugagaaccaaggcaagucacucauguucuacagcugagcugcuucuguguacagugugaauuuugauacccaucucagacgguugaauauacagaugaaucuacaaguuaauauuguuaaauauuacuacagcaaauacagacccaaacacagcaggagcucauagcuucguacauuagccauaucuaggcacagauuuuuaccauagauucugccuucuaugguguuugcuaaccaaagaaccaaagaauucaggaaaaaaauaugugcagacuuuguuuuuaucguuauucccacaacacaguguguucgaauggugcugaauauuuuacauaaucuagacaggauuuucaaauauauggaagagccaggcaugguggcacacacccuuagucccagcacuuaggaggcagaaacaggcagaucucuguaaauucaaggccagucugguuuacagagugaguuccaggccugccagagagagagccugucucaaagaaauaaaagauuaaaaugcaaaggagaacuauauaaguuuuaugcaaauacuauguuauaaggauuuuggacuggggguacuggcacuaaugcccccagcuacccagggcaccuauuuaaaaaccauuuaaaaccuuggacucugaaguccaccaaguaaaacaaggcagaugguaaagguauacccauggaacccaugaauucaggccagcccccagcgggccuuccuguaugucaccugcacacagaccugcuaugaggggcuguaggcccaggaaaaauugcuguggguggaagagauggcuuuaggggggcauucuuccaucgauuguccuacaggaaaccuaacaccauuugcaguaaccucagucacaguggagacaugaacugagcauggcagauugagaggugggaaggugucaacuaaagcucauccugccccuuguguguaaaauguacaaaaagcuuucaaagagaagucagaaaauccuaacacuaaaagcaaaagguucaagcaauuuguauauacacaugugccggacugcuugcacugaaaauguaguguggcuucaugccagaaccauaugcuaaaaucaagucuuccuccacgagucacuuuuggucauaauguuuaauuacagaaugaggaaggucacuaagacacucugucugcucaugauacuuugggaaaugcaaccaaaagacucacagcagagggcaaggggaacccugggcaggcgcacacuuggucauagagcacauucuaaaaugaaaccaaacuccuuuuguccucaguacaggcuacucaguccacagcuagcagccauccuuuaaauguuaggggguccuuauaaagagacucgcucuacaaggcccgagcuggaaaacaucuaaagcacauguauguucacuaaugcaacacaggcagccacguacaaugccaucugcuguaagcuggggugcccuggaagcuauggcugcuguucuaaugcuugaugauaaaaaccaugcuuuuauuuuccugaagucucagugcguacccaucaauuauuuauuccuguugaauuccgugauuuuacuucaaucugucaguguuuuaucauggaggcucauuuuccuuucguaguuuggggcauuuucccucuuucuccuuagggcaucuguagcaccuucccaccccacgucagucauucuacacauuuauuaggccucgcuaccggguaagguagcuuucucagagauaaaugcauuucauucugucuuuaaauauuuauguuucuuuaugaucuaauguaucaucaugguuauaggggaauugcccccuaacuauagaaaauaugccaucaguugccugucaauuuuguuuaauaacucggcuuugcaauucuggugcacugucaucugaggcuccugagaacuccuuuagucucccuguugccuucagaaugucauuuggggguuuauucaggcugucaaugcacagaagauauugaaacauuaaguacuuaaauucugcgcccucugucacucaucaccacagaagguccagggcuggaguuccaggcaucuuugucuuguuuacucccagcaaggaauggcagucucuguagaaaaccaaccugucucccuggaaacaauucaucagacuucucaaaagaaauccacuuucaucuggguugauggguucaguguugcuuuuuaagauaaaugaugaaaauaucaauaucacaaugcaaagaacuccaauucauuuugcuuaaucucaguaaaaaguaucauaaaccauuuaccaccucuguagcagccucugcuucuaggcccugaacauccuagaugugggagugguuuaguaguuacucuccucccaaagacccuggcuugaaaccucugacauuuauaguccaggguguaagacucccagacuccauguucuuccugaccccuagguaguucugcacgaaccacucuguuaugcuugcagacaggagccuagcauaacuguccucugagaggcuccauccaguagcugaccaaaacagaugcagagacccacagccaaacauuagaaggaguugaggaagucuugcggaggaguugagagaaagauugaggggcccagaggggaugggaaccccauaggaagaccaacauggacaaguaaccuggacccuugggggcucccagggacuaaaccaccaaccaaagagcauacaagggcuagaccuagccugccccuaccuccacauauauguagcagaugcgcagccuggucuucaugugcccccucccccaacaauuggagucaaggaucucccugacucucuugcuugccuguagaucuuguuccccuaacuaggccgccuugucuggccucagugggagaugaugugccuuguccuacagugacuugaggugccaggguagguugguacccaggggggaccuccuccuucucagagguaaaggggaugggacauguaagggaggaacuucgauacagauuaaagugaaugaauaaaugagugaaugaaugaacaaaugaaugauggaguuggggagagagaaaagaaauauauuaccauacucaaagauggcuuccuucuccuauaagauaugagguuuugaggaguuuuuuuguuuuguuuuuuguuuuccccaagauauuucugaugaagaagaaacaaacucaagacccuaugugcaggaauagggguuccugagcgagccacugaaauguagaggguugcuuugccgcccugcccacaccuccuacuuucuucuagcuggaaggaaggugaugaccuucuucuaggaugccuuuucugucccuuuaugaacacccaggcacacaaagcugcccuaacaccauuauuacuguuauuggguuacuauugccauaacuguugucagaguucauguuuaugaaguacuacauucuaagugcuuuaugugaaucaacuaaaacuuacaguaaccuuaagaagaaggcagcauuauuaucccauuaccagaagaaagccauguuucccagagucuccaauaagguagugugugagugaggagucgagugggacagagccugccuucuggguagucaguaaacaaguaaguauacuaacacgccaauaacugaaugugcacguaacgauggcagaagcacugaacuugcucugacuugcucccccaggcaguacuacgagaugcuguacaacacagccgacgagcuccugaaccuggugguggaccagggugugaaguacacagagcuagaguacauccaugcccugacccugcugcaccgaagccagacuggugugggggaccagaccacccagaacaccaggcugcagagacucaaggagaucaucugugagcaggcugccaucaagcaagccaccaaggacaagaaaauaaccacugugugauggagugcaccucacugggugugggugggguucccaguaugcacggccacagacucuagcugcucagcauggccugagcuggcugugcuccaucuacacugaggcuuaguggguaggcgguggauuauuuucucuuuaguuuugcuuuuucauaugaacgcuaagaaaguuugcaguacagaauguugccuaacaaacacuuuagucuauucucaagggaugagggugggacagggaggaggccaugccaaguugcuggacucugagaaaggaaugaaggaaagccgacugccaccuaaguuuuaggaccauccugaaauacuuaauaaggccuguggcauaagcagucggcuuucucuggucuuagccuugucaguuuauaguuuaguguaguaaguauaugcacauugcuuugucuccauugccaaaaucaaguaagcgcuucucagcuggcuucccagcccaaaacagaucucugugagccuaggagauagcgguccuuuaucccaacccugggacagacugcacacucuagcaggauuguucgcaggcugcugguuugguuuuacaagcuucuuguuuuauuccuucuguauuaaaaccaguuaagagcagugacuguccuuccagaggaccaggguucaagucucaacacccgcaaacagaggcucauaacccucuguaacuucagcuucaucugaccugaggcccucguaguacuacaugcacguggugcacagacauacaugcaggcaaaaauacucauacacacaaaguaaaaaaaaaaaaaaaugaucauaaaacuauugcuaaaaauaguagggagggagaaaggugacucacuguuaaagaacuuccaucucacacaccauccaggguaaauuguaaggagcguccucuugcucccaugcacacugucuuacugacuuggcuuguugcugugacaaaacacuccucgacacaagcaccucaagaaaggaagguuuauuuagcuaaccucaaaagguacagcucaucagagcagggagggugacagcaggagccugaggcaggggcacucaggaagcauggagcagugcaugcuguguucagcccgcuuccuccuuuccgugcaguccagggucucagccacagucagagugggccuuccaaccucaacuaauauaacucaaauaauuccacauaagcaaggccuauaaaacacugaccaaaaucaacacacgcacacaccaucuacacagacacacaaaaauaacuuuaaaaaauuuugacaaugaaaaaguaaaucaauuauuauaauaaacauugaaacuacuaaaaaguugagagaggucuaaagcaguacaaguauuuuguauaaagcaauacagcucaggucugcuuggcugaaagcagggaagacgggacauuuccccacgcagcugccucugaagcuucuuuuuucuguuuguugguuuuugguuuuucaaggcaguauuucuguccugaacucacucuacagaccaggcuggcccggccuugaacucagagauccccuugggauuaaagguuugcaccaccacacccagcugacuugcccuuuccugauauggcugccugcaaugcuccaggcccucaaguccucucgcuacucaagguucauaggucacuggacacaacaguuuaucaacaaggauucaucuugaauacacuagggaaggagagacagaggacuggccauucaaggucacugucagacccugagggagggaauuuucacacuuguuucuaacaacuuuggacuggaugggaauaaccaaaaauuaaaaacuguuuugagaugcuuaaau

SEQ ID NO: 2899 - RNA, 3857 nt, Mus musculus
aaagagauugccgccaagcacgagaaaaccucagcccagguaaaauuaugugccucccacuuucaacccugcaauccagucuuuuauuuauguaaguacaccguagcugucuucagacacuccagaagagggcgccagaucuaguuacagaugguugugagccaccaugugguugccgggauuugaacucaggaccuuuggaagagcagucagugcucuuaaacgcugagccaucucuccagcccacugcaauccauucuuagucuuguuuuauucuuuguauugccuucuuuuaaucccuuggagaggaggaaaugagaaacguaagucuauuugcaucugcaggaaauaccgcuguuaccaaacaaggaccacuucuguucauuagcuucuugccaagucuucacuccuggcuagagaaauaaugguguuacuuucaggcguaugagagauaaaagagucagagggagcugugaagauaaucuuugucucaguuacuuuuucugaugcugugauaagacaucagcaucaaagcaacuuauagaagaaagacuuuuuugugugugugugugggggcaggggguggagcuuacaguuacagagagauaggaacccaucaacaucauguugggaacaauggcggcagucaggcaggcguggugcuggagcagcagcuaagagcucacaucucaaaccacagacaggaaacugagagcacccuggcaaugacuuaagucuugaaaccuuaagccuugcccuagugaugugucuucuccaacaaggccacccuuccuaaaucuuccuaaacaguuccacugacuggggaccaaguuuccaaacaugugcauuuugggggccauucucauuuaaaccaccacagcccucuuuuagugagcacaugccuucuucacuuuuuuuugugcacagguucugauucgguuucacauccagaggaacgugguggugaucccgaagucugugacgccaucacguauacaggagaacauucagguaagauggugaccgaucaccugauauggaugugugaugugaagacuccccguuaggcuuucuucucauccuauucuuggguuaucccugugucuuucccaauuucugaucaccuugugaacacuugucccagggagcuggccucaacagagcugagauaaaccaccagaaagccacaaaugggcugaggguguggcccagagaagcccugucagcucugagcacagguguaccuuaugccaccgagaagaccccugcuuucccaugagcacuuaaaucaagagccauugacauccugcccaagggaagacuuuagcugcagagcaaccuuuuagcuggagaacaggcauggaccagacuugagaaaauguccuuccugaagacuccauguaugugucccucgaggauuagacacugcacagacugagauuuuuguggcuacaagccccaggucucucuuuuuuggaucacugaauucuauaaauaguucagucuuaaucuagaaagugguuuguaugcagugugaaccuguuugugcagagaggaaugccuauagccucaggcaccagcccuuuccuugcuaaggaugcuucgggaugcuuguccuuccaggucuuugauuuccaguugagugacgaggagauggccacuauccuuagcuucaacagaaacuggagggccugccugcugccugaguaagugggguagaguuauggauaagcuuucugaaguuguaaaggauuagcuggaaggguuggaagacaucuaggauaacauuaucuucaaauacugaaauugugaaaaaguaaaaauugagucaugggaagucacgacugccagcugccgcuaauucucugaaguuuacccauagagccagacuuuucagaaacgauaugcuguuccuuugcaggaggccagagcacucauccacucucucacucacuaacuggauuauuguaauacacuauguguaugauguucuaguugcuuggcauaucacacuauacaaacaucauguuucucaauccuauauucuagaaauaucugaaguaacucuuaagaauguaugucaggcaguaacaaaugccacagggaaaaaaaaauaaaguuagugaaagauaugagacguagugugucuagguagaacggaggcuuuauaggugauggcccaaggacaguuuugcugauaaagucacaauucaaggaagugagaaaugugccaugcuguauuaggacaacacuuuucuuggcaauuacaaccgugggugcaaaugcccugagguguaguggauuuagggcucgugagucauggagccagagaagcugcagccagugaguaugggcucaaagcuacaggcauacagguggcaugaacugugaggaggacuuugauguuuaaaguggaaggagcuuagaagcugggagagaaugagcagagccuauugugaucugacaugucuuaaaaguuucacagugauuucugcuagagaggccauggggagccugcuauagcaauccagggaagaaaggacaaccggucugacguccaauagaaaaauacccaacgggcuagcaaaugcgguuuugcuugcuugguuuuguuucuuaugugagcaauucaagaacagaacugucauuuagaaaucaaggauuuggggcuggugagauggcucaguggguaagagcacugacugcucuuccuaagguccugaguucaaaucccagcaaccacaugguggcucacaaccaccugugaagcuacgguguauuguauaauaauaagugaaucuuaaagaaaaaagaaaucaaagauuuggcucgagacauguuugugaugcuuuuuggucaccaaauagguuaauuuuagguagauacauaaugaguggagguaguagauuaaacucagaagcaagcucagcuggcuucuaacccaaacgccagucuuuccggagcuauggagccuugggugggucuguagcuuugccaauucuuuuuuccucaucuacagaguagggaugauaauaacaguugaagcaaagagccauugaauacagagguccuagcucauggcucaucuugccuuguuuaauacaaacaaccacaauacaauaaccaauccguagauuucaaccugauuccccacuucucaauaaagcaggaugaacucaaacaguauucgugaggcccugggaugugugcuggucucuaacgguggaucaucaugaccuuauucugauggccuggccacugcguacuuccugacacucuuuucaaaugcucugcucaucaaucaaaggggacgaucaugguguggggugagggaagcccgaggaagcacagaaaguacauuuuuaugggcacccgaucagugcaccuaggcuggggaaguggcucaguggggacaguucuugucugggaucugugaaaucuugaguuagauccccaguaguccacaaagccaggccucuuucaaguucauggccucuuuuucauucauuguuacauacacauauguuuauguauauacauauauacuccuaagagaucaaggaaggauauauggcagauuuuggagggaggaggagugauguaauuauauuauaaucucaauacauaagacaaauaauuaaaaacaaacaaacaaacaaaaccaggcccaguggcacauaccuguaaucacaguccucuggaggcaaaggcaggagggucauaaguucaaaguugcucuccauuacauaaguucagagacaaccugggauacaugggaccgucucuaaggaagcaagcaugaagugucagaugucacuaauguuuccuccaugcuuguggcugcaggacaguaaaca

SEQ ID NO: 2900 - RNA, 29409 nt, Mus musculus
ugagaaaccggaaagaaccuccggcuggucgcuggccagagggcggggccgugaaugagugacaacucugucuuccaauacccagcgcuaucgguucugaccauuuuggcuucuaggcuacaaaagagcguugaugccggcuguagcgaugaauccucacuggcgucugcagcacggcguuaccgaggaccggcugcuacugguaguuuccuugcaggugaguggcuucguuguaauuguuacaguugugaggauuucuuuucuuucaugaguggcuugcuguucuaucgugagaaggccgguugcuaccuugcccggcuuuaguaucuggugggaaccugaugcccgcuucaagcgagacccucccgaguaccccagcucucagcuggcccuuucucagcgagcaucucucaggaacagugaguucugucggcuggagugauggugugugaacccagagcuguagugaugguggcuuagcaaaguuaaacucuaccuccuggauagcucagguguggcuacuugucuuagccaguggauucacuggaaggaagcagguguagggcgaaggcagaccuugauccuaaaaguguaaguuaaggggggaaauaucauggaaggcaaagagguuguugcauauucaggagucucaggaaccauauuccggguucaggggaacacuacccccuccccagcacacacgcgugcacgcccgaccaccacuaucauggccaaaaagugucauuucuuuuugugcuaagggguaggagcaaguauuucacuacaguaagucaaaagaaaugcaaaauuguaaugaaguuuauuauuagacuuugcaggauggagcccccccccccaaauuaggaaggguuuauagcccgugaaugggggaaaugguucuagaauauuaacuaacagaauuccgacgccuucgggaggaaauaaaaaguaaaugguuacauuucagcagcagguacaaacguuucuauaauaaaagucguguuaguuugucuguaaaacugaauuuucacauuuuuuuaaaagaauuguuuauuuuauguauauaaguacauuguagcuguauucagacacaccagaagaggacaucugaucacuuuacagaugguugugagccaccaugugguugcugggaauuuaacucaggaccucuggaagaaccggcaguguuccuaaccucugagccaucucuccagcccaauuuucacauuuuuuucaagacuguuuuauguguaugauuuuuuugccugaauguauguauguguacucuguguacgccuaguguccauggaccacccccccccccccggaacuggagcaaaugucuaugagccccccugcaggugcuaggaagggaacccaguuccucuggaagagcagccagugcuccugaccacugagccaucucuccagcccaguuuccacaucguuuaaaaaggcagaaguuacauuucuaaggcccaugccuuuauuaaaggcuauguaaaauuaaagauaauuagacaauuuuucacuaucaugucuacaaggaaacucucacuguauugaccucuguaugaagucuauagcaaauaaaaguguccggcuucaaggacauauucuuuugugcccauauuuaaacugaaccaaacuaaccagaucauuguaaaaaaaauauuuuuuuaaaggagaguauagaaaucuaguauagccccccaaaauugucaucuuuaaucucauuacucagaggcaacuguuaaguguuuggcuauuuuguguuaaguuucucuuccucuucaccuuuuaugguuugugagauuaauaggguuguuucacuuuaugaagugguugguacaucuaacuucauaauccaugcaucuaacucugcaugccuagagaacagagggcaacaugcuugcacugguggcuucucggauguucuuggaauugaagccaagcgugaggcgguguuuggagaaagagagcgaagggauugacaucugggcauggugccuugcuccuguaaucccaggauuuaggagguugaggcuggaggauugcugcaagaccguggccagccugggccacauagccagagccuggauccaaagauaucaauagcaaaacccuuccauuuagaaagacauggcaauaaacuacuuuauagaaugugaauguaacaucgacuuuacuaacguguuuggacugcacacucuaauaguauuuggugugcuucuaggacugcauaauucauuccgccuuccccuucucgcacauucgauugcugcuugcucucuccugcucaagucuccuguuuaaccuuucccuucacguuacuuuauuccucgauuucaugucuagccauaccauuagcccaguagaaucacuuugacaggccuguggucuguaccaaucugcaugagugagcuaaaucccaguccuuucuaccucuguuugcuagaguaccucaccacaauuaauuuuauauuuccuaagggaguaaugcuuuuguuauaacuuaguguucaaagaauugaauguauucauucuccaaccgugagucagcugcuaaacagugcuccagcgcaggcuuuugugagcuuuugggauuugauggacacaguuuguauugacaagccugccacccuagagcaguaacuggggagagaaaagaagacucuugagugggcggugcccacacugcugauugcuagcaggguguagcaaguaccucggcucaggcaaagucaaaucucacgacuacacacguguaacucuuucauguaaagagggcucuaccugcuguaauuugcugcuuuuguaacccugugugugugugugugugugugugugugugugugugugugauguaagguuuuugugagagaugccugugaguggcagagucugcugcagggguguucuuagcacuucacacacaagugggaaaguuaccacaucaccacaucaacuuuuagggaaguaauagugggaucucaagugcugccaggacucaguuuauguuuaaacagccugagucuggggaaggugugucuuguuaagacacuugaaacccuaaggaauuaaaugcuggguuucauuugccucuuuccuuuguaauugaugagaggcaucaguagucuuucuccuuguccucaaauacagccagcucaucuuccguaaggcuagcugccucguacaguggggaguaaugguugcugagaacuguacagugaggaucuguaccaaggaaaaucucagaguacucugagauggguuuuaaauguuuaauccuuaagaguaaguucuagauuugagagauucuggccccaagucccuuauuugauauuacuugacauauuaugguuaguuugaaaaugggagaaguagaaguuugggcuucucuuuacccugugacuuaacugucucuuccccgaguucugauacaagagucuuaggcgaacuuaacuuuucaaacgccgagggagggaggaagcaaagucccaucgcuguuaauuuguaaacagauggaggaaauaacaugcaaaugugggccaugcggcagacccaagggcagacccgaggguuuuacgugccugucacucagccugucagcucuuucuguuucugcuuugucaagagaauugaaguuugaagcacagcuucaugguggcauuuauagggaaaaaaacuuuggugucauaaucuagauggaauuucaacauauagaauauauggaauauagagaugaaauuucaagauauaaugaaaggucuucguuauaacuggcaaaaggucuuuugaauuaccugauuuuuuuuuuuuuuccuguacugcuaagacaacugguuagguccugcuccugagcaaaucuacauucacguuuaguguacugcaacaugauuuacaaagaggguaugucaaacgagagcccauguuugugggaggcuaacaagugaaucauuuccccauaguucuccccccacucccccccucgaaccuguuccuaaauacugaauuaagcacagacuggguacucugacuucagugugcucaaugcugacuuaugugaggaauaaaacaacucugaaugggauuccauuccccagggcacuuugcaguucuuucuggcuaaggguacaaacuggugguuuggcuuguuuguuuuguuuuguuucauuuccuugagacaaggucucacuuauaagcuggcuauuuuauaauguugggagcacauccauguauggggucuagcuaagcagggauuugcacaccagagccuucuggauauauauauauauauauauauauauaaauuccacaagauauaaauggauuuuuuucauuuuaaauuguugaaauuagccuacugauaacaauagaucaugugaaaaugauaugagauucuaauuuugaugccaccaucaaauuauaucacauuuacucacguguugcguacagauacuugcagcuacagagacaaaauuguacaacuguacauauuaugacagagaucauauagucugcaaagcuaaaaaaaaauugacugcuuagauuuuuacagggaauauugccagcaucuuaaacaaacuacaguuucuuucucacuuaucuuuauuccuuuccagcagcugucuucuuggcccagguugucacuguaugucaccaggguuuccugcaaaaccccccacagcuaauauuuagacuucucugugagcgugaaugcuuccuggcccucaaaugugugccauuaaaccucuaaugaggucucaguguuuacauaagagucggcauucuuuggcacaagguccuccuugagccucuauucaguuuuaucuuucuagccucgucuccgccuacuuccugauuauacccuaugacagagugaccauauaauuuuccaaaugggacaccuaggugugaaaggggccuuaguaauaauuauguuggggaaggaaaaaaaagcauaaagcaauaguguuuuaggcaaaucagagggaauagucagcuacuucuaguucucgccauuuugaaugggccuccuguucucucugcaccuguuccugauuguuaccuuaggccagaacuccacuucucuuuuaaucaacuuaaauuuaaauaucuuuccaaauccacccucuguaaugcuguguccauggagggagagaugcuuucucuuuccucuuccucuuuuuuuaagaauaaagaaccucugccagugugacuuacuuuuccuuguuagugacacaguggcaagugcacacagucagccuuccucacugccgcucugaaggcacaguccaggcuggagccuguuuuccucacaggcugaccauugugcugggcccaaguggcaucgcugcacguuuggaaaagugaaucaaucgacugugcugggaaggcuggugagggcuuggcuugcagaaugugaaucauucccuuuaacguguugaaaggagugagaaaaaaaaaugagguuucgagguuugaggccagagccugggguuccaguguggcagugcagcagagugguucagggcauggguguuuccuuggggacaacugagacugacuuguacuucugccaccuacaaccugugcuaauuuaggcagguuacuccuuucaguucugcaucuguaaagugggcacaaugggagguaccccauggauaguaguugagaguuugaacaugcacucugaauaaacugcugugguuaagaccaccaccaccaccaccgauagcuggggugggauccaagaccagaguguaaaagaaggaaagcuggaggaaaugcaggacugaacucauagucugagcagcagacugaggugcccugagagaagauggucuccacauaggcgugaguaaucauggucuuuugagaaaucacuucaguagaguagguaggcaaggcacacauuuguagauaccuucauagucagaggaugaagaaaacaacgucuaggacuaggggauggcacaguccugugcaaaugugaaaaccugagcuuggauucccagcauauccguccauccaucuguccgucccuccauccauccauccauccauccauccauccaagcuaggcuugguggugcaugccuauuauccuagcacuggagaugcugagacgggggaaucccugaggcuuccuggacagcuagucuuguucaaucuguaagauccagguuuaauauggagucaugucucaugaugaugaugauguaaaagcaauagaggaaaacacuuggacaguagccucugaccuguguauacacacacacacacacacacacacacacacacacacauguacacauauauaaagcaugcacacauguguuguaggauauuugauuacacugugaacuuugagauuguguuauuuacuagaaaaaaacaaacccaaaacccaacuguuucuaguuguggugugacucagcccuuggcacacaccuuuaaucccucuggguggaauacagacaugccuuuaguauacaccuuuaaucccaaacaauaaagguaagguuuauuuguagaaggaaacacucuaguuuggaagugaguucuaacugaggggcaggcaaagugauggauuagaggaagauuugacagaaugagucagagcuaggacacgcccaacuuccacacgagagaggaagaggagcugcuuaagagcagugcagagagagagggagaggggaaggaggcagguuuccugagacaguugcacagagacagguugaagagaacaagcuagacacaugaagacagaacgagccagagaaugagaaggagccagaagaucagaacagauggcuagagugaguuugaggccaagcagaggcugagagagaaaagccauauugagucagucagcuuggagcagagcuugagccagaacagcugaguugaaucagccugccagaguucagaaguagaaagggcgagcuuauucagcaagacucagaggcugaaaucauucuaggccuagauaagacuguacgaagucuagaagcuuccaggacuaggacucaguuagcagacugaggcaguaagccucaaagagaacaauugcuacaggaaaauaaaaauuacaucacaccuaugucauacacacagcuacccuuagaugacaauaaggaaaugucuggaaagaagggaaaacaguggagagaaaggaaaggcaagacaagcuagagucggguagaacuauguugguuuagaaaacguuucuucaggcagaccauacucuuaaaaguaagaagcugcagcuggagagauggcuaagcaauuaagagcucuggcugcucuuccagaggaccugggaucaguucccagcauccacauggcagcccacagcugugucuaacuccagaccuggggaucugacgcccucuucuggucucugugggcaccaggcauacugcauguggugcagaggcagacauucaggcagaacacguuaaauaaacucauuaaauaaacagugaaaggaagaaacucuaggaaauaauaauccaaucaccuaugcagacuuuuuuugaucguaaacuacugauugaaaaaucagugccuaacuuugguguccguaacuugcugagagauuaaaaacagcagccacaagaaccagcugcagggugguggcuuuucccaaacagaauggagcgaaaaugaagccugguagggguuuuaagggacuggguuaggauuuuggaggaaaggaacauggucucaguuacaaagguagcuuucccauaggcugcagugccuguuuggccuggcgaggcucaucugcagcagugacaagcuaagcuucccuccguaguccuguguuucaguacacuuucugaaauggcuguguagacacgcacgcgcacacacacacacacacacacacacacacacacacacugccuugugcugaggaagaaaggacacagguuacagaaaagcgccaucucuuccuaagaguugccuccaauacucacacaguccucagaagucagcacuccugcccugccugugguccagcagucucuccugcacacaucaguuuguuugcagccccagccuugaacuugucaaacugaccagcaucucauaucuguugcuaaacaugugauaggccagcuucaacagaugcuaagaggggucuuaaagcuaacaaacucaacagugccuuugcacauguucgccagcugguuaaauaggcaauuaguuguaccaaauaagagaguaggaaguuuauuuuaccugauauggaugcucuaguuuaguaccguguccuguguucaccuccuguaagggaaaaguguauuugcauagguuuggggcuguaauacuguucugcuauacuacguguauuuucaguaaaaagaaagucagaauuguuuuguuuuguuuccaaaaacauggaagcaaguuguagcagauaaagacaggaagcuuggugguaggguucugaguacuggaucuuggugguaggugucugaguacugaggcuuggugguagauggcugaguacugcuaacaccaucgauacuuguuugguucccuugauauaauuuguaaccaagacugauugagaaguguuuuuucuuauagaauuuguccccaugccuaucuucguuuccucuucaaugaugugauaaaaugcuuagauaaaagcaaauugaaggagaaaggguuuauuuaguucaggauuccagauuacaguucaucacuugaagcaaaucaaggcagcaggaaugugaagcagcagccacuucacauccacagucaagggcagagagcagcgagucgaugcaucuguaccgguguguguucuccguuucauauaguccugggucucaggcagggagugccccccugcacugccacccccaacacacacagcggccgagucuuccuaaccucaguuacacagucaaggucauccccuaggcaugcucagaggcccaucuccuaagcgacucugaaugucaaguuaacagcuaaugcuaagaagaugcuggucuucauuugaaggaaaaucucuucuguuuagccuggaggcuucuuacuuggcaugccaaaguaaaggcugaaguagaggaacaguugauagcaugcuucucauuucuuacccacaaaacaaaacacaugauuugcaagauuggauaugguuuucagugggcuuagagcaucucuuacuuggcugauagagacuuuugaaaacaagaacauaaaaauaccuuucuuggggcuggagagaugguucagcaauuaaaagccccggcugcucuuccagaggaccugguuucuauucuuagaaccaacauggugacuaccaacugucuguagcuggaucugccacuuucuucuggccuuuagugguaccagccagagccauacacgcugggaaaacauccauacacagcaaaaggucuaacucuguaccauccacauccacaugaauucauuggcuggucuuucccaagcgaagcuggggcuuuaucaaugugauuauuucccggacauagucacgggcaaagcacugcccaggugacuuccaucccuuucucucuuugccaccucaguggccccuaaggcugagaggacaggcauugugcugucacucugcaguugcccagccaugggaggugcuuccucccgagccuuuguucuugucagcauugggugcaucucuacuccauaugcaccaaaagccaaaccugauguucagcaagaaagaaugaauccuaauccugguagccuuccagcugcuuacaaaccacuucagucaccgcuaguuacuccugaagccucaucucauuggaguguuucccccucagacucuccaggaauugcuuaaaaagaguagaauccagguagaggccaccgaacucugucgcuggugguuauauaacugugggugaaucacagcuuaagcaggacagaacaucuccaguuacuggaaguugccaagaaugcagaagccaggcaggccccagucuucauauaaucuuugcuccccaguguggaaaaaaccccugggguggagauggagagugccagccgagcaucgcgugucaguggagaagcacucuucagaggcggauggaugcagccggcucucccgguucuccggggacagacuaggcaggagcuacagcauaagggagcucggacuugccuuagaguugcuuguccaacuuuaguagauucuccucacaguaauguggcugaugugagucgaguuucugcaggacaggggaggaggaggaggaggaggcaaggccgccuuaucagugugguucccugcacucgcaaggaccuguuucuguuaaucuguuccugcagacagcauuucucagcuguuuacauuugauagcuuguuuugcacccggauuuauuccugccaacagcaggugaaaauuugcuuucagugacuacuucauuuguucuuguuaaggacacuuuauagcauuuauaacuuuauuugaaugccgaacuauaccuuuuauauaggguaugaguguuucccauacccuagaucugugagccuguagcaucagagagcugguugcugccugucagaaagauguuugacauagauguaguacuucauugagguaacauguuuuuuaauguccacaaugagguaaggcuggaaagacacugaaaaccccaagagagaaggaugcuuucauuguagcgucagcugcuggaagcugggcguucccagcuacucguucguuuugagaucuagaacgcaucccgugcuguccucuccuuaauaagcauaaacugcuuacuuuggguagaaacccaccauuagaacggaguguugucauuuuaugucacgcaauuaacaugcuaucuagccaucagaaaauguaagucagugagguugucuguaauuaucugaagaguguuucuauaugugccaaagugugugaucaccaguucuguuugaugucaaaacuguucaaaggaauuucaguuuaucuuagaaacuggcuguuguauaauuguucuccgugacuggguagucauuugagggaggaauauaauauguauuuuuugucuucuuuuucuagauauacugcuguucuugaacaucaucccauugagaaccccaggguaguucagccaccagcauguccaagcacaaacuuauuauacuaagacauggagagggccaauggaauaaggagaaccgauucuguaguuggguggaccagaaacuuaacaacgacggacuggaggaggcucggaacugugggaggcagcucaaagcucucaacuucgaguuugaucuugucuucacauccauccuuaacagguccauucacacagccuggcugauccuggaagagcuggggcaggagugggugccuguggagagcuccuggcgucugaaugagcgucacuauggagccuugauuggccucaacagggagaaaauggcuuugaaucauggugaagagcagguaaggcucuggaggagaagcuacaacgugaccccaccuccuauagaggagucucaucccuacuuccacgagaucuacagugaccggagguacaaagugugcgaugugcccuuggaucaacugccacguucagaaagcuugaaggauguucuggagagacuucuucccuacuggaaggaaaggauugcuccggaaaucuuaaagggcaaaagcauucugauaucugcucacgggaauagcaguagagcucuccugaaacaucuggaagguacuggcuuucuguccugcuucagagcuugcuaagaguugugguugggucuuauucuagaaaccgagcuacagugugcugcccucuagcaccuccuaccucacgccccuugucacuucauauuuaagaagccauuguucuagaaaccagaacuccuguaguucuuggugcucauuguggcugaagcugaggcuuucagacacaugcggggaguucagugugacggagcgguaggguuuuggaguuucagaauuggggagguacaucuaagaccuugcauuucugagcauuuacggugauaacugcugcucugggggcucugcacuuuuaaagagcucugaucugagggaucaccugcccucugcuguaaugagaagaggcuaagaaaggaagcaauuuuacaaguuuauuuuagccuuuuaaaguaaauuaucuagaauccaguuucgucuauuuucuucccaugucaaacaauuguggcuguguuuucagacguggauuuccugagcaguucuuuaguugccguuuuccagaccaggcuuagucacugcuuaugagaaugcuagaggggaggaaaaucaaacauacggcuuuuuuccgaaucucugcuaaaggagaagacuaggggcuucuguuugucucagucacuugauguugaguucuaacacaaggacucugggcaauccguucuggggugccagugacugagggugacuuccucacuccugcucucccuucucucacccccacggcugucccuuugacucuuguacuccaugucuuccuacagaauaggaagggcugaagcucugugagaaaagcagggguagguggcugaccccagagcaaugggucucugggagaugauggcacugugaacauuuuauuguauggcuagcuugcucuaauuguuagggcauuaucuagacccgauugaccacuuagauaccugacauccacuagucaugcggaggucuagaaucuacaagcuuuaucagcuguuacugaguuuaucggauaaccauggugguuauccuuuugugucuguauauaacuuacuuauucaagaauguauaagguucuauucuuaauuauucaggaaaaucaaaauaugauuaaauuauauguaacuguaucauugacagacuauaauuauuuauuguucaaaagaguugagggcccuguuagaaaaacaaauugaaaucuaaaauuucaauguuucuggcagaauuuauauucuacacaacuucuuuuagagagaugguacuuauaucauguuuuagccaggcucccuuccccaaagaaaauaccacuccuucaggggguuccuuuuagcuaggugagugagcccuaaaaaaaaaaaagaagaagaggaggaggaggaaguuucccugccguuuagugcuaucuacuccucacccgucuacacggauguggcucuugaagaugguucuguaucccuagaugcccaucccgccucccacccccagcagcacaugaugguuuacuguuugugaaugaucuuuguaagggagcuaggaaaagggccucaccauugguaaugaaggagucaaucaccaugguagaggugaagggaaaauaucugcuggaggugagguuagacauugaaaaaaaggucuacaugccaggugaugguggugcacgccuuugaucccagcacuugggaggcagaggcaagccagccuggucuacagacaagcuccaggacagccaggggcuaugcagagaaacuugucucaaaaacaaacaaaaaacaaagcaaaaccaaaaaucuugucuacaauuaagggaaaauuuuaauguauuaauaauuuuuuaaaaacuguccagucaagcaguguaaugugcucuggacaagaaugugcagcuuccuaaagggguccagugcacuccucucaagaccagcuaccccacccccaccccacacuuagugcccuacuguagcugugaagggcccagagcaggacaccuaagacaacagaaauucacuuugugagucuagaagucguaaguuugaagggauaggcagggcuauccuuauguccagcuucacagcucuaggugcuggcgauugcuggcagucuuuggcauuuauucccugguauuuggacaucauuccugucuucuucccauguaaccugugggguuagggguccuuguccaaauuucuuuguguuguagaaacauucauacauacuauugaggcggggucugcccacugacaucauuugaacuugauuguuucuuuuaaagauuugguuuucaacuaaggccacauucugagguccuggagguugaagcuucaaucucccucccugucuuugucccuguccccgccccugccccugcccccaccccccuucuccaggaacagaguucaaucaacacccaagagaaaugaaaauuuccacacuaaaacuuguuuacaaacuuuaauaacagcagauucauaauagccaaaaaguagaacagcuuaaauguccaacuaacgaaugggcaaauucaguguuuucuagccacagaggaggagguuuucucagcagugaagaggagugaaguacuauaugcaucguacuggaugaauggugaggucauugcauugugggaaagcgaggcacaaaggauucuuuauaagguguccauaguagaggcuggagagaugacuuggcaguuaagaguacugccugcucuuccagaggacccgaguucaucucccagcgccuacgcagccugucauuccaauucuaagggauuggaucugucucuuggcaucugagggcccccccacgugugucacauauucaugcagccacacgugcauacacauaaauaaagaugaaucuuuauguccagaauagguguaaaucucaagacagaacuuagaacacgugcauacggacaggacuggggacgccuggagucugcgaggacagcgagugucuugauucugaguugcuuccugggugacaaaacuguucuaaaaucgauuauaaugaugguugcacaacucugcacaugucugaaaagcuauugaaauguacaccuuaaauggauagcuuauaugugaauuauauuuuauuaauaauauaacauucagugaaauucaaaauaaaaagggcauguuguuauaacgaagaauggcuuagggcaaguauagugaagugaugcuaacacagauguauauagauaaugaauauauaaucaggaaggcaaaagcuuagcuuugacugcugagacagaaaaggacuuccagggcuuucucagaaaggagcaagcuuaggccacagacugcuuccagcacucuggaaugccuuccuagaugucggccacauaggauucagugaguuuucagaggcuaacaaaauugaaauaaucuuaugacuucagucauuaucacuguagauaacuuuaggaaauggucuuauuuugugauucugagcuaaggcaguggaguuggaaugagaagaaaagacuuccuuaggaagucuuggggucaggagcaaggcaaaggguagaagaugucugcagggaaagagaggcagguaugaaggagcuagagcguagagaugguggguguggugcaagggagagggagauuuuccacuaggggaggaaugcgcacaagaugcagacagacagacaucagucuguaaccaggcagcagcagaggaaaguguaaagggagcguuuggcuuuggcucuugcacaucccccccccccacacuuuuuuuuuuccuggaguagccccuguuggaaccacuguuagauucaugaaguucuuugauguuaccaugccuucuccugguuguggacugccuaccuaacaugaggaaguuauguaugcgaaauagguugguuuauuucauagaguacuuaccuauuguuuugggaaugcucaaaacacuugucucugcucgucuaaagcccaaguguuggcacagcuucuuaagugugggucagaaacccauacgcaauugaauccugacauaggacccuguaacaaggugaggcuguggaaagucugggagcacgggaagguuucugaggguacaacaauaacaaaauuaauuccgauccaaaugcauaacggcucugggguguagcguuaccaagcuucauugcagccuugguuuugaacacacgaggaagaauuaaaggguaucuucccagaaucugaagaaaugguguccugaaggauagacaguguuucuucuauaucaucucuauuaauuugaugagauuucagcauuuuaaaauuuguuauagauguacucacucaccaacauaggagcaccacccuuaggccuguggucuuguauguggaaucuugagaaggcuaaguuuauaggguuuucugugcuauuugauaaaauaucccauuggcuuuagaagcuacccuuucuccaaaaaaaaaaaaagaaugacuuucuuccacuugguagggggugggaggacaccucaccucucucagaggcaucagagcuuacaauguguauguuuauugugaaaauuuaccacauugcuaguguacauucuauaguugucugccucacaagacccauuucugauggauacaaauuaucuugauguaauuacuauuaccuuuuacuucuagaguuaccacagaucagccaguaaaugacaaagucacuuuacuguaugguugucuuuagacuuaaugacuaaccagaauucauuaaaauuaacagucuuugcaaugcauacuuccuguauucacaaaaguugccaaacuuacauugauuaaaaaaaaaaaaagguaaaaauucuuguuguagauacaucugauucuaacccaugcuuucuguaggaauacauauuuauauaaaagugucccccauaaaauagggguuuuuaaggaccuggggaacuuucccuguguuguccuuaaaccacacauuaccaauuauaaaacuacuuuaacuguuugagaacuaacucagagguggggauaguggugacuccaguuaaggaauuauaauauuguucuuuaauaugcucacaacauucaccugcccuccugucuacaggggcaaugucuguguaugucagcugugcaaguguugacuuuaggaugcuuuuuaaacuucucguguauuugguacugcggcauuacugcagucagauccuggcugugcuuagaagacaggacccagggugguguaaaaaaaauccaggaaggccccggauggcuuggccaugaugaccacagccuucggucagaauugucaacucugccccaagaccaauuuacuuggcuucuaagcaggauugcaagcaggaguuuuuucauuuuaaguuuucccccugaagaauggcucuuuuccuugcuuauucuuucuucagaacauuacaguguaagcagcggagucaagagcaucccuagcaggucgaccaguuuuuaaaaagguaacuuaauacaaggaaaugagucuuuaauuauuaccgccacuguaacacuguggcccgcgaauggcacucccugggggaaaugagucuuucguuauugccgccauuguaacacuguggccugugaguggcacucccuggcacagcuguacaaagaggcuguuuguggagcucaugcuuccugccaagcauaguccuagacauuuugcacagauaucuuguuucauguagaaaccugaguguggccuuuagcucucuggagagcaguagcucaauauuggguuuuacucuguuguuuacugucuccaaauccuauuucuuuauuucaugggaucaaucacugaucaggaggcuugacagaagcuuuaguuaaaacaagcaagcuuuuucacaccccaguaccguggaugaauccgucacagcaugcuaggugaagaaaccucagcagagaaugcugcguaccgccucggcccacgcauguggcacgugggagcgaaccaagcuacaagguccaagcagagcugaguggcagaggcaggcugcaugucugcaaggcgacucggggucaggggaugcuaggcucuugggcaucgucacugcaggugccuacaccuuuauagacgaagcuuaacggagcuggcuggcaggugcuuuaguguuaauguagugaaaauggugccucagaagagaccggcuucauucaguguagucaguaagugaagugcccuuaaucgggaccuuaguuuguguuccacagagugaucgucugagugggauucaaucccaggaccccuauuugccaccguauucuauagccaugugcuuccaucugcucucuccacauacacacaguggaauuagaugaacacaccucccugugucuugaaaacucgagugggcauuguuacggccuuuucagucuucuggagcuguguggugccgacucucuucagugccuaagccaucagcaggccagggccacccuucaaaguucugcuucaugagauguuacaccgaagaugcuggaagaguuuguguguauuuuuauuuuuauggugcuggggauugacccaaggagcucacaccuuccagaccagugcccugccacugagcugcacccuagccugaccguguauuuuguuagccuugccaguguuacuuauacagguugugaagccuucugauggcuuuucaaucccagacugaugaccucuuauuugucacuguauucuauagccuuaugcuuucaucugcucuuuccacuuguacacacacacacacacacacacacacgcacacacacccauacccaucugugugcuucuaacaucaucuaguaaggcuagaaguagguuauggaccucuuggagucaaugugugugagcaauacaguugaagacaauguuacugguuggaaguuagcuaacauucuuacccgaggaucaccacuuuaggagccucguggcagcaucucugacaggcucccugucugcugagccuggucuguaaccugccuaguaacguauuucuauuagagaucgauuuacguguaaucugagaaugcuuaauauuuucagaagacaaacaaggcaugggauacuauacaguaagaaaauucccccagggacugcuucacugguuuucagaaccauaaauaauugccuacaaucuugucaguaaguccagguuaaagccgaucucgccccugacaguugugcuucucacaacgcugcaagagaacuuugaaugcccgcgggagagcuaaaagcaaccuguugugcacaguuccagacaggcguguguuucuuuuucuugugguuggcauaguugcuuccuguuuguuuccugcugguccacacugaaggaaaagccgaguaccuaacugaguguuggauguggucuguaccuugccagaggaaguagauuguuuagucugguuuaagcacaggaucaggcagaugcaagacagggauaaagaguggcggcaagaaauuuguauaagacuuggacucugucccuggagaaguguacacagcugcacacacagcaagucagacacaaggugacgugaaaugagagaaaugagaggaaaggucagcuagagcuggcugccaauggcggcugagguguuugucaccuuuggcauuuaguaggauauuuucagaaucauggaguucaagcccucuuuccugggagacaaauaauugcuuagugguagagcugagcuagcuuuuaugcaagccuacaaaaucuauaguagccuuuauucuuaaauagcguaagauuuuaacuguaauuuaacuaaacaaauuaaauuauaauuauuugaauacauuauuuaaauuauaagugauuuaagugaauaaauuugguaaauuauagugaaugaaaaguuaacuaaaacugaaaggugaauucaucucucucuugcuuaauuuuaaagcagcagcuauuacccugccaucagguuacaggguaauuuaauacccuguuuucuuugguuuccccaggcuaucuuuuaauuguauguaugugaaacuaaaaauuuagaagucuaaaauuaaauuuacuuguauggucaccuguaauggacagucucuucuuucagcccuuacugauaauagaagaauacacagcgucguugucccauagguccaguggggacaaagaggggugggugggggucucacaguuggcugccaccagauucacugaagcugggugguguuuuugcuuuuuuguuuuuaauccuaaaauaugggcuuuccuuucguccuguagcaacuccuccugugucccugagugcugcuuuuccccauuuccugcugcuaaaagauuuguaggcauuuuagagaaaagccaaagaacacacagaacagauuugugcaguuugcuugauuagcacuagguauaaacaacuuuuuuguuccaggcuaagaacuguuuaaaugcaccucccacaccucguuucuugcucaguucauaaugagaaaagucuuuaaucaaggcuucaacaauaaagacuagacuugaaagccaagaaaguuagaauucacucaguucaacuguaugcccagggcccagugauucaaguccugcuuuuggcccaggagcuagaguacacaugaaugagugagacacacaagguccugccuaugguggauccuaugugccccuucugaucuuucagaaaugucacccaaaaaugcacaucugauaugaccuuccuuggagugcucucaugcaaaagccuguugcuggggaaucuuuaaccuuuauuccuuauaaccugcaaucccauguaaaaagugcauucuugguggauccaguggugacauaccuaauguaucugacggaccauauagcuccauguuuugugccuccuagcaggcaaccuucgaaagcacugcucacagaugcacagauuccaguuauauucuuguaaggauggugaggcacugcccggagagcuggagucacagagcagaguucucauucuggcagaagccaggauuuguucaagugcuucucccagagguguuggguggggcauugugguugaaguacaguguccuguguucuaguuuguuaccaugacuuagagggagugccggcagguugacuuucuuuuuuucuucuucuucuucuucuucuucuucuuuuuuuuuuuuuucaguuuuccgagacaggguuucucuguauagcccuggcuguccuggaacucacuuuguagaccaggcuggccucaaacucagaaauccgucugcgucugccuccugagggcugggauuaaaggcgugcgccaccacgcccagccugcaaauugacuuucggaagcuacuccugcacguagaaaauaaguuauuuaaguuuuccauuuuggguaucaauuuacucacaugguuuucuccuaaacuuucguucuuucuuaucugaaaugcuuccaccauuuccagugguugcaguggguuucgagaagcuccugcauagagacuggagaauuaaagaugcucuagguauuccgaugcuugccuaugguaggcucggcccuccagaggcugggguagaaaauuuccaguucaaggcaagccugugccacauaguuaaacgcugaagacaccagguguaaagugaagagauggcuucagagggacugugauggaaagaagguagagagagagaaagaaccuggugccauuuccaagaaggcgcucuuggacuugguuaaacgugaacuggagacuggggugguguucugcuagaaugugugaagcccugccuuuugaucaacagcgcugcauaaaacugggugugguggugcaggcguccucauagcacccgggggggcgggggggggggugguggugguggaaagaggagaaucggagauucugugucauccucagcuacgaagugaggcuaagguuagccugggcuacaugaguccuaaugauuuaaauaaauaaauaaacaaaucaauaaaucaaaagcugagcuaggcaggaggugugauaccugacuacacauuuuagcuucuguuugguggcccaguggauggauuuuuaagaguauaaugcauagcaucuuuugcugguuugguuuggggcagugcagcggggaaguucuguuuacuuagcuuuccuaggaugaagcauuuaguauaugccaacuuuuaguaacaagcaauggcuucccugugguuuucuuaauuugcuauuuuaaaaugucagccgcuuaggucucauugacugauuaguaaccagucuaagcauuuuaagaauuuguaaguaauuaguuuacucugugaauagcuugaggcauuauuaaaauagaauguuaacuucauuggaaacuuuuuuuuuuuaaguucucuuucuguuaguggcaugcuauagucuggaggccuuuguuuaguggacucacacagggaugagucauuaaauaaaagcaaaccuugggcaaggacuuggccugcuggcuccuguugcaucgaagucaaaccacugaguccccugugaugcacuccagcuuccugaugcaaaccuagaacauguuucugagaucgcacaggugaccucuagaccuggccaucugcuuccugggcuuagcuguuuuaagucagacagacuugcuccucccuguuuccugugagaacacugggacugauguccaguuagcacgcagccuuuaccagagcugagcaaaaauuaaaacauucucuuucaccuucaguguuagaaacagcaguaaacaaugcagaagaccaggguuuaagugcugacugcaaggacagcucaguuuuuauagacuuaaaagccuugagacuugaacaggccuuuuggaucugcuuaguauuuuuguuaacagcuguagugagcuaaaacccacauguaacugccccugagagugguuuuuaguguguaguuaguuguacaaguaacuguagaggaugguuccagacgucccugcaguuaacaaaaaucuguaggucgauguucaagucccggugugaagcagguggugucuguacauagcugaugcacguugccuccuacuccucagauugucuguggccucgaacugugggaaucggugcucuacucugaugcagggaguggcaaggggaaaagguuucgacuggugcagaugcauuuguuucccgacaguuuccauuggugaccgauugaauccguaucugaggguccaguggaugugagugauguccacgguccucgauccaucgacacaguguuuauaaguaaggaccagagacaaugcugaucaagggguauuaagucgcagcuguagcagaauaagaaguucuguuguguuguugcauacgugguaggacgacagcagcugaguuauguucaagauugcucagaaaacuagaagaaaggauuuggaauguuuuuauuguaagaaauaaugauaauaaaauauguaaguuaugcuuagcuugauucaaauguagauagauucuucuaauuuuuccccaaaggaaacugcuccuccaauggcaaugucugguucucccagcccugggcagcugcuaauccacuugcgucacuaugggcuucucugcucugaacauuuucuguugauggagucauacaauaaguagucuuuuugugacuggccuuuuaaaagccauuuacauauuguuggggacagaacccaaggccuugugggcuuuaugcaagcacuacugaaagcuauauuccagcacuuuaaaaaaaaacuuacuacaguguuuuccauaucaauaacauauaucaguguuucaucccuguucaaauaauauuccaccauccugcccagucacacucaucugcucacuaguuggcagcaauuucaguguuucuguauuuuggcuauuaucuguaaugcugcuguggagauuuauauauaacuuuugauauggacauauguucuauuucucuuaggcauaugccugagguauuuucagacuguuuucccaagaagcuauagccuucugaucuccugauuucauccuguauuauacuuauaaucuccccacauccuugauaaugcuuguugauaaucugccuuuuugcuguguucaccucacugacgcgaacgggcaucaucuugugggcuggaacugcaucuccggaaagaccagggcugcuggucguccuugccagcgcuuucugguuuauccuuggagaaaugucugcucggaucuuuugccuguuauuucacugccacucaucuuuucaugucuccuuuuaucuuucucaggaagaucuuauuucuaaaagcuacauucuugguaguguuggggauggaauccuagguccugugcauccuaggcgagcacugucacugggcuucagucccagcccauguguguacugagggaauuccgagguguuggauccccucaggcuggaguuucagguagucaugaacugccaagugaguacugggaacugaacuuggaagagcaguaagugcucauagccgcugagccagcuccccggacacugucuuaauuuugaggcauaguaguucuuuguguagucuuaaugcacgucccuaugauuuuguaaaaauaaacaaaauuauccuacucucuguagugucuuuucaucuucaaagggcaauggugcccuuugaaccugacaauuguauacacagauuucauuuuucuucucuucuguugcugugcuuucguguugucuaagaagccauuguccuaauucaaggacuuugcuccucccugugugccugugugugugcuguugagaagguuaccccucuugcucuuacuugccucaguacacguguuggaaauuaguugauugaaacugugaaggcugauuuugcucucacuucucaccugcugaucuguugucgguccuuacugcgagagcuguguagcaucugcgaggacggcacucuccgcagucuagagcuccauaggaaguuuugagagcugacacggugcuuucuugucuauuaaggauuaaauagagugauuuuggugcugaagggcacuacccucucucuucacuuuccugagugcuuuggaucucugugagguuugagguuguaucaacuuuuauaaaaagagcugaaauuuuguuagggauuauguugggccuauacauuaaccuagaaaaaaauugacaucuuguguguguguguguguguguguguguguguguguguaaaagccagaggucaacucguggugucuuccucuuuugcuccccaccuuauuuuucgaugcagugucucucacugcacuugaacuggacaguuugaggcagccagugaccuuggggaucagcucguccccaucccuccagcaccgaggucacggacacauccugccaucugcagcauuuucccugggcgucggggauucaaacucagguggucuugcuugcaugggaagcacuuuacagacugagccacacucuuaauauuaagucuuccagucauacaugucggauuucuuugaaucgagauaauucaaaucauaugcccuuacauuguuucccuucuuggcuaaaauucauucugauucugauacuacugugacuaggauugugugagucauuucacucuccuguuggugucuguacugaugguggggccugagagugaccucacuugcuuacacuagaguugucaaugcuacguguuccuguguggaagguggugguggucuugucaucugcagauaguucuccuucuugucuacucuagguggcuguuaguucacuuucucauuuauugcccgggcuaaguuuuccagugcaaggcugauuagacgugcaaugcuuagucuuccuaaagguccuguguucuagaacuuacguagggucacuagcugcagaccuugucugcagcagccugugaggugcugauagauaugcacacaguccuaugucuccugucagacuuuagucaugcauagaccuuuucacuagcuaucaacuuaugaauggguuucuguagaggagauauauauggauuagauaaaucuauaaaucguucuuuucaguucagugugcaaugugcuugcugauuagaaacauaaagaaugggccuuaccuugcagcugaguaaaaacaucccucaauguccccacguugcccgugccucuaaggcaggggcugucaaccuuccuaaugcugugacccccuuaagacaguuccucauguuguggugacccccaaccauaaaauuauuuuugcugcugcuucauaacuguaauuuuguuacaguuaugaauuguaaauaucggauaugcaggguaucugauacaugauccccaaggggucauggcccccagguugagaaccacucuucacuuuucuugucuacuaagaauuaaauagaaugacuuuggugcugaaagggacuguccucgcuccuuuuauaauaaaguaguucucuauggguaaaagccugccaagagaauacuguuugcaugaaaggccuuugguuaccgaggauuugagcgaguugggcuccagggccuccagagcuuucccuggacuugggagugaggggcaguggauuccaagcccucagugguccucuggcucugcuccacaugcgguggggccagcuguccugcccuccuccaggggaggcaugugguagcugccgcaaagccagcuagcuagcuuucucacugauggaaucagagggcucucagaaucuaaggcugucaugucugcugaacauccagugccugggccgagugccuuuguccuugccagcuucggacugugguggcaaucuugggugacauuacugugugaggcaggggccccaugcggcucagcagugggcuggcuacguuguguuuggaaacugucuagaagaggauucacaggugggaagggaacaacgcucugcauuguuucuugugucauucucaccuaagcuacgucuucuccccacagcccuuccauagugcaaggucagagagagcuuaugaaugaguggauaugaauauccgauuaugaaugcuuagcugagauacgggaauguuggaggcucaggaaggccccuucccuaaaacccauugcauagcauguugaggcucuggggcaguaugcuuagaagaaacccaguuuucuaaaguuaggaauccccuguguuccauagcugugcauauguggguaguuuguacauagacaucaauagguagcucuuuuggcccaagacaugaaaucagaauaaagagcuucuccaucaauaaggacccagggcagcgauuccaagauucucagcuggugcacacaguuuugacuggugacuaauuagaacagcaaggcauauuuauaacuaaccaguaauaguuuauucugccaccgccaagugaagguaaacgcuuacccgcugcucagaacugcaccuagcuccuugccauuagugcagaggagagcccaaugguuagagucuacaagucuggaaaaguguggcaugucuucuuacaguagacgaugcguacacuuucaguugccuuucaguguguuggucucacucuguguuuugaacucggauuuucauagguacagguauccagacuugaauccaggcccugucauacccugugaaaucuucaguucuuugugucauaccucauuacuuggagaaggugauagcucaucuccccauagggugguaauagugaauacaugaguuauuuacacauaacauauuacgugccuagagaaguacuauccuguagaguguugccaggauuuuagauguuuaaguuaaaagcaguuguaaaaauaaaaauuuacaaccacagccacuacugccaucccuauuccuguagucaaagauggauuaucuguaauuaucuuauauuaaaaaguuuuaaaugugaccuucuuucccuccccacacacaccuuccucuggcgauguuaagggcaguaggagaaagaggccuuguuuauaggcauccuggaaaguuuuuuccugaguccccugagcugugcuuccucucaaacccauuaaguauuggaaaauuaaccacauucuaaucaagugaauuaguuagauucagugcuuaaugaaaaacccucaucuuaagacuagcauucagaagacaguugucuguuuucuuuucuucgguuuggauaagaaacagccaggaacaggucgccucagaaggaacguucaauuccaagaccuagcacucugucuagucucccucgucuguuaugugucugugucuggaacgauagguguggccccucaugguuuugggcccacgguugauaugggacaaguucaauguguaguccgacaguuaaacagaccauccugccaaguuugucuaacaccuuguuucuucucuccugugcgacagguaucucagacgaggauauuaucaacaucacucugcccacuggaguuccgauucugcuggaguuggaugagaaccugcgugccguugggccucaccaguuccugggcaaccaggaggccauccaggcagccauuaagaaaguggaugaucaagggaaagugaaacaaggcaaacaauaaaguguggccaggaacgaguuugggguggcaugcaguguguuccgagcgggcuucucccccuccuccgacgggcccccucucccuaagucuaggcugugugguagaguuuguguagguaacuagguaauuuaucguggcccagacgugaccuucgaaugcugaagagcuuugucugaagccugaaugaacuuuucugcuccucccguuugaauuaacuuugcaaaguaguagccagcggggggauuugaccagggugguuuuguguuuuggagacaggagaguaacaaguggagaugaaauuguuuauccuuaacaagucauugcagagucaccacugacaggugcuauuccagugagcaggucaccguuuuauucaauaauacuucucgagaagacuacuagguagcacuugggcaguuuagaucagaggcgcaucgaauggcagagucacaggcggguccgagggaaggcaucugagcgccacaguagcacaaggcccuuugaugucuagcccagugccauccugucugccgucaguagaaaccaacuucagccaguuagaaggaccaggguaugcacagugguagcaguuuauauccuucuguuucauuuuuaacuuuugaacuuuaaucuuuggggacuucacaguuuaaaauaaagcuuugugacugcauacaacacgcgcaaggugccucgagugugugaugaauuucagacgggccucugagcuuguccuggccgccgucuccuguagcacuccuaagguuacauuaguugagcacaacccaccccugaagugaaggcuggcugggggaaguugaccguggugcgugugauuuuauucaccugagcaggcugacagccugugagagcgucugcuguauaucugcuguuccucggcuagguacaaaagauuacaguccacauccuaguuuaggugggcugugagcagaagugaaguguguucaggugcugugugacagcugccguuucuuuaggcuguugccucccugaaagcaaguccucgauauuccagugacagucaugcacacauuuugcagacauaguacuuacgauagauguuaccaucuuuucaugcuuuuuuccaggaguggguuaauuuacuuguauccauuuuauaauaaaacgggccuuugguggaaac

SEQ ID NO: 2901 - RNA, 10845 nt, Mus musculus
cggggcguaaaccggaaccuggcagcggguuccgcccucgcgccggggaggagucccggagccgagcuggagcuggagcaccucucacacccuccucgcccuccccaccgacaucaugcuccaguuccuggugaguggggccucggaggaucgggccucgcggucgccucguucccccggggucccgggucggcggugcacggcucugcaguuggggcucgucgcccucggguuugcucgcgcaguuuuccucuggccuccuccuaaguccuugggucuuugccuggguuuguuuauauguaguccuucaaguuccgaaaacuuuggggugucagugauaugacugcguuuucaaaaaaccacuuacugugagcucuuggcgaaaucuucgcgguaaguugggucggaggagucaucaagaugacuuggcuccuguccucuccacgcgacuucccguagacccccaucuauuauauacggcuuauuugaggccucagagugccuuucacacgccgugcauuagucagccacaucacgaggucgcagcgagagauccacagugcccucccucuucagaccuuuacagauugcccgcuuugaggagugagucagacugcccugcgaguaacucuuguaaaaaccugccccuccccacacccuuucaagucuccuuuuugaguuaacacguuuuucuggcaaaaaucaaguauuucuaaaauugccuguugaggauucuaggaaacuugccagucaaauuuucagaugaaaguuuucaaacacuuucagaugaaagcguuucaucuucgaauucuaauaaagcagauaucuucuuucuuucccacggucaguggcuaccuggugcuccgagaaugaguauuguuuacauaaaacugcccuacaaagacucaguugccucugggguuucucuaguguccuaacuaggccuuaguuuaggagguaggaguaauuagcaguaauuuacuuguuaggaaucacuuuuaaaagcagcaucagccagcuaguguaaggugauaggauuggcccuuccacugcauuugcuguucauugauaagcagggagaacauuaaaucgauuacacuuaaccuuuuaagugcuuugcugaaugaggcuaccuggugcgggacuagcgcucuguacuuaaacauggguuuugauuggaaaauucaaaauuuucaacauuuauggagagaugcugaagccgaccauuagaugcuuagcuaggauguaacugauguuccuucucuugcccugggucugucuccucuucauugcuuuuguugggaaaaguggaaucagauguacagagauggaaucaacuuuccucuuguggaacuuggucaaacacugcuaguuucugcaaaucuugcuuuuuacauuagccguuucaacuguuuucuaaaugguuaagaguuuagacccuaucuuuaaucucaagguguguguguauguguguguguuggggacgugggguuggguggguguuggccagguuauuuaaauuuucuaugcuucaguuugcaccucaugagguuucaaaaggagccaagauguugaacacguaaacacuaaaucgugguugagauauacugcccugucucuucuguaagguaucagaaaugggaacuggccucccacugauaggagaggcuugggugugguggaaagauuccaggcucuucccuuugauggugcaaggcagcugaauacuuuguaaccucugagauguugccuaaguugaaaacuugcauuugauuguguggcuugucuacccauuaccccuauuuccacaccgcacuccacagcuugcuccuagcuuggcugaaguucuuugaaggaacaccuagaugggaauuggacugugagcacugcugugagugucagggcaccugaacacugcuacaguuucuguuccucuucccccuggggcccaguagcaucaccuccucauaacucacccucauucagcugcuggggccugugcaccgugcuguguggguucuguccugggauagcucagaauugcggagugaggggaccauaucuggguguagcagcugggaggcucucucccugucucuaaucuugucucccgcugcuugcuucugcucuuaguuccugugaagugcuuaaguccggagcuggcugugcuuccuaaacucacccuuagggaacgggcuccuccccaagccagcaccuuucacaucagcuuccaggacaaccuugaauccccuucucugugcuuccagaucccaaguaucaacugucaguggcuuuccuuugccuuucucucagccucuacucaucuggauugaguuugccuuccugcuuucccaguccuuuccccacacuuaacgcucacauuugaaauguugacauagucauugauuucuuucucguauucaugcauucaccgguuuaucuagucuuuucuuagaaucauguaauaccguaggugcaucuucuuuguuacauugcauccguuuaucuguugaugacugugcgugccucuccugugagggccugcacgugcaagaagucugaggacagccuccagcagccgguucuccuucccucaugugggucuaggggguugagcucagguugccaggcucgggugcaggguguuacccugcugagccauuuuuccacgccagaccugcuguguagucacgaguaagaucuuuacuugcuccgugccucaguuucccccagcauaagccugggcaguaauagugguuauuccacgugugcaugcuugugaggaucaggcugugaacuagcaggguucuccagucuggcuggcauacugccacuucucuccacuacuaaaggauuugguuggggauauaaagggacuuagucaauacgcagugagugacuucguuugcacucagcucugcauauugcugggcccauccgcauauuuaacuaaccauggauuagauaaauaugaaugaauaugaaaaauauaaauauuagcagauaguugcucaucaaugguauguguacaguuuuuccuugccguuccugagcagugcagugggauagacugccgcaggccuuccauacaguaggucuuaugagugaucaagaggguuagaguguaugggaggacauggggggcucccgugcaguuguaggaccugcuugaauagcuacagauguuggugugggggguguccugggauggagccccucauuaauuuuaggucuuccuucuucaccucauuacuaccguugauuauaagauagugguuacaagguagcuccagcuucuuuuagagcaggcaaacccguacaccuuucccagagagauuucauguacuucuguugaauauuggcacauuaaggagguuuuuuuuucuccuucuuuucuucucuaagcaguauuacugaauauaaagcaugcuuuccuaggaagcagugaagggcuuuagcccuagcaagguuuugcuuuaauacacagaauguaggguuguuuuuuuuuaaacuacuaaacauuuggugauagucuucacacugaguuuaaaaacuaagacagagaaaugguaguguguguacaugccuccuuggaaggccuucugauuucuucuuuugaaucugaauuuaagaaugcuguugccauggcugaagagaugccucggcuguugagagcgcuggucgcucuuccaaaggaccuggguuugauuugcuguacauugauagaggcucacaacaucuguaacucgaguccuagggguucugauguucucuuuggccucugugcauacugcacgcauguggugggcauuauauuauacaugugggcaggacacccauacagguaaacauaaauagcauuuuaaaauauuuuaucaacuuagcuuuuuauuaguucuaguuaguuaauguacaguuuuuugaguuguagaugcuuuuaccauaaaccaaaugucauuuuuagguuuccuuuucagugcuggcaugagccuauauuugcuuaacaauuuuuaaaaaagauuuuauuauuuuaagugugcuugugcucaggguagaggugugaguucucuggugaguugcggguaggcaugagcugccugguaugggugcuaggacugagcucgcauccucugaaagaguagcaugagcucugagucgcugagccaucucuccaacccuuuuuaaaaauagauucuuaaauccuuaucaguaacuugggccuggguguguuauuuuugaaaauacaguuugaugagucacauucggacuugucagccgcuuugagguuuugccaggagcugugccagauaaacauugcgguuuuauuugcuggucuccagacacaacuuucugaaagggaaggcccugaguggauggcagaugcaucuguuuuggaguaggcgcugugccuuuuagcagagcuuuuuaguguuaauggauaaagcauuguugaccaaucuguuuguguguuaaaagaaauagguacacuuacaauaauguagacuccucaugcgcagacucuuccauuuauuggacugguucuauuuugcaccucuggaauuuccauucuuucuaacaaaguccagguuggaagccaugaaguugucuuugguuucuucuacuucacuccagguaguugagaugacuuuaccaaauuuggugauauuguuuguuugcuuguuuguuugcuuguuuguuuuguuuuguuuggcauugagacaaagguucacccauuuauuguauguaauccaguggcuucagugugcucagagaucguguaccuucucauuuuacauaaaaaagaaacuguauaauauagggagucauuucucauuccccucuccaaacuggacaaucaacaguugguuuucuaucaauguggaauugcuguuuuguauuuuuuuuuuaauagaaccauacaguauguggucuuuucugacugcccuugacugcacugucaaggcuccucuacugacagcauggagcagugagcgcuucauuucucgauaugaugaguauguguuaaucagcucuccaguuguuuccgcucuugguuguuaggaaugggcuaagccaggaauauugaggaggcauuuuuguggggguucauguccaccuuuuggugcaugcccacacuggaguugucacauccuauaacugugcacacagcacucuggaaaguggcuagaugguuuuucagagcggccauguguuauacaccaguggaagaugaagaccuccgccccaugucuugccagcauuuguuguuuguuuuguuugguuugguuuugcugcuuuugaguaaagccaucuaagcggaugugccgugguuccucgugguuuugauuagcguuuccucggugacugaugucaaacaucucgugggcuuguugacuccgugucuuuggaggauccacucacagcuucugccacuuuuuaaauugaauuauguaucuccgucauuuaauugugaaagaccagauuaugauuugcaaauaauucuauuuugugguuuguccuuucucuuugaugcuguuauuugaagggcaaacauuuuuauauuucguguguguauguacacgugacuaugcaggacuguuuggcugugcauacagauguccagguuuagauuugcuuuucuugucugcuccuaccuguugaccaucuccugaagcaagcacgcuuuccugacuucuggguucuccaucauuuuccugagugaguggcacuucucacaugugcucugcaucauauuuaaaaugucgcguuguagauuugguaguauucuggaacgggugccgcguauagaggccauggguuuuguuugucuucuaaaauaacuguccccuuuucugccccagugcuuggugacauugacaaaauaguuaguuaggcaguguuuauuuugagacacacauuguaagaauuaggaauucugugucugagccggaacguuucaguguugggcugauucagaggugaggaagcgcagcggagcuggagcggguugaguggcccacgaaggcacggucucucggacgaaggcacggucucgucucucuugcggggcuacugcuucucacgguuccucgugccggcuaggauucacagcaucaaggaguucuuucccucuccuuuuaaauuuugucucaaauuaaauuaucuuucugguuuucagaaaguugugguuugaaucuacuagagugaaaaaaauguaauucugauucuuauugcuaccuuaguaaugacuuuuaaaaacaucagaaaaugguuagcagcuugaaacuagguagcuucuuuuauguuucuugcuaacaaccaaccaauuuaaaacugccuuuggguuuaaagguuaaguauaagacagacccaguuguaguucuccuuuuuuguguuuucucccuucaggguuuauuuuuacuauuuaugguggugguggugguagugguaguuguagugugcacuauguucacuggcauguggaugccggcagagggcagaauaagguguugguuccugaagcuggagucaguugugagcugacuaacaugggcgaugagaacugaacucugguacucugcagugguccuaacugcugagccaucucuccaguacccccaucuguauccuugccucaccugcaucucaugugugagugaugggacacuuaaugcuguucuuugauuucugucuuaacuucucuguugagacugaguuaguggcaauaccguuuaaacaaaacaaugggaaaaaaggguagaugccaauuugaauuuauuaaguuagaaauuagcccacaguuacaagcucugaaauaaaaagucacugagggaaaucagaauuaucauuaaauugcacgucuguggaacucuggcccauuuguguauauggaguauuuguguauauggaguauucuacauuuucaggagaauacucacucagugggguaaauguuuacaguucucuaaaaguuguccaugucccuuuugucauugagugggagccacagaccuuaaguguccugcccuuuaguccccacccuuggcguggugcuaggcuccgugaugugucagaguuuccuguucuucucugcccuugaggauuugaguccccgaguaacuggaguuguugucugcugcugcuuuccugaauaacccugggcaaaccgcucuagcucuuuugaaauaaggagagacuaaacucugagagccccuuuauuuuucuaagcuuuuuugauucaaacggguuuuuguuguuguuguuuugagaagaagucuuguuuuguggggaugagacuuuugcuggguagcugggacucucuguguagaccaggauggccucuccaggccaagaaugccccugccucugaaugcugauggcaaaugugagccaccaugcccagcucccguggguauuugcaagugaauaccuuuuuuaucagcuguguacaggaguaacaguaccuacaacaaacaguaacgaguaauaguaacaaaaucagaacacuggcuuccagaccuuucaaacuugcucaaagccaccguuauucuguccuaauguuggugcaugguauauauguaugugauuguuucauagaagaaagaugugacuucucuguuggaugcaguccuacacugaggaccugggcagucaccugccgugcacuucuugggaagaugcagcccgugugucugacauaguugcaggcuccugguggguuuugccugcaguguaacucuccuguucuguucuuucagcuuggauuuacuuugggcaacgugguuggaauguaucuggcucagaacuaugaaguaagugacuacauucaugucuuucuuggcuuacuguaaccguuucauaguuacauaguuaccucucucaaggugaaguuugcgugcuaacacagugaggucuguaaauguaacuccuuaauuuuauagaaagcuuuucuguuguuugagaaaguaacugaacucacaaaggcacgguguccgcacaucaucccaggagaacuggaugugaauuuagcguggcuuguaggaggaagacgguuugggaaagugaggagucacauccaccucacuguugguguaugagggagggaggagggguggaaaaaugcugucacagcccaacgagaagccucgaauguguugcagagagacaaaggauuacauuuucuucuguacccagggacaggaacuuuguugcuuucuuauugccuauagauacacuucuuuuaucuggcacuugagcugaagguccaaguguguaucuaaagggagugcugggccuggcuuucagagaggaaauguaaaucuaacacugauagcuaauauauauagauacaagccaaggaaacaccacugaguaggucuccagaggaagccaaagccuuggcaaagcccuuuguccuuuaaagaagagcugugaaagauacuggcaagucuuucuagucuuccuaucuauagcuaaauuauaauguuucuuuuuuuccucuuuaaagaugccaaaccuggcuaaaaaacuugaagagauuaagaaggaccuggaagccaagaagaagcccccuaguuccugaugccugccuggcacugcaaucuggacccaccaguuccauccuggggggccugucuccuucacagccacguccaaagcuguguuccucuuuggucucagacccugcgcguugcugaggcuccagcacgggccagaaguggaguuagcuuuccguuuccagcaucuccccguucccguaucuuccguccaccugcuucugagaccuaagccuggaaccauggugcuagguuagcagccgcaaccaugacaggacucacucgccugugcucugggauuccuaccgccuacugucaagaaaugaauggauuuggauagcugcuggggacucacugucuagcagugauaacaggagcuugcuagacaaacuaaacuguguuaaagucauuaaagucaguaucuucaagccaguuucuggugaauuaauccauuuauuauauauuguuaccaaggagcuccaugguugaugauuuaaccaguaaaucauuugcuggucauuaaccaggaaacuauuuuaugcauucuauaaaaagcaaacaaacugggaaaacuuaaaacaugcaaaguaacuguugucuucguacaguucagucuaugcagucuauguuuuuccuuaaugauauauuugaacugaaucugccguaaaagagccauucuuuaugcuggcacuugauaggauggguggauaaaugaggagcuguugauaaaauaauguuacuuuuuuuuuuuuaaacauuaaaauguauccuaauuauauaacuucauagugaacccccuaagagaaguguggugcaaaugugugguaaagugagucucucugggaucugggaucugaugcuucccccacccccgccccccacccccacccccacccaccccccgcccccgguugaggcauccuccccggaagcaggacggaccaucaggcgucagcaacuucauuuuuuuuaaagacagucucccaguguuacccaggguggucucaagcuccugggcucaaguaauccuccugccucagcuuccgggugcugggaccacaggugugcaccaugguguccagccuaguccguaauguuuuuaauuaaaaaauauuuaaaaauuauucccacaggagaugauaggaaagugauuucacaugaagacucuuucuagccucugucuuauucccagguacaauuccucaggcaaucccuggugucagguuccugugugccuuugagaaggagugucuaaccacauaaguguuuucgucuuuuguuacauacauacauacauacauacauacauacauacauacauacacacacacaguauguauguauuguguguguguguguacacauaugcuuuuugucucuuccuaucacuuuuguuuuugcacagagucaugacgcccacgcuuuuacagucagugauaacauugaauuucugacccuccugccucugccucucaggugcagggaucguaggugugcacugccaugcccaacugugcuuuuuaaagcucuuuuucuuuucuuucauuugcuuguuuuuuugagauaggguagccccagcuggccuggaacucacucuguagaccaggcuggcuucauacucccagagauccgucugcccuuugccuccugagugcugggauugaagguggcuccaucaugcuuggcuugcuucuuuauucuuaauggagagcaucccccuuccgucaguacguuaaccuucccccuuuguuuacugugcgcgguuccacugaauggguguuucauaauugaaugugcuacugcugagugcuuaggcuggucuucugcugguguggugcuagcacugaaccugaugcccauaucugcccagaguagagcuauaggauaacgacucacagucuaguuugcuaagacacggugugucucguuucagagggcuuauugggcaacuucccugacaaugaaugccuuuuuugaagaccacagguugcaaagauaaguuagggacaucugucuguuuucgggaagugaggacagugaccccauaugggaaucagaacauggcauugcuccuuagagauacauuccaucccugucaaggucaucucuguauacgagacagagguuggcuucucccuagcaguggggaguggggagugguguguucuucugagacucuguaacaucuaccucaugaggguuuccugggaaacagugagaugauguucugugcucuguuagacugugcuuugcaaacuguccaauaaauaguagcuacccauuggaaaag

SEQ ID NO: 2902 - RNA, 31067 nt, Mus musculus
uccuggacccauauacagcaacaauguguaucagaaaacuuauauugaaguuaaaaaaaaaagcuuuucuaugagcagcaucuaguaucguuagcucuuuaauaauugguuucuucauuucuucuagaaguaggauaaaaugguauuaaaaucucaaguuagucaagauuuucauaucguuaaggacgucuggaaaggaaggcaacagugacuggggauaaauauguugcuaacauguuaucuauagcacaauucaaguuuauuccauuuguucuugcaacacgaaacuuaaacacaguauuaguuagcauucggauguacaugaacuaggauacuuaugagaaacccaacugugucaagggaaugacauuguggaaacaugaacucaaauauaccaaaagugcacaaagcacuagucuuccuccauacugcuuagaaagauuguuucuccauuuacaaaauagaaucaggacaauuuaaauuuuuuuaaauuugcaugcaaaacacugcaauugcuuauuuaugaaggagggcacucuuaccagcuucuucuauacacaacccaguauacaauauuacaugaaggaaacagcagcucagcugaagugaauaaaaaucaaguacacauauauugaagcuccuuuuaucuggcuggggaaagaaagaaaugacuagaaggcuacuuguuuuagcuuucacaugcugcaguuacugccuuucuucugcgcccagcugguucuggaaaggugagcuugugcacaugggauaugcaagugcuguguuagaacucaaaucuacauaugcuggcaugaagcugggggugaggguaggggugggcagaccuguuaguacacuaaccauguucaggcaaguaaccuguuuuugauacagugcauaugaaaugauggauuuuaauauaaaacuauagaacaugcaggguuuuuuucugagauguuaaauaguacuucaguggaaaacaaaacuuaaccuuuuauuaaugcguguuguaccaaaagcagacauuuuagcuucauuuauucaaaaauauuaacauuaagugucaugaauuucucugccaagugguucagaaauacauuauaaauaaccuaguuuuuuuuuuguuuauuuuuguuuauuauuuuuuuaaagaaacuguaaaccauccuggucagucuauccuagucuauguuuauaugcuauuuucucaagcaaucacuucauagcuauggguuuacaaaauggccaacaaagggggaaggcaaaauagccucuacugcauuacaaggaacacugggauaaacuguacaaagaaucauaugguuuugguaccauaaugacuguagaaagcagacccaaguucuggaaugauaagacaauauacacucugcaauagccaacuauaacagaagacuuugaaagaaaaauugaaaauuguguaaaggguaaaauucaagccuuuaaaauaguaugccaagaggugaaaacaaaggucucaaaacacccuguugcauuauauugacucauagacugaucaugugccuuccacuuccuagcagaauguccaacucuauagcugcuuggccuuuugguuaagauuaaguguaggauauccaacucuaguaggcugcauuaaaacagcagagcuagccaaauauaucaaaguauuuaaacuacuguuuugugauuguuuucuuggacauagaaaaacuacaggggcaggcuaguugaaagugaaaaagccacaggauaaaaaagaguucaugggagaacacacacacacacacacacacacacacacacacacacacacaccccaaccaauuaucaacugauuaauaguuauuagccaggcugauuguucuuaguaauaguuuaacccugcuauauaaugcuacaaugccuuaaaaaaaaucaguuagguuuuuaauauuauuaucccuaaugugauuauaagucccuaucccaucaccuacccuuuaaaaauuugagguacauucaauuauugcaugauuggcuauggaaagauucuaauaguuuuuguaauccuguauagauggcaaauuaaaagcaaaagacaucuuaauacuuaaaguguaggccaucaaauuuaagguuguauguuuuaauucauuuuauuguucaugaaagaaaaaguuagagauaaguuucucuuaucugcagguccuaggaauaccguuuuagggcacuguauuauaagaacacagaaugcauuuugaaguugucacauguaugcaaagaaugauuguuaagauaaaaacaccaugcagguggggugguacuggcccagcaagagucuauuaccagcucaggagaacaugguaacaagaauguuuuugaagggaugaggucccaucuguccaaauacaguacaucucaccccagugauaccuuuggugcacuauaaaaucagcauccaugguggguuuuugagaggcauuccaaagaauauucuucauucuccaaacacaacgaaggcuggcucacucaaauagcaaaugaagaaacuccauagguacuaagacaacuguucucucuuuauaagauacuaacacgcuuauggcuaugauuuuauuuuuaaaucuccuuuacuaccagaaggagucucaaaguguuucaauguuauauaaaugucugagucuaaaggagaaaaaaagaaauaagccuacuggaaugauuccuccuuuaggcuccuagaauuuaacauuuuauaaauaaaacuagucaguuuuaucuaaagagacaugaaauugaugugaaaggggagagaaaauccaaaguuuagucauccagcaauucaggagugcgcugcuccuuaccuuaucuaagcucuuauguaaagauuaacgucauucuagagagauuuuggucacuaaccgcucuuaacuagccaggagcccccaggagagugcauucuuaaggcagaaggcuauagcuaauugcuuaucucagcacccuauguugacauaacagcagccacuacugcucacagcuagggcuaccaaauaaguagaguuggccuuguauagucagaccuucaauaaacuaauuaauaaauuagcuagggagcugagaagguccaaugauuccaauagacuguauuuuugcucucccuugggaauaagcuguauauuuuacuggaaaugaaaaacaggcugguuugaucaggaaucccaguaaaagucucaucacauuccccacugcuccuccaaaacauguuuuauuccccuccccuggcagucugauuuguuaugaauuucucucucccuucacccucuuaaaguauuuagcugaagaagcuggcagauagaaagugacagacagacaggcagcagugugaggccacaggagagucauccuucccaaguuaucaguccguccauccaucuaucacuggagaagagcuuugauugccugguugucaguggcuucaagggcggucaguccaucugggccuuucacagucuuaucagcacccugaaaaagagaggagagaaccuucuuuaacugaacuuacacuagggaacagcaagugccagagguggcuauguggcauaggccuuuuuuauacucugauuccuagaauccaugguggaaggccugaaccaacucuggacaguugucuucuguccuucauacugagcuauaacacauacauggcuauacucacauacauacaauaauaagauaaaaauauuuuaaaaugcauuuuuuugguguuagaaauuauaagaaacaaaacaacugucuuaauuacuguuuuguugcuguaaagaaacaccaugaccaaggcaacuuauagaaaaaagcaucuaauugggggcuugcuuaaaguuuuagagagguagucaaugaccauuaugguaggaaggaaugagagcaggcaugacacuagaggaguagcugagagcuuacaucugauucauaaauccagauugagagauugggaaugguguagguuuuggaaaucucaaagcccaacugcagugacacaucuccuccaagguuacacauacuaaucuuuccuaccaccaaccagggaccaagcaucaaauaagacccuauggggugaccauagagaguuggagcucacuuaaccguagucaacuucacuuagaucaaacaacugaaagauccuugcucuucaaaguuuuccacuucccagguucucaauaauucucucaccugaccaacagcuuuucaaaaaguuccuauuagugugaauuucuuuuucauuuuucgagacagaguuuucucuguguagcccuggcuguccucaaacucagaaaucccccugccucugccucccaagugcugggauuaaaggcgugggccaccacugcccggcuaaaguaaauuucuauuaugccauuauuuagcugacaaaauaccuucaaugcuauaggcuagauacaacuaauauuaguauuuuaaaugacauuaaacaucaauccuaaaauaacauaaaaaaauuaugaaccauuucagcaugggugagaauauuaaggaaaguaguuuuugagauuaauaaaguuacuggauaauuugguuauaucuagccccauuccuuucuugaugaagcaagucauuuuugugcauucauuuuuaguuaugugaacauuuccauagcuuuagauaauauauuccuguacuauuugagauacuagcuuugauuuccugcuacagagaugaaucuuagcuuaccaacacccucuuucucagacucccacuuucuuauacuuagugcaucauuuucuuugcaaauuuaaauaguuacuugaaucuaggcuucuucauacauuuucaugacauaucauuucccauaaaguacuaucauuagacacucuccuggcuuugccugucauucucucuggggaucuuuuaacuugacaaauuuugggugcuuuaggauuaacuauuguauucuagucuguaaaaacaguauguggacucuccaaguuaaaauguacugacaauguuuaauuacuugagauaaguacuucaagacagauuugucucuaaagguuaucuaaggauacagguucuuuccuuuguuguccuccuaugauuucuuuuugugucccuuugauggaaaggugguguacaucuaccugccucuagcguaacagauuaggagugaugguggcuggggcaggguugggggcuggggguugaggugggcagcagcacagcuaguccacuuuaggugaugaucuguaaauggcacacacucugugcacaugucauuagcccaaguuaaaaggauauucagcugaagugucugaaagagaaaugaaauaugaggacuaaaaccugagauucuuuuccuuuuuuuuaaaaaaaagaggaggaaaaauuaacccagcagacaacuggcaacugaccuaaacugcucuaaaaauacuuugaaauacaguaguaauguccucugaaugcugaguucacuggguguuacuguaucugagcaguaaggacaggcaaauuccuaacccaauauacccauucucaagacaggaucucuguauucucugcugucuggcccuuccuuccuuccuucuugucuaacuccuuccacccucuucggcuguccuguguauguccccguucuacauaagauugccgcaccacuugcucaggugcuuuucauuaucuaucucaaguaaagucaaccuuuacuuccacggugaauaacuuauccuaaaacaagccuguuacuuuucucuacaagcacacuccuuuucaguguucucucucauggugaagaacuuagaaaugugaacacacuauaaaguuuuacuuguugacuuucuacauaagcaguuacuaaaagucugcacuaucuuaacauuucccauccauccuugcuuuuccauuacaaucauuauuuuaaggaucuugacuuagaugcaauaguuuccuaucugguuuuaugcuuuaccaugccauucagacuacucacauccaucacacaauauagacaaccuucacuuuccuaagagccuuccucuuauggcgaccucauaaaugagaaugaagacaaauaauaaaaagccacaagcaaacucuuuauuaccugcuuauguuucgucaaccugacacaccuagagucaucugggaaaaggaaacuucaacuaccuggaccagacugccuacggcuguaucuauaagagauuaucuugacuaguguggguggcaucaucccaaggcagauggggccugaguauaagaaagcuaguugaguaugagccagagagacagaaagcagugucucuccaugguuucugcuucaguuccugcuuuggagcccgccuugacaucucuugaugauguaccauuaccuggaaguguaaacuauagaaacuuuuccuuccccagguugcuuuuggucaugguguuuaucacagcaacagaaagcaaacuagaauauuaccuguuguucuugcuacauguagcuucuaaaacccuaccuacuauauuuccuggugucucaaucuugugccugaaacuuuuuucauuuaagcuucugccaugaaugacaauucucuuaagaagacacucuccaaguuucuaagcuccuguugacugacuuacaagauauguuagugguacaugguauuuuuuaaaaaauauuuuuacuagguuuuuuuccucauuuacauuuccaaugcuaucccaaaagucccccauacccacccacccccacucccuuacccacccacucccacuuuuuggcccuggcguuccccuguacuggggcauauaaaguuugcaaguccaaugggccucucuuuccagugauggccaacuaggccaucuuuugauacauaugcagcuagagucaagagcuccgggguacugguuaguucauauuguuguuccuccuauaggguugcagaucccuuuagcuccuuggguacuuucucuagcuccuccauugggggcccugugauccauccaauagcugacugugagcauccacuucuguguuugucaggcaccggcauagucucacaagagacagcuauaucaggguccuuucagcaaaaucuugcuaguguaugcaaugaugucugcguuuggaaguugauuaugggauggaucccuggauauggcagucucuagaugguccauccuuucgucacagcuccaaacuuugucucuguaacuccuuucauggguauuuuguucccaugaaugacaauucucuuaagaagacacucuccaaguuucugagcuccuguugacugacuuacaaguuauguuagugguacaugguauuuuaaugcuacccuuuacugaacacaauucccugaacuccaagagaauaucugacuuuuuucaguucccuccucuuuuacauauuaacucucaccuaagaaaaucaauaaaaaauuuccacuuuucuccucacccugaacagccuaccuuaaauuuuaagccuuacuuucccucccuaucuaucugcuuugaaauuuaucuauaucaagucucacaauauuuucuaaaauaaacuaacaucuuuucuuaaaauuugucccuuuacccgguaaauaugcuguagcaggagccaaucuuuuaagucucugcauucucaaggccuagcaaaaggucccaaacaggaugauaucgaugauaaaucuucaaagaaauauuuaaucaugcuauguuuacuuugcuuaagagaaacauauauaauacccucaagaaguuuucuacccuaauaauuaaaacuuaaaaaaaaaauuacaaaggcauuuuuuauuuucuuuuucuaaaguacuuuuuacuaucucaaaugaagguuuaugccuuuagaaauaaggucucugaggucugaggaugcacuucacuuuguucuauuauauauuccugguauuuaaauaaaaacaguguauuuucuuuuauuugauauuauccuaacaacugaaaaaugcaaaggaacaacaaauaauuuguucuucccuucaauuggcuccuacucaguuguuauugucugugagucugucugaguccaggcagcuggcgccuguuucguuguccaucgcagguuguuauguguuaucauguauauugugcuggacacuguaugcuggcucucuuggaggccagucaaacuucuuuaucucuauuuuccuucacacacuggucaaaaagaaauggaauugcaaggcucccuuuaagcuagagguggccaccuggucuaauuucagcuucuuuuaugcuuuucuuucuuuucucaguaaaagcccagaagaacauucucaacucccuugcccauguuccuuuucaaacacaaauaauuccugcagguacaauacucacucuggaaccauaagaccacuagguuggcaggauacagauggugggcugaugauaauuaauaucuaucuaucuaucuaucuaucuaucuaucuaucuaucuaucuaucuaucuaucugagccagugacucagccuugaacuguaacuacuaggcaucuuauuuugagacacagucuugcuuagagucugauagcagggggguucuguuacaacugagccccacucuucuuauuccucacuggaguaccaggcaacuuuauagaccuaggcuguauuucaugaugacagggucuuuaucuuacccaaguauaugccaguuccuacuauauuagaauacugcuauccuaagaaacuauaacuguuucaauguguauuuaaauauuaccuacccaaggaacuuacagauaccauuccauuuuggagacuacuagaaauacaguugguauuuaguaacauuaaaaacuauucaaauauauaaaauuacauauuuuguaaaauuuuauuuauugguacagaacuugguagaaauuuaauuugcauauuaauacaggguacaucauauaaagacagcugagacaguagccccaugacaucuaauuuaauacuaaacauuauuaugaccuuuacauuuugguagcucaagauuuuuaauauaauauuacagaaaauccuccuuuauauuuuucacaggaguguuguaaagaagguacuacuaacuacuuuauagauuggggcucugaauucagagagaagagacuuguuaggacugcuauaguuuauauaugcucagcccaggaaguggcacuaucagaagauauggcccuguuggagugucauugugggugugagcuuuaagacccucauccuagcugccuggaagucaguauucugcuagcagccuucagaugaagauguagaacucucagcuccuccugcaccaugccugccuggaugcugccaugcucccaccuugaugauaauggacugaaccucugaaccuguaagcaagcuccaauuaaauuuugucuuuauaagaguugcuuugaucguggugucuguuuacagcaguaaaacccuaagacaaggucagucagcaaauuauaaggagcuuccaguuauaaagcccauauaauucuuugccauacuuaguugaaaauuaacauuguuuuuguugcaaaaauuuuaggaucaguuuccuuuuguaacuguguaucugacacaagaaaaugcacacagaaacaggauguugaaaccugagaaaacacauacacacacauacacacacuuuguguaacuaagagcggcuuauuuaaaggcaagugcuguaccucugagcuacaucaauacucaaacauuuuaaagacaauuuauaaguuaauucaacaaauauugauugaacuucaauuauguaguuuugcuacagauguaguuuugcuaauuaaagcuucuagccacucguuuauaaguaguuuauggcugcuuuggugauaugguagcacagaugaguaguauaaacagacuauauggcccucgagacugagcaagccaggggaggcaagccaguaaagaacaucccuccauggccucugcaucagcuccugcuuccugaccugcuugaguuccaguccugaacuuccuuggugaugaacagcaguauggaaguguaagcugaauaaacccuuuccuccccaacuugcuucuuggucaugauguuugugcaggaauagaaacccugacuaagacacguaugcaaaggugucagcguuuggaggcugauuaugggauggauccccgggccuuucugucauucuuauuuugcaggauuguugggauaaauuaggugaccugaucuauuuuaaacacucaaaacaguauuugcacauugagaauguuacuuagcugugaauucuuuuauccucuuauggguugcaugugaugaguacuggagccacauuacaaaagauaagaugaugagcugcuaaggaauuugcuuaaaaccagaucuacugaaaaguagaacugagaagaaauugguacuacaauauacaguacaguucaccaacagaaaccaucuauaauaaugauguacuccagcuugaaagagcuaaauggaugaaaguaauacauuuauaguggcauauuuguauaugagauuuauaaaccuaucauaacaguuuuucaguuauuacaggguaaauuuuuuaacuaaagcaugcugcagucucuuuauggugcaauaaggcaccgagaaaggcaugguaagauucuuugagugucagucaguggcccuaaaaacuauuugaaacuaaaucuaucuacugggcuugagugagugaauaauuugaauaaaaauauaccagauauuuuccuggugacucaucuaugcagggacuugaaauguaccuaaguuucauggccaaggggcugcucaaaaaaaccaauuucuuuucuaagggaacacuauugauuuaaaagaaaggggagggggagagagagagagagagagagagagaggggggggguggggggaggggagaggggggugcuaagaaaacuacagcauguccauuaaaaaagcucauacaauuauaaaagcacaguaauuaauuuugagaaagcagaacuaaacuuuucuccauuauuuuacaaaauguuaaaaaaaaauccuaagacaaccagcuccaauuguuaauuacaauuguaacuaaccuacuaauacagacuucucuaaugucauuugacaacaaaacaaagacuagauccaaaagaauauaaaauaacuaguuaagacaauucaguaacuuggcaacauggcacacguauuuauaaagcauuuaguaggacaccauaguauggagaucaaguuuaucuuuuaagaauucccuguugcagaacauucuuuaccaauggaaacuuacaaacauacaucugaguugaagaaacauauuugaaauuaaauacagaccagaggauaacucugucuuguuuuguuuuccuaugaaaaaaaccucaaguauaucagaaagaaaaaaaaaguucuauuuaaaaaccagcuaagaggaaagaaagaaaauacugaguuuaauaaauaaucuuaucuaaaaggaucccagagguuuuuauuuucagagaacaaaacacuucccugaagagaggagaucaguggaagaaugacccugccuccuccacccacuuucuuuagcuauuauacuuagcuagaagacaguuaagccauggacauucagucaaugcugaagaagaaaaauaugaaaaaaaaaugcuauguggcauaaauccaggauuaaauauugccucaacuguacaguuaguuacaugaaccagcaaaacuuuucugaagucuaucuaaauuggguuuaaguaucuuuacuauaaauaguuuaauuacuauuggaauaaaucuuucaugaaucuugaaucaguauuuguagccuuuagcaauaaaucuuugaaacaaggaaaaaaaaauccugagggaugaaacugacaaugauaaaguaugaaaaauuugagaccauucauuaucacugacacuagauugacuauaauggcacaaggaauacuuuuuuuuacuuugguuuuugaaggucuuuguuguccauacccauuaaaauguuaauggacuuccagaauacaaaagaaugaaaaccacacaauuacagauagcuaguuuuuguuugauaugaaacuaaggguagaauuucacacuaauguuacaggccacacuguagagcucuaaggagguaguuaaguguuaaguuaaaagugcuuuauccagcacucggaaggcagaggcagguggauuucugaguucgaggucagccuggucuacaaagugagucccaggacagccaaggcuauacagagaaaccuugucucgaaaaacaaaaaacaaaaaaaacaaaaaaaaaaagugcuuuaucauauccaguucucucucucuguuauauuaaaacucaagcaacaaaacuguaaagcucaccuuuggucuuaguuauuaauaaaaauuacucuucacugauuauguagauauuuugugucaggaaauuaacaaaccuuuacacgcauuaacuaacuuagcuuccccuguauuccuugcugcuuucuuuuagcagggaguaauauaaagccccauguaugaucacaaaaugcaagcucggaaacuuauucuauagauauuucuucucuuacagcauaugacacagcuagaaaggucgguacuaacugguuacuccuaagccuggauccuguaucauaguuuguauuaacaaagauaaaaacaucagaaagcucccagacucaucacuaucuuaaucacaucaacaaacuagguguauagaaaaacaccucugauaccuuuuuaguauagauuacagaaaauaaaguguaaaaucucaaacccacguuacucaaagugugguccauagccuugugccaguaugcaaaauuacacuccuccacaaggaccacauuuguuuacaucacuuacuucaguugacuuuuucugccuaacaagauuuucuuaugaaggaaacuaguccaagcuuguuagccaucacaaacuggaagccaacagccuguagccaguuauuguaacuaacacuguucucaauuuuggauucugccuuuaguuuucugucccugaagccacauuuagcuuaaacaguuacaaaguagugagaguuuuaaaauaagugauaaaaaugaacauugaccuuaccuuugacagaagcaauuucacgcaggaaacaugacccucauagacagcagacagaagagggguaauaugauguuuaucuggagccuauagaauaucaaagagauaauuuuaccuacuuaaaaaaaaguuucuggcuccuuaaaaaugaucaagaagccaaaguacaaaagcaauguauuuucccaggagucaggauggaguagaaaucugaccuaagcucaaaucuuuuaucugccacugauguaacaaguuaguuucucugaaccuaucuuuuccacuacuguagaaaugccauugugauucagagaagaagaagaggggucaaaaugccaaugaggaggaagagaagaaugccaaauuaggcccaaucaccugauguggugaaaagucaucucuuugacuaucaugaucaccaaaacaaugucauaaauccuuaaauuacagaguguucaaggcaggagaugacagcuccugccucaugaauuccucacacuugccccauagugcaggcuaguguagcuuaucacuucaggguucuaugauuuaguacaugauagcaucuacuaccuacagugucaacuuggcaagguuuagaacaugaaaagcaacagcuaaggggaaggcagcaaauaguucauuagcuuaaaaaaaguguaggacuauauuauuaaaaguaacuauuucacagaccuacagcaaacaauuuccuagagcauauaacaaaauuuuucuagaguggcauacauuauauacaguaaacauaauauacauuugguacauacauuaauaucugcuccuuucagcagcagaaauuccaggauuucaagcuguccacaaucugcagcauaaugaagaggcuuccuuccacccucuaguguccgguugacaucuucucccuuuaaacaaaaaugacauuuauaccuauaggaaaacgcugaggcaucugauauauuuuuaacuucuuuaaacuuuaaagaguuucaaaaaaaacccugcauuuuuugcaaagugaaaugaaaacauaaagaagucacaauaacauauggcacucaauuuaugaauagauaagcugaaaacaauacauaaugcuaaaugcaaugaauuauaacacuguguuccauuacuucuaaugaguucagucagcauacugccaauauguaaccaaagacuguaaguuuaaguacugagauuuuguauuuuuuaugacauguaucauuaucagaaaugauacuuauaaagaauucacuucauuccuucaguauuuacuaaggugguauuguaaaguaggcacugcguuaacaauggugaacaaaaccaggcauggcuuccaaugcagguagcuuaccacauacuguguggagaugaccuaauuugaaaauauuaggguucuguauacaaaaacaaagaaacuaauggucacacaguuaccagagacuauggcuuacucuugauaauaggggacauaauguuaagacguuaacuuuucuagugaccuuuucuagugaccaguguguuauuugugguaccaugcuauauacauaauuucuaaucuucaaacuauccuaggauaagggacacuucacacaccaaaugugaagcuaaaacaauccuuuuaaaaugugguucacuuaguaacaaaguauccauggaaagccacuccuuuucuagagcaccaugauguuucuaauucaaauuuacuuccuuuuggagggagauuucagguuuuacagaguagcaaaaugccuagaguuuauuuucucaacaaauaacucaaaaaaacuuugcacuuaguuuagucaauucaucaaaccaaaaccaggaaaagaugucaaagccuuaacauuucauagccauuacaagcugugcuuucaagcccuucacaauucccaucccuuucacuuaggcuaguucuuuccuuccaucucauuaauguaugcacuacagauucccuaaguccauccaaacucaagauuucucuuaucaacaucaccuuucacaguuaugguaagcuuucccucccucaaaacggcagcaaccgccgaggcagagagugcuuuugucacuuuuuacauguauaugccuucuuucucaacaggaugcaaauucugggagcagagaucauauuuuucuucuuuaccucuuccuaguaugaacuuugaguuaaaaauacacauuucaccaacacuaaacacuaggcaaguuacuuauauucuguauguaugaguuuucauaauuuaaggugaagguguaaguacuuagcuuucacagcacuguuguggggauuaaacuggauaagccaaccaaagcacuaacuccaaauauaaauuucaaauauaugggugcuauagaagacugaguuucaucagaaauuaauuuucucuucugaguuaauggaugauaaaauaaccuuuguaaguuaagacuauagugggaagcagugccuuuuaacaggguguucuuaaagucaauacagccaaacaguuuaugaugaggauguuccaugaacaacgugugauuuaaguguuuuguaguuguaugauuuuguuguugagcuaacaucacaaaauauacuuuaaaaauauaaaaguauacuuaaaaacuuugacaacuaucaaccucauugguguuuuguuacagaacuacuauauauauauauguauguauguauguauguguguguauguauauguauacacacacacacacacacacacacacacauauauauauaaaaucuguucuccaauggagcaugugauaccuaauggugacaucuguuaaaauagauacuuaaaauauacacuuauaaagauauguauuuuaagaacccuggaggagaauggguaguguuccaacuuuuucauguuacaagaccagagacuacucacuugcuaaaucuuagauuccuuagugauaagauagaauaagacugucuguacccuccaaccuguuuaaaauucaacuacgaugacaaaugaguaugcugcauaguucuuaauagagcaagacauuuaauaaagguuaacuaucauuuuuauggaccacugcuguugguuuaacccaucugucuguuugcccaccuguuuuucuagccuauccauuaauuaaugagacaggguuucauguagcucaaacuggccuugaauucacuauacagcuaaggaugguggggccauaggcauauacacaccugguuuuauguggaacugaggacaaaaccuaggacuuuguguauguugagcaagcacuccacuaaccagucuagguauuaguuuauacuugaacuaaggcuauccaaaucuggguuaaagcaaguuuccacagaaugguugaaaauauaaacaaauauacagcuuaaccuaauacauauuguuuagaaacaaauuuaaauaaaggugauuugcuguuccaucuuauauuuugguccacuuaaaaaugcagaaauacaagucaacaagggauaccgaugagauuuuccuuccauuacuauuauucccuuuucauaucaguauuaucucuauagauucuuguauugaaauauccguauuaaguacucagaguaaggugcuuuucuuaagauauucaucugaaucacaauguuguauuugcaauacaauacugcacaauacauaugaaauagagcaguguuuuuaaacuuucuccuuuauccuuucauacuuguauuacaauucuuacuuuagcugacaagugauaucacugcaaagacuaugaguaaacaaaaagaaagcagucucuagaugggcccucuacaaagcaacacugaaaagcauuaaauguauuagaaaggugaaaggcuuuaaguuaaugcccuuucuacauucaccaaaauaauuagaaaaaagcaacucaaaacaaauagggcuaaagacuaaaggucagaguagaaaucaaauaaauugaaaacaagauaccauggagagaagucaaaaggugauucaggaagaucaaugcaccugaucacauacuaugaaacaugaacaagaaaaggguaaaaacacaaaugcuaguaccagacucuacagaggaucucauacggaaauuuccugcccugugauggacucacugcuaaauguuaccaaauaguaagggaagucuucauaucuguucuacacaauucuggaaaacagaagggauggcaagacuuaacuaauucuggcaucagcaucagucuuccagagcaagauaaacaguacaagagcuugcaagagaaucauacccucugagaaguuaggaaucucucugguuauuuaaauaugacauuuuagaagcuucagguuucuagucaguaaguguugcuaccuaccacauggguaccaacaagccuuaguuggaggcugcacugauauucaagacauuuacagcuaccuuuuaacuuuuauggauaaagguucuugguauuacaucagucugcaacuuuuguuuucucuccuccuagagcacugauggguaugcaaacaguucuugaaagacaaagcacuacaauggccacagccuuacuuaacaucugacaaacuguucaacaaaacagauuuaacacaccacuaaauaaaguaaggaaaaaaaaauacuuucaaaguaagaauguuguucaaaaauauacuguuauucuaaauuuuacuuauaaaaguaggcgaagguuagaaaaggugagacuugugaucagaaaaagacauacuacuuuacuugauuuaacuaaacaaacaucugggguaaguaagguacuugcuugagaugaaacaaaguucugacugagacaaagaauuagcugucuuuugggaaaggcaagcauguaagaugcgugccauuagcuuguguccuaagaagagcauaaauuguagggacucagccaacagagugaucaagaacuuaccucccugcaguuuaccuuucauugugaauuaaauuuucaaguaccugugccuuaucuuguuaagauuuuaaaggcccacagggauuacagacuacaaguuuuacuucuacuacugugauucauguuacuuucaagccucaacagaauuuauuguggcuuugauuaugauaacauauaguuuagguauauuuaacugcaaaacuaauauuaauaaaugacaaggaagaaaucaaagcaaaaaagcagaaacacuaacuuuacacuuuaaaauugcuucuguguacaagcaagaaaacugaugaaaacagcacuguaccaagaugugagcacacugguucuccagcagaugaaggcauagccaccacuaaaagaugacaauauuaacuaggucuauuuucccagucuucuucaaucuuugccucuacaauuuuccuaacugaucuuacaugaaauacaaacauaauuagaaaucuguggcauauguguguguguguacaaacuauucuaacacaaauggaaacauccuauaguuuguuuaaaggcaccacucaaaucuuguguagcauacauuuaagugccacagauuucuccuuuaugucccagaucuuguauggaucuuaaacuacacuaggccagguucauugaauaauagaaucacagacaggaacacguucuaaauuaaauggccaccugauucuuacugauaacuuucucuaggucauucuucagaggaaaggaaacaaauaauucucuuccuuugauucccaaaugugcauacuuugugaaaccaagaucuaaaguguaaguucauauuguacuaucacaagagacuaaaauaaagcuacuaaaaagcaggcuaugugugaucauuuuauaggacaguguguaaauuaacacuggacaccugacugaguagaaaccaaacagcaaguguauuaaauuuaccaaugcugcagcugagccaauguuccuagucauucaguuaguguuaaguauuuccuguccuauuuagaucuauuuagaauaccuuaauaucaggguguuuaauggcuuuuaaacagauccuucugagaagaauauucuggcccaucauugccuaccuuuuuccugugugugccucauuuuucuucccuaucuaccucauuaguugagacuuuuaccuuaggauauaauuuugcaaagaaucauauuacuguaccagugauguuaguguauagagcauagcaaugagaucaaaucuacuuuugaggguaaaguacucaaaaacggugagaaaagcuuugauacuuuaucugaacauucuaauacaaaaaacccuaacaacagaaaguaaaaaagguaugauauauaucuccaaccuauuccuuguuuuguaagaauuggcauauaacuaaaaugugaaucuuuacucauuuaaaagaacaaauaguaauucccacaacuaggcagaaacucaauuauuacaauauacaaucauguagccucuuaaaauacuucaaauauuuuaaaggauaguuucuuauuacuaguuaaaaucacaaccacagugauaacuuucuauaguugaagaacccaugaagauguauuccccuacuuaugcauuuccuucaacuuaggauguuuuuauucaaaauuaccaauuaauucaaauuaugaaagauucuuaaauuuuauauagccaguuuguuugcuaaacuguuaaaauuucuccuuuagaugguagaaggucuaaagguaauuagucaaacauauauuuuguaacuaaaauaguaaguuguuuuuaaagaaaaauuuuacuugugguauaaaacuaaaaauucaauagucaaaggagugcgggugggcgccacacacacacacacacaaacacacacacacacacacacacacacacacacacacacacacacgaagcaagccuuaccaaaguaaaaaaaaaaauaacacucaaaaucucaaaauucuaugguucucaguuugaaaagaaaaagaaaucaaaauguaccuucacuuacaaaguaugaacucagugauccguaguugcaauuccuucugaaaagguuuugcagcguggaaaguaucugcuauccuauuuaauaggucacagaucuaaaaguuguauuuguaaauaaacccauaacaagggagggaaauaaauggaaaggagggaggaagaagacuucauuccuacccccaucauuuguagcucucaaauguauaauaaauaaugaugggaaagaaacaagaaugcucuucuggaaugacucagaucugagcugaaauccuccuguccuccucucccuaugagagcuagggaaaguuacucaguucccacuucucugacuauaagaaaaggguaagccuuuauguaguuaaaugauauguguaucuauauguacacuguguucacuauuuacauacaauagggcacucaaagaagauguauucuuuucuuuuaacugaaauucuaauuugaaucagauauuuuacaguuuugaauuuucuuucuuuuggaaccaaauauaaauuuaucauagauuuucauauauaucaucuauuuuuuauagaguugcauuuuacuaccaaaauauaaagcuacuuucuaaguuuuauccauauuucauauauuuaagaaagagaguuuauucagaagccauauaaucauuguauuugcuguuuucuugaacacucaaauaaaguccccaaagaacacauauccuuagaagcauccacuuuuguuguguucaugcuucccuaauacaauugcuggcacugcaggugcuuaacugguauuugcugaauuaauuaugaaugaaccagugaaaauugugcuaacuagccuucucuuucacugguggaguuagaaaccaaaccaggucaugggacuggcaccagagcuggggagagaauucuagaauacuuuccuauuuuaacagcagaaaagauucucuagaaauuccauucaguuuaagaacuuagguuaauuuugguuugcacauuuauacauaaagaucucuaaugcucaauucauagacuaaacccacaucucuugccuaagguucacauuuacuaaagacuaugcuuuuuaguuuagagaauuuuagcuuaauuucuaucucuucuauuuacccacacaugauuuucuaugcuucaguuuucauaauaguucaauaucuuucaaccauaaggauuucuaaaauggauuuuuagaaacaaccucaaaauaaaauuucuauuuuuaaucauauagcuuauuuauuuuagaugucaaaaucuugaggauaaagaagaaauuuagucuauuggaugcauucauuuuuccaccuucagucuuauguaaaggugaacaaaucuauggcuaauaggucaaaucaaaccugcugccuauuuuugguaaguaaaguuuuccuagaacacaaacagcacauucaccuguuuagcuguuuacauacuaucuaugacugucacugcacaauagcagagauagagaccauauggcugacaaguccuaaaauauguaauaacuggucauuuaugaaaauaaagggaaguuugccagccucuugccuuagccuccucuaagccuccccuuaguaaauaaucuacccagacaacauaaauagcaaacauuacugcugcaauguguagaugcugcuguuucaacacauacacugucucuuuaaaaacugcauaaaauacuugaguuggcuauaucaugauucuguuuuagauaagaaugcugaggcuugaacaggugcauuuuaaaagauuuauuuauuuuagccaccacaugguugcuaggaauugaacucaggaccucuggaaguacagucagugcucuuaacuucugagcaauuucuucagcccugaacaaaugcuuuuauguuacuaucaaaaaacaaaacaaaaacaacaaaaaacaaacacugcugauucauauuuuucauaaaucaucaaguacaaaacuuugcuuccaagcuagauggugguuuugaaaacaacuaaaauuuuaaaaugauggucacaagguaaagucaaaauuugccaacuauugucacuaaaaucuuggggaacugaauaaaguucaacgaguuuaaaacaaccaagaguuugaacacuaaggguuauuucuaagaaaagaaggauaucauuuacaccaagaagagguauagaguaaaucaacuuugagaaaaaaggaagggcuugcuucuucagacaccaauacaauccaauuaaaauuuaacuagacuguacaguagguaagagcaaugugacauuaauuggaaauacaaagauaauuuccuccuuuuuugaacaaagauaauuucuaucuuuuggcaacuaaaaaugagcaacagaacuucauucagauugacuaacaagcguaacacacuaaacaagacuuuaauguaguucucagggcuguugagacauguauaagauauaaaaggcuuacagucaagaaauaaaaauuaaaaucugucagaauaacauggccaacagauggucacuacugugguguuuucuaaacugagugcuuucuuguggcuucuacauccuuuacugcccuucacugugcuuaaccuuuuauauucggcuuuagccagaagcauccaauuagucauauuuggauuuugagcucauuuccuaugugagcaggagaaauuuauuucuugaauuuuguuguggugugagccagguuucacauuucaucaggaaucauaucauagggcagggcaugguggcgcaggccuuuaaucccagcacuugggaggcaaaggcaggccaauuucugaguucgaggucagccuggucuacaaagugagaaccaggauagccagggcuauacagaaaaacccugucucgaaaagaacaaaacaaaucauaucguauagcagggaacuccaaaagaucagguaggggcuccacuagacauggaagcuaucucacaucaagauugcuggcuuccagugaaggagagcugucuaguucuuggaagcacuauuuaaauauauaaauaguucuaacuacuuuacaucuauaaaugcauccuuuggguuuccuuuuuuuaaagcagccauuaagguaaaauuugaacucucauuuucucuccuauuuccccuuucucugucuacuaggauuuauuuugcaaaauuagaauuuguaaguaaaugcuggcucccaaguuuaaaaaaacaaacaaaaaaccaacaaaaauccacaacaacuccacagcacaaauacaggaaacaaacaaaccaaaaaaaccaaaccaaaccaaaguaugagacuguaugagaugcugaaaugccacagugguauaacugcacaagucgugaaauuuauuuaacaaaacacaugaacaaaaacuugaauauaaacagugauaggagcuugguucucaauauggugguguaagagcugaugauauuuugauuauguguaagguugcuacuguaagacuaguugcugccccugggaauggauuuagguaguucucagaaaggacuauuaaagccugagaccucuuucagcucuuuagccuaugguaacuguuaugugguugguucuucaccccuccuccacucucaaucuugucaugcacuauggcguggcacagcuaauaggguccuuaacuccaucugagucagugccagcuccaugcuucugaaccuucagaaccaugaacuaguuaauuaauacuaaguuacauacuuuagguaguucauucuagcaaaguuaaacaaacaaacaaacaaaaucuagcugauugacaaaaagcagaaauuuaccaagcagauggaguaggacagaagacccuaacauuaccauaggaguagcuaguauaaagaacuccauuagaaaacacaauauuggggagcaggggggaggggagaggggauaggggauuuuuggaggggaaacuaggaaaggggauaacauuugaaauauaaauaaagaaaauaucuaauaaaagauuaauacaaaauaaaaagaaaacacaauaguugaugaaagaauacacucaaugaagauuuaggaaaaacaaauagaugucccaauucuaauagcaauauccuggguaaggccauuaauguccaagguuuccuuauguaagaguugaacuagauguaauuuuuugcuuuuguucuuauuuuaaaacaauuaaaaaauguagcaaaguaacuuuagcauggaauucucagacauauguuaucaauaugcuguguucuaauuggucuuuucugcauuccacuccggacugguuucuuuccuuuacucaauuacccccuuugcagucaugucauauggaucauuauuaccuuaucuuugccccauucccuucagauuucuuccuucucaugaucucccuucugguuucauggcccacauauaauuuugcauguuucaagauagaagagaaaauaguauuuauccuuuuaauauuuguuuacuucacuuaaagugacuuaguuucacuuauuucucugcaaaugucaugauuuaacuuuuuuaugacuguauaaauucuauucugaaagugcacauuuucuuaauccauucaucugcuaauagauaucuaggcugaauccacucccuagcuauugucaacagugcaaaaauaaacauaaauguucacaugaacuaggugucuuuuaaggagcuucgcauauaaauauacaauuauuaacaacagcuaauaagcacugaacaucgccauguaugcugguuggcuuuaugucaauugagaaaaugauuccauaagaucaaguuauagggcauuuuuuugauuaguugauugacugauugauugauuaguccauuauggguggugucaucccugggcugguggucccagauuuuauaagaaaacaggcugaguaagccauaaagaacaagccaguaagcagcacuccuccauggcgugccucugcaucagccccugccugcuucuaggucccuaucaugccuggcuucccucaaugggcugugacuugggauauguaaaccuuuuccuccucagguucccuuuggucaugguguuucaacacaguaauaauaacccuaacuaagacaacaugauaggcacaauauuaaauaauucagcaaacuacacucuuauuuaacgacuccaaauaaguaacagaaaggaacuaacaaccaagucauaagaauaaguagcuaaaauaaguagaacagaauaagaauaaguagaauagaguaaguagcuaaaaucaagauauaccaggaacaauauuuauaugacaaaaaaacccaacccaaaccaaaccaaaaaaaaaacaaaaauccuuccuuauuuuauaggacacacacaaaucuguaaaugggccaacuauacauuuuuuaaaagucaacaaaagguaaaaauaagaaaugggaauaagauguugugggggauacaccuuaacuacagggccagaaauacuaaggcaggaggaacuuagguucaaggccagccuaggcuacaaagcaaguucuaggauagacugaacuaaagaacaaaacccaagcccaaagaggcaagugcagaacaggggagaaauagaaaaucaagcaggaaaagacuacaaauggcuaauaauauucuaaaauguucagugcuuauugaaauauaaauuaaauaccaauuuucuaccuguccaauagcaaacccaaaaauguuuagugaugcuuaggacuguuuaugaugugcugccugccuaugugcaucuaaauccacgaaacucuuuaggcucaaaauauggaucuauucucaaaaguuguuaaaaauauaaacaugagggcuggugagauggcucaguggguaagagcacccgacugcucuuccgaaggucugaaguucaaaucccagcaaccacaugguggcucacaaccaucuguaacaagaucugacgcccucuucuggagugucugaagacagcuacaguguacuuacauauaauaaauaaaucuuuaaaaaaaaauaaacaugagcacuauaauacuguuuaauugcaaaacuaaacugaaaauaaaaggcuuaucauaaauaauuuauuauuuuuaucauacuaguagaauggaauacuauacaucauuucagaguaauuaauuucaauauaaagcaucauuuaagauaaguuaagagagcaagugcaaagaguuuaaagaacuuuuuuuuuuuuuuuuaaagauuuauuuauuuauuauauguaaauacacuguagcugucuucagacacuccagaagagggagucagaucuuguuacagaugguugugagccaccacgugguugcugggauuugaacucuggaccuuuggaagagcaguugggugcucuuacacacugagccaucucaccagcccuaaagaacuuuuaaaugggggaaaugagugaguaaauaaauuuccaauuuuuuucugauacaaacuagacaaauuucuuuaggauggcuagcuuuggucagagaaacuaggagggucuucaccuuuuaguuccaauugcugcauuuuuuaaucugugucugaauuaaucugacuuugccagcuguccauguguguauguuguacagugugcauguauaccuguggcugaacauguaugcacacaggugcuacugcauguaugugcaugaguggaaugugugauggucagaaguugaugaugggugucugacuugaucauucuccaccuuacucacugaagcagagacucuuauuuaaacccacaacuugcugauucagcuaaccuagccagccagcuuuuucccagagauccugucucugaauccuggguguuggggauaugagcuccaguauucaagcuugggcaagaaguguuuugcccacuaggccaccucccuaagccccuaauuuuacuucuuaaaauuauuaggauaguaggauuauaaaguaauuuuugucuucuguauauuuuuguucaaagauccuuuguuauuauuucaucagaggaaaaaagacaaccuauaauagaaagaugagcacuuauacuguacuaaauuuucugaguuuacugauaacaccuccauuucccauaggcugauauaagcuuucuuacagcgcuccuggcaggcuguaaaaagaacaacaaagugauuaaguuuuaucagcaaaacaugcuaguuuaaaaacauuuuuuuaaaaaguaaacaaaaaugacauaaaacaauaaaugcaagaugacugaaucuagaccauuuuaaaaauggcuacauuuuuuuuuuuuaaagaaaaagugaaaaaagaucccaguaagcuugcaauuucuaaagauuaaacuugauacuuucuuggauucgauauauccuacuaccuuucacauggugcacaacuguugcuuuccaagccuauuaacgugucaaggcagauguaauuagaaugggguuggagagaaaccacagagaaagggaaguuagcggccuaauguauaguguuucccagccagugaaacagaaguacacguaaacaagagaguacacguaguagagcggcuggagaguuuaagggcgacccaccaacacaacucacaagcagucccaagaaggaaccuuggauccucaaaggcuaugguagucuuaucucuaaauagucaagggaccauuaugaucuugccccaaucuuuaauuuuuauauacacaguagcaauauaccccuuuugcuaucugagaguguuuagcaaugaaggccaagaguauguuaagagguuaacagcaaggacuucggaaagccugugaaagugaguucaaauuucagaccuaccauccacuugacagcuucaagaccuuggguaaaaucuuuaccuauaaaauguuuaaaauuacacucauggguugacuugauaagaauuaaacaacaccuguauauuauauuacaauggucaaauauauaaaauguuaaaaacauucuuuuuuaaagcaauuaugaacagaaaucucaguaauuuacccauguuuuucucugaaagccaacagacagacacaauauuaccuuuuucuggauuguuguucaggaucacaauuacacacauaaauaauaagacuacgauuuaaaaaaauuuccacaggccuuauagacacacacugaaccagauaauuuggugagaauuuaggcuuaccagauuuauuugucuuuaugcuaauuaugucuaaacugucuucauucauaguuaggacuaaguucuuucagcaagccucuuauuuucuuaauggguugacucuaagccuuagccaagaaaauagaaaacaaaacaaaacauaacuacuucaaagcagacugaucauuuuauuuuauuuuauuuuauuuuaaauauaugcuuuagauucugacaaucuuugguuuaaauccaaguugggcuaguuggcaaccuuguccaacuacuuaacuccuccaaaacuuaagagccaaugaauggcaauuacuuuuuuuuuuuuuuucuguguagcccuggcuguccuagaacucacuuuguagaccaggcugccucugucugccuccugaguguugggauuaaaggcaugcgccaccaugcccggcaauuacuuuuauauaacuaguuuaguuuauugaaaucauagcuaaaaaucacaguaaggaaagacguucuuacuaagaacauaugcuuuuaauguguuauaggguuauacuggagauauuaagauuuaaaagaacagagcauuuacuguccagaggcucugggccuaaugaagaacagauacucugcaaaaucacaaugagaaacaggauaagaagcuucacuuccuuucaaggugagguguugggaguuuuuguuugcuuguuuguuuuggguuuugguuuuuguuuguuuuuggaagaggugauauuuagguuaagaggacaaacaugaauucaugagcuuggaggcuaacuggugaagcuuacuuggucaaauguaagcguacauggacaaagcuacuuaaagaaauacaagugagggucuggaguacagcuuucagauagggaagaaaaagaauuguucaacacaacacaaugucccaguagaccaaaagauagaguuggaagugauauagagucaaaagcaucuaucaucaaguuagagaaggaaguucacugagaaaaaaaauaugcuuaaaauaaacacugaucccuucagcuaacuauugaagaugaccaggaugggggugggcaaaccaaaucaagaaaauacagggggugggguggggugggguggggaauaggaaacagcagcaacuaacuucaagucaugcugagacuggagagugaagcaagguagucuugauaaaccucagcuaugcaggacaaucacccaauuuccacuuuggaugaaugguucagucaugaaguuguaaguuaacauauugacaacagaaacaauuucaugcauguuauuuuuguaacuguaaauucuuuauuaauguuuuguauuuuaaauccccuauguuugagcaggggcuggaaaaacaagagccacucacuuugagacaaucguguguuguuccacuacugguugauguauuuuucuauaacucuacauugaagagacgguaguucagguuucuauuuguuacuagcuaagguagucagaagguagcuugccuuaaacauccauuacaaucaacuaagcagaucaaauacaugugaaaagucuaaauuauaaggcaucaaguggagaaaaaacuaucauccuuguacaauccuguaguuaaaaacaaacaaacuaaccaaccaaucaaccugcuucugccuguuuccuaaaacaaguccugugaggcaggaugccaccgcucacaccuuuuaagauuuaaaaucuugaccgcaggcucacacuuuuugaagaggaccaagauguucacaguugucacaaaauucuacuuucggaaaauaauaauaauaauaauaauaauaauaauaaaacuauagaaguucuccuuacaauuacaaaaggagcaauuuaagacccaaaggcaggccaggucagaacuuuccaaguaccuccaaguaugguuuugaauuuggguuucuuaaccauaucccaaacauagcgugaucagacugcaguacuauuuacuacacacgcgcgcggacuucagaugaaauaauggaguaccccaaguuaaaaggcuuuuugaaaacuacuccgauuucccaacaccccagaugccaaauggcaaccuuaccacucgaagcaaacgauacacacacauacacauauuaugugguggugguggagaggaaaaaggccacacccaaguuaaagacuuucagagcgaagugacaccaaguuucagaaauuuaacuauggcuauuuuggggcagcucauuucacgggugacggauccucugaauccuccccaucuccaccaggccgcacguucaggaaaucguucccgauucgaacugcucggguuuccuucucaggaacccggugcgaggccaagauggagaaaugccucauucaaagauugcaguacccgggguauuagagggccggcccgugccgaucgagggagacaaccaggcgcccguuaccugcggggcugggacaggccacagccgccuuagcaacaacacagcgguuaccuggcaccgaggagccacccagauccaggcccugcggcguccacgagucucccaagcuggcccagcucccggugucccccacgcccugggcuucacgaccacccaccccgccgcagcgcagcaucagcgccgcgcauccccgcucaccuuagccacauaguccuucaccucauccaagucuccguuuuucagggcccacaugaacuccuugucgcacaugacugcagcggggugggccggcgggccgggcaggagcggcgauuaggcccgacgaggggacacgagaaagcgacgcgccucaggccgcugagcgggcgagacugcgggucgcggcuacgguucgggcgggagaaaguucuucugcagccguugggcccagcagagcagguuccgccuagcugaggagaagcaggacgcuuacacuuccgguucacgccccgcuagggcccgccucccacuuccucuuccucuuccucucuccagaaagcucugcucggg

SEQ ID NO: 2903 - RNA, 561 nt, Mus musculus
uaacaaaguagauauuaguuuauuaacuuaaaaguauuuauuuccaguaucuauauucaacauauuaaagacuuccauaaaaaucuaagagacauaaaagaaugcugauaaaugcagcuagaagagacaaaacgaucaucuaaagaggcauauagugaguauuuuaaguacuuaugauaaacaggcucaaaagucuaaagcaaagguagguccaugugcacaguuuaacagagaugguccuauuagccauguagagaccauccuaagagauagggauaccgaccuacucagacucggacuguucuagcuguuaagagcagaugugguaaugaaguagccauccuugauauccagccuccuggagccuuugcuuauccuaaauuuuagcuuccuuuauccaggauaauaauaauuuaucugaguccagucagucuagaggaguccgugaauuaauugcuugaagucacccaauauggauucuguuuauuagcaauaauggacaaucgacauuggcaaugaaauagaaaaauauguuaaguggaauucaaguauaccuacgua

SEQ ID NO: 2904 - RNA, 1565 nt, Mus musculus
ucaauuauauuucauuuuuauucuguacauuuccacacaauucacaauacagaaaaaguguccaaaaguaaguauaacuagucaauuucuuuuucagagauuaauucagucucucaaauuaauuccauugaaaaucucuguagagcaacacagugaucaagauucuuuauauaaauaggaaaugcaagaaaauuagggaaaaauacuuuaugacuuuauuacaaaaaaacccuccuuucuucccuuuccccaacccacccuucccacccacccucccuccacuucauaguaucuggauuccacuuuaccuagaaauaaaacuuccucuucuacugccauagcugcuacuacugggggaaaccccaccuugcagcugucagcuuugcaguggcauggcauggcucugggauguaaucagacagaaucagaaagcaugaaugagcccuuuacaacaugaccccaugucuucauauacauguaguagcuucugugagugacccaccuccagccggugguccucaggagaccugaggagccuuuucacucuggaaaaucauuccaucaaacauuaucauucugauggcaacagcagccaugugacccuucacagaaaucacuuccucacuuuccaacagcugugggccaccgagcaauccuggugggccacuuaauccuuggcaauuuggaaaaagagcugagcuaauaaauggaagcugaucugcacauuaccuuucccacacaugguuuucuacugcacugcaacguuuuguccuuuagaguccccagauucucccacccuacccccggggggaagacauucugcugugucccaacucacaaucaggauaucagcaagcaacaagauccuaacugcacugcaaauuaugccuguaugugcauggguuagcgccucaguccaaccaguuagaaguguggggguagagugggaaaugaaaaaugucauugauaagaaaacacgaugaucgggagccauuuggaagcauuaggguacaguagguaucaaaugaagaaaugcuuuaaacacuaugaauaugaagaacacaugugugcucaugagcuucaacaaaaaacuaaauaaugcagggccuaucauuucuuugggcucuuuccauuuaaguagagacugcauguaaacagcucauaucuaccauuuuuaaagaaaaacaaagaacuagguuuauauccucaaauaacaggucgacuaucugaauaguuaagaugaaaauauauuuaaauuuguagauaaaauucuucaaguugaucuuacuuuucucaacucuuacuaugggccagcaaucugugaacaaggccucacauagucaugcgugaguuuagucacagcacuugggagacagaggcagguagaucucugugaguuugaaaccagccuggucuacacacagaguuccgggacagccagaccuacacagagaaacccugucucaaaauuaaaaaaaaaaaaaaagucuguggacaguugaagaaaucugaaacaacauucuacccuuugggauuuuuuacaacaaagcuuuccauuaguggcc

SEQ ID NO: 2905 - RNA, 114896 nt, Mus musculus
agggagucucaaaguuugucuggagcccuaguggggagugggcuuguugcgcgaggacuuucuugggaugagcgcugccuuuuugccuuccuuuuggaugcacagcccgauuuaaccccugcaccuuccgcccgaucccagcaggcuuguccuccccggggagucacagauuuccgaggacaagggucgcguagccuucggcagggcucucccgaguuccugcuccagugcauaaguuccacgcgcgcacacgccaaguacacggggagaagcgucucaccggcccgcggcggcucugcgcgguccccuccugccucagcauccucggcccugcgcggcgcccaccgccauggaggugcuggagagcggggagcagagcguccugcagugggaccgcaagcugagcgagcugucagagcccggagagacugaggcccucauguaccacacggugaggacccgugguccgggcaaagggagucgggggugaggagaaaagcggguuuugucaccagcuggguccugggaggcagcguuuggggaagggcaugacuauauuaagaggucuggggaugggaguuuucuucuaugaacacauuaaggugcacagcuggagccuuuaaacuuucuuccgaauaagugacccuuuguauuccaaagcaguuuauaguguuuuccugucgguagcuccauuuccuauugcuaacgguacagcaaugcugggaagcgacguguuuugagaauaauaccuccgcccaguuauauugauuuuuuuuuuaaaaugguaagguuuguaaaaaaacacacacaauacacacacauccaaaauuuggacaagcuaauguaguauagucaucccauauguuuuuuguccccaucccauccaguuucuuuacuuucuuguuuauagcuuuaaaauguucguguuaaaagccuuccuucaccgcacgggaaggcggccgccucacuuggcugcuucaucugcacagccucgaacugcuuccucccuuuuucaggggaaaaucugaggcaacugcauguuucagagaggcucugggggagagguaggacagcucaccaguuccuuccccgcagagaccucuuuggagacucaacugucagaagcgugaaucauuuaaagaugucacuuucagcuuuuugcaagagaaaaucuuguuugugauagccagugcugguaauguggcuuuguucagaacucuuagaaguugagagggagggguggggguggggggcacugagggacugcugagggacugagguaaggacaggcuuggcugcauuucugucuuagugcuguuaauggggucaguaccaggauauuugaaacuuuugcaaaacggccugcaggcuccaccucuuuggccuuugccacuggcugacuguauuuugggaaaagggauggggccuccugcugcuucccaccaaagcauuugugguagcugagaaggucugguuaaaaaaagaagccauguguaggguuuagagggaguggugcuucacucuggggcaaaagccagauguugagugugauccuggucaucuggccuucgcccucugucuaucccgaugaaaucuucggguugggagccuagguugcuuccuaugcuuuggaaagacccugagccuuucacaccauagcugggguuuguguuuuguuuuguuuuuuuuaacuuugggggcuccagauguuugcacugaugugagcugcagcuugccacgaacggagagacagcgcuccccuuguuuuuccggcagcagcucucaguaaaaugucuuacgcagcagccacaaggccacagcaucaggccuucuuucagugggugggauaaaaugugcagacagccacauugcuggaucucgagagaucccaggcagggcuuugagaugagucccuaccugcgaccagcaggaacuguaggacaaaagcuuggccugucuccagccaccaucuuuacagccucuaagcuggagacuuugcauuccuuuugauauucacaacuuagguuuucuguguaagguagugagaugggguuaguuuuguuuguuuuguuuuuuguuuugguuuuuuggcaauccucugcuuucaacaacuauuauauggucuccagacaaguaucucucuugugaacagcucacauacacagcaugccucucgugguggcugccagucaucguguguguguauauggaucauaagugaaagaagcauagacggcuggaucaucugccucugaacuggggcaaguuuggaaaagcuugguccuuuccccagcuagcgccugaacucaagaugucucuguugcuguagaacugcucaugcaguuuguccaugauggcacaaggcugaauccccaugaggaccgguuuuuauuauguuuucauucaaagauacccuuucacuucauauuuaucgaguaauuuccaugugccaagcacucuuccaagcacuugggauccauaaugaaaaaaaaaaaauagaccaaugcacuuacuguggguaguuuacuuuuuuuuuuuuuuuuuuuuuuuugcauguguguaggaaaaaaauaaacaagaaauggcaacuguaaaagagagacacaguauagaacggucaacauuuuaaaugcagaggaagaaagaaguaaaagcagacuggugucacccuugguguccaccccaggguaaagaccucaaggacagaggcuggggugguacaaggcuaggauggaugaggcuacccccuguaugagggugugaugaaagggagcguuagcuggaagaagagccuaggcacaggcuggcugucagagguaggguagcucggaugcggucugugucuguaacaccaucuucuguauuagguuacccugucucagagagucauucucuuuauaaauaugggcuacuuccaagaugcuggugccugguuuuggaauggcccagguacauuuucuaaguugaguguguugagaggagaaugugggggugggaagcagaggagagacugucuuugggaaaagggcuaagagaugaucauagcuuacaguccgcacuuccaagaaagggcuucuuucuuugugugcaugugcccuugugcagucucccaggcccccauccgugguuggauggucucuucuuaccaucuuuugacuaucuauuaugcaugugugcauguguauaccuguaugcuccuggaagccaaaguaaaaucuuggguguuauuccccagguuccauccauguuguuugagacagagucucccaggggccuggaaauugucacguaggcuagggugauggccagugaaccccagagaucuacccuucucuacuuacccagugcugggaguauaaaccugagacugcaggccuguucuuguuuuguuuuuguuuuuguuuuuuguuuuguuaauuauggcucuaggguuuagacuucaguccuuggacuugcuaggcaagcacauuccggccucugaucaccagaucucuccagcgcaacugucaccaucuugaaaaccucagucauuuuuugggguaggagcucuacacuuuuauuuugcaaggguccccuaaaauuauacuggggcccuacuaaaagacacugugucaaaugcuuuccuaaaaucuugcuguuuccucucuuuugugacucagugagagcgccccuauuuugucuauuuuuuuuuuucacccauggguuccagggcuugaccucaggcccucaggauugugcacuuaagucccuuuaccugcugagcuaucuugcuguuuaagcccauuuuccccuuucaguuuugcuuuauauauaagaaaacugaggcuugaugcacuagagaauguugugggauuugagccucccagguaacgaguaaugcaaccuggaugcaaauccagauuugccugacuccagaacccuuuccgcuauggguugaaaaauccugacuugaagagaaguaucugauuaaaagguugggagagaaugauaggguuacagaaacugcugaguccccaagcaacccaugguuaacuggagcugccugugucuuccggaauucaggcucuuuguuuuaaggugggauuuagccaacaacauaucugcccacaaaagcucuuuuuuaagcaaugucaguguuucuggucaccuggcuuucaccaguugaauaagcauagaguucuagcaggacacagaaguauaguuugucuucgaggaccucguuugaacuuccuacaucuuuguccuucuuuuuuuccuucgaguuuucccugguucucaggucccaaguaguaucacuuugauguccucuuugcagugcuuucuuuucacuuccuauuaccuuacacgaauauuaaaaauccaagugcguucauaucgagacauaaucacuuuuuagagcaaaaaggugacucucugcauggagaacuugaggcaguagccagggagucugugcagagcacuuggggaauggggguggggguggggagggcagggagagucucuacugcucuguuaguccauacauagggcccuugagugacagccucccgagcucauguguggcuaauuuaugcaggacuuaaagauucccguugucucugugaacaucucugaccccuuaguuuuguuguuucccagauggugaugguauuaauuguucagaugguguaauauuaacacgagaaggcaaaugugggcuggacugaguuuucuauuugccuuuaucccugaaagaucucaggugcaguguucugggggcagcagacauucggguggugcugcucgugucgaagaaggaggcauugcgucugaaggaacaacgcggggaaucagagugcgugcaacuauguguacccaaacucaccccacguccacagacacaaguauuucucauuuugcaaggggcuuagaaauguagcuccacguuuggaugauccguuagcuccucagugagccaguggacuuuguuaccacccauccauguuggaugccuggcggacacagggguuuugggugcuauagccacaauaugacaguaugcagaugaagaagagaggcgguuucuuucaugggcuucuuuuuugagaugggagagacuuuucuuuacaaagggguugguuuguuuguuugguugguugguuuuuacauuuuauuauuuauuuauuuauuuauuuauugugugcauggguguguucaugugcauguguauauguguguguguauaaugugugugcugaacauguaugugaacuacagagggcaaaagaggacgucagguccucuguagcuggaguuacagguguuuaugagccacccaguguggaugcugggaaccauaaccugguccucugcaagagccaucucuccagcaccccccaaaauuuuuaauagcuucccaggucuaguuuauuuuuaggauugggucauacagucauuucuaaaugcacagcuaaagaaggguauaguuuaaaagauauauauauauauauauauauauauauauauauauauauauacacacacacacauauauauauauacauauuuuuuuuucccuagcuaacccauauaaaugauauaaaaccagguauuugacaaacuguaagccuggauuggaagauccuggccaugugcucaugauccaucuggccucauggugcucuccuccuuucuccauuuccuucuucuccuauggucucucuugagacccuccuccccauguuuccaggucccuucuuucucucucuacugcccaaucacagguucuaguccuuuauuaaccaauagcuuuacauuaagaagcaaaguuuacacaacaaaggccaccguaugugagaauucacuggucuggggacaaccagaauuuaggguucagaauuuagcauuugaauaaauagcagcaccacuccaacccccaacaguguaggauugaaaacauuggcuuagauuaaucauuuagggaugaaagagauaccagagaccaggugugauuguugguauaauagucugucaaaaguuuuguuugauuaacaaaggugugcccccccccccccugucucucaaaggugggacagcaacuagaaaaauguuuuaaauggauaauuauuagccacgcaugagaacaaaagaacaagcccggaaucuaugccacuugcaaagucuaaggauuguuuaggugugcugugaguauccaaggagggaccguuagaaugguaggaaaaaaaaaaucauggaauacuuacaacgcuugauuauggagcuaggguuagagauguauagggagggaguguccuggcucacugccugggacaugcagaauuaacuacauuauccagacuuccagcaucagaguccaguacuggggcuagggguaucuagcagggccagugaucuugcucaccauggaaggcaagaaggcaagagugacuccuuccguuccaaggccacagcaggcugagagcugaaggccguuuucaaagcuguuuuccuacuugcaugggacuguugaaauauugacgaggcagcguguaucucuccacaacaaggacuucccgccacagccuggcucucugcugacuuguguggggaauggcccugaggccuugcuggucauuugcugggguugagccuauggcuguagggccccagugaaugccuguuuccugccuggagaauuaagaggaaaugacaagaccugucauuaccaucguugaguuaaccuugaaccaaucccucccugcucucuggauguucaccagcucuuccacauaaaaguuccaagugaccuuguuuuuccccuggguggaauuauauagcucuggcauacauaguggguuuuauaugaagaaucugagaauucgagucguaaaggaguuugcccccucgaagacagacuucuugaggucagacaugccuucaguuuuucuguacccuccuguuugcuaaggucaagcaggaaauguuaagcaguccaugauaguucuacgacacacagucauccuagaaaauggacaaacagagugauucuggcucuuuuguugauauagaacaauguacauacacuauuuaagauaggcacauuuaguuugauagggacacaguguggcucagugucuuaguuagaauuucuauugcucugaugaaacacuaugaccaaaguaacuugggggaagaaaggguuaacuuggcuuccuuauuauuguucaucacugaaggaagucaggaagcgaacucaagcagagcaggaaccuggaagcaggagccaauccaugaaggggugcugcuuacuggcuugcuccacauggcuugcucaguuugcuuucuuauagaacccaggaccaccagcccggggauggcaccacccacaaugggcuccccgucaaucacuaguuaaaugccaaacaguugggucuuagggaggcauuuucuccauugagguuccauccucucaggucacucuagcuggugcaggcugacagaaacaccugguauccauaucuuucuuuuuguccagggaauacaauggggguggagcaguucucuaagagcccuggcuuucaccaagggugggaguggaggucguauugugaaaugggugugucuuugauccuggccacugguucucuggugaccuugggcauguuagcuggguuuguuucuuugccuguaauagaugcauuuauuuuuacccugcccucuaugucuucaguuugaggaugagcugucccagcccagauagucugaugucauuuggaaggcagaaggccauguaauuaucuucucucgugcaucugaauucuucucuggccagcuucuaucuucagcuauaaacacagguuucugccguccacacaugcuugccagcugccccuucuugaucauguuucugucuuguuuauggucaggguuuuauuuuuauuuuuuccacacaaguaguuaucagcugcagccuccauuucuaaaguuuucauuccugccuagagccccugugcccugguuccuaucacugauuguaggguucgccugucucucucuaacugcgaguccaaccaucuuuuccauguguuuaccugccggaccuuguggaaacauuuggcaacacugaccuucaguuugucuugcaacuguuuucuuugagacagggucuugcaguguagcacaggguggcuucgauucagucuauagcuccggcuggccacacacucacuaccuuuuggcagcagcuuucucuucucuucucuucucuucucuucucuucucuucucuucucuucucuucucuucucuucucuucucuucucuccucuccucuccucuccucuccucuccucuccucuccucuccucuccucuccuccccuccccuccccuccccuccccuccccuccccuccccuccccuccccuccccuccccuccccuccccuccccuccccuccccucuuuccuuuuuccuuuuuccuuuucccuuuuucccuuuuuuuccuuuuuccuuuccuuuccauuucucuguauagcccuggcuguccuggagcucacuuuguagaccaggcuggccuugaacucagaaauccaccugccuucgccucccgagugaugggauuaaaggugugcgccaccacaccuucuucuucuuuuuucucccccagcagcuuucuaagcgcugguuuuccuuugcccaagucuccacaacacugaggggucaggggugaugggcuuagcauuuuuuguuuguuuguuuguuuguuuuucucuuucacugacuuguuaauuuuaaacaugagguuuugguccuuggcugucaucucuuuuucugauuuccccaccuucucugucagcugcaacauaacugauucuccaugucuccuguuuguggcuggagagccggagaucuuuggaguaugaaccaaaauucuggguccacuucagccgcaaaacagcucaggcugucuaaccuucacaauguguuccucuagcugaggaaaacggaggcuacuuugacuccugcuaucaggcgccuuccuuaucucagggauguuuggugacucaguaguuccaaguauaaacccauacagccuucucgugggccauucccgagacgucugcuucuggguucaaugucgcccaccagauacagccuguguuuuggcuggacuucugaugcacuuuggcuagggaaauccuucaugaacuugaggugguagugguauguagagcuguuugacuguuuggaaggucagggcaaaagucagaucuuagauuauguccuguacauucccguguuguuagggugagguacaaucaguucguguuaaauugccagcuuuuggguuguuuucccccgauauaauuuauuuauauaaaauuaacuagcauuauagaagagcuuugauggugguggugguagugguggugguggugguggugguggugguggugguggugguggugguggugguggaagaguucagaugggucccucuggacugcccaaaucucuauggcuggcuauucuuuguagcugcaucugagguaggcagcccucagcuguguucugaggcauuuagauaugggaacacacuguacgcaggucuguguuuguauuaaaugggacgaauuccauuuugcacauuaugucuuuggguaccuaucauugaaagcuguuugguugauuuuggagguuuuggguuuuucugauacugaacgcucuagcucagguuggcccaaaacucacugaguagccaacaccaaaucuuccugccucagccccucagaguauagaguuacagguguuugucacuauaccaggccaaaaguuuccugccuaaaaacaaaaacaggcuacuuaacgccauaaugaaaccgauuacuuugcauacuaacuuaacgauauacaaaacagaacaaaaaccuacagcaaacuuuaauuaaauaaguuauuaaaaauaacagaaauaauauuaaauugguuggacuauuucauuuggacaaucugauuggugagcagaguguuuguguuuauuuuuauuuuuugagauagagucucucugugcagucuaggcuggucuuagaguccugguccucuugccucacgcuucugggugcuggcauuccgugcucaugcuccaccgccuggauaauuuguacuuuauaauguggaaaucugcuuucugguuuaaaaguuggcugcagugaaaccuagacaaaauaaaaaauggaaaaaaacagggagguaggagacauuuuuuuuuuuuucauacuaaggagaaaaggccuuucagacuucuuggccaauaagaagugucuggggagaaacaauccgcaguuuccaaguugucugaguggaaaauccugguuuguagcauuuugugccuuggaaaugucugaauaguuuuugugugaagggaaauuccuuuuggcugagagagagcaagccggccggauucaaacugauaggaugguguuuuuagacaagaggaggaaaugagauuuguggcaggcauagcccccucacuggucaguccuguaaacagacagucggaggcagccagucagagccuugcaagggcccccagucucaaggccuuccuugcuuccugcucacauauccuggggaaauaacacucuuagcuguauccuccuccaaucucaggaucacugucucuguuucucucucugacugugacucacacucugugucuguuucucugucugucucugacucacauugacucugugucugugucucucugucucugucucucuccucuccccucucuuuuccccucucccucccuuacuuucaaagccugccccuguagguaggcagagugggaaggaagacaggcaaggaggucauugaguuacaagccauuaaauaccuggaauguguuuugcagcagagcuguguucaggcuccuuuugcagcguggggaguggaaugacaaacgaaagggaggaagaucugaggaauacuuuaggcagaguguggugccgagcauaaacagccuucagagaguacagcacaggacgauaaauaaagcuggaguugaaucugagaauccuaaguagccuguuuuagaaaggggcuucggacugcagaucucucugccuccaucccccaagugcucgaauuacagaucugcaccaucacacccccccccacacacacacccccacacaccauaguuuuaagaaaaggggcucuguuagggaguguugggagcuaguccaagauuaugaaagguuugcacauucuuucuguggacaggaaggcugauaauaagagaaggacggacgucgggaugaauguauucgaggaaggaaacuuagaaagugccuaaagagauaagcuagagaagauggagcugaugaaaugaucugcuggccggcaaguucacccuggcgcagaagccugugaggccugagaccacagggaggacuggguggcuuuaggggagaaagagucagaguuugggagacuuccuguccccugugucagcuggcugaguugccuuuggccuagaauggaaauguuuagagagcacaugaguuuggcgggaagauaguaagcccguuuucagacuuggugacagacguaucugugggauacuucaggaaugaaguuaaaaaaaaaagcaguuggaaaauugugucuggaguucuggagagagguuccgacuggggacuuaaagugggguguugggagucugguguuuuguggugaagcuaggguccguauauaauaauccaaacagccccuggugagaggaagcagaggagaaggcgaacgaagcaccgucauggcagaggaacgugcuggugggacucggagagaaugggcagagagaggcagaaagugagcacaccuuugcaggaucccaaagagggaggagaugcuggggaguggucaaggugaggaagaugguguguggccccacccaccccugcagcugauugcugagccugggggguggggugguggauuucccuguaguccaggguuguuucccucucucugcagccacaggucuucugugguggcagaaccuuuaugcaggacaugugacucccucugggaagaucugucugcugagagugcagacggaaggaagggggggggagccaaugaguguggugcacuguacacaggacugguuugguuuaugaaaggguuaaucucaguucucaaaacaggcagcauuugggugucucugagguccuacuuucauucuguccauggugaguccaucugucucuugauguccuucuagucagcacugugugugugcgugcgugugugugcgugugcgcgcgcgcgcacuuugggauccacagaaaagacagauggccacagacuuuauaacacuuaagugcuggaguuugccaucgcauuucccuucauuacuucugauuuguucaccaagaaagcacuagacacugucccucgugcuucaagugaguuuggucucagagucacuaacaauguucacacuguagagaaaugagagaaaagccgggugugguugccuauaccugcgaaucccagcauuugggagggacaggcacagggagcaggaauucaaagcaaauuuuuacuacagagagaguuuggggccagccugggcugcauacgagucuguuucaagggcaggggguguagaaggggaaagaaagaaaaauagaggaaaaaaaagcuucuccaaaccaguuggcuccagucugguaggaaauaauaacagggcaggugagaacagacggcuugguaguauggucagccuguaggaaacacuaaaauaaacaacuuucaagaaaaugagcaguuccaagcugucaccagagagggguaugguagaccccuugccugguucugcccagggacguucuucucaagucuucaggccucccaggguugugaggagguaggccuauggcggcugaagauacauguggcuguagagaaagggucaguuucaugggcagucauguaucaccugaccuggguagugggaacagaacucagguccuguagcgagcagcacgugcucuuuccagccauggcuucaaacucuccuguaaccaaugacgacccugaguuucuuaucucauguuccagggauguacuaccaccccuggcuuauauguugauggguauugaaccucggggcuaugcaugcuaagugagcgcucuaccaaggaaaccgcuuccccagcccuucacacucuuuuaacaagaagugucuugucaacuugaagccuccguagagaaacauuuucuaagaaaauugaccuuaaaguauuauuuuaugucuaagaaugcuuugcuugcauguaugcaaauagacuacacaugugccuggugcccgaggaaaccagaagggggucauuggagccucuggaccuggagucacagauggugugagcugccaugugggugcugggaaucuaacagguugcuuguaaaagcagccagugcucuuaaccucggagccaucucuccagccccugguuucaauuuuugaaguggauuuuaggaacaaagcaaaacacagcacagguacagagaguuccuggagccucuaccccggacacacaaaucucccucccuugaucacccugccgucacacuguggaccauggcuucauuagucccggaugccuguggcugaucacucagcugucacacuguggaccacggcuuccucagccaggguugcccguggugguguuuuucuuuaccuuuguauuuuuaaguucagucauaaugauuucuuucccauacaaccagcaagaaucuggacucgcccacgagaggagagccguaagccuguuggcacgcccaugcuguuuucucuuuauguugacaagggcuuagucaaacacccaggugcagaccugcggguuucagcagagcgcagcugaaacgguagaaauguuuucugcagcuucccauuccagaugacguagucacgagacaccauccuuugcaaagggggcuggaaugcaccagagacuuuauauaaaauucuagucagggcuauucacauaaaaccaaagauuucccaggacuuuugucacucucacuuuuagcugccugccuggccgugcacucacuggggaggugcagguaccauuugaaguuguuuugcugguucugucccggguuugugaguuuucuuuccaggauucuuguugcaugcugugagcuacauuugguagccccuggaaagcaggggcccgaggggugaggugaagaccaaacccagauggaaacagucugccuuucguuggguuuaggacaucaggggccaucuaaacccagugacgucuacagccgugaggugcacaauuuucuugcauggugagagagguagccaggcagcugccagcagauucuuugguuagaagcauaagguugucuaguguugccuuugacuuaugggaaggcgcuggaucagcagaaagaucaaauagaccaagaaaggagauguuugggcuuucucauuccaucucuuccugagucugucgugggauucucuuuguccugugggggagagaagcaggaguuuggcuuccacacaucuacauggcccugauugccaccggcaaacuauugaguguguauaaacucugcugaugguacacccagaaaaugauggucucugaagguucagaugaguguagucuuggcagauggggauccaccccaagcaguaugggcuccugcuuccacuucugaguaguucccuacucccaagcacaugaauggagcacgggugcuccgugacacacuuguuggaaaccccugagaauuaugguugcccaguuacuuccuccaauaaagaauaaacaccauaaaagcagagcuuccuauguuuaaccacuggggggggggggguccucagcuuccagaacagucuuggacacuuagcaguucuucaauaaaaugguugauggucagugagugugguccuguccugaggcuauuuuacuaagcuucaagaaagaaaggaugacauggugugucuauuguugugccugguaccaagcuacuuaacuuugcagaaggaaccaaguuccuuugcucugguuuucugcuccaguaacuucagagagaccuaggaagaaaacguguugaaucaggagcuuauggggagaagggccaauaaggagaacugggggucuguguguguuacagcucagcugugaaaagacuuugagggaagggaguugcuagaaguuucuuuggcucucuacaaaaugcccuugggcuccagguccuuuggugauuugcauggcugaauucacacuucaauuuuucaggcaccugucccgaggaacugaaauucucugugaguuuuggugggggaguguugaggcagguguuuguauucuugaaguuagucuuaggguuuccauugcugugaagagacaccgugaucaaggcaacucuuacaaaggacaacauuuaauuggggcuggcugacagguucagagguucaguccaguaucaucauggcaggaaguaugacaggcauggugcuggaggagcugagaguucugcaucuugauuugaagaccaccaggagagccuggcauccucaggcagcuaggagggagcucucuuccgcaaugugugguaucuaagaauagaaggagacauggugugucuccaaagcccacccccacacuuccuccaacaaggccacauuuccuaacaguaucacuaccuaugggccugagcauauucaaaccaccacagaguuacagcaagaggggacaagauaccugucagccgcuggagcaacuguccauuacucgacacugagauuaccaacuucauguuuaccuuaugcaaauagcuuuccuugcuauuuagaggaaucuguuagcaugagaagaguggaggagggggaccauaaucgugguugagugacccaugugggacuacaacccacagcuucacaaagcucauaaccccuccauuuuaugacacuccuucccuacccccagcuucccagcagagcuguucuaccauggcacugaggaacaggagugaggacaaggaagucacauggaguuccucugggcugcauccagucuugaacuuucugaagaaggucauaaaaauagccucaagugguaguacaugccuguaaucuaaacacuuaggaggaagggauaaccgggucaucacaguuuugaggucagucaggguuacauccugucaaaaauaauaaauacguguccauggaaguugaguuguucuccuccucagagagccuccugagaccugggcuguaagaugguaucucucuuuccuuucaucuggacccguuaaccccaucauacaacagaaagucacggagacgccucccuauggaugggcccuuuccuacagugucuccugacacauucagugaagcuucaggaagaagcuucuagaagccugugucuaaauuuccaucucccucggaaguuacgcuuuuuauuuucacgaaaaugucacugugguucuuggcguugaccgugagagagugagcccuuggcuacacagcugacauguuuuaagcagguacccaagcagccuccaacaggaggcuuucugaugucuuuggucuuucaugaaauggucuuugccaacugauagagaaauccccugauugagagacuuuucucuuuuacugcucacuuaagaaacucaccccagccaauuugcuuuuagaaaaauaaaacaaacaaacaaaccaaaaaacccccacacccgucacaauuuaaaaacuauaaaaaucacaagcacauuggugaccaucuugaaagcccagcaauuuaaacagguuaagaaccuacuuaugccaugaaccaagagugcuccuucuaaguccuccagggcucuuguaguuacuggccaguguucacgggccuggaauuuuccuaugcauuuauucuuccaucuuuaucacagagaccuuuguuuuuaugacugcaaagucagcugcguccuuugcaaccuaugcuuacacugauggaaggaaguggaaaggugaaucaggaaagccuggauugagaagccaaggauuccucuaccuucaucagaagcccacuugccuuucuuugaccaccucucccaaaagaguggccagaaagaaggcuuucauuauagcugagcgucuuucuacccaggaugaaaccuggaugagaaagguggauaccccauggccaagcagcagugucuguugugacaucagagucccauuugaccaggcuuacgcagucauuggucuagagacgagcugggagcugaucacagucccuucacccaacagauggagggacugcuuccuucagaggacggggacgaaauccucagugguccuuuggauacuucugggugggugcuuguucugaccuguuaacuguggcuggaacauggguggaacuggagauguggggaacagggaaacaggcgguguuguguguaggaaucaaaaggcgugauuaugcuuucucaggaaaagcggcuggccaacaauaauuaaggggcugccucugagugcagggccuggaauccggcccucuggaaugaucgcaaaaaccguuccuuguaaggcucagcccugccccugaggagugcaggcuaagagggcucacagcuacaguugcaacgaagaggcacccaagaggugaaugggagaagaaagaaaggccauggagucagaguaaccagggccagauguuggcugcaggggaguggacuuggaacaggcauuuguaaagcucuccuaugugguggaugggaauccugcuuugacaguaagcaguuuuguugguuggaaauagugcuguaaccggccagaaaccugguguguuuucccugcaagagcagccuaagccacugaugcacagggguguuagaguacucgggugacuauaagccaguggcucucaaaguacucugagacuauaagccaguggcuuucaaaguacuccgagacuugaauuggacuggaaaccucuggaaugcucucuaggauauuagauauagacuguguauuggcaccucucaugaauguuaaaaaaaaaaagcagccauguuacaucguguugcuaauuaaaggccucuuaacacguucuugggauucuaacagguugaaagugaccuuucugaccaucaguggugggcucuggcccuguacucacucacaggucccugaguaaagacaccauuuccccucugguccgguacacugaccuuggcuggcgggcuguugcaggcucucugauuuggagcgucaguggacguuucugaguugauugcgguucagacgggaguauuuuccagccccuugcuucuuuuaacuucuuuccuuguucuugguauugcuaauucuuuucuacacccauuuugaauuuuauuugaccucgaauuguuaaguucccuuuaagucacuuaaaagcccuucaaaaccuggcaaacaagaguguacuugaagaguguagaugcagagacugggccuggcugagggcugaggcacuccugaccccaggacacucacuccauaguccuugaggcaugcaagaggaauuugccaccaucccugcccaccucuuccacauggccacugcucuuuccuuucucucuuggucccucugugccuuugcacuccuccuccuuguucuugggccugccuuccaccuucuucccuuguuucugcuucuagcagccuugaacuagggguuuuucuacucucagagugaccucuuucacaacaaggacuuggcagccacaguguuuuggaggguaucgucuacaaggcauguauuccuaccugugugggguggauuucucucugguguauggaaagugcaugauuuuagucccagacguaugggauagcuagggccagaggaggaaucccauugugcaaauccacggacuagugaauaaacauugggucaacagggacaggagcuagguaggcguucuuggaguuagagauggaugagcaagcagccugauuucuggucacgaggauaauuucuucccauuuugccuuuccugucccucgcucuguuuaucugaaauacugguucuguagcccuacccguucuccaacccauguuuagaaaucucugcucuguauuuucagagcuggacuagcaaguuggaggcaugugaaacucagcugcuauuuacaggugucuauaagcuuggcgcaagccucgggcaccagcuaucuuccccuuucuucagcuguacuuacguaggccuaggggacacucugcuggugugccaccuucuuaauuagaccuccggucacuuccuugacugacuccaacacuuuuggagcugugaaaguuuugcucugacuaagaccucuacuguucggcaacgguucucaaucuuggaugcuggucacaauggcguggagcuuagaaggcaguggugucacagccucagauuuggggguaagaucaggacgucacagauuuuccaaccuuuccuggcaauuccaaaaugaaacugaguuugagaacuaccuggaugcaaguuuugauacucaagacuagacaugggugggcagcaucagcaacacaugggagcuuauccuucacacaagagucagacucucuuccagaauccaagucugaccucuucagauaucccuguacauacaaaguauuacuaaagcagugccuacacgaauacauugaaacagaaacaaauguugaauuacugcagauaaauauacacaagcuacauaaacagauacuguguccuauggagguacagguacauuacuuuuagcaaaguuuccccauauucuggucacuguauuuugguacuuggaaauauuuuuuauuaaaguauaauugugucauuuccccguuucuauuucuucccucaacccauccugucucucaaauuuguggcuuccuuuucauuaauuguuauauauuuauaccaguaaacacacacacacacacacacacacacacacacacacacacacacacacacacacacaccacgcgcacgugugguauaugugugugugguuuuagggcugacaaguuggauaaccaguugugccguucuuuucuggggaacuuauuuuuccagcuacaagcauuccuuagcugccuguaguucucugucuaggggugagaccuccuaagugucccccuuccauguuaccaugccugucggugucaugcuuguuuagaucuccuuuagacagccacauucuugacauuucauggguguagcuucagaccuuucuaggagauggaguauugcugguuuuuccaaucuuuccacccuuguucugccuugaucccugaacacucaggugcgggaguugugauaucaauguaucuguugggacuggguaccccaccaccauucucuaccuuuugauaacuuguggggucuuuggaaauggucucuaucuguugcaaagagacauucugaggggugagaguuaugcuuaucugugagucgcuuauaaaaucugagaaccguuggcugagccuccugaauguccgaucacccugguauguggcuuccgggacccucagcguucuucaguguaucggaugaagcuagagggaauuaagcaaacugacucucaccccugagaacuccaccuucggggucagcucuucaucugcacugggaucuuaccaccuuccccuccagaccagagcuucauacaucuguccacucagaagcuccagcacgggucaaggcaaggaucugaucguuguucuuuggaaaucagucagacaggacuuuguacaacucgugcuucuugguaguuugaaccugccucugugcuguucagccugccugguagaguuugcccugucuugaccuucgagguagaagagcaggaaacucaggcuaaagaauaaaagauaaagcauucaagaggugugauaggugcacaggggugacaggcacaaggcccuggcuuuuuuuuuucuuccggcucuggcucccacagacaacccucaucaaccuaucagacacagaggaaggguggccaggagcucagaaguaacgagagcuuaggaucuaccuguucguaggaagcaauggccccucggcucucaugacucccuaucagcauuugaacccugaaaggccuguugaucugcaacaaagaauagguuugggagauguaaaaaaaaaaugcuuccuaaaaguugcccuaucugcaucuuaugguaggccagcaaauuugagaaagggccaagcaguacgugucuuuagagggagggauguugaaaaauucacagaaauaaggcauauaugguuuacccauuuuucuuuucuuucuuuuaucgucuaucagucaucuaccuaucugucaccuaucaauuaucaucuaucacuuucuugucucucucuaucucuaccuaucuaccgaucauaaccuauccaucauuuaucaccuucaugaaaucauccaggacauugggaaacucugcuaauguguccgucaggugccugguagaucaucugaagcccccaucccaagucauagcuucucacccugucugagcccccuugaauguuacccaccccccacucguguggcugcagccccucugcucugggaguucugggucucugagaggacagaacugggcugccgcuccugucacuucaaagcaccuuggguuaggauccuuuagucuagaaaacccaagcaggcuuuuccccucggagacauuuugaguagcucugcaaugccacuucuauguagccuucccuugugggggagagcuagggugaggggaagagaugggcggggaaggaaggagguaccaaggcaauggccaugucuaaggguagacacuuagggugugcguguggcccuggaugccuggacuaaugggaagugccccucugcaacuccuagccugggauccuuuguugccguguuugugguagugauuaugugcuuggugaaaccugggggcugcaggcugcuuggcuucugagaauauacagauuugugacagguaagaauaaugaaauacaaucaauagcccguaggcaguaggcaugcaguguuauaacauuuuuuuuucccgacuucuccaugauuuacauuuuuuccagggagaaugguggguggggaaaacacagcacaccucuacagaggacgaucccugcacugcagguuaaauggugaccguggcuaugagauauuuagggcaugaaaucuggggcugauuucugcgaagcuugagcuugagaugagcggacagacacugcauaggcuuuauggagaaggaguacccgagcagcagcgccgagcgcaugcgugguggcuguggguguaggcgguguuacauuuggagaaggaaccucagaaagcccuagagaggagguggguaagggaaaacucaguugcucacguaucccuguuaaagccaaagcuugcucaaucagagcucugaguaucaugaauucacauauucucauagagagaauggauguuugggacgaggcugacuccuuucucacagaugaugucuggggaacaucugguucucgcgugugggaggagaacgcuaagcaauaggaagcacugcgggccauuuggcccagccucccacucagugucucucucggugaacuacacuccauuuauacagcugcgcagagugacuccaggguacuguucugagaacgaagccacuuuuaauuccagcagaugugucuccaagccugucuuauauaacacucgauggccuucuuccugcucuucuguaucggguguugagagucuguaggaggaacggcaccccaaggagagcuguguccuugcgcccuuuacucucaccagcucuucaacccugcccccaaccccaaccaucuccuugcagcuucccugacuucugcuuuuacggagcgcagaaguaaagggccuucuguccugccugggaggcuauggaacaagugacaaaggcccuuuaagagauggagacagaccagaggacugcagaugugagguuccagugugucagugggggcuccggagcugcagucagcuuguugcugaggccuaaguauggggcucacuuguggguucuggaacuccucugccgcagcuguggaacuuuccagccccccuuccuggagccuccccagaguucccaggaaccuugggcuguuccguuggcuuuccagagcucuguucuaaguuaaacuccuucugaguuugggcagugaauguccuugaggagccugacuugcaaccuuaucaaugucccgaucugggaaacacagagaaagcuucccugccagguccucucaguugcuggaggaacugguguuuuaaaaaugcuuuucuguuuauaaaacacacccauuaacauuaucuccccuuaauucauacagccuucccugagagcccggggcaccuggauggugacaugucucuucucacugucacuuuuguggcucuggguaucaucugucuauaggugauggauaccucauugccucuuuagccuggaucucucuacaaggucugaucaugaaguugccaguguaucccugcacuggguuguccacaggcuucucaacuaaaucucuccugccuaaauuugugaugugucucccaccugaaugaagagugagaucaucucuccacuuguacaacagcaucuagcacgagcccuugacaucaugccccccccccccccccccccgcuccaguccagcuguucauacaggccuucgagccuuccuuccugaaugccacuccaugcacaucuucuguuucguuagccaccuuguuaggaacaaggugagacccauuugcuagcagucuccuggaaugugcugugucuucuuugcuucucgucucucucagauuuguaagaaauccuucaggguguagcucugguuaugucacuguugcuucuuaaugucacaauggcuuuuuacaaaacugucaggagagaaacacagcacccagucaguggggccuacagcauccuuugugguuugaccucuguguagcuaggucuccaauuagcguucucucucucucucucuccuuccuuuuucccuuccauccuuuucuuccuuccuaucuuuuuaaauguauuuuauguucaugaauguuguucugcuuguguguguauauauauauauguauauauauauauauauauauauacauauauauaugcaugcauauacuaaaugcaugcagugcucaaagaguucugaagauggcauuggagccccgggaacuggaauuacaggcacuugugauuugccaugugggugcugggaaccaaacugaaguccucuauaaaagcagcaagugcucuugaccucugagccacccaccucuccagcccccuccuuccucauuucccuucuuaaagcucuuuaaauauguucguuauuguguuccgucugaauacuucuuccuuuuuuuuuuuaucaguuaauaggugucuguccuucuggucuacccaaggcauaaacaaaugcucgcugcucuuccuuaaaaagagaguucuaaccugaugucuuucuagcccacucuugauuauuugauugauaucuugucugcuguuaaugcgagagggaucuuuuuccuuugcaucacugccgccccugccccagcucucagaaagauuuguugucuaaaugauuccccccuucagaguuagcgaugcauaaucacuggcuuuagaauugcuccucaugggcuggugagauggcucaguggguuagagcacccgacugcucuuccgaagguccagaguucaaaucccagcaaccacaugguggcucacaaccauccguaacaagaucugacucccucuucuggagugucugaagacagcuacaguguacuuacauauaauaaauaaauaaaucuuaaaaaaaaaaaaaaaaaaaaagaauugcuccucagagugcacagagcuaugucauaaaaaugaucucagagagcuagcaauaauaugaaaaccugcacaguaaacuuguggggagucauuggcuagugcucagucuccaacacuggucccacaaugcagggaggcuuguaagagggaagacuuaagacugaccuuuaaggcuggccgaggcccucccucuccaccccuguauuuucccacaugccccuuggcaccugcaucaucucagaucuucugaguaagucugggaaaagucacucagcuguggagccaggucugcgugugcucaauguaggggcgucucccauuugcugcuugcuccuucucaggaguacaguagacucugacuuacugcgagguugcuuccuccagcuccccaggccucuuggccuuccauuguguuguucacaaugugaaggccaaggauccccuggauuguccagcaugccuugcugcaguuucgaaccaauuccuaacagcucacugcuuuuaagccauagucauuuugagcuuauggguuccuuaguggcuccaagucuucugcauaaagcaaagggaugagaaaacugguccgucugcagcgcucagacaaacauuagcuggaggaguuuuagguuuucacuccagcuucgcuguuuuaaguuucuggagaggggagguacaaagaagggagaaggggagaaagggggacagugagagaaugagggauugagccuucuuccgauacgcccugggaguggggacaguccccaaaugaagcaggagaacucuguuaccgugguguccaucugaguaccuacugucagaaaagcacaaguauuugcccaggaauauuacagugacuuugguguuuaguucccuuggguauacauggaauucaaaguaagaaaucuuauccuagauucaugguuuucccauuuucuuagcuagaaaaaaauuuuuuugucauuuuuguuuauuauaaaaaacccauuaccucacuauagaaaccuaaaagcauuucugaggggucauuuuuguucaucauaaaaaagcauugccuugcuaucgaaaccuaaaaucaaagccccgcaucccucaaaaacucaguauccacugccccagcugauucuuauucugauagagcggcagccaccgauuccucugaaaaucugacaggguuguggucuguuaucucacggcuacugggagucgauccuuuguguucaguaauagaaacuucccuauuucaauacuucccggucacuuuuacaaucucuugugugaugcuuuguaguuucuuaguuaauacccacccaauauuuggcuguuucccauauuuugcuuuugaaaauccauugucuuuguuuuuaauuaauaauuucagaaggugagaaaugucagacuaugaaguacgagugcuugucugagacucugggaagcccagcguugaguccaggcagcugaccaccgggaaggugacccaggcagucaugacuucacugagaccauggguucugugcacacuaacucauugucacacacaugagcucugcuugacugaccuuccacagaccuucaaaucucacauagcaccuucugugcccuccgauuuuuugacauaacucaaacucuuagaauaagccagcuacgcuaguagcucugcgaguuugauuauuuuuuuuucuuccaauuuguguuuaacucucagaaaucaugcuaacuuuauuuagggcgacagaucaugcugggauuggaagccugccacccuccaggccuuuuagaaguguagguauucccagaaucucacaguggggcacacaguucuaaaaugacuggggcuagguguguaugcaugguguugagggagcuccuaugugcuuggaggcacggcugaaggagaaagcuguucuuagaacaaggcgcgugcugucggcuccagacaagugauguuuaacaacccgcuggccccuggcccacccuccagaccuguggaaugugcucugucuggacuacacucccagccagccaggcccugauuuggagagggcugaagcccgcucuccuacucucucagcccucagcccaugcccuuacuuaaggaguaaucuguuuggaaaacuggguuucacccugcgucaccccccucauuccaaggcugccuucuuaccuguggagacuuggguuuuuuguuuguuuuuuguuguuugucuuccuaguggcuucuucauugcaugggcuuuccucagaauguaaagcagaaggcaaagcuuauaagaauugauacaaacuuugguugagauucaucaccccauucuggguuaaagguguuacugagaagcuggagagauggcgcagcuguugggaguggugaguggacccaggggcagcuccaaguacccacacagcagucuacaaguggagucgcagaugguugugagccaccgugugggcacuaggaaccaaacccggcccccguacaagagcaacaagugcucuuaaucaccaagccauguuccgaaaaaguccaagccugagggaagucacauaaacagagcaacaggaccaggaggagaaggcaccgaugccgagccuagcagccugagugugggccccgggauauacgugguagaaggagagagcugccacucuuccaauuugucccccaaucgcuacauguccaccauggcacacacuugcccccaagaucuaaaauaaacaaauaaaagcccagcaccacagauacauaucuuucaacuaaauucuccaaguuguuaguauuuaccucauuagcuuaucuaugugcuuuucuauguaugugugcauaggguucuacuuuuuuuauuagguguucuaugagaaccucauacacagaaacugcaucuguaucacuucugcccccucucccaccacugcaauucaugcugucuucuucuuuauuuauuguuguuuuaguuuuacacacacacacacacacacacacacacacacacacacacacacacacguauauacaaucuacugaguagauguagaguugcuuggauuauuuuauccagaacugaccuucugagauugaauaagcuaugugggaucucauaucugaaggaaacugcuucucuccugagccguuacuagcccauagcucuucgucuaggagugggaccuugugggauuuccccauccccuuuggcacgucaaucgcuguugucaucgugucguuaugcaggucuccuuuaggcaaccauauuguugagaauucauugaugcagcuuccuggucaggccuugaggacaugaacuagcagcccgguuuccuggucuucuggcucuuacaaucuuuuagucuccuuuucugugauuuucuaugagccuuuagggauuauguuaaagauguauaacugggauuguggugggggugggggugauuuucaggacuuuuguuuguuugcuuguuuuguuuuauucccuuugaaagcucauugagacgugaugacauuccuccccagaaugcuuagcaagugucuuuuaauauccaacacauuuccuuaaacgaucucaaagucauguggcuuaugaauuuguacucuauuuaccuuuuauauccuuguucagauugccccagcuguccccaaaaugucauuuauauaugcuucuuguuugauucaaugcacagaacaucauauaugcuauaugauuuacugacuugauauuaugggugucuucaucuccagccaggagccuuuuuccuuugauugucugaggacugcaggucaugcugugauugcagacuggagcacccgucccucugacugcacaguggccuuacauguugcuuguagucucacugggcuccauaucuuuugcauuuucuucucucuucuacucuuuucucugccuuaccucccccucuccugcuccugcuccugcuccuccaccuccuccuccuccuccucuuccucccccuccucuucccccuccucccccuccccuuucuccuccccuuccuccuccuccucuucuucuucuucuucuucuucuucuucuucuucuucuucuucuucuucuucuucuucuucuucuucuucuucuucuucuucuucuucuucuuccucucucucucucucucucucucucucucucucucucucucucucucugucuccuccccccuuucuuucuggcucuauccccccuaccccugcuuuucacuaacuuaucccaaugcacauagaagacuucuauguccuuaugugcugaaaagacugagagaacagaaauguauucagcucuagucuauggagacuucaucaauggaaggcaggaggguagcuggugugccaagacaagagcagaagugguacuguggugcacuggggaaagugugggcuuugaaaagccauacgaacauguuagccuagcaagucuguacagaguggcuguaccguaugaucuugggagaguuacuuaacuacgugugcucuucucccacagugggaggagucaugucuucucuuguggugcuguguuaaaagaugaggaaaaauauauuccacagcaauacagcuggugcucaguaauuaauugguggccauuacuuacaugaugucccugccaguguuugguacagagaagucccaagugaagggcuggcaggccauguggguggccaaaaugagaaggaccuuugggaugaaguuugggacaggcuacuggacaggauggaaauuugaaaggcaggugcugcucucagacgcagaaacuggagcuaagcucucaucaugaagcauagcacuugacaccaagaauauaaucuaagacucggaaccaaacugucccauugcauucaagugaauggcgaaggagacuggcuauuaagaucgccucauguuugagccucacaccaggaaugaacuggagaggcagggagcugcuguggaaggaggcuggcucucaaacaaaggccagcauugaguuccauuuuagaacugcuagugacagaaugcucauggauguacuccagagggcuucucucccugcaugucuggccuaaugcuagacagucagcaccagguuguuggugauacguucauaugaacucacugucaaacuucugagcccauguaaaauuaucuacauuugcugccucuaucagcucaagcuacaggagcaaagccccaaggaugauguggugggaacaauuguucuggaggcugaagguccaaggucaucaugccagccuagagcagaucuagugagagcuaccuucugacuugcaugugacuucuucaugcuguguccuuaaaggacagucggagggagggagggaaggaggaaaugaaagaggguaaggagagcaugcagcucgugcucucuggucucuucuuacaagagcacuaauccaucaugagcacccugggcuucaugacucugucuaaacacaaggacccccaacuagcaucacaccgcaggcuggaguuucaacauacaaauuuugaggguucuguuauccccuccaugaauggcccaucccccccacacuugggaaucuauauucaguggaaacaauuaccuugaugugcgcaccucauaagugggguguggaggcagggacaugauauggaacuacaguucuaccaaaacauucugugcaggggauuucaugagagcucccacacacauggggccuuccuuucugccucucaugcauuccuauuuacacuguuucuuauuccagacacgaacccaaggcaaaaugcuauugcuuauuuauucuagguaaaaccuccaaauugaacuuuucauggccucaaaguaaaacuuccccccacuucucuucaauagaacccauuguuuucaagcuguaccucuucccgcugaacuguggcuaaaaucaacuuaugcuucuuaagugucagggcccaguacgcccagcauuuccagaguucuuugugggcagacuuugcauuuuuguuuucguuuuuguuuucuuucaccugcuuucugaaagagcauccuguuaguauccaagcuuaucagaauaugguucucaacaaguauuuaagcaagucauacaauccaaacaccacacgaugacuggauuauauagcauuaucuguuaggauauaagauucaguugguucuaaucuuguccauuucuagaagaauuuuguggcugcuccacauguaucucuuuucucuggccaauguauauuacucuccuaccaaucuccgcucaucuagguccuucauccuguuggugaacaucggguuucucucuuugcgaccaguggcucuuccugugugcucuacagacuaaaggcagcaaugaaaacuugucagaagggcagaacccuggggcccucccucacagaccuaagauuagaaacucuggugugagacacaguguccauguuuuaguguucuggguggugcugagguacccaaaugguuaagauucccugcaucagauuagauagagucagauagauaucuaucuccuauugacugugcuaucacaccuuuuguuuuggucaccuucagacaucaacccaguuuaaauagagugagauauugaguggcaauccuuuagucgauucagcuuagaugagagcuuaugaccugugccaacggguugcagaggguggcuguauucccucgggcacugaaggcuucuuuguucuuagcccuucgucaugaacgugggccauaccuaccucuuagaggcaucaucaguacuuucuggcucuaggguucuuugaaaggugauacaaggaaauauucuagaagaccucguagcauugacccaaucacucauggacagaaucucuuuaacauuuugguauuagcaauauccaguaucucauaagggguucccaagucucaaaaucaagggcuuugucgugacuucgauuuacuuauucucugggaggaaucaaaugccaaaauuagaagcacuccuuauguuuccauccugugcuguucuuuuacaguuuuaguuuuuccaucuccgaugaauguauuuguguguagaugugggcuugcuuuguguuugaaugacaaaggguaggcaaacggacugcauuugcucauuggaaaaaugucaguuaucugaggaaggaguggugcuuguggguuggagacaguucucugucuugcccuuugcuaucuggcuuaggggugguugcuuucagaguuccaguauaugaguccuuuccuuaucuaacucaccucccccccaccccaaguaggcuaaucucuuaacagaaguagauuuuggucaguacugguuuguauuucuguagucuaaagaaaaggguagaauguaaugaauuugcaaguaguguuugcagaauauucaguauuggauuuccuguccuauuacaucuguuccuauccugccccuggggugggauggcuaaggguggggaggggcuggguuggggauggugcuauucaaagccagccucuucaggcuauccuggaacucacucuguagaccaggcuggccucgaacucagaaauccgccugccucugccucccgagugcugggacuaaaggcgugcgccaccacacccggcuaugaccuggcuuuuugaaguggcuuaaaacccuuagacuugguaugucaggagccucaagugcuucauucucugugcuaauaacaugaaagggucaccacacaggaaaguguuuuccggucagaauagaucuggauuguguugggagccagagauguuccgcugggauaaagugaggcuucuuuuuauuuuauuuuauuuuauuuuauuuuauuuuauuuuauuuuauuuuauuuuucuaugcuuuacauacauuacauccugaccacaguuuccccuaccgccaugccuucccgcccucuuuccccucucccuuagauccacuccuccuccauuucccuucauggaaaaacaaaacaaaacaaaacaaaacacuaaaaagaucaggccuccaagggacauuaaccaaacacaguguaacacauuaccauacggcuaggcacaaaccuucaugucaaggcuggaugcuuuugaggcaacccaauggagggaaaaggccccaagcgcaggcaaaacagagacacccugcaccagcucccacugguacaggccccaugggaaucccaagguacaagaccauagcauauauggggaagaccagcucagaggcauucaggguccaugacugucucuucggcuucuugugagucucuaugaccccuuuugcggguuguguucucaccguguccuccacccaaguggggcuuuggguaccguggugauuuuuaaaggcacaagaagucuguucagagcucugagaaaacagauugugaugaauaauucucuucaugucgucacuuguuaauucuuauuucucucuuugugcuugagcagauauaccaaauacuacccuaugcacugaggaaaaaaaugguuucaaaagaaaggguaauaaaagaccuaagcauuucuauuaaacacaaaaauauaccaaggggcuggggagaucacuuagugaagcacuggccuucaaguaugaagaucugaguuugaucaucagaauaugcauaaaaaaagaaacccaggccucggggcaccauuuguuaacccaguguuugggaaggaggacauagacaucucucugggccuugcuggucauucauucuagccuacuggauaaguuucaggccaaugagagaccuuguuucuuaaaacaagguauauggcuccugauaauaacaccccagguuguucucugagcacacacacacacacacacacaccuauuaaaacaaucuggaaacuucaguuucaagugaccaccacccccuuaaagaaaggaagaugguggccagauaaggaaauguucagggagggauagugaccgucaggggcaagugugagagcuaugcacacugcagcggcacaguugcugaccuaccucugaguauaugcaugugcguauguauauuuaguuuuguauuuauuugugaucacugucuuuuaagcuugcauccccauggccaguuuuauaagcucagcccuugcuauucuuuaggggcaguauaauacaaugugaaauuuauuaaccguguaaucagacaucuggugguuuaaauucuagcucccacacauuccaaugggguguuaacccaagucuugguuuacugugguacaaaaugggucuggucauauuuaccuaaugagguagcugugagaauccacaguacauucaccauauauuuaacuagauguuaaaaguaccuaguaaaaugcuuuuacuguuguuuuguuugaggguuauaaugggaaugucaaguaugaaccuuauaaaagccagggaaagggaacauggaagagaaaucaaggagagaccaugaaagcaugaaguaauugaggggcguguuuuaucacuguguuuuucccugugcuuagaaaccgguaaauaacucauguagcgcuuuuuuuuuuuuuuuuuuuuuuuuuuuuuaagauuuuaaacaccagaagagggcaucauaucucauuacagaugguugugagccaccacgugguugcugggaauugaacucaggaccuuuaggaagagcagucagugcucuuaccugaugagccaucucuccagcccaaaguagcgcuuuguagauagcuccuuuacucuccucaugagauggcaaaggaugcgggucacccaggauaauuuaaucugggcuucgugacugauguccgucauccugcuuugcagaguuugacgaauccuuugcuuugguuccccaucucggaagaguugaauguuauccacacacauacauuauacauuucuguuuuuaaagaugaugcauggcuuuucuuuuuuccugguguaacagaucacggcacaucuuucuggccuaaaauaaccauaaguaauuuaacccaagauucuugacugggcacacucagaugcacgguucuguugcuggucucggcuggcuccucacgugagccagcuguuggugggccggccaacagcaaugcuuccaggguuggcugacuaucagguuaucagcuugggagauagaggaagggaguggcagagguuggccucucgucagccaacagacuggcccuggcuuguuccaaggacagcucggacucucaagagaauuacuggaaacaccaaggacuuuggaggcccaguuucaggaguuggacagugauacuuguaccauguuccaguggcccaagugacuaaaaaugucacccuagacuuagggagcagugaguggauaucucaaguguuaguccauuuugguaauccuuucuuccaacagggauucugcagaccuauugaccaaucaguuguagucccuugaaguccaggauuguuuuuugcuguuuuccccaaggccucugugguaucuucuucuuuauuuuaguccauuuugcuuuaugccuugauuucaugguuuggaucuuaaauguugcucacaugcuaaagacauaguggccagccuccauuauugggaagggauagaucguuuaggaagugaggccuagcguaaggaaguuagguaacuuggagcaucuccuugaaagggcuacuggggucccagcauccuuugcuucucuuuucuagcugcccugagauuaauggcucccuccgccacauguuucuccuaugguauauugccuugccacuggccuaaaaacaacagggucaacaggcccuuaggaacugugagccgaaauaaaucuucuuuagcugaguaccaagauuuuguccuagcaacugaaaucuaacaaaauggguguuccccuucccuuccauuccauugucaucucaaguucguuaagcguuacugcuggagaauugggucugaccccacugacccuuccuagauauccacucugacaagacgcacuucuguguucuugcaugguggccagaagaguugagaggucagcuguugggcgaccucucuggaggcugcccagggucucuggcucaggagcagcuuggucacugucuuugaugcaggagauuuauuugcaugaguaaacgggcuucauuugagcuacuggaucucucgggauagugaccgugcgucgugguagaugcugggcacauaauugaacucccuugaauuuaagcucuuuuuauccaucagaugguuuuaagucuucggguuggcuugaaguagcuaagagugaauuuucugguucuuuggagggagcagggcguggugauucucacuggguccagucaggaagcagggaacaguaaacaccaguccucagcuugcuuucuccuuuucauucagagcaggacuccagccugggaaacagugcugcccacagcgaagguggcucuuccuuccucaggaacugagucuagaaaaccccuuauaggcauguccagaagccuaucucuuaggugauucuagauucuagcccuggggugaauauugacagccaguauaaaccagcgguccucaaccugugcgucuugaccccuuuggggauuccaaugaccccuucacaggucaccuaagaccaccagaaauaucacacauuuauauuaugauuuauagcaguacaaaauuacaauuaugagguaacaaugaaaauaauuuuaugguugggggucaccacaacaugaggaacuguguuaaagggucucuguguuaggaagggugagacucaaugauacaccaucacagacaguguuuguuacucguaucuuugcucuuccacguucucagggaaugguuaguuacuuccuggcucacaaacauaacucugcucuacgugucccugcagguacuugaacagacaagcagggguaucugcuucucuuagggaccacuggggcuugggauggugauuuuagggaaaaucuacagaaaacaacuacacagccaugguuuaauggcuccucagggcuccaggguaccaaguacagcagacucugugaguaagaagucucguuguguggcuguuucuuccucgggaucaaauacccuaaguugcaaacaaagaguuaaagcacaagcucaucugauguguuuuugcuuacuguucuauuuaugccuuggcauggggcagcaauaaaugucacccacuugucauauguccccagcuuucuuccauguauguacuuugaugaaaacuugugaaaugggugaauugaaauggagggaguagaaguuacugggguuuccaaaauagucuucauuuucauuucuuucuuucuuucuuucuuucuuucuuucuuucuuucuuucuuucuuucuuucuuucuuucuuuccuuccuuccuuccuuccuuccuuccuuccuuccuuccuuccuuccuuccuuccuuccuuccuuccuucaucuuggacucacuuuguagacccggcuggccucgaacucagaaauugcuggcuucugccuucugagugcugggauuaacgacauguacuaccauguccgggcaaucuuuucuuaaaauaaaaaagaaaauccacauucccuugaguuuaaagauucauuacacugaucugguuuaagucagaaaugaccuccccuugccccacccccacccccauauacacacccaugggaagaagucaagccugaauggagauuauagcaugaaaggugacucugggguuauagaaccaggcagcucugcggguggccaggauguggcaacaaggacaaggacaacaauagggucaugccauucauuaauuuauuaagcguuuguuugccuucugccuggcuagcacuguaaccuaaggcuuucccaugauuaagcuauggguaacaugaucaguggccacacauaugaagaggggaagaugcgcagaaaugcacaaauaacugaaggaggaggaggaggcggcagagggagaagaagaagaggaggagaaagaggaaaggagaaggaggagaaggaagaaaggugacuugggaacacauugggugcacagcauugugaaugggaaaaggcuguguugugaaagucagagaaguuuugcaggagaugaaaggaacaaaaucauuccacaguguguccacggcagggagguuuggugaccuucaaaucucuccaucacacuagacuggagcagagugggggaugggaagaaacagagacaaacaugagacuucacgucaggagggauggggaugaaacacacacacaaagugguaguuggagugacagccagaugcugcccccagaaaaugucgcaaguaagccagacgaccaguaacuugaagauguuuuauaaugaaaacaaagguucagauaucgaaaccauacgguacugagauuuuauuuacuuccaauugccaucuuuuaacuuaaucuccacagaucugguaaagcauuuauaaauacuuacaaggcauuugggagcccacuuugucguguguccguuaguauagcaugacaguaaaaucugaguccugaacucuuggggcuuggccaguguuuuaaguaucaaacugaugaucguuucaagggacucaaaaguacacuaggugagaagauaaauuauccacauaucaaggaaggcuggaaucuggcugugcccuccagauggccugggggacauuacuucucugugaacagguucugucagaaguuucuaguuuuauuugcaauacuucagaguuuuuuuuaaauguaaagauaagagaacaaaguuauauauuaaaaacuugaguggaguuauuuguuaauuauucccuccgaaauacuguuuuuucuuucuucucuucuuuccuucuuuucuggcuucuugacuauucuggcuuuguuuuucuuucuucucuuucuuucuuacuuucucuuuaguuuugaaaccagaucauuucuuuuaugauggauugaaauccucacaaugaacugcaugcugcaacagcugccccucauggguuuagguguuccuucgaggaauucaugucugagucugguauggacaguuuuaggucccacguccgucuggcccccgcacugucccacucucagucuuggugcuccaguugugcuuucucuugcccuuggcagggcaggcacaugugccacgggugguggggcuuagauccccaauagcacaucuuugcucuccaaacugugacauuccuuucagcaucuugcuucucccacccaggccaaauagaccaguuacuugaagauguuuuauaaugaaaacaaagguucagauauugaaaccauacuguacugagauuguauuuacuucuaauugccaucuuuuaacuuaaucuccccacuuccaccacuuccuguggauaaucuucuguccugaaacuuuaaauaauuuccuaaguauuaaaaugcauggauuuuaaucccaguuggaaaugagaaggccaaguccccucacacauauuucuaaggcacugaguaauuuggacauguuuguuuggcuguuggggcucauggggagaugaggagguuguacuaaagaguuaaucacaacauggucauugagacuguucuuaccuagugaaaugucccuccaguagccagagcugguucuaucaaaugucagugaacauaugcucuuccuucaacuaugugauggcucuguauaccacaaggguggaaaaggagcaagaauuucuacauagugucgagugaguguguguuaaaccacuuacagaaaggcaggugggaaucugaaaggucagaggaauauugguugaucacagccauugacuauuuaucuuucaaggguguuuaaaagggaguagguaugcacuucaguuacggugucucucuagcagacaagagacccuggguuugaucccaguaccacauacaaaacuaggcaugaggguacaacccugucccagaauuugggagacagaggcaaaacgaacagaaauccgagguugccucaggcugcauaggaaguuuaagggccagccugggauacaugaaaagucucaagaagguaugugggaggaccagaaaguuggagaaauucguuuaaugcuaacuaagaucccagccucccugguuccugcagaggggcagggugagguugcacggcagagcagcuccccuggagcagagcguccugcagcugaguucugcugacacaggagugccaagugacagugcugaggaaaucugcagccuuuccucucccccucuggaggcuaaaggacugugccugggugucuaggacugugggguauaccaggaaaguagagggcaaacgggagcaaucgaucacccugcuuuccagacuucuugccuuucuccucacgcauggccaaagaaggcagagacauuccagacuccuuucucaguuuuaagaauaacauucacccaugagagaccuacagagcuuggccaaacaaaacaaucuguuuugagaaaacucucucuuucucucugucucucucccucucucugaugucucugugucucuguuucuaucuuccucucuccccccuccuucucccucucuguuucuucuauggugcuggggaucccaaaccuaauguauucuggacaaguuuuugacugcugaguuauaagcacuccagacuaaaugauccauuuuaaaaccaggggugcuccuccaauguuuggauguaagcacgaggugccugcggggggggggggggggggguagcaaccugccugcugcuccuggcugcuccuguauaaaaccuucccaccugcugaaaguuuccugaaagcagugagcugaagaccuuucagggagagcaggcucuugagagaugaccccugccugcagcugcugcugcuuccaccucugcugggcagcuguugacuuugcaggccggaaggguaucugugaucugccaguuauauccugagcacuguguagccuuuucucuuuaggaaaaauaauacgcaauugggacaugaugucaccaagugcuacuccacuccaccuccuagaaucauucaacacuguggauggauuucaaccaucaucuugcuuauccuuucuauguaaauauaauagauacugucuagcaccucagggucaaagggcagaacucugguuauucuguggaggcugaaaauagcagaaccccagcaggggccucuuggauggaaucuucucuccaugaagagugaagaguuuuuuacccugugacucaccagaacagcuuuguuuauucuuuaagcuugcaccucaagcgcgcgcgcacacgcgcgcacacacacacacacacacacacacgcagcccucugguuuuccuccugacgagguugcaugucugugugauaucucuggcuggugugaaagucaugauguuuuuccacucugcaaagguccucuuuguuugacuagccaugaagaccucuccuuuacuugguugucuggcugccugcuguuuguugagcuaguuugcaucaacaguugccuagacaccaugugaagacaggcuuggguaaagacuuuuccuuuuuucccuuccuucuuuucuuccuuucuuccauucuuucuuucuaucacaggugcauucugauuaagauugguguuauaaauagaucacuguauauauccuggccuuaagguacauggaagucaaaccagaaccccauacaugggguuaccuccaugugccuguagucaacaauccaggauggucauagaugacccaaaccuuccucuuccacaacuucccuccauggagacucuguguuguaaauugcuggcccuuuuuaaagaacauuagcaaaaccaacagaaaaauuucagacaccauuauucaucugccagcuacucggagcucagccaggcuugagugugugugacgggagaaggugggugccccaaguuggucaugaugcgggaauguguuauauggaguggccaucaaucagcccagugauacgcagguuuucagcagagcaacacuaggagcuaauccucuuuuaaaagcaguuacagugacuuagagggacaaacucccuaacccugaauucuguuacuucccaggaaacaaaucaugauggagucaagagacaccagugggcacaccuucaaaguucuuauuaaaugauucaaggauucuuaaacuccugggcagggaacuaaaugauuguggccggaccuggggucaaaggagaaagagaugccaggaaaggauaguguugguaaagucagcaaauauugacuaagcaccuccuacucgcagaauuucccuuauaggugggguagggucacugucaaacagucaacaaaguaggagucagauaauaaaguccagaacagauaaauguuaauuucagauaaugacaagagcaaauguggaugauaaaacgguuuugugaccccaggguaggcauaggcaccgacuucuggagcuggcuuuugauaugggcugcugggggccugggagggguuuggaaucaacagccaggagauggggaaggaggugcaucauggaagagauagaaauccagacgcagaggaugugcagggcuuagacaacaaacuauguccaaguuucccagauggucuuaauugccuuuggggggggggacgccuagcaggguauuagucacagaaaugacaauaaggauauguagauuuucccuguaaucgcuucuugcuauuugcaaaauagcaagucccacaaagucauugaacuaucuaauagcagaggagagaaaugugaagauucucauaagccucucaugccagcauuuuuaucagccaguugauacauagucuuaauagugugugcaucuguuuagggacaccucauucaaugaguucugcuggcuuguuuacacuggacuacgguccagagcaccauaccuuguuuggauggcacuuaucuagccuaaggaugguuucugugaggcacgucaucaucuccuugcuuuggggagcaaaggcaccucacaacugugccuggagcugcuucaaacagcagacugacucaucgacagugcacagauguguaaacacgacacugaacagaccccgcagaggacaccguuuccggugugaggauggagucaggcugcuggcacccggagccugagcagcagugaccucaguuuuccgugcuuugcacagacucgcaagagacucccacugggaggggggguggcaaguaaacccuagcaagcaaaugagucacaaauacggagucuguggguaguacagugugucccacuguccuccugacuggugcuacaugguugacaguaugguaaguggcuugccaugaaugcagcucuauucacagagccaacucuugaaagcccgaggaggagguagcugaaaaggccgagguagguaagaaacagccccauaugucuuaggaagguugagggcagucauuugccuuucacuuaggagggagcuucaugugcuguggacuagcugcccagaaaacagugcagcuauaagcugacuggaaucauaccugccucuaccuaaaauaauuggcaaguauuuugcccacuguccuggauagugagucuugccccuuucuuugcucacuaucauuugguaagaauagauguacaugaaaaucguagcucauguugcccacucgacacagacagacaugguucucuauguacuuauuucaaaauuguacgugcucaugauguucaugcugcacccaugccuucaacaugaaggaugaauuaauuagcugugaacucuaacuuuucacggaaggauggucucgugggaaaaugugguucuuacacucagggaaauagaugcucauuuucugucucugccccucucugagcugcacaauuuugggcccauuguagaucuuuucugggcucacacuuucucauugguaaacugacuaacuaauaugucuguuguaaagauuuauuaaaauaauauauuuagccauuuuccucgucaugcuuccguggcuaggccuuaguggacagcuagcucuucgguggcuuccuagauaaaaugaaugaaucaucguguagacagcgaccuuugucucccagcugcucugccuggagaggaucacucccaaucgaaccguuaucacaucguccguguacccuggcuucugcaucaguaaacaccuuagccugaugucacuauugacuuucuuccuuuuaaacacaaauguucuagaguacacacagaggaagauucccuuagauucuuuuccccucuaaucuugagggagauguugccagguuuucuguguccccuggugagucaggggcucaggaacacucacuugguaugacagacaaauaugaaagggauggacagcuacuggucuagugugguaccugucacaucaagggaaaaguacaguaccaggaauggcuugaaccacaggaucccgaccaguagccaagucuuggagguacucgacaagggauauaaagauuccccauuuuaugauaauuucgcaauuacaugauacuauaugguucuuuauaccuaauaaggacauuuuacagaauuuauacuugauuuuaaaacucuauuuaucauacuguggauugggcccagggccauggguaugcuagguaaguucucuguuacugagcuucauucucaacccaggagauucuuuuaaaagacucuaugugaaguuagcaggugaacccagcuaccagagagcgucauaaggucagccugacaauggcaaagaccacaggucgccgucucaugcuaaguggcucugucucgcugaacuuugauagcugcuaucuggaggagagaaauuuguuuguguugccuugacuuuugagauaaccuggguccuugauggucucuggacccugaggugagcugacucauuguucagcuauggggaggaaagggaauuuuuauggacuugauugggucucuuuuccauguuaugugacaguccuaccacaucucccauuauaguuguuuguccuguuauaucucacacuuauguagacauaugcaaugucccauguuugcucugauugcuguaauuucucuaaugaccaucuguuguuuuguguauaccacagaacaaaggcaaugcgaugcaccgagcacacaccuaggaucggguagucucaagcaauggacgggaugagaaagaaguuauuguaaugaagcuacuuuucagcaguucacuagcauucaugcugucauaaucaauucaguagaaagauucaaacuagaaaacccauguguugagccaagcacacuuuuaaacagcugagaaagcauucugaagguuuaauacuugccuugauuaaggcuaacuaacauucuguuuccuucugguagucgcaacagguaucugcuagcgggagccaaguagggacaccaaaacuguaacacaucuauuuuauuuuagccuuaaagaguuagagaguuggagaauagagaagucauagguaauuuuuguucccaccacagucuuucucuggcuauuaucaagccugaagcuugggcacgagcugaggaaaauuaauuggauccugaauggaauuugggcagaauauaguaccagccucuauaguggauaaaugauuuuuuaaguguccuggcaggcccugagcuauaagacaguuucucuguauaucuagaacuuagucuaguuuacccaacacauccugaauuugucuucucugaauugaagacaaagaggcuggagaacauagugagauaccauggaggccucaagccaucgaggaaagcaaguguggucuugaaaggugccugggauuggggguagaagaggcuucguugaggucacauggagaucuuguuccuacauggauccaggcaccagagcaggaggaccuggaaggguaguuacauggaggaagugccagguuacagagcuggucacagagcuagcugaaaccggcuggagggagacugaugcaaggucagcuugcacagacaggcagagagaggaagaagauguggaaaugagucuuccagaagcaucagcagucaagcugcguugugaccagucuuaagguagaauacaaaaaugucuuaagcaaauaugucuccuuuguacauaucaaaaaccccuccuccuuucuucaguuuucuuugcaaauguuucucucaaaggaaaucaacuucuugcuguccuggaccauuaggaaaaagaugcacuccccuucucugacacucuccuauagccccagauauaggccagggcagagcagcaggcuugccagaggugaaguuccagccagacuucuuuuguaguuagacuucucagagcuguaagugacaggaugagaggcagaccucagguucaggagacaaaugcagaaaggggaggcuuggcuucucacacggggcuagaggcugccugugaggcucacagccucccacaacugccacacagguggaggagaccguagacaugaggccuaaugacggguuguuucauguguuggucggccugagauacugugugcagcaaagccccauagccugggugacuucggugcagggcuuucuuacagauguguaggcuggguagaccugucaggaagccagaguaguuggauuugguugagggugcaguuccuggcucauggauacuacgcguguucucaaagagggaaaggaaagggaccagaaacaugacucagcagguaaaaggacuugccacaaagcuugacgacuggagucugaucgcaggguuucuuucacaugcuggaaggaaagaaagauccagcucugggaagcagacccuccgcaugugcuccagggugggccugcucaucccuuccccacuguauaaauaaaggaaaguuacaaaauggaagaagaaauuuaauaauguaagaaauagacaauagaggaaauuuaaggagaaaggaaagaagggaauaagagagauagggagggaaggagagagagagagaagcagagaagaaagaagagaaagaggagacagagaagagaaagagaugcguggagugggagggaggagggugcaugcuguaugcauguguguguggaagcccgaggucagucuugauuguuccuugggugcuguccaccauguuucuuguuaaucuaucuuguuaaagauagauuaucuuugcugugcuggagcuugcccguuaggcuaagcuggaugcuggcuauguucccgacucuccagggcuggcauuacaagcaacugccacacccagcuuuuuugacauugguuugggguauugaaauucagaucuucacaccuguguaguaagaacuuuggaggcaucucuuuugcuucuuugcaggagagaauuuguccuauccugagggcccuucccuuaugacaucaucuaaaccugacaaccuccugaaggacccaucuccacaaugcuagcacauugugcaggagagauccaacacaugagguugugggauaauacaguuguggggugguuuugccuuuagcauuacuacaaaguaccacaaacauagcaauuagaaaaaccauguuuauuuugucuuguuuccugugggcagaugucauggccuagcuaccucuuuucccaccucuuaccgccuuucagucagguggcagcuggagccucagccucuguagagucccuucuuuggguucacgagucaguuguaagcuggguauaucuuugggccuuuuucagaccagcaggagggaaguuucucuacuuggagauugauugauugauugauugauugauugauuuuuuuuaagaucuccugguuaggacagcgcuaguguccuaguuaggauuauucucacuguggugaaacacagugaccaaaagcaagcugagggggagaggguuuauuugcacuuccuuccacguuguaguccaucacugaaggaagucaggacaggaacucaaucaagcagggcaggaaccuggaggcaggagcggauacagaggucguagagggguucugcuuacuggcuuacucagccuguuuucuuauaaaaccaaaggauagcaucacucacgauggacuggguucucuaauuaagaaaaugcacuacagcuagaucuuauggaagcauucucucaauugagguucccucucuuucagaugacucuggcuugugucaaguugacauaaaaguagccagcccaccugggcaggauugucuccuauuuaaugaacuagucaaugaguuagaaccuuaauuacaucuauaaaaucacccucauaucaaccucaccaucucuacccuacucuuuauugcagagguuacacacuggaaaaggggcuaacuacauagagaauguagaacggggugggggggagggaguugggggucugcuuagaauugggcccgcuauagcaggcgagagaaagugaguggacagggucugucuggugccuucguuggcaguaaugggguggguauuuggacuguaggaucaagaacuuuucuuuuagguauuuuuagucaauaaagcauaguucaauaauacagauuaccgugaguggagacuuggauuuacacaagagaguccauaguagagagaugcuggcacccugauagagccugcuugguaaggagcugugaaggcagggcccuggcugggcuugggagccuguugugccgagcugccaaauggagccacccgaagccuguacucucaccagaacuguucagaggguaugagucuuaauugcuacuaaugucggggagaaacuugaggggggauuucuguccacuuaacagccugucagaguagaggugcucagcgacuuggggcauuagugcucugcagacuggcuguguuuuaagcccauggcccccagggggcuauuuauuuacuuauuuaacaaggauggaauauccaauauccgcccucuggacagaaaaccguugcuagucagguauccucacuguucuuuguucccugaggucuauuuaaaccagguuucacuuaauucuuuuaaauggagucugccuuucaaggcaggaaaaaguguagagugugugugggguuuuuuuguuuguuuguuuuuuguuuuuuguuguuuuuuuuugguugguugguuggguuuuguuuguuuguuuuuguaguuguuugguuuuuuuugguuuuguuuuuuguuugauuuguuugguugguuugguuuuucucugcuaucacaagcuugaaaguuucuguugcagagaaucacacaucugauucucucuguagcuauuguccucuuguauaucccugauucucucuguagcuauuguccucuuguauaucccacgucccagcuuuguuauaggcacuuguucuuuuaucauugagaaaccacagggaauucauguuucucaaugcauauaugugugaaggcauuugaaaauacucuagccaacggauuucugccacagcauuuuaaacaguuacuuagaugcccuuuuaguuauuuaagaagucuuaucugggccacuuuugguuucacacaagagguuggucguagugcagcgugauucacuccauuaggagacccaucuuggugacugagauccugugugcuaguccaguacucaaagcucgcuggugcagccuguuugcugcuugcaaaggccacacuccuguugcauauuuuuugccuccccccuccacccccugcacccugcucaguucccaaguuuccuuacagaguuuuuaaaugccucuuuugugaguuagcagccccaauaaacaaaccacuuuguugaacccaggaguauuaacacuaccacagucucccaacuuaacugugcauggcagacaucacgagguggcggggugguccagcugcgcuuugguuuuccacacacagacucuguauacaguucaaugaacuggggguuugucuuucuuguuuccuucugaaugggaugcuggggcagaaagcuguuuaaaaagaggugagcagaagaucgugguagcaccucuuuaaagcuuacuuagaaagccugacuucgccgaugagaaggggaggucucaaggaauguggcguguggauucuaguggggcgucaggcaaggcaggcauggugucaucagcucacauauccacccagcugagucuccauuuuucauuuuauuguuauuauuauuguuguuauuauuauuauucuuuuuagacguggucccaugcacccuaggcuugccucaaaguugcuguuuagggaaggaugaccuuggauuuuuuuuuuaucccccugccucugccuccuggaugcuacgguuacaaguaugugcuacacaguuucauguggugcuggagauuaaacccaggacucugccagcugagcacuaucccuggcccagggaucuccauuuuaacaguuacuuuuugaccuuuuggacuauacguguggugauacuuuugguugucaccuugaugagaaaggggacucugauagcauuucaugcucagagguuuuauuguguguagacuaguccugagguggggacucacagaguggccugguugaguacuccagcaacuucagaaucauuugguuucuccugagaaguggugcagaaaacaugaaaccacggccuugagcuguccuggaaguugccuugccucucuuuuuccugcugugguucguccgagccaaggcuaggaagaucuuguuccauguaugggauuguaggucagagagaagcaguacggggcuuucaagucuccauccacacuugaccuguaaaaguugagucaugguuuaguuuuguugauaaacgccuuuccggcuguuugucucuaaggccagcugugggaauuauggaaaucagccacuacuguccagcuguuagcucagcuguccucagggaagcaaauucuuugccaagaaucccagaaaagaccgaggagagggauuugcagggaagacugacucaggcuuaagauuuguuuucaggcucuguauucccuuaggugcaaggggacacugaggccaaccacaucaucaccaccuucucaaggucaagggcgugagagagcagcucuacccuuaccuuauaaucugagaaaagagaccuagaaaguuucaaagacucaucuagggucacagaagcacguagugacaauuugucuaaaacuaaaggccuuacauuccaaauggagccuucuccccaguacacgggcagacuucucuuaauuuauuagugaagcuuugucgacuuccuugcuaaaauauucccuguguucccaccaaggcguugcauuguggucccauugaagccacaugugcuucuuaaagccauuggcugcauggaugagggagaagaauguguccagaacugcaggcagcucucugaccacgcugccgugagcggcucuacaucauuguucagccauaagcaauacacagaaacaguaccuuagguugucuuccacaggagaggcuggcaagggucucaaggaagcuguuugguaacaaguuuuaacaugucaugcuuacauguuucccagacagccucuauagaacaucuuugauuugguuguucuuagaacaaccuacuaagaucacaagauuccacuuauguccuuucuuagaaagagaugaaugugaucucugcugcuuagaaucacauuuuuuaaaaauccuuuuggugugaccacuaugcuuucuaccaagcuguuguaguugaguccuuuugugcugggcuaugucauggguucccaguaacccaguggguggggauauauaucucaggcuucuuagugguuacuucaggucaucugaggguuuuuuugguccucagauucacccaagcaggaauuuggcaaugcugcuuagcucuggucaguucccucauaaaaguuuggagagaugguucagcaguuagaagcacuggcuacucuuccaggggacccagauuugauuuccacaucuacagggaaacucacaaccaucuguaacuucaggccagggaaauccaaggcccucuucuggccucuaggaaccacugcauauaugugaugcauagacauacgugaaaggcaaaacacucacacagcuguacauauauaugguaaaaaauacagggaaacauuauuuuaaagcacaggugggaggguugcauaacauuauaauuccuggcuugaagagcaccaaggaauacaauggacgugauuaaauuugauugauggagaagcaaucauagggaaggagagagauggcuagagagccgagaugugggccuuuugcagaaaggggaaaagcaaauauauccauuauaaacugauagacugacagccagggauguggcaaguugguacagcacuugccucaaaugcacaaagccguggguugauacauagcaugcacaaguggggucugaccacugcauaaacucuguaccuguguguauguguguguguggggggguaccuaugcaugcauaucuauaaucccagcacuugggaggcagagucaaaaagagcaggaguucaaaauggcaugccuacaacauguguguguugaauuuguugucucuagaagucugaaaggcagauuuuauuucugauuuuuggaugagauagaaaguaccagugacuuagccaagguuggaugcuaaggauagcagagcugacuuaacauacagccaucucucaggaccuaagggaggacuaggaccagacggccucugagaucagcaaaaucuguagacacucaagucuuuugcacaaugccucaauauuugcauaaaucuacacacaugucuuauguacuuuaaauuaucucuaaguaacuuacagaauaaugcuauguaaauagauguccgucauguuguuuagguaauaauggcaagaaaagaagccugugaaugcucgggagagaagugguugcuugggucauuugcuuguuuggaaucauuuucagcuucaguucucaguuauucccauuugcagauggagaacccacaagcauauccgugaguccagugagggaaaaacauggcuucacgaggcuaagguccccugaugugugguagccuccaucauuccagagggaggggucgcauaugcauagagucuaauggaccaagagacugcauggaugaaugccagagcuguggaauuccuggugcucuuaucuacggugacggagcugccucuggcagugagcacuuaaacaagacaugguaccuaguacgucugagacauccccgcccucugacauaguugguucauaaauaaaacagagucuguggaauguacaaacuccacgacuccuuuaccuuuucauaccuggcaccuuuggcauuaggucuugaguuaaaggucagauugcauugcaaagcuguaaaaauuccagaguggcagggggcuuggggguggguggaauuguuuugcgagccucugcagucauuugucgaaccucguguuugggcuagccuugacucugacucauguaccacuuucggccucuauuucucucggguuggaaugaucagacuggcacacacgguuuucagaguuucugugguuaucacuggucucugacuuccaggcuguguuaucauacacaaguguucaggaauggcagauguuagucacuuacaguggacucaagauagugagaacaaguaacuuaacugugucuucacugaaggauaucaggaacacccuggaauguuggggcaaagcccaaagguuggcaauagaugggagcuggggguggagguguguggguguacucucuguuaaagaguagaaggaaccuaaaagcuguaguguguguguguguguguguagauauuucuagaagagauugaccaaaacccucuccuuauuuacuuauaucaugaaaauauaaaggggcuaaaaauugcaaacuaaagaauacaggaaggaauaucaacaaggcaccaaacaacauccaggaagagacacuugagagaauuuagcuagaagaugauaaaucagaaauuuaaauccauuuaacuccaccuaugggugaguugaguuuagacuaagcuguguuggagacuguaugcuaauuguggaagaguuaagaauguagauuuucuaggcucugguaccuaggacagaccaggcaugggaccccucuguguugccaacacuccgaucuaaugguggaggugauucaucugaacuuugccaugaaaggagagaaaggaagaagaaggggcuggccaugaagacggcugcucuccacacuccacaagucuguauggcuccccuuaauaauuggagagaagagaacuacagauuccauauugcuuuagcaucgagugguuagcuccaucgugauuuugaauggcuuucaguaaugaaggucagauucaacuccuugcuaaaguagaagcaagaaaaggacacacaggcucaaaauaaaccaaaaggccuucacugucucucaaggcucugcugcucuaggagaauccuaggagcucucucuguuaccauaaggagaugguccugcugaugggguccaaguuaaacuucuaaaagcauuucuuugcaaaaacuaggaaucugaguugcuagcccucugguacugauguggagguggggggugguguuggaagugucagaaagcaagccagagaccagaaauccugccuugcuccuuccaauugcugucuccacccuauggcuugcccuagccuugggaagauagaguaauggggugggagcucucugucuucagaaaagcuccaaacauugaacauggaagguaaacaucacuguauguucuuguuaccccaacaggggcagcaaaggcuuuuggucaggcucugaggcuaguucagaaauuacucagacacacauuugggggucauuugcagcuguagaugucaaugacgcaagcagaaagcaaauggaacuuguuugugcugcuaaaggaaacugcuggagcccuguugcagggaccaccgaugggcuaaucuuuccugaaagucacgaacucguguguguguguguguguguguguguguguguguguguguguguguguguguguauacacuaagaguagacagucuucaaaaugcugugcauuuuccccacagcaaauucaagaagagcugcugugagccauuauggguugggcugcauucauaauuucuuauuuuaauggcaaaaaguuguguaguuuaaaagcuguuuguacuagagcaugauaccaggccaacaauaucuguaaaacuuuacguuuagauaauagguaaaugaagggugacaagaaaucuugaagaguauuuugagguucaaagcaaaauugaacaagaaacacaaaggacuucccagacaacuauauucaugaucagcaucaaggucagagugacccacguguuacaguugguuugcccuggcacauucuucacacgggggucagcaauuuaugucagacuucacucaguguuaagccuucugggguauagacagguguguacugacauggguccgcauuccagugcucauaguuaacugucccccaauccuggugugccccugcucucuuacauacaaccuacccaugccuuuauaauccgauuaauucuauuacauuguuuuauguauaaagaaaagcacacuuacauacaauauacuaagguauguaugucuugagaggguaagacuugggacaguuucucuuacugcuaguuguauuucaauaaagcaaauuacauuugccaauguaaaaaucaaacccaagaaacgcauaccccccauaacuccuuuuauaaugaaaaaagguccaaggcuuuucccuuauuaauauuaucauuauuuuaauuuagagacaucuguaaaguguagugccacauacaaauugggcacaguuggaauuuucuuguagugagguuugacucaucagccuuauuuauuuauuuauuuauuuauuuauuuauuuauuuauuuauaacuuuaacaguguugccuucuuccuucggguugcaguguguguacagaggccagagugggaaccucucaggucuaaggccuccagaggaggggacagggagggaagccuuguggucuucagagcuugaggacagcuccuucugccccaggacaggagaacugcuuuguuggaaggaggccacuguuucuaaagugaauuugaggugugucuucuaaaucuuuuuuuuuuuucugucagcuugucccaccacauuccccauucugcagcucuaguuccugggccugaagugcuguguauaaguguauaaggcuccuggcauuccguuuugauuuuugaaguacaaagacuucuuuuuucugcccaaguguacucuuuuucagaacuaagguggucccagcuucaggcccacaggcccagagaacggaaugcugaguaagaacagauuggggacuuuggguggcugucccugggguuccucuaucugaacucccuuaccuguuauaccugcuucacugccccaggguauaggucacaggggcaaauaaaacaaacccacaacagagaagagaauacuuucccuucuccaaaguggaaaagccuguauggcuucauuuuauauugccugcaucauuuuagaaaaugauagagugcccuagcugaauggguugcuaaccauggccugccaguauuugugagugguuacuauuaucuuugcugacugugcuuagccucagugcauggaauaucccucuccugucugggacagacuucagggguaggcacgccugcguaaguaggguuuguguggcuauggcugugggcgugucucaggcaggauggcuuaaagcaagcacaagauuguccaguagaucuuugaaucaaagcaagauacuaaguauggaccaaguccaacaucauccucucuaccaucccuuaacauauaacaccgugucuaucaaggugcauagguacugacuaagucuaaugaucacuacacaauuccucagcauaccuccccuaaacacacaugcaugcauguaugcaugcacacacgccugcgagcggacacacacacauacacauugauuuaaaaagugauggguugacagcuacagggucccagccuucuuucuuuucauugggcugugagcacccuggccagagaauguguuucagagcguucacuuugugcaguuccaucuuccuuccuuccucccuccuucaccuggcccagugccuuguccagagagcuguauuuaagccccauuggaugagaggccucagaggugaaugcccugauggagauagugagaagucuaugcaccgccugcuugaacucacagucccuugauucucuucccaacccauucuuucuccuggcccuccugaccucagaucuuggagcaggugaucuuauuagagucaggucaccuuucuaauccccucucucugugugugugugaagguacauaggccucugcaugcaugaagaccagaagaggacucugaaugcauaucauucuuugccuuauucccuugagacaaggucccucacugaaucuggagcuaggcugguagccagcaaucccagcaaucccccugccuccacuacuauaacucucagguuauaggcauauauguagccacaucuggagaaggacaaaaaggucauaccacuugaguuaagcuggcauggaggucagccagcuacaugguagacaaacgaccacauggcuggaaggcaagcuuuagagaaagugaagaagcccaaaguaccagaggaggcaaguuuagaacagagauaggaagaagaaagggaaagucugugcuuuucugaguaaaucagaaaaguggggugacuuuagaagccauggggcuucagcccuguaagcugcugugcugggcaggggcuggaauucugagaagauauaguaaauccauuaucucuguaaagggaccguuauucuauguaguauaaguuaauguaagacugccuuccuagggccggccucauaggcugcccauugaccuguccaauugaaagguuaggucuccacacaggccagagauuucaaccucuugaccagaaaaaaaacaaguuucccuuaucgugcucuuauuauugaugacaucauuuauaaaccuuuaaagggagucacccaguaucuucacugagcuggaugaagcacaucauguuaugaagugggguuuagccgaguuucagcucagaugacucugaacucuguagcagaaguuccuccauuuccucugccaauggaccauaggaggcauuacuaaguacuucuccacugaauacucucaguauuuuaguacaguuuucaugugcucauuaguagauggucagucugugagugugucugcuuagcauuagaggcaggcggcagugagguggcaggcuguaauaaaaaguacacagagcauggaagcacuugagcuugacacccuucaucaacagcacaacccuggacauagugcuuaagucucauacgccacagauuucucaucgauccagagaugugucucucuuguaggagaagaucugauaggucagccacucgguuccucaggcaagccuaccacacuaccuaagcuacugugaagaacuguccacguaucuugacugugaggcucaaauagcucuuuccugggagaagcaaggugggaaaaaucccaucaguuagaaauaagaggaccuuaguucaaggccuuaugcuagaugaaugagauauuggauuguguauugcuaggcaacuucacaagagugcugugaucguggaguauggagcaggcuauggagucaacuaguaaagcuugguuaauuaauaggcaggguuccucagaaacaauuaaacuacaucuauauaacccccuugaguuucuugcuagaguaucugaaggguccagaaggucucccucuuugaggcccgcuuuguucuuuucuccuguuuuggaccaccagaccauaaagccucucuaucuggcuggcauuagugaugcacugaugcuggccugagcucuguaccagcaggaggaggcugucuuguccuguacauccccaagaccaaagcuguggguagguccgccuagagccauuuugcuggucugagccauggugucuggugggacugauugagcauauuucuuuagucuguggccccacucagugguuaccuuuguuaagauccaaggugagugguuaggcacucuuaguccuugcuuccgaggcgcuucuuuuucccagagggggaggucaugaugaagcgcuuguuaaugacuaugaauuuuucagggcuuccugucauuagggcuaaauuguuucauaacauaauaaucacuguaucauccaaaguagggggagccugaggagggcgaacacagcuaggagguuuuauuauugguuaucaagaggaugcucaugaaaacauucauuagugcugcuccagagaaagaaaacaggguggcaacagagcaggccagccugggcagcuucuccucgccuccagaugggccgggaugcuagagguuuaguagagccagccuagcuggacagaguugaccuugcagcuugggacauaauugcaguuuggaaaugggcacacuguguccaguucucacuuuugcauauuaugcuuugcauuauuuacuucuuucuguuacugugauuuuguucuugaagggagcuccggcaaauaccucacaauugucaccaccugucaauccaucaggccggaaguguaggcugacuagggaaccauacacugaccuuagcuuacuguauaaccagaaaucugguucagaucuuagccuuacagcuucccugcuccucucuagacucagcugguuguaaagaaaguucuuggauccccacacauacacaugaugcagaauuuccaucuuuaguuucuccagauaguuucuguguaugaaguaguuuaaaauaggcuagcccuaucguaaguggccaugccuuggguaggccugggucuuuucugucuuauuucuuccuugucccuggguccuccucaaguuugacauuugguagcugcaaaaaucuuugacuuuucuucucaccuuggacgcaaccucuaaggacauuguuggugucugaggacaagugugguacaggaagcaggauggugagugggaguggagccagcguccuguugaaaauggaaguguauauagaauuauaggugcugaggauggcuucaauauggagaugguuuugacacuuggaaguuuggcaguauagauucagaaugcuguaaagauuucuauaacauacagaacccccccuucucauccccaccacacacacacacacacacacacacacacacacacacacacuuacacacuacuaacaucaccaugaccaucacaugugucuagucuaauaugucagaaaugcacugcuaaacacccuacaacaugcaaagcaaucuuuccuaaccccugccccugcccccccccccacacaaucacauacacacugcuaccauuaccuccacaccagaacuagaagaauugucuaguccagcaugcugagagugcaaugagaaaugugcagggaagaugcucagggcacugguacacacucagcuuccuccuuguccuucccucccuccucuccuuucucucucucucucucucucucucucucucucucucucucucucucucucucucucucucugcacugccacuuaaguagcuuccuuuuucucucucuucugcugagaguuggguauauucuauccaaaucuuucucugauucgacacuuugucugccacucacauucaaacaugggugcuuccuucuacaaacuaacuuuaucuucauuguuuggaauugaaguuguguacuaagggcgugacuguauucaagccagaaggauuaaaggugugugcacaacuagaaacagcuuuuuucccccaguaaauaacacaaucucaggguucacagugcgauuagauauccugcaacaggagagaacagagagagcugggcuguuagguacuuaccacuauugcaacgcuugcuugccugauaugaucaacuuacaaagagaaaauguuuccuuuggcuucuauuguagagauuucuuugcauaaauugccacuuugcauaauugaucucuuugccuaauuaguuucugcugaugcuguuacuuugggcaagccagcauucccuaaugucgaggugcauggcagaacaggacugcucauuucauggcugaaaagugaaagggagaaaagaaagaucccaggguccccuuuaagagcauuucaucuaugacgugaagggccccugcuaggccccgcauucuggcuuuacagacuuuagauccaaacuaauagcacuacuucuauugcaggcaccuuacgauagccacugucucacacuguggaaauagaggauagcuucucucuagccgcaccguagugguuugguguuacuaguggagaguguggcugaucacugcagcgauggcccucagggaaucacacuauccuccgugcacacucgucugcaguggauuuugccauuuuuuuucucccagggauuagaguugugucgugccauccuguggcccuaggcuagcucaucauuugcuguggcuagagaguccgugaacacaggaugcuguguaacagugauguaugcuucugaggucauucaucuuucaugcuguccuugauggaagauuucuaccauucugucggggagcaccaccuagcuuccuugaaugagggcccagguguccagcuugcuagcucaaccccuagccaagcauacaguucaggugugacuguaccagggcaccucaauaaagucaguuccucacacaaucacagagugacagggaauaauaaauuaugguuaauuuaaaccagugaacauugguuguguuugcauguguaugcgugugcacaggccagaggucaacccuagugucuucuuuaagggauguucaccuugucuuugggguucuucaauuaggucugacuggccagugagcccugggagucaaccugucucugauuccccagcacuggcuuuacagauaugugcccaccacaggugugcuuuuguguguguacuggcgaucaaacucgggucuccaugcuugcgcagccugccauuuaccaacagagccuucucuucagccccacugcaguggucagauggacagagauagacaaguggacguuaugagugaccgaaugucuguuugucuugcgguacguguguggggugacagagaaccugaccucuucccccucugcuucuugcagcacuucucggagcuccuagacgaguuuucccagaacguccugggucagcuccugagugacccuuuccucucagagaagagcgagucaauggagguggagccaucuccaacaucaccagcgccucucauccaggcugaacacagcuacucucugagcgaggagccccggacucagucaccauuuacccaugcggcuaccagcgacagcuucaaugacgguaaaaaagcugagagcaaggaaacucugggggccucgaaccuuuugacucuagcuccgugaggagaugugauugcuggcuuuguuauuguuagcauccacauuagacacacacacacacacacacagacaccccugcugccuggugcuaagguaaaugcgaagagguacagcuugaacucuccugcgcuaggcuacaucuccgggaacuugcugucaccgaaucauaaugcucucuuuaacccugggucuugggcagcagcgcagccauuugcaguccugcuggccuccuggcucaugauacccugcagugugugaagccaguuauuuuuaaagagucaaucauuuuucugacaaaggauuuuuaugaucaucuuuaugaucauaugagaaacuuuuccagcauuuucuacugacccagcacucuuggugaacauuaccugacucccuuauugcuuucccuuugugccuuuucucaucaacugaugcuugucauuguugaaggacuggcuuuucuaacuaagaugcugagguguuuugaccauuacucuauaagccuuucucugccaucuuuucuaucugcccaguucuccauguaugugugcauucauaugcauacauguguauguacacacacaauugaacuaugucuucuuuucuuagagggguacccggcuauuuuacauacuuugaguagucugugaagaccuuguucccuauucucauuccagcauaugacuuuucucacauggccaugacacaguggucaaagauugacccuuagguuuugcucugagccccuucgccaugucuuucccaucauguguguaacggcagugucuuuuacaaguuucucccacguaacacggucccucaugcuucucugugguuaaaggccaaugccuguauccagauacacaaggaagggacuguuccuccagcggaaugcauuaccagccucuacaaaaaucaaacuucucuuaggacucagaaagucgugggugugagaaucccaacuguucuccaggauacauuuuuuuaacuugaagaaccacacuaaucaacaugagggaagugugcucucacaugcucaguacuaagggugcuguggaucuaguggauucucuccugccuggggagccuuagucagauacucugacuuuccuuuuucuguggagaguuuaggggaaugcggaguuagcccuuuccuguagccuaucaguuguucccaccuuaguuccacaggacgagguguuucaucuucugggaaagaaaggaaaagagagcugagcuaauuugaggacauaaugguguuugggaguuaaaaugagguguuuaaaaaucucagagcaauggcuaccgcaucucagccaaucauguucuacucccaaucccugcccccuaccucaaccaaucacguucuacucccaaucccgccccucccgcaacuuguucaguucauuucagagaugcccugagaucagcuguagagcaugaugcugaugugacugguacccucuucuccccuuagccuaauuacaacuuggguauuauuauaacaacagacaucagaaaaguuauuugaaacuuaugaguuacuuauuucucuaguuuuccauguaagauuguccgucugugguugaccacacgugacugaagccguggaaagcgacagauaacgguggagcugcuguguccccauuccucuugugcaggccagccugaggaagugggaugucgaggguucagguuacauucacacaagcccugaguugguuuuauuguuuugcaaauggacuuuagccuuugaugagugucuggacaaaugacuuaagaucuauuuuaccugacuuaaguguagauucccuccaguucuugucuuuccuuagccuguauuugucucgugguuccuuugaccccucuaucacuaucccuucuuccuucauggaaucaccuucagugucuuuugucuuagccaguuauguuguguaagaaauacuccucccgacacuaaugacuuaaaauagccacuuguucccuuaugaguucugugccuuaguccuccaaagcgguucacuaguguaguuuugguucauaauuuacuaugggauuggauucaguugcuggcugggacauugccaguguuagaugcucuacccuaaaagcagcuaucuccaguagccaacaagucagugcuggugaauuggccugugggucucuccaugggguugacacacccagggaggagacccagcugcucucugaggaggaaagcacugauucacagugggaggggauugcgcaggaaggcagcucagaggaggugcuggcacuggaggccucuuggacacugacaaccacacugugaguucuuugugucgguuccuuuaccugggguucuuguuugccacacuuucucuucauucacccaguggcucucaagcuuacauucaaggcacugaagaaauaaaaagaaaaaaaaauguugguccauuccucucccaggauuuaucaggaucacaauguucgugacuggugauggaauuguuguaaugugccagcccuaguggaagugacgugcucugcauucaugcacuuccuacacaucgcaauccccacugaguggcucugggagggcuauuuaaccuuucuaucccagcuucguuguguguaaagcuauggugagagugaggucuccugguguccuuugaggauuaagugugaugauagauuccauugccuuccagguucuggcucuucuuagcucucuagcggucaugauuuacaacuaagaucugcaagacgacagggucugaggaagacuuuguagaagauuuaaaacaacuuauuuuaacguuaauuuauuuguguagagggacaugaguguacaugcauguguggaggucagaggagaguuugcagaaguugguucucucuuuccaccaugucaauuccagggauggagcucaggucaucaggcuaagcugaaagugccagcacccagugagccaucuuccugguccugugaaaggagagcucucuauuuaccagccuguguuuaacagugaaauuuaguggcuacuuagcagucuaacuuauuaguggguuauuuuauuuuugcuaguuuguuuuuuguacaauagcuagauccagagaaugugccccagauuauaauuguuuaggagacaggaauuaucuguaaacauaaugcuuuuuacuugcauggagaucauuaguugccccucuuugcucaauuauccauguagcuguugggucucuuuuauauuuugagcugagcgagggcaaguuccaagucccauccuguaucuggcaguuagcauugugcuugguacuuugaagauagccaguuguuuaaaaagacgacacaagagauggagcauccaucucugaccggcggggcagaaccauggagaccauugcucuguuuggugcguggccucucugugcagacugcagaagcaggauuucaccaggguuggcuccuagcucacaguggcugucauuugcaggauccaaggugaugccaaagagcaguagguguguuguuaguucuuuaugcuucauuuuuuaaauuaauuucauaucucauuuucagugccuuaccuuuuaauugccagucugugagauauggaaaauagaaaagacaaggaacuugugggaagggagagaagcugaaauuugaaugggaauagauaggugacgugaacagagaccagcggaagagggaaggagcagacguacgucgcacacucacaguuugcuaugcagaacagacaaguuggagaugaaauucagcaggcugccuuugcuucacuucagcauguugguugcacaccuaccgugugcuagacucuggcuuagauacuuaugaaccaaguaguaagauguagacccugucuugaggaacucagagucugguggagacauaguguaccuaauacucgaucaggcagaacuggaguaguauuccaagaggaaauuaaacuguaggaguuuccaggagagacagagagagcgaacacagccauugaggggucaggaaggccugaaugaaacaggauuucagcugggccuuggcucacugccuggagucagcccccuggagcuuugucaagggccacagauggagagcagagagccaggacugggguggggggcuuugaaaacaagauccccgguggaaagauuguucacaggacagauuuccaaaggguccggguuccuuccgcuuccauucaugaguugucuuccugugucuacggcuggguuuauuguugucucgacuucguccuccgaugcugaaauuuauuccucccuguggucuuuucuugggccgacacuuauuguuguaguuuuaauugacugauugauucuuucaauuacagaacuucugcuugguucauuuccagcgugucaauucccuugaugacuuucuuuccucugucuuuggacuuccucucccagcugacuauuucgcuuacuuuggagacugucuugugggggacuagacuucuuuagugcaucuauguauuuaagucaucugucuagucauuaauucuuguaaaaaagaaggacugugaauucaccauggacauuucaacugucuugguaguuugggguuucauuaugggguguugguaguuugggaaugagucauggagaagccagcccuuuggaggacucccagacagcaaaagaaccaaauaaaauuagaguggguggguggggaguuaaaaguaggaggcacauuccgcccuacagacuuucaaggcaccacaaagagacacagagauuacgagacaacaacccuccuucugugaaaccacugggcucccauuuguggucucuuuaacuuacaugcaaccuacagggaucauaagugcgcacaagcuaacccucagcaugggaagaacgggcagcagauccuguggaggagggcuucccuauccaaagaccaaagaauacgcuguuggguucccacaaauggcaccuaguucuauuuguagcucaugucgugacaggcuaugccccuaauuuucugaaaagaagcagaugggguucugauggauauugcaaagagcauucgguccacaguccaucuucuuggaaguuguggugguuuucuuucauguauguaacuaggagaugaugacugugggauaggaacuguuugagauguuugacaucgaagcgugggagaauggaggcaaggguagcuuauccugcgcagccucaccugggucuuagcuucaauuagguuucugagcuuugagaaugagcaagugugugguagcaguauuauuuuauucacucgaaccaugacuaauauauauauauauucuuccaaaggaagagccagucccuccagguccaagcauucagagcagauagccacccugauaaaguacgacuccucuugagguaacaugcaggcauguagugcuuaagaauagcuauuugcaccaaauccaauauuccuuaccucuuaauaagcaauagcugaaguaguacuaggagcccgcaccucuacugguggacagugagcuuuucacuauucuugggaaagcagguaauucaucucuccauguccaguaauacuuagaguaaacaguucuguaauuucuucuaagcuugaaagcagcacucacacacacagcuaaguagagacuugguuuagaagacagucuccuuuuuguuuaucucccucucuucuacaugucauaagccuucuaucuacccgcuccuccuuucucuuccuuucuccucccauaauccuucucucugcccucccuguuccccuucacuuccccuuacaccccccccccugcuacacccccccccccccgagucucagggcaaucauacaaagcaaauggguguuuguaucuugucaaguggacucuggauucccaaaccugugcacaaaauuuggggacuaucuacaguuguuaaccuuucugguaagagguguuauaacuuucuuuaguuaauuuguuuguuuauguauuuauuuugugcacgcccauguccguguguguguguguguguguguguguguguguguguguguguguuuguccauguaaggguaugcacauguacauguuccacaaaugcugagguggaaguugguuuucuccuuacacuauguggguuuuagggcucaaacccaggucuguugagcuuagcuacaaguguccuuacccagugaaccguacugugggcuuugauaaauuuucugguuucacaaaaaguucuguaccuaaagaugaaaaguuaagaagcccuggucuaauucaucacagggcucauccacuugaacgcugacuaacuggaaaugucucagaaacgcuggagccacagagcuucaugggcucaggccauagcaguggccaaggccaggaacguggcugccuuuccuggccacuggagucagucuccaccccauucggucaccucuucucaagguacaggcuggugacaagaggccgagggugcugcuuguucaaccaacaaaguaaaaugggggaaaaaggagagaaaugaagaggcugaaagaaauaucucagcaaaauguuccuggcuaugcuuauggcccgaggaauaaaggcuuauguuagaaagagcaaaccuugaaggucacuccaggaaagucagcaccauggcugccuauugggggcucaugcuccauugaaaucaaauugggauguuggguauauuacucaauuuuccguuaugaugguagauucuugguguaaucaacuccuaaggagagaacuuuugucugacagcuuuggaggcuccuccagggugucgucgguggccauggugaagcgacccuucacagcggaaguucaugguagagcaaagccgcucaccuugggcucagaaagacaaaagagaaaggagaugagacugagucccauaaucuuugaaggacauguacucacugacuccaaaggucccacuaggcugcaccuaguuuuaccgccuuccaguggguacagcagcauaggcacacuggaagaugcaugggauccacacuguggcugggcuccuuuuaagcuuuuuccacuuaugaaaccuuuuuacucaagaaaauacugugugacccuuggguauauagguauauaaaauaaguguacaaagcaaauauuuacuauaauaaaucguaaauggauuuagaacaguucuuuaguauauauguaauuuuaguauuuguugaagacaaacgcaaacauagagguaaacagauggugcgcuuauuuuuacauaaagcauucaucuuggacaaauaguggauacugcaggguauaguguguuuucagaguggauuaauaguuugguuuuagaaucaucagagcuaagaauguccuaaucccaagucaaaaucaucuaacauuuuuuaaaaaugaaacuuaagucagaaacucuaauggcaauuuuuaaaaucaagcauucuaacacaguagacuccaaagacauacuaauuugauacaugaugaagaaugauauccaaaaugauauuauuuuagaaugauacuaaaaaccuuggauuucuguaauuagacuauuccauuucuaguagagcaggacauguauggacacuguaaacacugcagccugugacacacagugguccugaggguuugggcuuucauggcugguggcgcaugguguagcgguccguaagugcagugacuucagagccaaagccacaguaaaguugcucagugcaacccugcaugaacucugccagaagccccucugauacagcgcagguuugauuuugaauuacuuucuguccguuguguguccagaagcccuuuccugugaccugacuccaugauucccacacucaguugugugacuuacagccgaagagucugccaaagcauaccccaagguggacguuuacuuugucuuuuauuucaguguuucuccaaagaagaaacgugaucgugacgagccuggagcauuaagagagaacuugauaucucuauccucugagguuguguaaaaauaggguuggaaagucuauaaaauaucagccagcuaaacagaagugguguauaaugcauuugugccaagauaauuuauuuaggcuggauuaagagacuaacugaguggcucugaagagaaggcucaguggugaagggugccuacugcucuagaagagguucagagucugguuccuagcauuuguaucaggugucucgcaaccacuuguaaauuccagcuccgugggaucaggcacccucuucuggccucaauggguacugcauucaugucuacauaccuacuccccuaauacauacauagacaaacaauuuuaaaaguaguaacaaaaauaaauuuaaaaaucugucuguagccgggcguggugacccacgccuuuaaucccagcacuugggagacagaggcaggcggauuucugaguucgaggccagcuuggucuacaaagugaguucuaggacagccagggcuacacagagaaacccugucucgaaaaaacaaacaaacaaaaaaaucugucuguauaaaauuaaacaaauagucugucuuuacuguugcuguuccaggucuauagaccauuggggcuucuucagauuacaggagcuggagauaacugggugggcucaguacugacuuaugaagcugcuuucccaguuacaaaugaaggcaaguccucagggaguaagcuguggccguugagaagucacacggggugcaugagacaaguugugggaggaaaaggacugugggaugggauggcugggaagcgggguuggagccaugagggaggcaucgguuggugagucaaaggagacacucguggcuggacgcugaggcuuagagggcacagacagagcuggccacggagagccaggaagcugagcuacguagauggcacagaaagggugguuucugaaacgaguagagagauaggcagcaggauucacacaggguugugugugugugugguggugggggguaagggugacucauaggugacuuagguuucugcucuguagccuuuagagggauauugguguugacguguucucaggaagugaaauccagaaaagaaaaaggcaccgagaugagguaaaaagguaaucacauuuccugugagcuggugucaagagcaucagcgugcgucaucgcagaggggguaaaaagggugccgcucuccucaucugcuuccaugcugggcucuccguggcuggguguugggguaggacaggcaggggaacacgggugaaaaugauaacauugcuucccuuaaaacagucaaauagggaccccauugcaaucaagaauagucuaaaacagcaaaguugacagccaucuaucgagcaaagccacuuagauuauucagcucucugucccugaugaagaaacacaaacugcaugcgacaguuucauguacaucuguguaccgaaucagucuuuccaaaucaguguuguuccauggauauguaugugguucaugcucuacauaccauacucugcaggagaaauugugaguuuaaaaagcaaucuugaccccggaucaaguccaucauggcucucuaaagucauguuaugagucugggcucuguccaauuuaugaaugacuugacccugggugagcuguauccgucuuuggucugaccuuccagaucuuuaaaaugaaaauauaauacuuacccacugcguggcuggagggauucucugaguucacauuuaucgagcacuuagagcagugccugccacuucacaagugccgaggaaguaucagcuauuauuguccuuguucuucuguggacugcuccauaauuaaguacauaauuuaccaagugcccgugauagggaugacaggagccaaggagagagcuucuauauauccaggcauggaaagaacacagagagacagagauuguguuggucucagagguccauccaguacaggcugggugucugccaaagacuaaggacuauggguuggucuuaaacaauguuucuucauaucagaaacaccuguuuggcggucuauaguauaggagugaucuaauuuuacuuuuuucuaugcguacauaugggcucaaaaaauaacauuuauuaaaauguauacaucuaggccagaccuguuuugaaccauugcuuccuuggaaagcaaugugugcaggugacagugaaccugggauaugggacucauuucuauggugugaagaaucuuuuucuaugaaucccagcuguacacuuuugggugagucuuuuuaaucuuguaguuguuuguuuuucaaaugggaguaaugguuguauuaaccucugugguuaugcuuaggacuaaguuaucauuuccaaaguacuuagaacaguacccagcccauagcaaacacugauggugcugcugaguuuacuauucauaucagggcaccaugggcagacaggucgccggcucccacgcagugggcccuauuuucacuauuaugaccauguuccacagaauucuugucccacagccuccugccuuccagaacucagucuuggaacuguuaaaggauauuauuguuccuuuuuuauuagucuagguguugugccuccaggcacauaccacuuggguaucugguaccuguggaggcccggauccuccuggaacuggaguuacagaugguugugggcugucauguggguaccgaacuguggucuucugggagaauaguguucuuaaccaccaagccaucucucuaggcaagaagauuuuuauguggaaaaaguaagaucugucaauucuuuaauacguguucaaagagcaaacaaaaugaagguuuagaggaggcauaagaaacuaagaugcuuucuucaauguauacaugcuauuuggaugauaauguggauacuuugaaugauauauuggguaauauaucacauacuauuauauacagguaggauacagguaggacuuuuugucacauagaugauauuuguaaccaagugauuucucuuaacaaugaaugcuuacuccugugcuguguguauguguguaguguacaugugaucccgcacaugcgugugcauguguuuauaaaauacaagacugcguccagguuugaucuuuucccacugugguugccuggcugugcguauggaaaucaucgaggcuguauuacggaugcuuuaagcagauccgugccuuugugcuccaaggccaccugauauuucagucuauucagcgucugcaguguuaaccgugguuccauucugagcucagguaugcaggacuugcucccugucgucacgagacgguggcuucuucucaucuuugcugauagccaaaggguguugcugagaagaugcagcuuuggaauuugaccuuugagggggagcugugcaaauacauucugaugcuacagggggugcguuaucucccagcacgcacacgauuaaaauuaggcaagggcgucuuucauuuggaauaaaacuuaaaagggacauagauacaauccagaagaacacuuuuucauuuaaaguccaaauugcagaauuuauaaaaguuagaaauuauaguaucucaagcacuuaguucuccugucucuguuuagcuaaguacacaaauagcugaggauacuuguaguucuaagccucaauggcucuguagaugaguuuugccaauaaaacucaucugcaaaacuaaagcccugggcaaguugcagaggccacuccuucccucauucuacccuuuguugaccuccgaccuuccagguuacauuugccauuuuguuuacucugauuugauauucuuucccuuggugacagaauauaggccaacagccaagaguugggguucaagcugucuucucuuauuucaaccacacgggaaugcuggucucaucaaacuucuuauuaacugcccuucuuuaaucugaaaccagguuuuuccaugauguaucuggcgggucugauugaccagucuacaaauauuuaugcauuuucauucaucauucaugugcgagacagaggacaacuuuggggaguugguucucuccuuccacaguuacauagguucuaggaaucggacuucggccaucaagcuugcaaggccaguguucucaccugcccauacaucucaccagaccccacucauagauucugauaucuuaauaccagccauauugcauuagcuagcugugcuguauaagaagccaucucaaaccucuauucuuuuauguuguguguauuugugggggcaaugucuauuccaggguggugucagauuuaguauauagucaaggaugacuuccaaaaucagauccucuugccucaaccuccugaguuugaacacuaggauuaccgguauuugugugguacuagggaaucaaagcuggagauuugcauaugcuaaguaaacagucuaccaacuacauuauaugcccagcuccacaugucaggacuugaaguagcaaucacuuccuuacuagagcucacacaucuccacagcugggaacuggcugguugaaauggggaucggauaagugacuacuccuuccagcgacauucacucaucucccuaaggcuagcagaguuggauggcuuggcuuggcuuggcuuggcucagccuaucuugccgugccuuugauuuguguggcugcgcuccuuccucugggaucaagagaccgacuagccuagcacauccuucuuaugugacaauaaaacugugagaacauaaagcccaucuuagcuaacacauuucaagaugcuauuauguugagacgcuaacaugcacugccuagguuaaguuacauggccaaacuggaggcgcugagcgcucauauagcaaaaggcacaguuagggggugugauggcuuauauccauguaguuugaauagacuaagacucaccuaggaaaggggccucuggaugugcuugugaggaauucugaguaggcuaauucaggcaaaauacuccacuaaauaugggcagcaccauccaccacuggguugggggccuggacuaccuaaaaaggagaaagccagccgagugcuagcccggcucucccugcuucacgaguauggggggaggagcagagccauggaccuuucacuuggaagacuucuguagucuucgagagagucggcuuccuuuccaguuaccacggcuugcucucuauucgcugcucccagacagccaugauugguguuuagaccaggggcugagcaugaagagcaaacaccgcucaucccuguuuccuaccugcuccugucuguugagaaugguuuuguucaaccagaagaaccugucucaucuuccuguugggcuucaaguucaaguguacuccccgcacugauuuuaccuguugaguguauugugaguuaaacuggaucgaagucgcuuugacuguaauagcaggaccugugaccuuaccucacaauuuacuggucauugcacagggccguuuucccagagguguuccuuccucuucauuuuauuauacccagggguaaaugucuucuuccuagcucccuucuagccucugccgcugacaagcaguccuccaucuggacugcgagugucaucucugcaaacagaagcuuuggugaagagagggaugcacacccucucugucccaucuccaucccgucccaagcgaucuacacccucacucugccucucccucccuccuccauucuguccuagcauguccucccuguggcguccuugcuguggauagucuucuaguucugagccuccuugugaggcucacuggucuuuuggccugggguucaguuguuucuauaagcugaggggggcgcccaucuggccagcagaaguaugugucaaguacagaguggugucccuuccucuggcagccauuaaaaggucccuuuguuccccaccaccagccccuccugguccaggaugucgcccacacccggugauguaaauccccccaucgaagcagacacucagcagcuuagggagcucgcucuaacugccaccucgccagugggaaccuggccuuuucugggcucaaaggaagaaguuuauggggauggaguuuaucucugugaacuuuugcuuugccgcccuccccaugcuuucccuccucaguucuucuguaugaugguuuucaaguaccuuuuuaaaaaaauaaggaaauuggagucacauuugugaguauguguucacagugggaacugcuuugcaccccugaacaguuaagggucaccaagcaggcagggcucguuuucaaauagcagagaacacaugugccuuguguaugucccgucuucggaaagaugguguccagugaggaccaggcggcugccucuuccuuucugucugcauguuuccagccucuuggcucucccuucucacccgacccuuuguuccugcagggcugggcugaguaauuugcucucaagcaguuuggugagguuuaggcuccaggcaguuugcguccagugacggaggagccccgccguuggcucagucuugcugcuuagcaguugucauaucucccccagcccaggcucuauucaucacuagggccggggaagcagaagggcaaaaacuagggauuaggaacgagagagagagagagagagagagagagagagagagagagagagagagagagagagagagagagagagagagagagagagagaagaggggagaaaacaaauggcuguggagaaaucuucuguuaaccucuuuuucuuucuuuucuuauuuuuaacuauacuuauuuauuauuaaauaguuagcacauuuacuugauuuaaaaaacaaaaauauagcauauuaacauuuuuugggaguguuguuguuguuauuuuguucuuucaaaacaggguuucucuguguagcucuggcugucauggaacucacucugauccaccugccucugccucccgagugcugagauuaaagacgugcaccacuacugccggcucauguuuaaaaccuuuuaaaacaaauuucagaaccuuccaucccaucuuauucuccaccuacuuagcuuccaucuuggugugcccuggaagccugggguacuagcuaguuuccuuuacugugauaaaacaccacgaccacaaccaagagaagaaaaggucuaacgggacuuacgcuuccagagggucagggucgauccuggcuuagaaucauggcagccgagacagcugagagcuaaagaucaagucuuaagcuguaggcaggaagauaaggggugcucagggaauggugugugcuuuugaaaucucaaugucaugucuuucccuggccaccaggggcagacuucuuccagcaaggccacagcuccuuagccccaagcaguuccaccaaccggaaggaaaucaaguauucaaacguccaagccuauggaugacauucucauucaaaccaccagaccauguuucugucuuuccauguaaccuuuccggcacuuccuucagcuuaucacguccgaguguacuuaaauagaagcuuuugguuugugccauucaauuccucauccauacaucucuauucuggcaugcacacuucccuuuauucucuucucuguagucuuggagcuuugguccagcaguggucaguggucacaugacucgcuuauaccuggugccccaaugugcucacauguggcuuguccuuuucccacagaggagguggagagugaaaaaugguaccugucuacagaguuuccuucagcuaccaucaagacagagccaaucacagaggagcagcccccgggacuugucccuucugucacucugaccaucacagccauuuccacuccuuuugaaaaagaagaguccccucuggauaugaaugcugggguauauccaguuuucuuccuuauaaauauaaguaucaaaagguagagaucuuuggucuccaauaaggcauuuauccuaggagauacacgauuuugagggagaauagcuguauauguaugcaugcauucauguguguguauauacacgaguguaucaaggauauauuaauuguuaucagcaucgauugugacaaauuucaaaggaauuguguagaaaaagcaguagcaaagcugauuucuuuuuuuuuuccuauaauugccuuaaugaaauuaaaaacacggaugaauagccacagucaaaggagaaacguuguucauggccuugacuuuuacucuggaggggaggaaugauggagguuaugguagaggccacaguauuuggugccauugcgacuaugcaugcugguuccacaucgacguuuccuuuccuagucuccgcugaguccuccucucucaccugcccauccacaugugcugugcuacuggaggagauggcaggaaggaaggagucuccuccuugcuuaacuuaagcccauggcuguggaaggcagaguuuaacaucaccccaccucucccuggguguguucggugucugaugguugauagcccagaaucaugcuugcauagcuucuaguucagagccucacuuguguggcuccagacauauccguguagucacaucucucaucagcaagacgcagagucugucugguccugaaaagguaacauugggagaggcacagacacguugcagucuccucauuggggagauguggguugcaguugaccuucagauuccuuucucaaaaccucccuggguccugggagggcuuucaaggucuguauuaguuuucuugcuccacaagauucugacucacuugauuuacaugugugugcgugcgcacauacauacaugugugugugcaugugugugugugcguguguguguaaguaugugugcguguguacauguaccucauguguacaugaaaucucugagaucagaagagcguauuggauccccuggaacuggauaugugggugcugggaacugaacccaugucugaaaguaagagcagcaagugcucucuacugcuuggccaccucuucagaccucaguuggguuugaagucugcauguaaauaacacuucaggauccuguucccuugcucgcuucucuccuuucccugauggguauuuuauagugagauauugcuaucagccauuggggagucuggagggaaagcaugcauuuggaggcacauggucuuauugcaggacgaacugggauccgcugaguccuugaacauuucccagaauauuuuaccauaaaugucuuuaucacaacaccaacaguaauaauaaugacccuuagauuugaacuagagguggcaggucccagguuuggcugugacacgaugcagcacaugaccuuagagaguaagauacaguugacaacucgccgcuguuucguaaaggcuguuucuaaguuaaaagacucauguuugaaauuccuuuuccagggggacuccucaugccagacgcuuauuccuaagauuaagcuggagccgcacgaaguggaucaguucuuaaacuucuccccgaaagaaggugagcucaucuucugccucucccacacguuucgugcuaagggaaacggagcagcagaguagagugggggauuauagacguagcuggcagucuggaaucauucuguucuuaagacgauccauuccaaaacgauauugugaaauauaaaguuaccuaauacaauuauuucucuauauguccuuuauuuccagcuaagcguuagcgugguuugaugcuuaccaagaguggguuuuugacccaugcuugacaccgcuguggcgugugucugugcgguuggugacacucacuugucccuauggccuccuggugugaaccccacagauacacaguggcacucacugccuuaauaaaaacuugaguuuuaacccucugucaaugaaguugucaugugucuacacagccaggguguguucuuagcugcucuagcugagugacaguugucaugagcucccuuccuugguaacgucgugguccuggcggugcugggccucucugggcuucuugucauucauuuagaaccugaccgugccauuccuggaguuguuuacucuuuguucauucucuacaucuuuuuaauuuuuacucuuuugacugcccgcucuguguucucccaugagaccaagcugggauccuggacacagucucuccaccucaggagggcacaggaagcucucaguaucuuauuuacacagaacguggaguccacucuucuucauccugugucuguuggugcuacaccucccuuuuaguuacauguucagcacaugucuagccgugcaguucacugcaugaccaacaaagucagcgcacacaacuagagagaacgacgcaugugcuagugugcaaaggagcggauacugugugagcauuggaguaugauuuaccuucguuccuuuaggaccugauuuagggcuggauuugagaccacuggcacagggcuggccauuuacuaucuguaaagagcuuaaacggcaauauuaucugucugcaucuguguugagccuuuguuucuugucguugagcagcccacguccaugccuuugagucuuauagucugcuuccaagugauuucuuucaucuuuacggcugcuuaccaccaacaaaugugucuuguucuuuuugguauguuuccaugcgguucagaaagugucacaacccgaacaauagguccccacagugacgucaggaucuagggucaccggaggagaaaugacaauccuuccucauuauccuggauaaagacagauaaagaaacugaauagccuguggacaucaaaguuucugggcagaguagcuugcagucucccugcgccuucugcagccuaggagcagcauuucaaaugauguuuagaaaucugagccugcggcaccuguggccagaagggccugcuuuuccuguuugcuucucucuugugggcuacccgcugcuuagaaaggagaaaagcauagcuuagccuguggcaggccuggaggccgaaaaaaauuugguguccuugggaguuuagcuggacuccccaccccccaauagggaaaucugauuccuggauuuuuuuuuuccuuuugcuuuugcuuuugcuggguuuuuaugauuuuaacacacagugucauauacucaugacauaggggaaaccuuggcuaguaugcaagacaugccaacuuucuagccaagcacaugauauauuaaagggccuaucccugagccuaccccugaccuacucagguuuguaaagcaugcaacuguccuguggauacagaaaugcugcaugaagcugggaugagggacccucaaauguaaugucccucagcaacaggcaacaggggcuagcagaacagaacuaacucucucucucucucucucucucucucucucucucucucucucucucucacuagauauuuucuuuauuuacauuucaaaugcuauccccuuuccuaguuuccucucugaaaauccccuacucccucccuccucccccugcuccccaacccacccacucccauuccuggcccuggcacuccccuauacugggacauagaaccuucacaagaucaagggccucuccucccauugauggccaaccagaccauccucugcuacauauguagcuagagacaugagucccuccauguguuuucuuuguuuggugauuuagucccagggagcucuggggauacugguuaguucauauuguuguuccuccuagagggggcuguaaaucccuucagcgccuuggguccuuucucuagcuccuucacugugcucuguccaauggaugauugugagcauccaccucuguauuugucagggacuggcagagccucucaggagacagcuauaucagacucuugucagcaaaaucauguuggcuucugcaauaguuucugggucuagugguuguuuaugggauggauccccagguggggcagucucuggaugguccuuccuucagucucugcuccacacuuuguuucagaacagaacaaucuuguucagaaaaaagaaagagggaacccacagggucuuugugcaggugcaccccagguaaugaucucccuuuagaagcucauuccaacugggggugcuagcucgaugcuuauugggugcucucagccucaggaaugcgcccuguagauagacuuuaggagagaaggcaucuuguaccccuuucuuuucccugugacuacuuaucagaguuucugaaugaagaaugccuggccuccugccuacaggcccaacuggcagcauuccuccagaaacaaaaggggcuuuucuccaagaauuccacgagagcuuucagguuggcaguuuccuaaaagaacaaacaaacugcacacuacuaacacgauuugcacaucaaaccuggguaaacucucugagaaaaacaagagugggacauugaguguagcucaguugauagagugcuugcauggugugcaagaagcccuucaucccacccccaguaccauaguaaaccccggcacgguggaacggcucaaucucagcauggcagaggugggggcaagaggaccagaaguucagggcuauccucagcuaaccagaacucaaggccagacugggaugcaugagaaccugucucaaaauaugucacaaagauaaaaugauaaagaaacucaggaaaagaucuugucagcaccgugucgggagucccuagcaucccaggccacccuuggggucauccuuuuguuggugucucaugcacauaucugcccaggguaguuuugugcugggacuaggaaguaugagugugacuaugcucucucucucugucucucucucucucucugucucucucucucugucucucucucugucucucucucugucugucugucugucugucugucucugugugucugucugucucugucugucugucucucucucucucucucugugucugucucucugucugucugucugucugucugucugucucugucucucucucucugugucucucucuuugccucucucucugucucucugucucucucucucugucucucucucugucucucucucugucucucucucucacuuuucauacaacaagaggacuucuggauauacuguucuucuaccuaacccaaagcucccaguguggagacacauguugcguguugaacugucccccugagucgagagcuacucuucugugguggcugaauugagcucucuuuguccgcagccuccguggaucaacugcacuuaccaccaacaccacccaguagucacagcagugacucugagggcagcuugagccccaacccacgccugcaucccuucagccugucucaggcccacagcccugccagagccaugccccggggccccucugccuuguccacaucuccucuccucacagcuccacauguaaguaucugagaagaccagggauccucucagucuaacuuuucauccuuguaaugaaaauuuuguuuaaugguuagaagucucuguucgugcuauguggcuguaacaaaauaccuaagacugaguaaguuaggaaggaaagauguuugucuuggugcauggucuuggagguggugaaguucaagagcauggugccugcaucgacucagccucuggagaggaugcuccaugcauagcaggaaaacagaagaagcagggagugggaaggacacaugcaaaggaggcagggagguuggguagcaacacauccccaugguaacuaauccugguccugugagacccaaugcacuccugccaaagggcacugauguguauucuucacgcccacacuucucuaagguaccacacuggagaccaagccuccagguggggacagacuggauucaagccauaggacgaaagcaguguagcaagaacccugaagaguguguuuauaaagaccugccuacaaaucucaggaauucucuuuucaaaugcagguccaauucuuauccacguguuuauuuuccagggcugcaagccucaggcauaacauuucuguucuuuucccuucaaaguuauagcauaaacauuugccguuaauguagaagauccuuacuuaaugggagcuaggaaaugccuuucaucuuuuagauaugcauucuugggugaaauuugaaaagaaaagucucucugagauuaacuucuuugaugucaaaagcuuaaaaacaguuuaauuuuuguguguguuucgaggcuuaggggaucuuaacccaggguacuacgacaaaaucccaggucaucguucaucccacacacaggugaaaaggagggguagagacuucauauuuuauuguucuaaagagggaauccagugucuaugaagucuucagaguuacaggcagauuuuuuuaaacgaagaacaaauuuuaaacacaguauuuuauuuuuugacaauuucaugcaugcaauguaugugacuaacacauauaaaugaaguguuuuaagacuaggaaccauguaucaugacacuuuggauaauuuugagaagacucacuuguccgcauauguuuuagaucuuaacaugucgccacuaccgagaacaaaggccuucacuggccaugccugucuucucuguuugagccuggauuucacugcuuagauucauguugugugucugcaucuccaccccauauuccugcucguguuccugugcugcugucuaaggccccuggagcccccauuccucugcuuguauuaagcagcuuccccuuugcugucucagccuccugagcucaccugcucugggcagggcgucuccaguuacucuucugaguacagcacugcccucuguuuggauuaucugcccguccuuguggaucaucaagucuccagaaagcagcagucucaucuccuccccugagccuccucucauccguaaacucacaagggcucucuuucucuaaaaacggaaugguacuccauucaacgucuaagcucagccuugaacugcccucaaggucucguggcuaaaacuccaguccuaccgucuugauccuaagccauuccagagaugggguuuguuuucagucuccuugacagggagcacggggcacuagugagucagcuugugugacuaaugcauacucgucauuguguucugggcuacacaaaacgaacugugucucucaucuuuauugcugagggccagcguaguacucucagaagucucaacuuucauggaaaaaugccugcugguguguuacaacuaagggacuucaagccccuugguuguaaguagagggaaagagaaacugguguggagaaagcuggucguaaacuuagcccuucaguagggaacaaugcaagucuugaaugaagcugaacucgaagggaauuuuccauugccccaagccuccagggaugugggguggggugugaacucuauacuguuacuugugugugcgagauagugggguguuccugggagaaacaguggaaggaggccuuuguagcuuaaccuuugauucaaaauuauggaguuuaaaacccccauaugggauacuggggaggugguucagggggucagaacauuugccuugcaagugugaagacuugaguuugaaucacaagcacccacauaaaagagccaggcaugacugccagugucugcgacaccagcauugggggguuggggccccaaccuaggugaugacaagaagcuuucuuguucaauaggagacccugccucacuaaaaaagcagagaggaauagaagaugccugcuauacauauaugugcacgggcacauacacauguacucuacguacaugcgccacacauacacacacacauacauacauacauacaagaauacauacguacauacauauauacauacauacauacauacauggcacacaguacucaugccccacacacuuauguaaauaaagagauaaaccauccacaggggcacaccuucucuaucuuugcuuuuacuucaaaguaccuaugucugacccgcaaccuaagaggcucaguuucucugcauggugagauucuccacacuccuuggugaggucacauuccagucacuccucucugaucuuuuugugcucccuggucugcacagaagcugcagggaucgggcccccugguccugacagaagaggagaagaggacccugguugccgagggcuaucccauucccaccaagcugccucugacaaaaucugaggagaaggcccugaagaaaauccggagaaagaucaagaauaaggugagcuguuccacucuaggcauugcugugacagacaggagaacugagcccucaagcuccacccccaaggcccauaaagggacuuccuguaaccacacaggagcauagaaauagucugcccaccgugggugugaacucacaccaguauggacuccuuguuacaccauagccuguucagaggcaggaggagauacaagaaccucucuuuaucuuaaaaaaucucagucguauauaguguuuucuccucauugcucaauaaauauguaauuuauaagcaaauacaguuuuaugugguaucacuuaaaaguuguuuuuuuuuuuuuuuuuuuuuuuuuuuuuuuuuuuuuuugcuaguggucugugauagaaacaaacuucaguaagccaccuagucucuguugccuccggagcuguggcacagacaaagggagcaggagaggaaggcagaacgagcggaacacaagagaaccaaucacaccuccuuacccucguguagagccagcagacaguuuauauguaucgagcccagcugccugauuuuauguauaauugagccagcugaaguccagggagcugacaucauuuuucugagcuauuucaacaucagucugugacccaggaguuugucggcggguugggaggaucugucugggccggaagcagaguuggugauaaguaggggggaguccacaguuuaaacaaagcggggcugcccacacgagugaggccggcuuugcuggccccugugccgauggccucccaugucccuuccauucacucccguuuuacuuucaaacaaggaaauuuaucccccuccccuccuuauuucacagauuucugcccaagaaagcaggagaaagaagaaagaauacauggacagccuggagaaaaaguaagccggcucacugccuaguucuauuaggucacauucaacaagcagggugagggucucaguuuggcuuugugaaaccacgucccggugcaucggcaguguuugccugcccccuaguggccauauggaaggaacugcuuuuuaacgagguugugugaaucucggcuuucugacugcgaucuugagugcuuccaggcuucugaauaagcauuagacuuugacauugcugcagcuucucagaagacaugcccagcuucuaccuacaggaacaguguuguuuaaccagucccuacuggccucagaugauacaaauaagacucugguauuuccuguacucucuaaugcaugcugugggcagacagaauuuuuugcaaaaacacaugaaggcaccuuuguucuuuugaaagcccuggaaugcccugggggcucagagaaccgugaggacuaaggaccaucucuuuucagcccagaaaguaguucucccgcugaccaguuggugugauuuccaggucgacccuggaagacccaccaaugagucuuucuuauuuguacaugugagguaaagcccuggccggcuucuaacuaguucuagaagcuucuauggaaaguuguccuucuccaagcugguuugggaguaggcaauguagcauuaaggacuuccguucuguuuucuuguguuucauuguguccugaagguauccacaaucaagguuauuucuaugggucucucuucucugugucucugggcauguacgcuccagcacuucacggcccugggaucugguccugccugccuuuuacccaagcuucaagcuuuguaucagggauccacagcagugcagaucccuggugacucuacagcccauggucuauugagggaugagaucagcaggaagagguggggaacccgauugagaugccucgugcgauuuauguguguccagcccacgugacuuccugaagagagcccugaccugccguguugucccugugaacccucauugucuuucuagucaggcugucccagcucuuccuuacugaccaccucacuccuuucucugugaaagucccguggcugagcaguugcccuguggagaguugagcgucuuuuugcucucuccacagaguggagucuuguucaacugagaacuuggagcuucggaagaagguggaggugcuggagaacaccaauaggugaguguggccagaggaaggggauguguccaauggcaggggccguaguccaauggcgggggucguaguccacauccagagugggagggauagggauucuaccaaccaggauacuugagcugaccaccaccuaccaguuucugcuucaugggcucccccaugcacgcacaucagccacacagauguuuuuuuacuuuuuagugguugguguggagguggucauaacgagagcuauuauaaguuaaaaaggauuggccugggaguguggcucagucacaggaaacccuugccuaacaugcacaaagcccaagguucaauccucaguauuacaacagacagauuaacgaagagaagaaauguuuaaaaggggcuuagagcagaauaaguaaagucccuaagccugauucuccuggaaaugaguuuuagggcuggacagggaggcacugggauguagcguuauuuaauucuagucacgaucaugcuuauuaguuuaaaaaggcagcaugguuuuauaagccugcuuugaaaaaauuagugauuuacauuucagucccauuuugaaaaauuagcuguggcucuuaacugaugaauucuuuugacguuuucuaugucggucacuguuugggcacacuguagaucuuaacucacuaauucucaggagauggugugagauuaucccuguuacauagauaaguaaggucccaggacccaggggacuugcccaggaacacucaccagcuuaaucccgugaauuuccguagagaaguauccuauuggguguaacucugguucaggagcaagggguuuggaugugguaagacacuucaccucugauccagaauguguguucaugggcucacaugguacucacuuguguucugaaaaugcccagagucaaagaauccugucacccuuaguaaaguauaggcccacugaauuauagguccaauacaucaugcagauuaaaaacuucauuuggagcuaagaaaauacgaaucagccauuacggggucagcauuaaugccuacuaacaaaaugucaaaggcuacacggucugauuagaucucuucacaugcuuucaacagcagcuuuuacauuugaaguccgaguccuguaccucuguagguuuuuguuacaacagcaggcugaggacuugaacuguugucuguggccaucagcuuaguuccaucuugguaauccggaagagcacucaggugcccuuugccugacuccuguguccucagaccuccagacaagcucguccucuccuuucccugacguuaccccaccaccccucccccacccgauggaacuuccuccaucaggauucugguuuugcugcucuucccugccccucccccaucuucugcugaguccccaucuccauccgaccaccuucugaccagcagaggugacuucaaggcucuuuuggcucuuugaauccugcaucucagccacuuccuuagcguuuggucucuagcccuucccuugcugcaguggaugcucuguguaugaacugauuuggcccugagcuggggaacagguaggaauccugucagcauuauccuuucaguuuguguccuggggccugucugucccggcucugcuguuaggccuccuguuggccacacgggugcagcaaagccucaucggggcuguucugggaccaagaagucuguugaggaggagggcucacaggccacuuggccugggaagaggucuccuccccucuccaucugguggcacuuggcuuuguuuuauuuauuccuugauuaucaugaacauuuaaaacuuucucccuguuuucgcuucccaagugcugggauuucgggugugcacccucacaaccagacuggaacguuuuguuuuuguuuuuguuuuuuaguuuugcuuguugguuuaagucagguauccacacauccaaaaguugaaaucggcaaagcguccacugaaagcccucggcaaagcguccacugaaagcccucuuaucuuuaacauacagauuuucuuccaugucuguauuucuuaguacagaguccagccagucaucccacuggccuccaagcccggcauuccuguggugccuguuagacaggcccguguuuacuguggaaugcuuugccuaguucugaguuuccuaugacuuccuuuugaguccccgcauccuccucaggagguguguaaacacucaucuucugcuuaucaucaguuucuaguaauuaccuagauagaucaauacauaaggaauuuagaaacagcucuacagacuccaaucauuucuucuucaguuauuagcggggcauuuauauuuaauaaaguuguggaggauuuaugcauguaugugcauguggcuggggaaggaauggaggccagcaaauugaaaucuaugucuugucuauuguucucccucuguuuuccuauggagucgacccuguagacuuggcauuucuguagacuggcuguucaggacuggcuguccucauucccuaucacucccaacuccagugcugagcuaccuagagcauauggccacaccugucuuuuaaaggagcaucagcucuccauacucuucaugcuugcauaguaggcccuuugcccuugggcuugaaccaugaggugauguaugucuauaaucccacuggugggaagccagagacaaaugggucccugggcucacugaccagucagccuagccuaacugaugagcuuaggccagugagaacuugucuaaaaaagcgagacggacaucuucugaggaugacaccucuggcacacacacacacacacaugcgcgcacacacacacacacacacacucaacauauaaagaauacauauguaaaccucaaaauucuuugauuuggaucuauuauuacuuucugggauacuccguauauguguguguguguguguguguguguguauuaugcauauuucuuaauuaaaaacuuuucauugaacaacguacacuggacuuguucuccaugaauauguuuacugaauccucgucugaaacgguuucauaacucccuccggacgcuggucuuuggcccuuccccagcaguggcugacagugaguauagucagggcuaguauuuuggcacuggacaaagcagaaaggguucugcuuuuuuuuuuuucuuuuucuuuuucuuuuuucuuuuuucagaaaccauaaaaucuuagcgguuuauuuauucauucauuccuaccguugucaguugccuauaagggaagcaugcaaggauaauuguuuauaaucauaaaaacaacacauuugaacaucauaacugcaauauguauuucccuauuauuauaaaucauuuuguaauuugaugcacugugguuauuuucuaacauacuucucauagacuuuuuuuuuccauuuuuuauuagguauuuagcucauuuacauuuccaaugcuauaccaaaagucccccauacccacccacccccacuccccuacccacccacucccccuuuuuggcccuggcguuccccuguacuggggcauauaaaguuugcguguccaaugggccucucuuuccagugauggccgacuaggccaucuuuugauacauaugcagcuagagucaagagcuccgggguacugguuaguucauaauguuguuccgccuauaggguugcagaucccuuuagcuccuuggcuacuuucucuagcuccuccacugggagcccugugauccauccauuagcugacugugagcauccacuucuguguuugcuaggccccggcauagucucacaagagacagcuacaucuggguccuuucaauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguuccaaauucuaaggaggggcauaguguccacacuucagucuucauucuucuugaguuucauguguuuagcaaauuguaucuuauaucuuggguauccuagguuuggggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccgguugggucaucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccacgccagcaucugcugucaccugaauuuuugaucuuagccauucugacuggugugagguggaaucucaggguuguuuugauuugcauuucccugaugauuaacgauguugaacauuuuuucaggugcuucucugccauucgguauuccucgggugagaauucuuuguucaguucuggguucugcuucuuguguugucuuuaacuuuacccgggugugacugacagacaaagcugugcauuucugaguguccuugauucauauauguguacauugugcaguggucaccauaguggaguaacucacauccccacacacaugugguucccucucuuuuucuauugugcaaaugcuuuagaucaacauacgagucagcagaagucuuacugcccugucgcuaauugcagcgaccugcuguacacugagugucggcucacagaagcuuuucaccuccgagccccagccucgccuucuuguuucugaguuggaacuuuguauaaaucauucuguauguaaacaauggcacaguauuucuuuggucucugacuagcuucuuucacuucuaaaacagggagccacacugguuguccccaguuugugagccucuugauugccaagagccugcauggguucccuucagagccucugucucacuucuggcucacacuuaacuucugguggacgaccuuuauugauggcgauagcuggucccuggcucuuuaugaucuucccacagauaauuuuacccagagcucuccuggucaucauagccaggacacauauuucauaugcugguuuaagaggcaaauguauaaaugaccuguucuugcugaagcauggucugggagggguagggcuaccuucccaucucuucucuucugcccaccuuuuccuguuucuugcaagggccucccuuggucagaagacugccguaacccaaacgacuaugguguaaacauuauuaaccccgguccccagcaccagcugcagagaagcagguggcgggggaaacuucugggcaauggucacaucacaugguguuugaacuuagcacaggccuagaccaaagggacacacagcuguguuugugcuacuguugaugcuucucugaccauuguccuuuggaggcagcuggacagaagucaaaacagaugacaaauguggauagggaccaggauugcaagacgugggugugagauguagagggaccugcagauaaugugacacaaugugugugcauucaucacuugaggagagcaacgccccuccuggcuaagauacccagaugaggaguaccagucuggacucguuugcacuaaauucagcaagagacuccuggcauguuauugguuucuagaggaaaggaauccuugcuucugaccucaagacuccggauggggccagccaggcagggcagagagcccuguucccucuugcuccagagcugacagacacuuggaaggaauguaccucgugacuaagaucacuaugaugauccacuaauugcaugcaaucaagucagaugcaagugagagggugucccaggggacccucccuccuaagcacaaucggcaacaguauucauuccuagcaguacugcugcaaaccccucugccgcucaggacgaucacugaccacucgggaugcaagcucucaggacgcccgcaagccuucucaggaaggcccgcccuugucucacuccugagacauccuguucuucauccccauggccacuuugccuaaaugaugcacaucuaccacccugcccguuccaggaagguguuuguaacauuuaccacuuguuuugcucugccucuaaaaggcugugggaugcagucuuucuccucuugcucugauuuuuagacucuuaggaacuuggucuuaaagugcaucuuagagaucuuguuguucuccugcuaaucaauaugagauccggugagguuaaagucauaaaaguaauugaaaguagaaaggggacuggaauucagccacuugacggucgcuuuccccuucucuagccacaccuucuccaugggcugaauagucaucaagaccauaaggaugcggucuccccagagcucucgcucugugcugguaccuaggcccuuggaauucucuguccagaugcucuuaacccauuuccagggucuguguggauuucuauccccaagucugcucucugacaaguaaacugggugaucaguggaccccugaggccaaugcggucuuuaugaagguucucuucucucucucucucucucucuuucucucucucucucucucucucucucucucucucucucucugugugugugugugugugugugugugugugugugugugugauuggagcugagggcugaggaagguggguagguagggggagagaggagagugguugagggugcuccuucaugguguuaggccugagauuucauuugaccuuccuauagaagaucugagguucccaaguccaagacaaaggacuuuguuccgcccagcacugacagacacaucuguauugauucuuuuugcuaccauauuccagaaaaguuccaggugggcauugcccucccagugccuagggcuaagaaggacauggggcuugaggauuccuucuuucuuuagcaaguuguaaauaagccugcuuuucugcccagugguagagauuacauccgauguuaggucgcuugcuucauaauccgccugacaaccagcccaugugaaaugguagcuaggccucugaguccuggcauggccagagagcagcaccuguccccuuccugaaggaguugcuuuccuuggcuguaacaaaauaucugacaaaagcauuuugagaaaggagguuuuauuuugacucaugucucagacucauggucugagacaaugcagucgaacaggaagaagaagauguagugggagggugaggcagguggcucucugcugucuucuaccucucccucuuuccuucagccuuggacugcagcucacggacugguagcacccacguucaggguggaucuucucacuucaguuaaaccucucuaggaagacuucucaacaccccuagggugucuccuaagugacucuagucaaguuggcauugaagguugacuuauacaucugaugucucuucacgauacugaagagcuguccuuuucccuugcugugcugugggguagaguccaggguggaaagagaagggaagcaggcucaaccuggguccagguucaggauauuaaggugacaaucugggagcucaagaauuucaaaugaucuaggcgugguggugcucgccuuuaaucccagcacuugggaggcagaggcagucggauuucugaguuugaggccagccuggucuacaaagugaguucuaggacagccagggcuauacagagaaacaacccugucucaaaaaaaaaaaaaaaaaaaccaaacaaauaaaaaagaauuccaaagucacacaguagagaaaaccacacagacaggcauugaaucagugccuuauagacagaguugggcaggcauugacuaugcgucauagacagaguuggcccaguugagaguaguucaaggaagaagccuucagacuuaugggauguucaggacccuucccucaggcuaugggaguuggggauaaguauuugauuagcagugagaaaaggcuccucuuuaaccucuccuuuagugaguccucuaagucgucuucucuuggucuuuaaacccuguauaagaaucccuaacauaagccaaauggugguagcacaagucuuuaaccccaguacucaggaggcagaggcggguggaucucugaguucaaggacagcauggucuacagagugaguuccaggacagccagggauacacagagggaaauccuauuuuaaaaaacaaaacaaaacagaauucccaccacagguauuuucaguuaaaucuucaggggcuugucuggguccugccucuccuccuccggugucuguugaggcuacaaagcuguguuaauuugcccucucuuugauauuccucccuacacuccauugcguuuuugguuuuuguaucuaaguucuucucaucucuuuuggaccaccuacuggcugagcccaucuucagccauauauaaaggaaccacugaggacagagaaauuacccaaguugcauuucucuacacuuucaucuugguuuaauucacuuuuuauuucuccaguaucuacacccucuguuguguguaguguguuuucuuuucauauggaaauaucucaaacuuaaaagagcucuaccauagagcccccagagagaucagacaggcauuuuaaugugccuuagcggugaauuuagaaaucucauagaccugguaaauauucuaaaauucucuuuuguguguuccuagggcaguaaguaguauuguaauucagaaaugcucucugguacuuguaaaacaaaugucuuauaauauagaaaucccucagaaagaaagcuagagagcugacucaggaguuuagagcacuggcugcucuccuagaggacauagguucgauucccagcacccacaugaugacucacaacuaucuguaacucuagauucuggcgauccaauguccuuuuuuggccuucacagggacugcacauaugugaaaugcagacauaaaaagagacaaaauauccauucauauaaaguaaaaauaauuuuaaaaaauucacucagacagaaaaggaaacaguaguauccccaccaccacuaccacguugucuucuuucuuuaggccagagccucacaauuggcuuucaaaaggcaaaaaaauauaaacaguggacauuaaaguuuaagcgcauuagcuguaguugucaaacuuuaguguguaagauacugagauaguucauauuccuuaugaaauaccuugagggaguuucuaauuguuaauguugcauccugcugucuucccgcucaaugggauagaugcuuuggccuuuggacuccuucucuaggucucagaccuugccagacacuagcucugcaugacuggacagaggcgguauggcgagggcaacacuuggauaacuguagguggguuuugcucgaaaaggacuugagugcuuaucuguuccauugaggcccggauucauugguauagugugugugugugugugugugugugugugugugugugugugugugcgcgcgugugugugugugugugugugugugugugugcgcgcacgugugugcacucacuaguuaagguacacugagacuuugucuuuguaaaaucucuucauguuuuauauuaccuacuguugugggaauuaguuaagagucuuggugcccacacaggagcucucuuggauuugagaaugaaagacacacacauaugccaguuaauuuugauaggucuuuauuagcucaauggcugggcaccuuuaaaagcuuccugcagcuagcaaacacuccccucugguauaccugaauuaacacccuccaaaucuacauuuuaucuuuguugccuucuuaccuucugggcauccccucccccauaggauugauuuccauuuaaacuacauuuccuccaucucuccauccuguuccugucuggcauggcccuuccuaauccuccucaugguagacccccucuuccuccuuucuuccccugggaaaccuagaaguccuaccucuuucauccuacaaagccauugacuguuagcucuuuauugaucaauauaaaaccaaauggggacacacuucagcuuuuggacacacagauuccugauuugggggcugaauuaagacaaagcauuaggaccaacucccaacaucucacccaaauuucuguccaaauuaaaaaaagaaaauuuuuucucucagacauaaauugagcauaaccauaucaauuauguaaauuauaaaguaugauauacaauuagcauuuaguccaucauauuugucaauuagauagucuucccuucaauccuuaaagacaauuauauauauauauauauauauacacacacacacacacauauauauaauuugauuuuauauauauauguguguguguauauauauauauauccuuuauuuaucuguuugugggaggcaggcaguuucuauugucugucugucugucucugucuuucucugaguagccagacucuuuguucagcaggggcucucagugucucugagcucgagcucuuuguauuguuugaaccaucagaagaaaucuccaugugacuugggcaaauuuuauagccuuuuaugaagccaagucucccccaaaucuuacucuaacaucaugguguguguauuuuaucugagaaucucuaaauaauuuuuaaguucuugccccauguugggcaccaucuuuagcugcuaauuaguuaacccacucugagcuccuggcaggccacaugcaugcuguaccugccuagauucgagaaugaaacacacacacacacacacacacacacacacacacacacacacacacacacacacacagacacacacacacacacagacacacagacacacacacacacacacacacacacacacagaguuaacuuugauaugcuuuggccagcucagggcuggacauuucuaauccuccccauggcuagcccucuguuacuccuggcuuaacacuuucuaauuuuauguuuuaucuuuguugcccuguuacuuucugggugcugccccuacagggacacuuuucccuuccacuuacauuuuggaugauuuuucuucuuuaguuucuccuaaacccaaucccucugccucugagucugucuccuucuuucuauccuaucugucccaaacccaggaauccuaaaagucucgacucaucuguccugcucaaccauuggcuguuggcaucuuaauuuaccaauccgaaccaacuggggacagugucucucaaugucuuacguguagacacucauguagguaguuuggggggaccaaaauuaacacuguaacacaagcagcauuaggcgaagcccacuuuaccuacagcaggcauaauauauaaacauauuuauuuaugcuauagcuaacugguauguauaucuuauucauuacuguuaguugcugauaguuguucccugauucuguauuuuugguuugauuucauuguauuaaaaugauacagcagucacaacccaauugaucucgucucacuaagaguccaugacuuggcaccuggaaagcaucucucuagguauucauaaggauguaaaaaaaaaaaaagauuucaucauuuucugaaggaggcugauucaccuagagaguugcacacacacacagagacacacacacucacgugugugcaugugucucaugacccauuuaauucauuuucuaguaaggugcacuaugaaauauaaguguguauaccaggcaggguauggggugacucuccugccccauaacugggaucucucaguguauucuuuuuccugauuucugauuccaaugggaaauuaauuucuugacuauucaaaggcuuaccuacacuagcuguauaucuuucucacuuaauaucgcucccuuucuauguuggaaaugaaggguauauaagaaaacaaaauuaagccaaauauaaagauaacacacuaagccacuaauguauuuuccaguuccugcaagauauugucuuauucucuuaaagcuuuugaaugcucuucccagguuuuuguuuguuuguuuucuaugugcugugugggauacagggugauguuuuauuugggcccaggcuguagcuccccuugacugcucuuuugccaggauauauaugaagauaagccacuaaguuuauuuuuacacuucaccuuaggacaagaauauacauuuucaaucaagcuggacacuccaguuuaacaaguuuugaaaaauccuuuggcccagauaaaaauguauguuaagaauguuucucccucuaaauuaagaccuugaucccagaagcccaagaauucauuaagccauaauuggccuugcucacaagauucaaaauacaauagcaaugagcagggcguauggaguuuuggagacgccacugggcuuuuuauagauguuuuuguagcucuaguuuuuguuuccuugauagcuuuccuuacaucaaguccugcaggcugguugccugauucuugccacccaaguuuucaguccugcacuugaugacagcuguccacugccaucacagaauguccugcaucaccucaaaauaauguauccauucugaggccuucccgagaaagaggcucucuucauccgccagccacugaagaaacaguggcgccuuucagagaugcauuugcucuagcaaaccagauuuccccaggcagagugauucuuccaugauccuguuagcugaugugguuucagaagcuagcuuugcuuagcugcugaagcacacaacuuaaggaacuugguuggaggcacagaguugucauggugaggucuaaaccugggcuccuccguauucacagccagucuucucauccugccauucacgcacccacuaagcaucacuaaagcaauccaucuacuuggcaucugagagaggaacaggucucaucuuuuccauuuaucuaaauaaauccuggguuugacuuccugacaccucgcgcugugcagggcucaucugagccucucuaucauuugcauuguuuucaauacaccuauagacguuccacaagggauuuauuuuccuucauuguuuaugaguguuuugaaguuagcauaaaaaguaaauggguuccauaguggcauuuccauacacaccucauuguacuuguuucuuacuuguucucuucaaccagucucucuucugcuuuccagucaccuguauucauuacacucucucaccucucaugguccccuuuuuacuuucaucacacacauacauacacacagguauguguguguauauguauauauauauauauauauauauauauauauauauauacauacauauauacauauacacacauacauacauguaucacacagacacacauauauauauacauacacucauauacacauaugcacauauguacacuaacacauauacauacccauaugcagauacacauacauacauacacacacacacacauauauauauauacacacauguacacagguauacccagauacauacauaugcugauauacacacagauauauacauauaugcauaugugcacauauucacacagguacacacauauauacauauacacauagguacaaaaugcacaugcauaaauguguauauacauaucuacccauauacauagguacacauaugcacacacacacacacacacauacacacacacacacacacacacacacauauauauauauauauacauacauauacacauguaucuacacagacacacauguacauguacccauaugugugcacauagguacauacauguucauguguauacauguacaaacagguacacauguacauacaaguacacauauacacaaauauacaucuguaccaacauguauccacauacauauaugcacacaucauacauguauaugcauguacacacaaguacacaugagcauacgaucacauucauggauacacacauacaaacauguaucccuaugcauauauuugugucauuauuauuagacauuaguggcuacagaccucacugcuauuagacugguuguuaccauggcccuuuauuuucaccuggguccugguacaguucucccuucugugguuauuuguaauagugacguuuugugucuaaugacaugugcacaugucauuccauggggcuguugucaauaucacauuaaugugacugcagcacauuuccagcaggaaaagcagcagcaaucugcaugucaccaagcuguugccuucugccagaauuccaaacugaaagcaugcauugggaacuacaguguuugcucaucuuaaagggcuguuuguaaguucuuagaaaucagaacccauucaaugaccaguuucacuucagcugacuccguguaugaucaucuuugagucuguaaagaauacacugauggaugucaaaucagugagcuuagccuuucuggcuuccuccaacaauucccccaaacuuagagcaucuggcacuguaacugggaggguugugguggaggucuggcuuggaacuugugccacucaucccaccaaggcgcuuuugggauaucuuccuugcuaaaagucccuuuucagggggguaccuggaagaauauuugucuuaggaaaguggaugcuaaucccaggagucuuaccuagaaauuggaagggagggguauuucuguuguccuggggaaucuguuuucucagaccgugggugggcagagaggaaguguagaauguuugaugauaaacaggcaaaaaaauauauaaauaaauaauauuuauguuuuugcuuccaagccaccagaggauguuggagcaaaguagauggcauugguacagcuugggaaggguccuucuagcugaaggcuggguagagagaagaugaccaucccuguguagcuuacagcugagcuuacauccuggcacaagaaugcucaaggcagaguuggggcacccagugacagcaucagccaacgcuggaagcagugaggucccugcuguaguucagcaggcagcccaagaccuuaggaucgaugccuuggaagaaguguuccugccugugggcuugcuuguauauaggucccaggacuugagggagaaccucgagaggaacuuggggcuggcauuacagaugacagucacaugcuacacacacacaugcuacggcuggcaggauggcaagucuguagaaugaguuccacugagccauuggccaggcaagagcucacucaguaucuggugcugcugcggugggggcuguguugguggguagugcagaggcuucugaggaagcuuaggcaggacagagaggaaauucuacgacagaagaaaguucugcagcacagggacucuugguuaugaacuuuuaaaguggaauuuaaaauaagugugcuaucagcauuucuucaccuugagcaacaugcagugugcuuuuaaagcaaauccuacuuugauaaauuaauaagggucaugucuaaccccaucuggucaugcuuuuauauagccaaaaugaaaaguaugauugaguacaauagccuuccauaggaaauauuaucuugcuauccuaaaauuauuccacauggcaaaaaacacagaguggguaggaccacagggagauuuuuuugaguuuagaaagccuucuaccaugugugcugagggcuguucaaauucuuucaccaagucuaccuccacugauacugcagaaaggaaaaccaucucaaagccagccuacccuugcuuaaacuaagagaauucaugucuuugauacugggcaggacagaauuacaaaccucagaaaagcuugcauguguuuucaucauuggaaagacaugccgcggguaggcugugauggcaagcaagaugugaggaaaucccagaauucuucuugccuggcuuucaaacauuccaucacgguucgcuguuuucugaaaaucuuugauacucagaccguauguucucacaaacccuuuccauuuuguaguggaugccggccuugagcagagcugaugagaaugaggcaggggucccaggcuuuaugcuagucccccugagucccgggagacacucuaaccugggaggaugugcugccagaccccugcuaugucuugccauucuugguuuaggauuugcaaagaugcucccacacaacauccugauauuacaguguguauacugcuguccucaucucugaacauccacaguuguccuagcuggggaguaccaucccccuuucccucucuccucuucccugcucccucccuuccucugcagagugcucuguguaaacuugccgcucacugauggacuggccauuuccagucaagccaccaccucuggccccuccugcuauuguucucugccggccuuuguuucucuccuucucuuguuuuuguuuuuauagaucagugucucucaucucuuggugaaacgagccuccuuuguaauuaccacugcccuagucaguucagacugcuguaacacaauaccauaaaaggacuggcuuggaaacaacagaaaugcauuucuugcuguacuggaggcagaggcggccaagaucaaggugcuggcagauucggugucugguaaaggcugccuucuggugcaaagaaaaaaacgacagcuccuagcuguguucccauguagugaagaacuguacuuuuagccccuuaugugggcacucguccuguuauuaaaacucuauucucaaggcuacucaccccacacccccugccuauuaucauuauauugcagcuucagucugaacauaggaacuuggagagaggggagucauccaaccagaguguccuuuucuucccucauuggcugacagacaaguuucugccugucaggguugauuugggggcuccucucuugcccagaacagcugcaggcugcagagcuguugucaaggcugacucugaagcuccaggggguucugcgguggcgcugccagcagguguaguccaaaggacacccgcccagguguaguccuuuugccgugcuuccagacccugcucagucacaggugugaagccgcuaugacuucugcgggagagucguucagagcagcucgcucucacgugccccuuccugacuuucacuuaucaccguggcaggacucuccuucagcaacuucagaagcuucagacuuuggugauggggaaggucucucgaaccugcaaguuagcuggcacacagacuggcaccugccucauggugaguuucccaaagggacuuccuccccuggcaagccccccauuuccagacuccccuaccuugaaaaugcuaacaaugaaugaagccagagagaccauacaucccguuccaaggcuuccccuugucucgucauuucaaggacacaagugagggugaccugaccccuaacagacuugugcucuuucuugucccuuguucccagaggucagccacccacagucugagcucuacagcuccccguguucucuccuuaccucuaggucguugugcuuugcuuugcuguugcauuuggaagcuucuuucaaggcuaugggccuuauccuucugccaccaagauggcucugcccagccagcauccucugucagagccauacacagccuccguggguaagucaccaccuuguuuuuguuugccugcaguuggcuuuccgagcucucugcaagggaucccaacccauguguaagaguagagcaucucuguuugcaggugggguguucugggaguggccacuggacucccuggguagcaccaggaauucucaagaauuccacagagaguuaacagaagucccuagugcuccagauuccuucucugauaagcccugacacccccuuuggaguucugacuuggggugggguggggcgauguggaucuuggaagaccagagagcgaggaggacauuuagcuugcucugauaucucagagucucugacucccugaggggaguuauaugguguugcagugagaguuugcaacaaaaauuaaagaacucaucugucuugggcucaagacuuuggaugcucagagauguucaccagauagcauauacuguucucaccuugaccaaugguaaucuuuugaguauuuagaaaacagaggggaacaaggagggaauauacaccgaguggcacagcucuauuagcaacaacacacagcaaguuuggaggcacuggauuugagaaagggauaauuucaccauucucgaaaugucuguggacugcagccguuaggccuauccaggcuagacaggugauaaaaugacauuccuuucagauaauuucagucgauucuuggggaccuucugcaccuaggaagauagcuuuaaauuuuguaaguuaaggggagcacuguuucuauauucaggaaaaaugguugcagagucaucuaugugacucucccauaaugcaacagagguugucgcccucugacuuguuggauuggcuuugugcugucucagcagauucuaagaccugcuuucuggggaugccuccucuuucgucuggguuuuaacagcuccaaguauuugaccccagcuuuccuugaguuuuuuccccccagggucaauuauggguaggugugaggggaguuuuauuuaaagacagugaggguggaagugggcucaguguuuauuugcuuuuauguccuuccagccuguagcauugguauaaguuuugauccauaaucucugaaaccugaagccauugcagaaagccaaaccuagcuggcacuccaucccaggagaugagaguguguuaauugucaucugcuacuggccuggggcauuuggaguaaagggcguauaugggccuugagguguuuugcuaauaucuguugcccuguucuuucuucagugagauccaggaaccugcuaaucuaugaggaacacgcuccccuggaagagucgucgagcccagccucagccggggagcuggggggcugggacagaggcuccucucugcucagggcaucgucggggcuugaggcccugccagagguggaucuuccccauuuccuuaucuccaaugagacgagcuuggagaagucaguacuguuggagcuucagcagcaccugugaguucuguagguccagaccucgugcuugaugauggaguguggaucagccccggcaggagggcagacaccagaggcccucacagggcccaccuucaguaacagcccagggaaggaucuguggauggcuguuagcaaggaaagggucuaagaugagcuaaucuagucuccauaucaucagcccagggcuggcagugaugaucccaaagaccaggagaagaugugagccgccucagucaguaugaccguuuuucucccauagucacaaacuggccauaugucguagcacguaucuuuaauccuagcacuuggcaagaggaggcaggaaaaaccaggaauucacguccagccucagcuuuauacugaguucaugguuagccugggcuaccugagauccugacuccccaaaaaacaccuggugacguagagagcuuguucugcaaaugcaccuucaauccacuucuauaguuuccuucuaacuagagagcaaaauaaugcugugauggguaucaguauaagugaugguuuguaugucaaugcacgggaguuagcugugacugcagaugagaugcucucugugugaaaugcuuggggccagugugaaauguuuggaauauuuuccagguguuagaauauuugcacauacauaacgagauccaagucugaacauuuaucuauguuaggcgacaaaguuuuaguucuuagagcagcucagaguuuaagucugaggauuagggaugcucuacccuguacacguuuguauccuucuaucgagaggcagcacuggcgaaacacuguacauuuuuuuuuccacauugaaaaucauucauauuuagcuccaauucugcacuaaguuguuccucuccgauagccgauggggagggagggguccuuaauggcugaugcagucuuaagguacugcuguuguaggggggcacuugggggcgccaauuggcacaggacucacacgugcucccucugggcaguguacggugaugcuggugagucagcgaaucggugcuccuaggccgcuccgaaauggggccgcuccgggguaagcaaugaagacuccauuuuuacuucucucccaacucuuugcaacagaguucaugaucauacguacuuuuauauguggacauggcaagcacauauuuaacacugguacuagucaugccuguauguacuaucaaaacaaaucuuguaaguaucccaccaugaguagccuuaaauuuauucccauucuggaaagaaccggaagcuaguaccgaagccccaggagaccgagcugcuggauggcguggcucgccgcacagucugcucucccagcucggggucuggaagcccagucugaucccucuguuuacugccgugucuccuaaguaauaaaacuuccccaacucccgucagagugcugggagacuuaaugagcugauauacaaguugaucuugugguuauuuuaugguauguauucuguguuauuuuaaguugauucauuaaaaaaaaaucauugucuggauucuuaauuccagagcagaugucagcccuuaacccuuuuuuuccuccucccuguaacuuaaagcacugaggucauuaauauacaagcaacggccauugaaagcaauuuaaaacaagucagcaucaaacuagcagaggucuccucugcgccaagauaaaggugcaaauguaggggugaucaggugacuauugggggaucccagggagcaaagacuuaccacuaggcauuuaaaagacucugccaggguuggcccacagggcuacaauagacucaugcuauggugucugagaauuugagcaaaagcugguggcuaauacuuguucucuccauuggaugccuucacagggucagcagcaaacuggaagggaacgaaacacucaagguuguagagcuggagaggagagugaacgccaccuucugaggagagcuccacccuccucuucuccuaacuccaucugaucguccuuucaguuuccccuucaccacuggaucucgaggaggagauggccuaguguuacggcucgagacaggaggccagcccaggggguucugcuuauguguccccguggcucuccacaaaagggagcuagcaccucuccaucccuuucucuuacugccauuggaaauuauuuuagggcugagauagggguggaacgagcaggcuuguuuccaccaauagugccaagaagacacugccugauucuuccccgggaggagugacuccucugaagaagacaugacucauguucaguugagaccccagacucuagccacacacaugccacagacaugccagggaguggcaaagcacugacuccugagcucccuuccucacuaggacuccagugugacccugcacugagaggaccaaagcgucauugcagucuucucuccacccuguaccccggaguccugauuggaugucugcagaggcagauggggcucccaccauauuuucaggccgcaagugcaauuccugaaggcaucaggcucuucucucccaggcucuccugcccacuguguuguuuguaggacacccccacacccacucauacacagccugcaucuccacaggacaauagcucugucucccuggccuccccuccccauuuguaaauaguauuuauuagcuugcucaagcucccagcuggccauagugaaaagauuuccccuuucaaccagcaaagucuucuguuggccuuuggaacaggagaguccccggaaucuaggacccuagucuuuguacuugaugccuuguuuccccccuuuucuucuuuaaaauuggggaccuauaacaucaucgcuguugcggaauccacuuaggcauguguccccugauggaugaauacaugggaaugguggauacugucuucugacucaggcucuaggcuccauggcuuccucucucugguccugccacacagaaggaaagcccuguccaggauaaugagcguugcugacacccuugcuagcuuguccugccuaccugcuuaccccacucccucaccuuccuccuucccuucugcccuccauccaccugccuuaacuaauuggggcuggaguuggucauuuuuguacacccacagugguaccuuuuacagucagguuuggauacuuugcagcucauccaaagagacauaacuaaacccuaaacucuuuuuuuguuguuguuguuguuguuuuuuuuuuuuaugauuaaaaaguaaaaauuguaguuuaaaaaauccuuuccucuuucauacaaauaagaaauggaaauugcucguuuauuguauaagauagaagauucguuuaaaguguuuccccacccccacccccagcuuguaaaagauuuuauguaagaaaugugcuuacacuuuguauuuuauuuuuagcagcagcuaaaaggccuguaguuuuacucucucucuccucucucucucucucucucucucucucccucucuccucucugucuucaucaucuuugagaucauuagagccuguauaaaggggauuauggcccugccuucuaugucacacauaggauuuggugucauuaguguuugcugucaugccccaugaguagcuccuuacuuggucugcucagggcauccuagggaauguuccuuucccccacuccucccucccuaccgugguggauucccagcuggcagauggccaagcucagggccacugugaucuuggcagcccuccuguuuaaggggcugccacccucccuuacagggugguguauagccagggcuauacaaaaaggguggcuagugaccuuuucucucucuucucucucucuucucucuucucucuucccuugaucuuccuuggccuggcccauucugcucuuuacagugccagauauuuauacaucauaaacuuaggaaaugccuaaaagagccuaagcaggaaaaauccuagggugaggcaauguuugcaugaugagagaggaaggguuugccauagagagcugaaauggggauuuagacugaugugugcauuggcugagcugaaccuuggucucuugaugucccuggagagcugaggucgagaccccauucaugcaggaggaggaagaaggaaguguccagucacauccuuaguucucagaggacuuuauuuuccucucuaccuacucuuuugggugucacugucuccagacagcagggcccuuugucucugagaaauuagccauccagaauagaaucuguaacaagagacaugggacauaagccagagaacucaaacagcccuuuaaaggagcucucggcaaccaacacugccacucuaugagaaaacccucugcccuuuacugcugcuggcuugccgucugggaugcucaguagagucaagggacccagcagagaugcaugagacaagauggauugcgagcaauuaguggaugugugcacuuuuuguucagaguuuaaggcuaggauauugguuuuucccacugacugagcuguccugcaaaccagucaauaccuuaugguuaugucugaagguuuuaaauagugguugacccaacaccuuggacugaaauuuugaaaaguuuugaaaaaagacugcuagacuuagagagagaagccagaacaaauuccgcugguuauauuuucuaccuuguaaacaggucagcacccccacuacucuuuuuaaaaucacuuuagugauggagaugucuugcaaagauguagagaacaaggccucuuuucccuagaugagaccugaggaacccaguugccccuuccccccacccccuuuacagcucccaacuuggguccuguaaauggaggugucauugccaucaccaucgccagcauugaggaagagccucugaagugucaggacuuugcaguguagcucaugcaaagagaguguucuauaaaaaucuugacagcugaacucaguugcucuuuccuggcaggaggugggggugggaucuaacaugagugcaggcaaaauuagauaaccauucgguucauagaaaugauuccaugccuugggaagacagauuuggggccacauuguuuacaaacuauacacaccagguuaauagacaccccgucuuaagcaccagcuccucuugggugcccccagagccccugcaacuguuauccacauacaacagggauaucggacugcuuucuucuuccggcugguacagaaucuguguccaucauuuuucacuacaggucuuguuaaaauucuuugcagcacuucguguccccucacgucccaugugcucagacccagaaaaagcagaacagaauuagaagugccucugagccuugugaagugugugcgcaagcccccauggagaaauggagacaucuuguccccaccugaggaguggacaucugccugauucuugccaacacgagggguggaaaugggagaaaaagcuuuuaguugcuaauuuguuuccgcugagccaaguguuugagaaaccuggacuagagcuuagcacucccacuugcagccuggcaggaccuguggagccauuaacggcgggggucuuagcgagaaccacuucauuagagcacuugcugcagaggcagagagcagagccgccaggauaaauucugcuuccaccccacaaaggcagucacaggagagaguggagagagcaguaaggaggccacuggaaggagccagacacagauucugguucauucauucauucauuccuuagacauuuucgguuuuacaaaggaagaacagguuuccuaaggccgaggaaaucuuggagaauaaaaaaggacuuggaaaacaagucuuaguagucauucagaggacucaaguacuagugcuaggucucuuuccuuccacucucucucucucucucucucucucucucucucucucucucucuccuaaguacuuauucaugccucugaugugccuuguaucugaauccaggauggcagagauccccugucccuggaaggugucauauauuacuagcuaguauuagguugaaguugggggugggggcuuucuccguaggcuuggggaugguucccucaaagugagccacuauuagauuugcccaucaggggaaaagaaaugggguuauauccauuaggaaaaucccauuuuauagauagaggugcaaucacauaaaaauguggccaggcaggauuaaagguauucuaaauccuuaccacggggcauuuucuggaugcaaaggcacuagcccauuugaaaauuaauauuccgugccucugggccaagaggucagcuuucugcacgaggagaaaaacaguaacugcuguuuguuacagccugaaauccaggacgaccgcauuuucucuugguuucuaaaaggaagggaaucuucccgauuuuucuaagauguugaguauuguguaaguaagcuuugagucuuugaaccugauugaaaugcaaagcaagggugacucauuguuaggagaaguaaaggccacggaagguaugguaguuucuggaguccuaucugagaacucacagauugucuuugccucucuaggcagaaacagagcuacccacugcagcggccugacugugcagcacucagcucuuuggcucucucugaaaugcccgucucauccugucuuuuucgagcauggcucacaggccuugugucugggugaagggaacccagggucaggcugcacuucuguuucugucuuuugcucaacagcggggugugcacucguggcugcacagaugaagcccaugcugagucugugggaacacccacacucagugcacccugugggugacccucccuacacagugcagagcagagcccaggaggggccacaggcaucagugaacucuccuugccuaggauggcaacugauuuugcucucuuuggaaagauucuagauaagucagcauuguuuaaauccaagugcagugcaagucugugaacugaucuguugcacugucuuauggcuucuuauucuucaucauagcuaauuaaauaccaaaaaaaaaaaaaaauagaaaauaaaauaaagcuuuguaguauacuuguacuuaguuuggggaaaaaugaaauuauaaugcauuuguauuuccauuucuugcaaauaaauauuuuucuuagucaaau

SEQ ID NO: 2906 - RNA, 1172 nt, Mus musculus
cacagcacauuccaggagacugcuagcaaaugggucucaccuuguuccuaacaagguggcuaacgaaacagaagaugugcauggaguggcauucaggaaggaaggcucgaaggccuguaugaacagcuggacuggagcggggggggggggggggggggcaugaugucaagggcucgugcuagaugcuguuguacaaguggagagaugaucucacucuucauucaggugggagacacaucacaaauuuaggcaggagagauuuaguugagaagccuguggacaacccagugcagggauacacuggcaacuucaugaucagaccuuguagagagauccaggcuaaagaggcaaugagguauccaucaccuauagacagaugauacccagagccacaaaagugacagugagaagagacaugucaccauccaggugccccgggcucucagggaaggcuguaugaauuaaggggagauaauguuaauggguguguuuuauaaacagaaaagcauuuuuaaaacaccaguuccuccagcaacugagaggaccuggcagggaagcuuucucuguguuucccagaucgggacauugauaagguugcaagucaggcuccucaaggacauucacugcccaaacucagaaggaguuuaacuuagaacagagcucuggaaagccaacggaacagcccaagguuccugggaacucuggggaggcuccaggaaggggggcuggaaaguuccacagcugcggcagaggaguuccagaacccacaagugagccccauacuuaggccucagcaacaagcugacugcagcuccggagcccccacugacacacuggaaccucacaucugcaguccucuggucugucuccaucucuuaaagggccuuugucacuuguuccauagccucccaggcaggacagaaggcccuuuacuucugcgcuccguaaaagcagaagucagggaagcugcaaggagaugguugggguugggggcaggguugaagagcuggugagaguaaagggcgcaaggacacagcucuccuuggggugccguuccuccuacagacucucaacacccgauacagaagagcaggaagaaggccaucgaguguuauauaagacaggcuuggagacacaucugcuggaauuaaaaguggcuucguucucagaac

SEQ ID NO: 2907 - RNA, 1172 nt, Mus musculus
guucugagaacgaagccacuuuuaauuccagcagaugugucuccaagccugucuuauauaacacucgauggccuucuuccugcucuucuguaucggguguugagagucuguaggaggaacggcaccccaaggagagcuguguccuugcgcccuuuacucucaccagcucuucaacccugcccccaaccccaaccaucuccuugcagcuucccugacuucugcuuuuacggagcgcagaaguaaagggccuucuguccugccugggaggcuauggaacaagugacaaaggcccuuuaagagauggagacagaccagaggacugcagaugugagguuccagugugucagugggggcuccggagcugcagucagcuuguugcugaggccuaaguauggggcucacuuguggguucuggaacuccucugccgcagcuguggaacuuuccagccccccuuccuggagccuccccagaguucccaggaaccuugggcuguuccguuggcuuuccagagcucuguucuaaguuaaacuccuucugaguuugggcagugaauguccuugaggagccugacuugcaaccuuaucaaugucccgaucugggaaacacagagaaagcuucccugccagguccucucaguugcuggaggaacugguguuuuaaaaaugcuuuucuguuuauaaaacacacccauuaacauuaucuccccuuaauucauacagccuucccugagagcccggggcaccuggauggugacaugucucuucucacugucacuuuuguggcucuggguaucaucugucuauaggugauggauaccucauugccucuuuagccuggaucucucuacaaggucugaucaugaaguugccaguguaucccugcacuggguuguccacaggcuucucaacuaaaucucuccugccuaaauuugugaugugucucccaccugaaugaagagugagaucaucucuccacuuguacaacagcaucuagcacgagcccuugacaucaugccccccccccccccccccccgcuccaguccagcuguucauacaggccuucgagccuuccuuccugaaugccacuccaugcacaucuucuguuucguuagccaccuuguuaggaacaaggugagacccauuugcuagcagucuccuggaaugugcugug

SEQ ID NO: 2908 - RNA, 1162 nt, Mus musculus
aaagaggucgcuuucccauccgcugccucgacgaucuucgcuugccuccucgcucgcugucccguuguccuagcccgccgccgcccgcugagcuugucuuuucccugcuugcagacauggcugacaucaagaacaaccccgaauauucuucguuuuucggugucaugggcgccucguccgccauggucuucagcgccaugggagccgccuauggcacagccaagagcggcacuggcaucgcagccaugucagucaugaggccagagcugaucaugaaguccaucaucccagugguuauggcugggaucaucgccaucuacggccuggugguggcaguacuuaucgcuaacucccugacugauggcaucacccucuacaggaguuuucuucaacugggugcuggccugaguguggggcugaguggccuggcugcuggcuuugccauuggcaucgucggagaugcugguguucggggcacugcccagcagccucgacuguucgugggcaugauccugauccucaucuuugcggaggugcuuggccucuacggucucaucguggcccuaauccucuccacaaaguaguccuuuuccaccaucagucacaggauaggauguaaagaucaccccuccucauuccagaacgaacagccugacacaugcacgggcagcugccccucaguaguuggucuuguaaaugugcaguguccuagugcccauugucugucgcccccgccuugccccuacugcaccgugcuguggacauacgggcccacucaucucccacccaggccccugaccagugacgaagucagccucugguuaccccacccaucgcccuagagugcuccuguguauaagaaugaacuagaguugucauuuuucucuucacuggauguuuauuuauaaaagauuugaccuauucaugcgucuguggagcagcuccugucucccaacuauauaguaaucauuaguagacuguugccuugugggguuccuguugcugagacuccuuggauggagccacccuucccccugcccugaacagccaggguggaggauagagugcuacugcuccucagagcuggcucccagcuguguccaauaaaaguucucggaugugaaaaaaaaaaaaaaaagaaaaagaaaagagggaaaauccu

SEQ ID NO: 2909 - RNA, 1162 nt, Mus musculus
aggauuuucccucuuuucuuuuucuuuuuuuuuuuuuuuucacauccgagaacuuuuauuggacacagcugggagccagcucugaggagcaguagcacucuauccuccacccuggcuguucagggcagggggaaggguggcuccauccaaggagucucagcaacaggaaccccacaaggcaacagucuacuaaugauuacuauauaguugggagacaggagcugcuccacagacgcaugaauaggucaaaucuuuuauaaauaaacauccagugaagagaaaaaugacaacucuaguucauucuuauacacaggagcacucuagggcgaugggugggguaaccagaggcugacuucgucacuggucaggggccugggugggagaugagugggcccguauguccacagcacggugcaguaggggcaaggcgggggcgacagacaaugggcacuaggacacugcacauuuacaagaccaacuacugaggggcagcugcccgugcaugugucaggcuguucguucuggaaugaggaggggugaucuuuacauccuauccugugacugaugguggaaaaggacuacuuuguggagaggauuagggccacgaugagaccguagaggccaagcaccuccgcaaagaugaggaucaggaucaugcccacgaacagucgaggcugcugggcagugccccgaacaccagcaucuccgacgaugccaauggcaaagccagcagccaggccacucagccccacacucaggccagcacccaguugaagaaaacuccuguagagggugaugccaucagucagggaguuagcgauaaguacugccaccaccaggccguagauggcgaugaucccagccauaaccacugggaugauggacuucaugaucagcucuggccucaugacugacauggcugcgaugccagugccgcucuuggcugugccauaggcggcucccauggcgcugaagaccauggcggacgaggcgcccaugacaccgaaaaacgaagaauauucgggguuguucuugaugucagccaugucugcaagcagggaaaagacaagcucagcgggcggcggcgggcuaggacaacgggacagcgagcgaggaggcaagcgaagaucgucgaggcagcggaugggaaagcgaccucuuu

SEQ ID NO: 2910 - RNA, 1142 nt, Mus musculus
aggucgcuuucccauccgcugccucgacgaucuucgcuugccuccucgcucgcugucccguuguccuagcccgccgccgcccgcugagcuugucuuuucccugcuugcagacauggcugacaucaagaacaaccccgaauauucuucguuuuucggugucaugggcgccucguccgccauggucuucagcgccaugggagccgccuauggcacagccaagagcggcacuggcaucgcagccaugucagucaugaggccagagcugaucaugaaguccaucaucccagugguuauggcugggaucaucgccaucuacggccuggugguggcaguacuuaucgcuaacucccugacugauggcaucacccucuacaggaguuuucuucaacugggugcuggccugaguguggggcugaguggccuggcugcuggcuuugccauuggcaucgucggagaugcugguguucggggcacugcccagcagccucgacuguucgugggcaugauccugauccucaucuuugcggaggugcuuggccucuacggucucaucguggcccuaauccucuccacaaaguaguccuuuuccaccaucagucacaggauaggauguaaagaucaccccuccucauuccagaacgaacagccugacacaugcacgggcagcugccccucaguaguuggucuuguaaaugugcaguguccuagugcccauugucugucgcccccgccuugccccuacugcaccgugcuguggacauacgggcccacucaucucccacccaggccccugaccagugacgaagucagccucugguuaccccacccaucgcccuagagugcuccuguguauaagaaugaacuagaguugucauuuuucucuucacuggauguuuauuuauaaaagauuugaccuauucaugcgucuguggagcagcuccugucucccaacuauauaguaaucauuaguagacuguugccuugugggguuccuguugcugagacuccuuggauggagccacccuucccccugcccugaacagccaggguggaggauagagugcuacugcuccucagagcuggcucccagcuguguccaauaaaaguucucggaugugaaaaaaaaaaaaaaaagaaaaaga

SEQ ID NO: 2911 - RNA, 1142 nt, Mus musculus
ucuuuuucuuuuuuuuuuuuuuuucacauccgagaacuuuuauuggacacagcugggagccagcucugaggagcaguagcacucuauccuccacccuggcuguucagggcagggggaaggguggcuccauccaaggagucucagcaacaggaaccccacaaggcaacagucuacuaaugauuacuauauaguugggagacaggagcugcuccacagacgcaugaauaggucaaaucuuuuauaaauaaacauccagugaagagaaaaaugacaacucuaguucauucuuauacacaggagcacucuagggcgaugggugggguaaccagaggcugacuucgucacuggucaggggccugggugggagaugagugggcccguauguccacagcacggugcaguaggggcaaggcgggggcgacagacaaugggcacuaggacacugcacauuuacaagaccaacuacugaggggcagcugcccgugcaugugucaggcuguucguucuggaaugaggaggggugaucuuuacauccuauccugugacugaugguggaaaaggacuacuuuguggagaggauuagggccacgaugagaccguagaggccaagcaccuccgcaaagaugaggaucaggaucaugcccacgaacagucgaggcugcugggcagugccccgaacaccagcaucuccgacgaugccaauggcaaagccagcagccaggccacucagccccacacucaggccagcacccaguugaagaaaacuccuguagagggugaugccaucagucagggaguuagcgauaaguacugccaccaccaggccguagauggcgaugaucccagccauaaccacugggaugauggacuucaugaucagcucuggccucaugacugacauggcugcgaugccagugccgcucuuggcugugccauaggcggcucccauggcgcugaagaccauggcggacgaggcgcccaugacaccgaaaaacgaagaauauucgggguuguucuugaugucagccaugucugcaagcagggaaaagacaagcucagcgggcggcggcgggcuaggacaacgggacagcgagcgaggaggcaagcgaagaucgucgaggcagcggaugggaaagcgaccu

SEQ ID NO: 2912 - RNA, 97228 nt, Mus musculus
ugggacuccccagaauuuccgguaacaagcacgggagaaggaagacaugaaauauaauacugaaacucuaaaaccagaauugagguccccccccccccuuuugagacaggcuuuuacacugacuaaaaccuagaauaacuuugaauuuguagugauuuuccugccuuugccucuggaguauuaguauaggugugugcuaccacgucugccuuuuuuuuuuuuuuaagaguuuaauauucagguacuauggacacuugcagaucauuuauuuaguccucaaaaaaauuaacugcuuuuauucauuuaagaagcaaaauuaauuucacccuuuuccauugaggucuuuuaaaguuccgacaaauuuguaauuucucccccuuuacaucauucucauuaauucaucacagagauaaauucaggccacaaaaagaguaaagcugccugcacacucccccuuucacacaaugugggcucauacaacccgguuuugggucucuucucguuugcacguaacuuacuucuucauccucccguggcccucccacgaucuuacuccuuuacccauuuaagucuccaguaguaaaagcaguuuuccaagcaguuucuuaauuaaucaggcuggguagacugggcagagcccccgccccuugggcggggccauagcggcgggcggaacccgaugccugcucuggcuccuuaacaaaugauuccuuuacaaucuacagaagagagacacacacacagcgagccaaucagcggccgcgguccucgcguccggcggggcuagccccgcccacucccaaccucccgcgggggccguccgagccucgcgggcuucugcagaccccgcccccugggcaggcgcggcggucauuggauggcgcucggcucgcagucgccgcgguugcugggagagggaggugggggcggggcccgcggugguccaaggggcccgagagaaaggcugcuaggcacgggcgggcgcgcugggcggaaucgagcgucucgguggcgguuugccuaucggcccgcgcggcggcgucgcggugcgggaaccgguccccguugacagcuccgcgucuuccggccgcgccacucgggagguggcuuccucccugugcucccuccgcgaguccguucggccucggagaagcgggaggcggcggcggcugcggaggucgucgggggcggcgggcggugagcgcgcucccgcuuccccggcggcggccgcaggacaauggagguggcuguggagaaggcggcggcggcagcggcuccggccggaggccccgcagcggcggcgccgagcggggagaaugaggccgagagccggcagggcccggacucggagagcggcggcgaggcgucccggcucaaccuguuggacacuugcgccgugugccaccagaacauccagagccgggugcccaagcugcugcccugccugcacucguucugccagcgcuguuugcccgcgccgcagcgcuaucucaugcugacggcgcccgcgcugggcucggcagagaccccuccacccgcucccgcccccgcccccgccccgggcuccccggccggugguccuucgccauucgccacccaaggugagaggggcccgcgagguggcgggcgcgacccgcugucacgcggcuggggagggggugaaaugggcccgcgccggcugagcgacucggcggucccucacuuuugcagagcucugacgguuguggcgaguuagcugcucucugcuccuccgcaaagcuuuguccgggugcauaugaucuggaucagcucguguacacccggguuaugcgagccggaggggggaggaagggauggagaugaagugauggggauuuucuuugaugauugauugcagauuggcugccgucuguuucgaaucuugugcguuccgggcuuuuuaccuuaaugaguucccucucuguccccuccguaggggacaaaggaaccgggauaaguuguuuuguugucugcugcuuucggagauuuuauuucgagcgauucgauaaacgauagaaaguaaauagacuuccaaaguguuuuguaugccguaguuggaaguuacuuucucuuuugugguguuauuggguaauuaguuuuugacagguaguuuccuuugcuuauguuaccagguuuaaaucguugaaagugauuugaagugcaguaauuauuucugggagaacacuugaaguuuuuaacuuuuaauauugcaaauauuugggcaaauugacgucuuuaaaaugcgaaguaacugaggaagggaaaucuuuuuucucuugcuucuuggguuuuguguguguguguguguguguguguauguuuuguuuggcuuauguagcagcccagaauuguccacagcuagcaaucuuccugccucagcuucuucagaguaaagauaacaggcaugagccauugcaccugcuagccagacacuuuuaacaucucuuuuaaagggaauaacuguuuuaaguuaauuuguuaaguaauuauauuuauuaggucaggaugcaauugcuggcuuggauuguugaauuagaugcauuuaguuuuuucuuacaacagucuuuaaauacaggaaacuauuuuccaugggucucuauuguugcaggaagcccaccagagguacaccacucagucuauagcuaaaugaaaguauuccagccagcuggauuacaaucggguaucuagaaugcaaauguaauccagugguuuucaaccuguggguccagaccccuugagaggguggaaugaaccuuucacaggggucgcauaucagauaucuugcauacuagauauuuacauuuugauucauaacgguagcaaaauuaccauuaugauguaccgaagaagauaauuuuaugguugggggccaccacaacauaaggaaguguguauugaaagguggcagcacuaugauuaagagcuuuauaucuuuagagcaaggggcuuuuuuuuuguuuguuugguuuuuuguuguuuuuguuguuuugagauaaggguuucucuguguaacagcucuggcuguccugaagcuugcuuuguagaccaggcucaaucagaaguugcagaaaucugccugccucugccucccuaguacuaggaucaaaauugugcacuaccacugcccugcaaggggcuuucagaggcaaaaaccauauccuguuaucuugccuuguaguugcgagcaggagguuuugugcaagcaagcaguuuaacagaagcuaagauaagcaguuaacuggaggggaagauuuguacaaguggccaguuuaacagaagccaagcuagaguaucuugacuuuggguucuuagauuuugguaauuuuccacaauauucuccaucaaggaagccaaacuuuggucaaaccuaaaauagucucagcaaaauauaagauaggggaaccucaguacugucuugccuuuucauauuaacuaauugguucuaugggcaagagucaaauaguugacuuguacuguucuggggcaugguugguucuaaagaucagaagcuuaacuaaguuuauucucuguuugauauauuggacaugcagaugaaaaugcaggguucaaccguuagcugcaucagaggugggagagggcaggacuccuuuuccaaucuggccaaugcuguggcaaguuccugcuaagccugugaggacuugcgaagggaagggaaugauuggauauuuuugcuuggugaauagcuuggaguuuggaagaugggaaguggucccccaaauauaauuucaaaaaggaacaguccccuccugguaaggagugcauuggguccugagcaggagaggaaguuggccuaauucuugccaguuuucaguaccaauuugaucagagucuccuaaagaguuuuauucauccuuuuugccugaccugggcucuggucuauacauucaaugccauuuccaauuaauaccuuugucagaauuugagacacuagcuuuuguagaagaauuucaauccagcaacauggguacucuggcaagagaucaaucauauccaaggauaagauccagcuggaauauagacaacuaaacaccuuugaucccucuggcuggaauacaggcaggcccuuaguacauaccuaugauccuucuggcuggaauacagacacaucuuuagugcaccacuuuuaauccaaacagugaccucuaauuaagaggcagacaaagugauaaaucagagaaagauugacagaacaagucagagauaggauacacccaacucucacaagaaacaggaaagaaaggcuacuuaaagagcagcgaggaagagaggggacuaaauuuaguucaguucaauguacuuuaguuaugaagugagagguaguuuuuuccaagcagaggaauucagucagaagcuaagagaagccaauuugaaucagucagcuuggaagugaauauaagcuagaacagcugaguuaaaccagcagccauccagaguucagaaaaagcuagaaaggaugaauuuauucaucagcaagucucagaggcuaaaauaauauagaccuaggauagcagacagaggcuggaagcugaaggcuucaguguucagacuugcagaagauaagguugaauggaggcuagaagcuuccaggcuuaggccuagggauuuagaaaugcuccuuguauuccuaaaccuugggcauggcucucaucccauccauuugucugagaaaauaaaaauggcuuuuacauuuucaugguaugaaggcagccgaaccccaaagcuagagacaguccaaaccuaagacuucccgaagaaguuucuuaacuauuggugcacucucuguuugggugguguaguucucccccccauccuaagaugucuacaaacaccagcaaauauuuauagacuuuauuucaguaaaguccaacuccuaguuuuucccaggcccauuuccucaauccuggaucccuugugggaucuuuuauucuugguuggaguuugucucaguaccgguguuacaucugaaggugguaucuuuaauuagacuuucaaauucggaacauaauacuugggucugaagaguucguuuucuuggcuccuagaugugugacuugauggagaucuauaacuauuggccuucuacaacucagggggaaggauggauccacuauccagcagcaucucuauuuauccuguguggcuaguucuuguuucacccagucauccucgccuggaauguguucuaagugguuccaugagcugggcuguggcagggcuaccaaaacuugaagaggacccauugauucuagggcuacuucccaaguggcccuaguuaacucuggcuucuggggagucuccuuuuuuuggauacuuuccaagggauauuagccauccguuuggguaaucagauaagguucuaguauggcuaagauugcuucuguguuugauuacuuuuccugcuaagguuagcaauucuuuuucucuguaugagcccauaggccugggccacggugaaagcauauugcugaucaguguaguugaugauaguguugucuuucucccaguauagugcuuaggucaaagcuaaaaucucagcuccucgaggugagguucuccugcuuaaagacuguaaaaguaauuuaucauucuacauaacugucgacuuagacuuacugcugauaagcucacucuuucuauuuuucuuuauuuuuuuaauuuuaaaauuuuuuauuaguuauuuucuucauuuacauuucaaaugcuauccugaaaguccucuauacccucuccccgcccugccccuccacccacccacucccacuucuuggcccugguguuccccuguacuggggcauauaaaguuuacaauaccaaagggccucucuucccaaugacggccgacuaggccaucuucugcuauaggguugcagaucccuuuaacuccuuggguacuuucucuagcuccuccauuggggguccuguguuccauccaauagguaacugugagcaaccacuucuguauuugccaggcacugcauagccucacaagagaccgcuauaucaggguccuuucagcaaaaucuugcuggcauaugcuauagugucugcguuuggugacugauuaugggauggaucuccggguggggcagucucuggaugguccauccuuucaucucagcaccaaacuuugucucuauaacuccuuccauggguauuuuguucgcuauucuaaggaggcaugaaguauccacauguuagucuuccuucuucuugauuuucuuuucuacucuuucugaacucugacuggcugguucaacucagcuguucuggcuugaauucuccaagcugacugauucaaucuggcuuuucucaccuuuucacugaauugcucugcuuggccucaaacuaagucugguacuuuguuuuaaucuucugcuuccuuauucucugguuucaacggucucugcugaccugcauugaaaauugcaugacuucaacuccacuccacugaugcucugaacucccaacucaacuguacucagugaacggauugaacagaacugacagaacucaagagaucugcaugccucuucugucuucugaguguugggauuaaaggcauguaccauugaaggacucccgaagagagacccucacucaagucucgggaauagcgcgcacccagcgagacacugagaccgaacuugcuguaaucacacgaggaaguuuauuaacagugagaagacgggacaugagcucaaaccagcaugcuggggcagagacucauacaccacgcaggggucgaggaguucgacccugacccuauuuuucagcaggcuuauaaaggcaaaaaccacaaaccagggggaggauuggggaggaaauagaggaagucuaggggcggauauuuguuucaaggcaccugggacauugaaacauucugugguuauuuuucucaaaaguuccggguguuuaggccaccuggcaguaagccgggguccagggugaaaaguucauguucucaggagcagucaguaauuuuccauucuucaccauuaugccugaaccugaguuuuucuuucccugaaacuugcucuauaccaggcuggccuugaacucagagauauguuuccuucuaucucuugggauuaaaggugugucuguauuccagccagagcagccuuguugcuggauuaaaauuccuguacaaaagauugugcauagauaaucuuauauugggccacugcugcuacuccugcauaucugauuccaucuugaacaaaacugcuuccauacuucauuugguaucaccagugggguguuagaucauuccuuuuuuuuuuuuuuuuuuucccuucgagacacgguuucucuguguagcccuggcuguccuggaacucacucuguagaccaugcuggucucaaacucagaaauucgccugccucugccacccaagugcugggauuaaaggcuggacuaggucauuaacugcaggacagucaugcagccguuccaugagauuaucguccuacagcaggcuuggcaggguugagggcuggcaucuuauggaaccaaaugcaggguugcucuaguuaguagcagggcuuaguguugaguccccucaucucacgccaggcauuagacauccauuucucagguaucucccucaagagggccucaaaagagcugucaggaauaguucuugcccuaauguuaauuugucaacuucuuuaccagcaagguggaggcagcuaugaccuucauauaugcuguccaucugacugugauggagucaagucucuugaacagauaggccaccagucuuuuccagagucucaggguuugugugaggaucccuggggaaugccucuggcuucauccacauacaagugaaauggcuuagucauauguggaagggcuagggcauauaccagagcucuuuucaaagcuuugaagaaggcccccucuuagucucaguccauuccaaagagcaaaucccauguccauagccaacaauaucuaacugcccccaggaauuuccauaccuguuuguuuguuuccagugauuugcaggauggcugaaauacagucauaggaaagcauguauuuuccucccucuagguuguagccuaguuaugugaccugagggaaguacaguuggaccuucuuggcugagacuuuguacccuggggccuggagggauucuaaaaggccuucuuuuggcucuuccucuucuucaguggaggagguuaucuacauacuggagcagguugcucuguaaacuuucuagauaauuuccaaaaauugagacuuacucauucuuucaaauccuucuaauuuuugcagcuuucuccuuaugucuggaggagacugugugauaaagguaauauuaguggcucacuguuuuucaggggcaucuggguuuaugggguaaacaccugauaugccucacacaccuuuuccagacucagcaggcaauucauuaucagguccuugaauauucggacuuggcuuggauaaguuggcagguuuucuggcugccacuuuuaauccuuccagugauguuuggcaagaagugaccauuacauucuuuauugauauuagaaucucaacuggguuggauggaugggaaaguucacucuauuugggccuuuguguugggaagugaccugccacccagccccagagcaaguuucuauccagccagauuuagguguccuuggcuauaaacaggguggccaggagcuccuggcaaucagcugauguguauaaaagucagcugauguauauaaaaagucuucaauaggcugauaagggcuuggggccucuccuaaaagggaugguuugggcuguuccaauuauaauauaaaucaauaauauuauauuaauucccuuuccuccuccuuccucugguuuguagcuugguccucaugcuucccuuaaggggauggucucauagcccagauaaagcuugucuggccuccccauggccagaggcaugauagggagggggagaagggaccagguguaguagaguuagcuuccuggccuucccucuggggagaaccauuuucucuagcuccuuuuguauuucccauugguccagucagaacauaaagagguggaauguccuucucuucuggugagcagggaucaauuagcugggguaucgugaccucggguuccuagaauagaguuuagugauuuuccucugggcuuuuuacaucaaggagaucuugucaaacauaaaguggccugggcaagaauauagauggaggaaccucugcacugaguugcuuugucacaaauacuugaguuuaugcuguugcuauuuauaauaaaccaccuuuuuuugucucuaauccuugaguuacuugccauugucauaagaaacuuacuaucugugaaacuugggauucuuuauuagguugcaggaaagguggaaucucauaguaguuugucucaaaggggcuugcuugcuggaaagguaaugcagguauaacauuaaucuuauucuauguaaccuugggugaccucugacucuugagugcuagguucaaaggcaugcuuuaucaggcucaaaucuuaaucuuaauugcaauaauguuauguugaugcugaggaguaagccuuguaaauauaaagcacucacuaccaugaagcucccaguuuuuaauucuuagauguauuuuuguauuuaucuucauuccccuccccuagguucuccuuaaugcauaugaauuguuuugccugccugcaugucugcaugcauguauguauguauguauauauaacacauaugugccuggugcucauagaugccagaagagugugucagauucucuggaauugaaguuauagaugugagcccagguucucugcaagagcaccgagcacuucucaccacuggaccaacucuccagcacuguuaaguugucuuauacaggaguccuaaacauuuaauuuuacuuugugugugaguguuuuuccugcaugucugucuauaauguguacugcaugagucccugguauccuuugaggcuagaagagggaguuggauccucugaaccuggaguuugccaagaaaaagaggacagaaagaauucaagagcuagaaaacagaaauccugcaaaaugucaucuucuaggcagauauagccauucaaucaggaacuaguaacuguggcuacugcuacugaucuuguaccagacuagccuugucaaccaggaacggaggugggccuccugagccccuguguauccugcuacuauuggcuacugacaauucuagaauguacuauauauagguauagaauuauauaagaacaaaauaaacuaaaacacaaaaccacugggcugcuugcugccaagccugauuucaauccugagaccacauuaugggaggagagaaauucuaaauggaagucauugggcaugccagaacaaaauguuaaacaaucccacaggguaucuccauguagcucucucacuguucugaaacucacagagauccuccuaccucugccuccacaugcucagauuaaaggaccacuauccagcuuacaugcaaacucuuuacuaguggaugugacggcucauaucuguaauacuagcgugugugaggcuaaggcaagaagaucagucaccacagauucagccaagggcagccugggcuagaaggaacuuaccucaaauaacugaccauaagaaacuuuaaccugcuaugcagagguucauuugacuucuuaguauaaaaagaucacaccuaacaagcaagcaugggacuuugaccagguuuccagucuuaggaggcauggauuuccucuuaagguuuccagucuuaggaggcauggauuuccucuuaaggaauaugccucaaauccaaacagaaagcaguugguuacccucauaacagucaugccauuauugcaguugggcaucuuuccaugcagguuaauauugcacuucauacggcucauagcuccaugagaccuuugauuuccucacccaccuccgaaccccaagcauccugcguagcauuuucuggugucugaaaaagcuagucagaaaaggaggaaugcuugacuucuccaugucuuggaaucccagugucuggugucaucagcaguaggguuuuguuuuguuuugagacauugucuuucuauguagcucugacuguccuggaauucagugauuauucaccugccucugccucccaaaugcugggauuaaaguguguguacaccaccaaggcuggccuuagcaauagagacuuaccaucuacauuugguguacaaccuagaggaagugcaaagucguguauuuggggaggauuucuauaucaguguguaucuuuguggcccucuuuggcaugagcaguaggcucucuuaaccacuaaacaaucucucagaacucugcacugagauuuuuauuuagaugauugcuucuaggacuagcauugaccagcuaugcagguuaucuccuuucagauucuuuuaugauaauauauuaauauguauguauguauguauauguguauauauacauacauauacauaccuauacauauauacauguauauauacacacacauacauauugauuggugauuguuuugucuuaauguaugucugcacacauguaugcuugaugcccuuggaggccagaagaaggugucaagauccccuggggcuggcauuguagacuuuugugaguccuccaugugugugcuuggaauaacauuuacuuggucaucaccauucuucucaugaauuugugaguacaagcaucaugagucaaacaguaucuauuggcuaagcagguaauuaagauagagaaccacgaaucuaaggauauauagccuaagcuggccucaaguucuuuauccuuuugcaucuaccucccaagugcugacauaagaguaugccauacuucaggaugucaacuuaaaacaaagguagcaggaguaagggcuggagagaugguucaaugauuuaagagugcuggcuacucuuucauaggaccugggcuccauucccaggcccuguaaagccauucacagaggucuuuaacuccagcugcaggggaucugaugcuacuugcuggauucugcagacacuguguacaugugguacauagacaugcagccagaacacucauacacauaaaaguucauauuuuaaaaaguaucagcaguagaaauuacagauuuauuaccaucauaaucacuucucuagagcccucauccaaauugcuuuucuaaggcuauuccuuaaaaaaaauaaggauaaucgucuugacuauccuuuuguuuugagacaggguuccucugucagugaccuggccucacacuuguaguuacucugcugucuuccaagugcuaggauuacaggugagucacaccugucucacugaaaguuucuuaauauccaguuuuauguaggaagaguuaagauuuuuuucccccacucuggaauauuagcuuggguaacuaauaucuuagagaaauguuaauuuaacaugguggcaugauguccagcuagaguaguaaacuauuaagagcuacuucuaacgacuaaaaagcacacuuuugauaggggucaauuuuuuuucccuucugggaauaauaaaauacaagaacucaguuuguggguuuuuuuuuuguuuuguuuuguuuuuuguuuuuuguuuuguuuuuuuaguuuugcuaguuuuguuuagaagauuuuguauucauuuuaaaauuauguauaugugugaauguguaccaugugucugugggugccuguggaggccagaagaggcugucaggucccuuggagcaggaguuccaggcaguugugagcugcugagggguccugggaaccaaacucuaaaagagcagcaggugcucuuaacugaggagccaucugcuuuuccagccccaucacuguucucccacccagagucucuggaaugaauggcaggccacccucccaauuuuguuaaccgaaagucuacaguauaggcacaguuugggggaacugucuugucuucuucaguucaaaacgauaucacauugucccuaaaauguguauuuaucuccucugacaaaagguauuuguacucuguauugccaagcugaugacuaaugugcaguacaguuaauaaauuuaacuguaucauuuuuauaucucaccaguuuauuucuuuucuuaggauuucucuuuuuuuuuuuuuuuuuuaagauuuaauuauuuaauauuuauuuauuuauuuauuauauguaaguacacuguagcuguccucagacacuccagaagagggagucagaucucguuacggaugguugugagccaccaugugguugcugggauuugaacuccugaccuucggaagagcagucgggugcucuuacccacugagccaucucaccagccccaggauuucucuuuuugauccuuccuuccuuccuuccuuccuuccuuucuuucuuuuuuaauuuuuuauuuauuuuaauguaugagauaugcucugcugcauacauaucugccugccugaagagggcaucagaucccccuguagaugguugugaaccaccaugugguugcugggaauugaacucagguccucuggaagagcagucagugcuauuaaccucugagccaucucuccagcaccaauccaucauuuucuuuagauguuucucuuguucaguuaucucugcauuucuuagguaaauauuuuucuucuccuggaaagguaaaagaaaaauuuugcccaacucuaauucugggucuuucauugacuagcaggauauaucuuuccuagggcaaagugcuuuuuagcaauaaaaaagcauuaucuuuuaaauuaaaaauuugauguuugaaauucuaaauaugccuuuaguauaugaauaaauaugccuacauuccccuuucucuuuauacuuucucuuuauauaaauuuaagagugaucuuuuagauuauuaaggauacuacuauuuauuuugaaacucuuaaguauaccuuaguaugugaauaaauaugccuauaugccccuuucucuuuauauaaacuuaagacuguuguauaucuuuuagcucauuaaagacacuacuguuuauuaaggaaaaaccuacauagaacccuuaaaagaaagucauuuugaauuucagacugccguuugcaaguggcuuuuucuuaucagcagacuaucccagccuuacuucauugucuagaccacuauggucuagaauucagagguauccugagugcugggauugaagguguggguugccaccacccugcucaaauacuuuaccccaucucuaaaucauuguaacucuuuagaacauaacaaauuugaacuguagugguacucugaauuuacuuaaaaccuaaaaaaaaaaaauaacccauuuuuugguaacaccacaccaugaaaucguuucuuuuuaaguugcuauacaguuaauacaugaucugcucuucacuucacaaggcagcaguggucagcaacucucugugucuguguccuuguguccuugagugugagcauugcuaauucuguuucuauuuuguugauaucuagaucauccuguuuauucuguguaguuaaaacugacaccauagcuaggcacaaguuugcagcauuuaaaggucugagucugacaaaguauagccuccccuuccucaaucaacucccuagcuguuuccauggggcagguuuguguguguguguguguguguguguauuguucccugacaucaacuguacuguuguuuuucugcaccucuaucuuccuuaguguuguucaugucagcacaugguuucagaaggucuuccuuucuucaggagaucuuuccugaauaaucuucauuuugauagaauccacagcuuucuucucuuauggaaacaaagacaaaaccucuuccccaaagcaacacauuuucuuccuuccauucugaaauuauggcaucccugucauauuucaguaguuuuuuccacaauucauugucuuuucagcagcuguuguuuugcucauuagcauuuaaaauauaaauuuaauaaaguacuauauaaucuaucucuggagagggcauuguuaccucuuucuguuuguuaagcaucucuuagagaaugauuagaucuuucuacaacugcuuguccugugagauuguguuaccugccuguaaugugcuuuuuguugaaguaugcaaaaaaaaucuucauuuuaugagaaaucuaugucagccuuaguuuguagguauccccauaauaguccuaacuucuaguaaguguguaauuacagaaucgcccuuuucagaacuuaaaccaguuaccauugaacaauuauacaauaaaauguacauacuuuaauaucccaaacucuuuaaaaggaaacacauuuuccaaauaucuuuuuuuccgggggguggggugguaccuuuuggguuacuucuugcaggcaauguaguuuuguuauacaaagaacaaguaggacauugccuuacuuccuugccuuguugccaagugauagaaaaaaaucuucaaacuuuugcuacuaauaucgugauucuucugaaauuaugagacuucuaacauauuucugguugauaacugagcacugucauuauuacguugugcuagauguguuacauaacggaugauuuuuauuucuaacugcuugcugaaggugaauaaauaagcuaauucuaaaugaucuggaauaaauuccacaguuucuauauguaaaacaacccuuuuugcauauugaaaauugguaacaauacuaggagguccagaaaaauuaaauaauacuuuaagaaugguauauagcucugguuuggggggggguuguuuuguuuuguuuuaagauuuuauuuauuuuaucuacaugaguauacugucacugucagaucuuauuacagaucucuuuacagaugguugugagccaccaugugguugcugggguuugaacucaggaccucaggaagagcagucagugcuccuaaccacugagcuaucucuccagcccagcucuaguuuuuugaacugcaucauaagggcucugagucacuuuauuuuuccugacuuaauaacuugccuucccugauuuauuugcauccauauagaauguagguguuccagaaauuggucugccuuuuacuguaugagggagaauucaauuaguuccuuuuauaaacugaagucucuuauuucagggauauuuguuauuaaucuuuccaaaaaaauuacugcaagcucuugucgguguucauuuucuccccccaucccccaccccccaaugagccaaauuucagcauuaguaagagguaccacaauuucugcugguucuacuccugguaacugaugaacuaacacacucucucauucucucucucucucucucucucucucaauuucagaaucaauuuggcaaccuuuucuacacaggucuuuuaauuuuuaacucugugagcuaaaaauauccguucuaagauaucaucuucucucuauauauaagaauuccuaugagagaaugaguagaaggcagaauaaccaacauacaguccagcuugggauccaagagacccacacgugcaugccauaguuccuuuucugucagagccaauucucuuucagccucagcugauaaauaaauuacuuagcucuugaguaguuagucuaguuguggacuauagccaguuauuaucucccaguaacuuuugaaaaucaucaagaguuuguuuuaaucucccuggauuuguacuuucugugguugaguuuucuguaaaccuagcuuauauccuagguaauaaauaguaucgccucuuuguauuuuuuucaggagcagcuugaaauccccagcaagacauaacuacuuacuuaaucaaauaucauuucugagauugaagguauauuaaucuguguuuuccauugcugcaacaaaucacauaaccauaaauucaugacuguauuagucacauaugguuuuaauuuuccuauuugaccuucuggcccuaugcacuuaggccaucucacacuuuguuuuaccugagauaaaguuccaacuccuugaaaccgaauauuuaccuccugaagaauccagucuggaagccaagauuuugaugaaauuauuguuacauuugcuucugugucuaccauaccuucaauuuugauaucauuuauaaauauuuuuaguuuugaccucugaucuucuauaaggguuugcuaaaauacuuguuuucuggucuccuaaguuuucuguuugucuacuaaagcugcucugacuuugacaucugggccauuaaugguuauauccagagcagugcuauuuaauugcucugcagauaaguuucucuuauuuuccuuaagugauuaguuguagcagugaauaguuaaucugcacugagcucagcucacucuguacuccccuaacuaagagcucuggauucacaaaugaaacacacacacacacacacaccacacaucagcugaauuuuuaauaugccuaacuagcucaaugucuggauacuucuaaaccucccugcagcuaucauauacuccccucucguguucuugaguuaauauuuucuaaaucuauuuuuuaucuuugguuucccagacucaagcaggggaguggccccuggggccaauuccccggauucuuacaugucgaugggccuuuaauucagaucucucugcuucccugccauggugauucucccugcucgucuucucccuugguccuuugcccaugcacucuacaagucguaucuccaucuccuguaugggauccucagcaucuggaagcagggcuuuugggagcugaauuaagacaaagcauuagaacuaauuuucaucaaucagugauauuuggguccuaccugaugccuuuuuuccccccacccccucauguuucuucuucuuagcauacuuuagcauuauuuuuuuguaguuuacacuagccugaaacuauaucgccaaaaauguucuccaguugucuauguaguggaggauggcucugaacuccaucucuugccuccuguaugcugagauugguuaugaacacacauguaggugcuacuguuaaaugcggagucagcccuccagcuccacuaccugccuggcacagccagggaagcaaagauuauuaagggagcagccaauguuucucugucaccuagacgcucaaaauuucaaacuucuuccuguaacuugcuccccuuuucauguuuuaauucuguauuuucucuuuuuuauuguuuuuuauucauacauuaaugauacagguuaauaggcuucucuuugauguccccaugccuacauauaucuuucauugguuuuggugauuuuagcacaggaucuugauugcccaggcuagucuugagaacuguuguguggauucaagugaauucucaucguggccccccaaacaccuaagacuagcgcuuacucccccauguccugcucagguuuuuguuauuacuguuuuugagaucuuagagcucugcuagcccaggcuagccuuauuagacuccuauguagaaggugaugaccuugaacuucugagccaccugccucugcccgggaugacaccaguauuacacccaguuuuauguuucguuuugcugguuguguuuuuuaaugcuuuuuccaaacacauacauaguagguaggcauuacuaauggagcuaacuucccuagucuagcccugcauuuucaauauacacuaaagaaguagucuucagaaugagaugggcuaggaguucaacucagugguagggaauuuguguaacauguacacagccugcguuugagcuguaguacuuuagguaugagaugauaauaaguagauuaucauacucaugugaaaaagaaugcuacauuucauauaugcuaugaugaguaucgugaugauaggaguugaggcugccacaaacucuaaugguagcuuugugugguuuggauuaaaaaaaaaauccuucauaauauucaaccuuccaagcacuacagcugcucuaaaguuagagaccuuuauauacuguagucccuuuuguuuuuuccaaacacccaacuaucauuuauaugugauuggauaaguaggccuauauaaguugauauauauuaaaaugacuugaaauuuaagauuuuggguagccacuuccaauccucugccauaaaaccuguaaucucaguucauacagaaguugcauguggaggcugcuuacaaaaguaggauugguaaagaucuuuucccagucaguugguugcuguuuugucuuauugacaguguccuuugcuuuacagaagcuuugcaguuuuaugaggucccauuugucgauucuugaucuuagagcaaaagccauugguguucuguucaggaacuuuuccccugugccuauguguuccgaggcucuuccccacuuucuuugcuauuagguuuagaguaucugguuuuauguggagguccuugauccacuuggacuugagcuuuguacagggacauaagaauggaucaauuugcauucuuuuacauguugaugccaguugaaccagcaccauuugcugucuuuuuuccacuggaugguuuuagcuccuuugucaaacaucaagugaccauagguguguggguucauuucugggucuuuaauucuauuccauugaucuaccugccuaucacuaugccaauaccaugaacuuuuuaaaaacacaauugcucuguaguacagcuugaggucagggaugcugauucccccagaaguucuuuuauuguugagaauaguuuucacuauccuggguuuuuuguuacuccaaaugaauuugagaauucuucuuucuaacucuaugaagaauugaguuggaauuuugauagggauuacauugaaucuguagauugcuucugacaagauggccauuuuuuacuacauuaauccugccaauccauaaguaugggagaucuuuccaucuucugagguuuucuucaauuucuauguuuagugacuugaaguuuuuuuuuuuguuuuuuguuguuuuuguuuuuuguuuuuguuuuuuuuuuuuuuugguuuuucgagacaggguuucucuguauagcucuggcuguccuggaacucacuuuguagaccaggcuggccucaaacucagaaaucccucugccucugccucccaagugcuaggauuaaaggcgugcaccaccaccgcccguugaaguucuugucauacagaucuuucacuuguuucguuagggucacaccaaaauacuuuauauuguuuguggcuauugugaaggaugucuguuuccacuaaauucuuccucagucuguuuuuccuuugaguauagaaaagcuacugauuuguuugaguuaauuuuauauccgguuacuuuacuaaaguucaucagcuguaggaguucuuugguagaauuuuuuggggucauuuaaguauaccaucauaucaucuccaaacggugcuauuuugauuucuuccuuuccaauuuguaucccuuugaccuccuuuuguugucuaauuucucucacuaaaacuuugaguacuauauugaauagguauggagagagugggcagccuugucuagucccugauuuuagugagauugcuucaaguuuauuuucuccauuuaguuugauguuggcuaauuuuuccccccaagauuuauuuauguuauuuauaugaguacacuguagcugucuucaaacaaaccaguagagggcaucagaucccauuacagaugguugugagccaccaugugguugcugggaauugaacucaggaccucaggaagagcagucagugcucuuaaccaucucuccagcccuguuggcuacugguuugcuguauauugcuuuuacuauguuuagguaugggccuugaauuucugaucuucuaagacuuuuaucaugaagggguuuauuugucaaaugcuuuuccagaaucuaaugaaaugaucauguggguuuuuuuuuuucuuucaguuuguuuaucuaguggaguacauuguuggauuucuguguauuaagcuaucccugcaucccugggaugaagccuacuugaucauggugaaugauauuuuugauguguucuuggauuuugcaagaauuugaguauuuuuauguugauguucauaagugaaauugguuucaaguucucuuucuuuguugagucuuugugugguuucaguagcagggugacaauggccauagaaugaguuuggcaguguuucuucuguuuauauuuuguggaauaguuugugaaauacugguauuagcucuucuuugaaugucugguagaauucugcccuaaaaccuucuggccucuuuugauugggagaugguuucucuuccuauagggacuaugggacuguugagauaguuuaccugaacuugacuuaauuuugguauguggugucugucuagaaauucauccuuuuuuuuuuuuuuuuuuuuuuuuuuuuuucccuucagauuuuccaauuuuguggaguacaggcuuuugaaguaagauccuaaugauccuggaagguuuuauucaauuccuucaccuguuugguuguguuuuccuguaauucuuuaagggauuuuuuaaaauguuuccucuuuaagggcuucuaccuguuuauccguguuccucuauuucuuucuuuauuucuuuuuuuuguuugucuuuguuuuuguuuuucgagacagggcuucucuguauagcccucacuguccuggagcucacucuguagaccaggcuggccucaaacuuagaaauccgccugccucugccucaggaguacugggauuaaaggcaugcgccaccacgcccggcuccucuauuucuuuaagggaguuuuuuuaugcuucuuaaaguccucuaucaucauuaugagaugugauuuuuaaaucaaaaucuugcuuuucugguguguugggguauccagggcuugcugugguggaacaacugguuucugaugaugccaaguagccuugguuucuguugcuuauguucuuguacuugccucucaccaucugguugucuguggugguaguuggcuuugcugucucugacuacggcuuaucccuccuugcaagccugugugucaguacuccugggagaccaguucucucugggagaaauuuggguuauggagugguguggcauaggguuagcuccaggaugcagauggaaaccggaaggaucuuguucccggcuauuccuugguuucuguguccugauagcucuggugggucccucucuuuuaaaauuccucuggcaggauuuugagcagaaaugguggucuuaccugugcucaagguguaucggcacuccugagagaccagcucuuucuugguuguauuuggauauggagcgcuguggcacaggaucagcucuuggcccauacagaaaccagaagaauccugucccaggcugcuccuugguuccuguguccuaaggucuccaggugggucccucuuagcagaagcaauccgucuuaccuguguucacaggcuugucagcacuccugggagacccacucucucccuguaguauuuggauggaguaugucaacucugggugcugucuucuuuaagggauauaauuguuuugucuuuaagugcuucuaccuuuuugauuguguauugaauuucuuuaaggaaauuauuuauauccuuuuuaaaggccucuaccaucuucaugagacugggauuugaggucgcaguguuuuucuuuagguguguuaggauauacagggcuugcuguaguaggagagguggguucagauggugucauauuguaugggcuucuguugauuauguucuuucgacaucucuguugcugguuggccugaauguucugaguuggauugagccucccaggaggaaugucucagguuugagcagaccuccugggagucagacaguugugggguaaagggggagugcugcucagugccugcugcuggugcaggugggaaccagaaggaagauagaguuccagcuaggcaggguagagcccaaaacugcuaggcuugcugggguccuugcugguggggguguugagguggggaggugggggugugucccuuguauguguuggguuagagccuggcucuugggaggcaggcacugcuguggugugggacucuucuccucucucccaccauugucaucguugucuucgccuucuucgccuucuuucuucuucuucuucuucuucuuuuuucuucuucuuucuucuucuucuucuucuucuucuucuucuucuucuucuucuucuucuucuucuucuucuucuucuucuucuucuuucuucuucuucuucuucuuccuucuucuucuucuucuucuucuucuucuucuucuucuucuucuucuucuucuucuucuucuucuucuucuucuuccuccuccaccuccaccuccuccuccucuuccuccuccuccuccuccauucugugagcagaugaccuggugcuuuggcucauacaaucuuucugcucccucuucucaguauuuacugagcccuaguuuuagggauuguaauagacauugguguugggcccauuuggauuacuuuuaaaggaagaggcaguuguauguuuguguaaucucuuuuguuuggguaguuuagaacaccacgcuaccuugaagagguagaguuuagaaucuauucucucuuuucuaucuccuucucuucucccuuccuguuucucccucuccccccaaaagcuuucaacuauguuacacuggcuggccuuguacucaccaaggucauccaccucugacucucaagugaucaguuugaaauggcauuaaaggcuuuaaugaauauaucuauuaaaauuuacuguacuaagagaacuacuuuuuaccuuuugggcagcaauccaaaaguuuaucagcaugcucuaucugaaacuuugugaaacuagauagcacgcauuuacagugaaggugcauuugacaguuuuugaaauguuggugauccuuuuaucuuugacccacaaacccaauucuaggagucuauuuuaaaagcacucugcuacgggucuaaagugguauguagacaguuacucacugugucuucuguaauacagaagauuaaaaguaagccauuagagauguuguauacagggauccuaucacccagugugugugugugugugugugugugugugugugugugucugagggaauaacaaaucagaucuacuguauauuuaaugaugugaaaugagucacccuaauacuguaugcgaacaggagcaagcugcaggguaguauauauaguagguagcuacuuuuuguguaagaaaaauacuuuuuaaaacaaaauuuaaauauuuguaaacuagaaaauguuuaacaaaaugguuuaauaaacaaaguaaugaaaauaguuaccuaaagggaaauaaaguuagggcgugaaaagaugaugaggaaagaaguuugaccuuugaacucagccaauauuuuacauauucaugcacauuuuuuuuccuuuuucuuuuuuuucuuuuugguuuuucgagacaggguuucucuguguagcccuggcuguccuggaacucuguaguccaggcuggccucaaacucagaaauccgccugccucagccucccgagugaugagauuaaaggcgugcacuaccaugcccggacacaaguuuuuaucagcauagaaaguaaagucuaaaaguaaaugauuuuaggaaacuuaaaguuugcugaguugguagcauaucauuggauuuuacugucagguuuguaauagcagacuuacuuaucacaguauuuuucaaauaguacaauuuauucaauauuuaaaaacaaucacucaguuuaggaucucucuuccauguuuuuauuaccuuuucugccccccccccccaccauuguguguguguguggggggggggggaggaaugucuccuguagucuaggcuagccuugcauuauagauccuccugguugcuaggauuaugggccugugccauaugccucgcucgcugacuggaagguuuugagggguagcaaguggagcggggaucuugcuuucucuugucuucuggccuccuuuguugugcauaagagucuugccuuuuuuuuuuuuuccaugauaauuuauuccuuuugauuucaguuuuugcauauuacauauuuuucauucucucuuggauucacucauccuggaaauuuuucagaauuauuucauuucuucagaauucuugcccauuauauuuucuuucugaaauucuggcuaaagacuuguucuguauucuauguguauuuaucucuggaguuuuguucuaccccauuguuuccaauacuuuuaauuauauguuuauaugugugucugaguguggguuuaugcacaugagugcagugucaguggaggccagaagagggcauuggucacuuguugugagcugccuguugugcgugugggaaacuggagucagagcuucuggaagggcaaguagggcgugcucuugaccaaggaggcuugaaugucacugagcuacauuacugaaguuauaguuauggagacauaaagugcgaguccuucaaauuaauuuucuaaauuauuguucagguagaaauacacacacacacacacacacacacacacacacauauauauauauauauaucauuaauuuaaaaaucauccuuuaaccaugaguuauuuggaaauauguauguuaguauuccugcucaaauugaaggaauccuaggacuugggaguccaggaaccacacaacucugaggugggacagcauccuaaugaacggguauccugagacaugggagcccaggaaccacacaucuuugagagcaagccuccucagcagaggcgcaucagccccagggagcuguuacaguguaauagcuaggccucacugcuccuuuucagcauugcagcucauaggagggcaucuccaacugagcuaaggaggggaggagccucagcccugcuccagucuuagcuuccuggcuucuugccaucagucacacuaggcagcaaaaaagacuuauugagagggacaaauccaggguuggcugccucucccagaagacaacauggaacagaacuguacugagggcuuauauagaguuucuuuguguguguguguguguguguguguguguguguguguguguguuuaggugggggguggauuuccagggugaggauuggugggauuucaaguccuaagcgcagggauucguggauuuuccuguucagagauuaguggguuuuuuuuuuuucuuguagggcaaggccuugucagagccauuaggggauucuggggguuagugcuuggcugcuggagcuucucaggcagggaccuggucacuuuccugccuugagaguguuacacaguaugcaaaguuugcaaagggaguuucccagcugcuggagugugaauagccaacaguuauauucuaagaugaauucauuuugaugaugacgcaggcuguauguuucaguuuauuuuacuuuacuguguguaaguauuuggccuuugcaugcaugugugcuugaacucugugcacgcugcugggagccaaaccaggaccucuggaagaagaacuuuuaaccacugugccugccaucucuccaacucuauaauucuuugaaaacauguuuuacuguuuagcauguauuacaucuugaugacuuuacauucacacuuaaauuuacauucugcuaguguggggugacaauaaaugucauuguaucaaguuauuuaacuuaagucuuuuuaauuagauauuuucuucauuuacauuucaaaugcuauauccuuuccuaguuuccucuccaaaagucccuuauacccuccccacacccugcuccccaacccacccacucccacuuccuggcccuggcauauauccccccccccccccccguacuggggcauauaauagcaagaccaagggccucuccucccauugauggcaaaguaggccauccucugcuacauaugcagcuagagacacaagcucuggggauacugguuaguucauauuacuauuccuccuauaggguugcagaccccuuuagcuccuuggguacuuucucuagcuccuucauugggggcccuguguuccauccaauagaugacugucagcauucacuucuguauuugccaggcacuggcauagccucacaagagagagcuauaucaggguccuuucagcaaaaucuugcuggcauaugcaauagugucuggguuuagugguuuuaacucaagucuuauugcugauugcagguucuuaaagaauugaccccuuuuaugacuagacaguaacucugacuguccaggaacucacucuguagaccaggaugguccugaacucagagauccaccuaccucuuccuuccuagcacuggaauuaaaggcaagcuugaucccuccauccccugcuagacaguacuuucugaugacaauccuuguuguauagucuacuguguaugacauuaugguaaauuacacuaguuuuuuuaggagauuuguuuguuuguuuuuccuugugcagaagccugguuacuauuuuagcuugcuacaucuucuacugcauuuuuauuacuuacuuacguaaauucagugagacagaacaacacagauuacaugauggagguuuauuauaagaagauauaaaagggccagcagaaguuaacuauucacugccaaccagccccucaaagcuuaggaaagcaguccaagguagaugaagucuuguuuguauacugcugggaaggaauuauagaaaacaagcagguacccugaguauauaacccaguggcaguauuauucauuggacuuaaaacauugagggauauguuguuuccaagacaacaggaacagagaucugcauguuccagucagccccucauuucaagauguugcagcccuaauacagagaauuagaaaugagaaagaaagaaguauaaaauuucugaauaacuugucccuaauguauguaugaauguauaguguguguguguguguguguguagggggugcugaugguguguagcucagcagcagagcacuuggguggcaugugugaggcccuggauccaaucccuagcaucuuaggaaaauaguauaggagcuggagagagagcucagcagagagcacuugcuacucuugcaguuccuagcaccuaugcauuagcucacaacuaucuguaacugcaguuccagaggaucugauagccucuucuggccucugcgcacauuacacaugugaugcacauacauaugugcaggcaaaguacuaauacacauaaaauaaaaauauuaauuuuucuaaaggguguucuguugauauuaugugagucuuuugauagcacaugauuuauuccauuaacagauggaauacagugaugauaccauuaaauuauaccagugguuuauagucaucuaguguaccuaaauauauuguguuguuaacagccuaacaauacauuucucagcauauccccagcacuuucauaugguguguguauguguggaagggcguaggggguguguggguguugguagcaagccauuaaugguaugacugacuaaguacagaucacugauuuauacucuauacauuaacucacuuuucuccauagaugucagaauuuaugucuugacuaggaucugucugaucauuuaccucaugucacuugaucagaugcauguaaauagaccuuaaauccacauuccuuucauagaaaugaacaagguuaugcaugcuaaccauucuaaguuauaaacucugcauuaauagaagauaagacuaaaaaggcuaaaagugggauaucaagucaugcaucuuagaauccagaagauuaaaacauuuaaguuuagaugggcaaugaacaaaacauuuaaagaguuguuuuuguuagagaauacagaaaaaacaaaagaacauuuguagcguuaguaaguuauaagcaaguaguuucuuguuuaauuuguuucugaaauauagucugcauucuuuguguuaugaauugguaaaaagaaacaguuuguauuauuuacuuuaugauuucucuaaagugacuccuuccuugccuguguggcuucaaaugacuccuuaaaaauaauuuaaaaaaaaucuuguguuccaaauuauuccuacucuucuaggaugguguauguaauaaagaccuauuucaguuaggcauugguuauauuuacuguaugguaugaaaugucuuggcuuuuuguuagguuuugguuuguuugccuauuuuuuguacugaaauaacuaugauuugggaaugaaauugagggagaaguucaaauuuggguucuaaccacccccaaguuggggaggauaacaaagauaaggccauguugguucuuuugauaaaagccaguugauuuuaaugagaagauaaggauauaaugcacaccuuccaagguuccagcgcagcuuagaccuucauauacauuacuuauucucaacguaauccuaccgugaauuuucugauaaacauggaacacuuagcacaguaacuggaacacagcaaguuguagccgccagugugauaguucaguguuacuguuuuacagaaaacagauuuuuuuaaaggugauuaggagcuauaaacaauaaagaggguuaauguaggucaaugugguauauauggcuuuaaaaccaaugcugaguuugcuuuuguuauuguuaaauguuuuuguuguuguuguuuugguuuuguuuugguuuuuguuuguuuuguuucuguuuugugcuggguauugaacccagaaccuuauggcauguucuaccagugagguaugacccuuacuauaguaucugucuauuuaaguacuuuccauccuagcacccaggauucagaccauaaacuucuuucagaguaugggacuaugaguaaaucauaguaacucugaauauacuagaacugcuauggggaagguuagaauccuugggcucauacagaagcuaacaagucuuugacuuggauaaggucucuuucuuggggcuuggaagguuuuuauuuacuucaggaaagaguuugaaugucuuugaaggacccugcuuccuuuuucuagccauagccauuauuauaaguuuuuuguuacucauuauuaggcuuuucuucuagauuuauuaguucugugugcuuucuugaauuuucauuuugauguaguugauuucuuuguuucauaauauguguucauuuugcugcugucuagcuaucuauuauuugaauguggcacacaagcguauugcuacuguauagacauuuagauuguuauaaagguuuuuuauguaaaacacuacuggcauucuuagaacaugucucuagaugguaaaguaugauuuuuuuaacugugauuuuuuaauuauggaucacagauaugugcuuuguacaaagggaguuguuguacauguacaucacucaucuguuucaucagcaaguaggaaccaagagaaagcagucaggaucauaaaacuuccucccagaacacaccgcucaugagccuuugaccucacuggacacaccccucaugacucuaugaccucacuuggacacacuccucaugacucuaugaccucacuggacacaccccuguagauucuagaaccucacaaggaccuaucaugcagucucaccacuugguaguuguacuuuggagacccagccuuuaacaggggcaccuugggggccacuagcuauucaacuauggcagauauuuuugauuacacuuuuaucgguggguguggagaugcuugucccacaugcgcauguggaagucagaggauaacuuggaaaagucaguucuuuccauccuguguucgucccauggauaaaacugcugucacuggugaugagcaagguaccuuauccacuauccaccgagccgucucagcagccaaauucuaaaguggauguuuugcuuaagacaggaucucaguacguagcccuuggcuguccuggaaguuacuuuguagaccaggaugucuuucagggaucaucugccuacugggauaaaaggcaggcauuugcaugccuggccaauuuaaaauuuuuaaucuacucauaauuuuaggggccagguaaauuaggaauuuaaucauguccuuuuuccugaaugauaauuaguagccaccccagcaacuugaagaguucaucuguuuuccugcuaguuucuaguuccacauugauuauauauauauguuucugguguacauauucauuucuguuuuugcuuacuuuuacaaaaauaccauauuauuuaccuauggcuuaguggucauuauuuaauagacauggucugccaucaaaaugcuaguaagaauuagaaacauccuugaauauauagcuguauugaaagguuuucuucauuauuuagagguuuuguuuguuuuauaauacaacauuuucucagcagugaucucucuuaucucauaaaauuuacucuuaaguacuuaauaguuauuauaaaaguuuuuuuuaauuuaaauuuauaucauuuucuucccucccuuuccucccuccagucuuucccauguauaccucccauacucccucuugaaaucauagccucucuuuucuuuaguauauauuaugccuaaauauguaaauaaaccugcucaguccauuuaguguuuguuacuuguauguauauuauuucagggcugaccacuuggaauuagauagccaauuaaggggauucauccccaggggaaaacuuauuucuccucccucagcauuccuuaauugccuauguuaucccacuucucucuuagcaugucuauuaaggcuggacuacuccagaucuuguugagacagucauauuauugugcuuugucauuuccagcaggaccauucucacagcaaauuuucuggcccuuuagcucauacagucuuugugcccacucuacccugagucuuggccaugcaccccaugaucacuuguggucucccaggugguguuaagaggguuucuuggaugagggguaagagcuacauuuaucugagggugcugggauaaauacuuagaguguaguuuagaauugugcugguuuaauaaagugauggugguguguucuccuuuaaaauccaugaccucacccaucccuagcuuuuguuggauaaucaucagcucuuguggaggaacauaguccaagugguaaaaaaacaagacagacaaaacaaaacaaaacaaaacggaacuuaaaauuuguauuugcuucaguguugaggaucagacuuagaucauuacguaugugagaucucagauggauuuuuaaaauauuuuuaaaauuugugucuguguguguguugccuacaugugugucuguacaccauuuaugugcagugcccacuaagcccaguucccgagaaaccgguguuacagaugguugugaauagccacgugggugcuaggagucguacuuaggaccccuggaagagcagccaguguuuuaaacugcugaaccaucucuccagcucuaggauuuuuuuuuuaauguacagagauaaaauuggccuauggauuucuuuguauuuguucuuaaugcauuucgcuuuauaaauguguauuuguaucaaucacuuuccauugcuaugauaaaauaccagguagaaacaguugagggaggaagaagcccaugcuuacagauguuugaguccucugcuuuguugauucugggcccaugguaacuaacacagggaguguuuagaggagacuguucucuucaugcagucaggaaguaguagagggucugggaaccaaauaggauuuucaagaccugucucuacugaccuauuuccuuuaacuagcucuucccuccuaaaauuucuaaagcuccccaaaaugguacagccgcuaagccuucaggggacauuucacauucaaaccaugagcaucuguguaccuugcugaaguuuuuuuuguuuuuguuuguuuguuuuguuuuucgagacaggguuucucuguguagcccuggcuguccuggaacccacuuuguagaccaggcuggccucgaacucagaaauccgccugcuucugccucccaugugcugggauuaaagacaugcgccaccaccacccggccguugcugaaguuuugaucagugcuuuguauauauuauauguaugucugagaaagaacuuuuccccauagaaacaguuugcaucuauucaagaaaacauuaaaaauaaauauuucuaaauagcuugaggagccuuuaaagagagauguuugggauuccuauaauucugauucuguagguuuggagagauccagaguuucuuguucuauagaaaacaugggacauugggugcauggugacugacucaucaagaccugaucucaaauacacaaagaacacaaaacuacuuagguuuggaaaacagugauaaagagguugcugaucaguaagaacagaagccauugggugugugacuuaaaauucaaagggcuuguacaacauuuaguguaucuaguauauauaaaauuaauauauauauauacacacacacacaccacacacacacagagauuccuuaugaauuuagaaagaaggauaugaacuuuaaaagauuagaaacuaaaaccccaaacuguuacaguguaaaugagauguggaguccucaguauguuaaacuucaaauucauuuugucuuucccaguuggagucauucgaugcccaguuugcagucaagagugugcugagagacacaucauagacaacuuuuuugugaaggacaccacugaaguuccuaguaguacaguagaaaagucuaaucagguaaguguaaauucaggccuucacugcccaugaugaaguagcuuaaaugcugaaggaauuuguauaaauagccaaacuucagaacauuaauauacaaaguuacaucauuuuuaaguguacgaaugauagugaauaguugagcuuaggaauaaacagugccaaaguagagccucugauuuuaucauuauauuucuguaugcuagaaacacuaugcuguauuuaguauuucuuuguacugaguuacuagguguugaaauuguuacuuuagacuccuuuuuaaaaaagauuuaucuuuauguguauuaguguuuuuuucugguaagauuacuguguguguguguaaugcuuguggaggccagaagagggcaucacagccgcuggaacuggagguaaaggcaauagugaauuccuugaaggguguuaagaguuccaggucuucugcaagagcuagugagccaucucuccagccccagccuccuugaucaguaagauuucuacauuuuaacaaucauuuuuagugugugcauauaucuacauacuugauggcuauaaauaaauccgagaacaacuuggugaaguugguuuucuaauguuuuucuguguauucugggaaccaaucuaaggucauuaggcuugcacugacagguaggaaacagcauuacauucugagcugucucucauccccagggcuuuacguauuuaagaaaguccugcucaugguauugcucugaaagcuuuguuuaguagcauuguccaaggugccuauauacucuaccucuaucauguuauagcccugcuaaggugaauucucuugcaugugcuaaauagaaaauuuguaugcauacaacuuuugguucauugucucauagacaguuccuuuucuuuauaacagaagaucggggaaagaacuaaaucuaguuagaaagcaguuaauuuugucuauuguaugauugguuucugugcuuucuucccacuucuuucauuuucauuuuuguuuguaccagugggauuuagggcucguguuacuuauaaaagaacaaauacuaauuaaaauuugguuguuuuaaccguguccacauugcucuccaaaggccaaacugggcuugcuucagggauaaacuauuuccuugugaaaccagcuuuaaauaaaggauuggcuguggguuaccucagguguaguauguauugugcaggaaacccugggcuccuggccuuuucuaggggugauaauccagaaacugguuguggaaacuacagugugaucagcugcgucucuaggccucgaggaggugcuuuuuuccuacauugcugcuugguuuuuggguuuugguuuuguuuguuugguugguuugguggugguuguuguuguuguuguuguugguuugcagcagguucuugcagugcugcccagggugaccuugaacucacacuccucuugcuucucucccaggaugaccgguauuaccauaucuugcaucuuauauuuuguuucauuuaccagagaucuggaacagugcauaugagccguuccucacuccuucuuguagcuucaguggaagauuagaaauuuaagugacauccuuauagacaugauaguugaacauaaggauaucccuagaucuagccuaaaccuacagcauuaacauuacaggaagagaaguggccaaugggaucccaaguggcguugggaaagcaaagaggccugccagauacaagugauuccuagcaccggcaagcacugaccagccgugugaggaaagggaagaugauaagccuuaagaaagacaggguuuugguuccuggaaauaccagauauuuggcaauuugacaacuucuguuuguuugauuuguuuguuuguuuguuuguuuguuuccaacuacaaagguaguuaguaugccacugucuucaccguuccaccagcuauauacgucuacuagauagauauaccacguccugugcccagugcacucuccaugcuugcucuacuuuguaaaucucccauccuguucucuuccucacuucugcuaaaccccuauacaaauugccuuguguaggaauacuuuccacuuccuuaaucuguucuuuguauugcaguaauaaugcuuuuaagaauauaagucugcccaugccuuucuuagucuuucucuugagaccaagaucaacacugucauguggccuuacuugaucugacccuugccugucuugcuacccgcuccuucucuuccagucuuccccugcccgauuccuuuuguaaagugcugcuugcuuguuuucaguucuuuaaagcagccaugcucuugcuuguuuuuuuguuuuguuuuuugcuggugcucuucucugacuagaugauucccaucuaguagcuuucauagcuuggugcugaccaagucuucuuaggaaaagcuuccuucuguguguccauucauaagcccuaaccacuuuguguccauuuccuauauugggucuucugaauagaagugaucauugcaaucaugugccuuucccauguaaucuucagaagaacucaagaacuauguauccuuagggcuggcgagauguuuucagugguuaagaacacuuacugcucuucucaagguucuguguucaauucccggcacccacauggcagcucacaccuaucugaugccauucucuggugugcgacauacaugcaaaguacccauacacauaaaauacauaaauaaaugugucuuuaagauuuguaucauuaccuucauuuuaacgaugaguucuguauccuguucaagaccauuguuguaguuaggauuucuagguggaacaccacgacccagaguaacuuaggaaaagguuuauuucaccuugaaauucuacaucauaguucauuaucaagggaagucauagcagacacuuaagguuggaucacggaggcaagaacugaagcagaggcuacccagagauuucacugcccguagugaguuggguccuccuacguuaauccucaacacccaaagacuugucuacgugccaguccuuuacuuuccuucuuucuuuucuuuaucuuuuuuuuuccuuuucuguuuuauuuuauguguaugggcuccuagccugcaugccuguccauguaucaugugaaugcaguacccacucaggcccuggauccuccagaacuacagagaaccccaaauugccccaugggugccauaaaaugaaccugggucaagagcagccaacauucccaaccacugaaacauuucuccagacccucaauagcuuaguauuauggaggcauuuucuugccaggcuagcgaaguggcuuagugguuugcucuuccagaagauguggguacaguuuccagcaucuacaugguggcuuacaaccguuugugacucuaguucccgaggaucagacacugguuucugaacuccacaggcacugcacacacggaccacacagacauccucacaggcaggauacccauacacauaaaaauaaaauaaauaaaggacuugaaauaaucuguuuucagaugucucuacauucaagucaacaaaaacauccagcuaauaaccauuuagcuaacucguaggauaacuuuauuuucacuuguccuuccauccaggaggauugauuguaagcaccauaaggacagaggcuucuguguacuccuccuacugcauguucagaccuagccuaguauuuggaaugacuaguauacuggauuaggcagaaaauuuuacuuaagauuaacuuucuaauauuuuugcuuuauuuguaauuuugccaacauaaugcaugcauauauaccacaagcauuccuggugucuucagaggucagaagaaagcacugaagccaccauaauugggguuacaaauggccaucagcagccaucugagugugagaaccugaauucaacauuuuguaugagagcaaccagugcucagaacugcugagccaucucuccaaaucuuuucuuuuuuaagauuuaauuuguuuuuguuuuauuuauuuuuauuuuguauguaugaauguuuguauguauguauguauguucaccauguauaugccugguguucacagaucuccuaaaauaggaauaacagauaguuguaagugaucguuugggcgcugggaaccaaacacagaucaucuauaaaaacaacuuaugcucuuaacacuggagccaucucuuaaaccacuugaaaugaauaccauuugccuaguuccuggaaugucuagucuaucaaucuaaagagaaaaaugugcuuaaauaaucuuuguccaguuuaguguugcuuuuauccuagaagcagaaacagccaggugucuuaugaguuaauguccagccuagucuaaauaguaagucccagauuagccaaggcugcauagugagaccuugucuaaaaaggcaauucuuauggauaaauauucauuuuaaaauacauauaguuuaaugcauacuaucaauuuuaacuuaggauaauauaagaaaacugauagucuauuugguuaguguuucauucuuuuuaauuuucuuucaacaauuuaugugaccagauuccucccauaccuuuuauuguuagguauguacaagcugugaagacaaugcagaagcuaauggguuuuguguagaguguguugaauggcucugcaagacauguauuagagcucaccagagggugaaguucacaaaagaccacacagucaggcagaaagaagaaguaucuccagguaaugaaucagguuuuuccacacuucuccuuaucucucucugcaacuguaacuuuacauuuacuauacugauuuauuuugauaccgcuauaaauaauacauguacuuuaaaauauacuuuuugaaucaaagaaaucaacauucuauuugaaauuguacuuagagguauuauaaguaugaauuauauauugaaucuugcuuuaauuuauaucuccaacucuccugcuucuguaaauucaauuugguguaaucagaaggcaaacuaaaugaaauaaaacuuugcuuuuguaaaucgcacugaauaagagugaagaccauuacuuaaauucuuuggcugaauuaugcaagcuuuauuaucucagacagagcuuaccucccuaaagagaagaugagcuuucuauagcccagagaagcccugcaagacuaggguauuuucaaggguugaagauuucuagaggaauuuugguaauauuaggaauuuggaugaacauuucaaaauuauuugacagaacaucuuaacuugucagaguccaauucguagaguguugucacaucccagaaacagguugaagcacagucaauuugaauuuugcagcaaacagaaaugaacuuguucugaccuuauaacaaaauggcuuccauccuuaagauugagcaggcugguccauaacuaaggagccagcucuccagccuccccuuaacauaauguuuuaagaguucuuacauaucuuuguuguuuuuccuuaagaucugcuuuuuuucauguuuauccuugagucaagcaguacaugaaccuccuuuuacauucuagauuuuugcuaaguacuagaaaugaaaaugccagaugccucuuguacuacaggaguaucuaauaaagaauauaagcaaauaaauaaugagaguugggcuaccaaauucuuuuggaauacuuacaaagaguaccaaccucagauuuagggauuuaaguuggaagccuaauaauuucaggugaaagagcucuaacuauacaaauugaagaguugcuugguagcaucaauguuucauuugaaguauagaccaugaaacuugcuccauucuggauauugguauagacaauuggacauguauaagguuggguuagcagggcagguauuauagaaauggaacaacauaggaaaaaucauauaaaggcauauugaacuuuuuggauuuuaacuggcuaauggaguacaaagucuuaauuaauaggguaacuauuggauauaacugauaaagguauuaguaauauaagcauuauuauaguaaauuaaguaaauaagaguguuuagagugggauugguggguugguaaguauagaaauagaauaguaauaaaauucuacaguguggcuauggauagguaguuaaaaugaagcaacagucucuggauuauuuuugguuucacaugcuuguagucucagcaauugggagaaagagcagaguggaucaguccuguugucuagguuacagccagucauucauaauccagucaccuuggugauuagcucaacugaggaccaaaccuuccaaaccgggagcuuuuggggagagggagggaacauuucacauccagacuauaacaacgacuaaaauuuucuaugguuauuuuucucuuuucauugugaguuuuauaaauuuuuaccauuuucuuuuuaacuuauaggguuaguuugguuuuauuuuugucuauagaaauagcucuuugaauauauuuacccaguuauuuauaucacuacccuuuagucuaucaaucuuguuucuuuuccuuuccuuuccuucccuuucuucucucucucucucucucucucucucucucucuuucuuucuuucuuuaagacuucuuuuuuauuuacauaugugaguacacugcagauauccucagacacaccagaagaggucaucagaucccauuacaguugguugugagccaacauggugcaugggaccucuggaagagcagucaguguacuuaaccgcugaaccaucucuccagcccccuccuuucuuuucaguuaccuuaauuuuauuuuaaauuucuauuacuaaagauggguguggugaugcacaccuuuaauccuagcacucagaaggcagaggcugauggaucucugugugaguuugaggccaaccuggccuauauagcaaguuaugugacagccagagcugcauaauugagagagaccugucucaaaaacaaaaacaaacaaacaagaaaaacaaagguuuugguuuugguuuguuuguuuuguuuuuuaauuacuaggauaggcgaguuauaugcuugauguguuuuaggaucuguucuugaagagcuugggcuuuuguuuuuauuugcuuucuacauugguuguucuaugaaugacugauauucaauguaaguugcugcauagugugauuaugaauucacgagucgauuacagugaagaaucgucucaagcuucugaccugcucagguagcauguggcuguggccugugcuagcauguccuacuuaugaggauuggacccagggcucaugacugcaaggcagacagacagacagacagacacucuaucaacaaggcugucccccagcaccugcaagaauucuuuaaaggaaauuuuucccaguucuuugcuuuuacuacuuuuuauugucaacuuuuuacuagguaaaauaagucuauuauuaacucaguuuuccuuucugguuacuucuaagguuuuucuaaaacuucaaaaucauauaaauauuuuaguugucucuaaauuuaaauguaauaaaguuuaccuauuauggggggaaaaaacuuaaaaaaaaaaauagaagccauaaacucuacauuuagagcugaaaggguuuguagccccauaggaagaacaacaguaucaaccaaccagagcucccagggucuaaaccgccaaccaaggaguacacagagagggauccauggcuccagccguagauguagaagaggauggccuuguugagcaucagugggaggagaagcccuugguccugugagggcagggaggcaggaaugggugggugugugggggcauacccucauagaagcagugggagggaggauagguuaggggauuuccagggguugggaggaaauugggaaagggauaacauuugaaauguaaacaaauaaaauauccacuaaaaaagaaaaaaagagaaguuauaagcucuacauuuagaccugaaaauguaggguuauacauuuuuuucaaagaaaagaguccauuuaaacacagauucauuauuagagcugggaauguagcucaaugauagaauguuugacaagucccuagaguucaauuccuaguaucacaaucguuguuuuuuuuuguuuuuuuguuuuuuguuuuuuuuuuugagacaguguuucucuguaucccuggcucuccuggaacucacucuguacaccaggcuggucuugaaugcacagaucuaccccugucucccaccacugaccggaacaaacaccaucuugauaauuuuauuauuauuauuauuguuaaauugugacuauguaagugccuacagaggucagaagaaaauguguggacuagaacuagagcagugggcaauuuugagccaccugaugugggugcugggaacccaacugaguaauguccuuuauaagagcaguaagugauccugacugcugaggcaucucuccagccucucaaaggaauaaaauaggccaaauaaaaaaauuaacaaaauauugacacaugggauuuaguaauucuaaggauaaggaccugaguuuagucacuaauauccacauuaaaaaaguccagcaugaugacucuugcuuguagucugggcaagugauggagcaucagggaauggggauauagacaucgccaaguauugcuuauuagccaagcagccucacuuguuagacagcccuagguuuagugagagacuccaccucaaaaacaguuggauggcuucuaagaaaugaaaccugggguuuaucuauacacccaugcucacauguguacacauguacuguacauauauguaccuaaacacacaugagcacacauaaauaguuuagaauauaugaacuaaaaaaauuagacaucagaguacucuccucauauacucuggucaauaaaagaaguacaaguaaacagaaaguauauaagaaaauguccagcagccuaagucaucaggaaaauguaaaugaaauuacauuuauauuuuaucucguugcagucagaauggcuaugauuuaaagaaagaucuggcaaggacagagggagaaaagaacucuuauaguauugaugggaguauaaauuuguucacucuucucacaaaaguaaacauagcuggggcuguacucagugugaaaauauuugcacagcuuguauaaagcucuagguuuaauucauagaacugagcggaagggauucaccaaugaaaaauacagccgccucauaagugguaguaugucaguauauaacagacaugcauacucaacuaugacccuauucaugagagccaguuuauggaaccagcccaggacaauccacaacuuuauaugaaaauuauaagccgggcgugguggcacaugccuuuagucccaguacucgggaggcagaagcaggcggauuucugaguucgaggccagccuggucuauaaagugaguuccaggacagccagagcucuacagagaaacccugucuugaaaaacaaaaaaaaaacaaaaaccaaaauucuauuacauauauagggguacuuucccugaugaauguuuguguaccaccacauuagagccugguacaugagcagaccauuaagaggacaugaauauccauggaaguggaguuagagaggcuuauguacugccugugggugcaaggcuggaacugagguacucaggaggauuggcaaguauuuuucauugcugagccaccuucccagucuuagucuacauaauuugauccucuugucucauguagaaaagauuuaguuuauacucauaaggacuaucuuaaaacuuuuuaauuauaugaaucaaucucucucucucucucucucucugccauuacaugucuguuuaaauuacuccuuaauuaaaguuuaaaaaucuuacccauuuuccuuaagaaaugcuuaauaacuguuuugugagacuuuuucucuuugacaaucuuauuuauuuuguguauguauauauguguggacaucuugugggagccugucagguuccagccucagcuuuagagagggacccaaggagggggcgaugggagcagcggaagaaugacucagaaucugugaugggugcaagcugacagcucugugaucuguuucccauagugcagaacaaagcccagucuuuuauaaagcuacuuucuuagaaauugcauaucaguuuaaucauuuaccccagguucccuuuugaucauuccaugaaucagcauuuuaugaccuuagccccuugacuucuagaaacuaaaauacagagcacauucaaggcaaaugaaccagacagcaaguaaguuuuuuuuuuaacaucacaaguccuguguaguucacuaggcacagcacuugugguugccaagucuaguaauagaggcuauuuuuaugugaaaagauuaacuuuaagcauaauauuuuucauaauauuuuuuucaauuuagugagcucuuguuuguguugauguaagcaguauuguggcucauuuuuauaauucuuagcuaccuuaauauauucuuuuaaucuuuagaaauuuuucuuuuucauuuuaguaacucagaggcuuauuauuggaacauauuaagugaucuaagaaaguaggacuaucguuaauucauaaucuuuuuucuuaauacuagacuucuuauuucuccccauccucuauuuggauuacacauuuuagggaguagaauaucuggaucaaauuuaguugauggcuucuguggaggagaucagcauuuuaccacuaauacuauagaaccaucuaucugagccuugcuuuguaacuauucuuuuuacuuucaugauucaggcucuuuccucuauugauaaaaucaugucuccuuuaauauuuuucugacuauacuaacucauuaguguagcuccuucuguucuuucagguccgugaagccccucauacaauucauauugcauuauuauauuuugaauacuugagaaauccuguaaagaauagcucuuacacugauuuauauauuuugaacucauguuuucagaauucuuuccaacagccuuaagggcuguccugaagguuacagcaucaucauuuuugcugagcaucaccagacacguagaguuguacuguuucugauuaucauuagagucucuuaaccuuggcaaggaaagcauuccuugaaagagagacaugaaguaaaauaauauacauuauuaugcaaacaagccuuaugacucagccaccaucagcacuuaaagagacccauguccugcuggcucuucuccagggacuggagcccugccacgccauaccuuccauggccaucccagagcuagcaggagacaucuugugggaguugguucuccugcuaccauguggguccuggggguugaacuuaguucaugaagcuuggaggcauaugccuuuagcuaccagccuugaaaauauuuaauauuucaaaaucuguaaugcaguaguaauuaagugcauagaugaaacaaagguacuucuuuuauaucaguggaauugaguagaaauggaccucuagugauuuaauaaucaauuacagucauuuucuuucugcuuucuguuguuuuuacagaggcaguuggggugaccagucagcgaccaguguuuugucccuuccauaaaaaggagcaguugaaacuuuacugugaaacaugugauaaacugaccugucgagacugccagcugcuagaacacaaagaacacagguaccagcaucuuuuguuaucuucagaucugcaguguaccuuuuauguggccuacagacgucuacugcuucagcuaaauggcaauuuguauguguuuuauuuggccagagauauccuggcuuacacaggguuuucuuuguugguuuuuuguuuuuuuguuuuguuuuguuuuggguuuuuuuuuuugggucugggcaguacauugaaggaaugcuaagcauuguaugguguuuagcagcacccuaguugaauacuagcugcacccuguacuccucugcccuuauaaaugacaguuaaaaacaauuuaaaaauauuuaaaacauuaccaaauguucuaugggccaaaaucaguccacauugagagucaguuucuuauaaugcuguuuuuuaaaauaacaagauauuaguugcuagugucaaaaaaugaggauguuguggcccaggauacgccccgcaaaccacaugaacaccaauaucagucaggcagagauaguuuauugagcauuugcccuaggacugauugaucagggcugcaaaccagacuugggagcugauuucaaccccaagucaggauccugcagagcuuuuaagccaaaaguccauaaacaccugugccaaguuauuccuccagucaggauuuaggggugggguuuccuugggaacaugucuuuguuguacacuuauccugcucccauugguugggguauucaacuguggcaggggacuugccuaucuaacauucauguaugucuuaacuugccaaaccggauaucagucacccacauacaugucucuuucugccauuguaggaugucaguuuccagggaggucuuaggaacuuaaacuuuauuugaccucuacucaaaauggaagucacauccaaaauagcuucauauauuggugcaggugucucucuuauguugggguacaucucaggggcagauuauaaaggcaagaaaccauaaaagcucacauacaggcccaggaagugcuacugggugguugguuuggauccaaguuuacuguggcuaacuauacaaaguaauucugacugacuccuauugugguuuguuuccaagaacaccaaagcacagaacauaacagaauaugcaaucaauuuggacaagagaaaguuuccuuguaacauuaguaauagcaugaaauggcuggguagacaggcagcagcaguuacgcgggccuuaacagaggagacuuuguuuuggucagguuuugguuuggguuuguuuguucaauuuuuuguugcuguuguuuaugcauagucucacuauguagucuugucuguucuggaacuguguaaaccagguugaucucauacucagagguccaucuuaguugugugccaccaguuguggcuggcuuuuuaaaaauuaaguuuauuguuagaguguguucccauaugugccagccuguguguguguuugggagucagcucucuccuuugaccuggguuccauggauccaacccaaguuuugagguuugcauaguaagugcuuuuaucugcugaaguaucucacuggcccugacuacuguagaugucacaaccuaaccucauauuguacuuauuuucuuccuggaucaggcauaaccuuauuauuagaaagcaaccuuuuucucuaauaaguccuguacgugguauguaugcauauacuacacaccaagacccuuuuaacuuuacuucuaccuaugauuuuaauuauucuuacugaggcuauaccagagauaaaaccccccagguugaaauacuuuucaccuuuauugguuuuuguuuuuuuuguuuguuuguuuuuuugagauaaggucuuuaucauauaguuuuggcuauccuggaacucaauacauagaccaggcuaacuuugaacucauagagaucuaccugccagccuuccuagcacuaacacccaguuuuacagcuccauuuaacauuaagaauauguuccuuggguacagaauucuagguuuacaguuauuauucuuucuaaaauggucucauuaugcagcaguaccuauagaucaagauaaauucagacuuaaagagaacccccugcuuuagucucccuaguggagacuaaauagugaaagcacuuuacuauuuuauuuuuuauguuuagaaguggaggaggggaaauucauguuuguggcacacauguggaggguagaggacagcuugcaggaaucccauuuucacuccaccauguagggcucaggacagaacugggguuuucuaguuugaggauaauggggcuuccuccuccuaugccaucucaccagccuaaaguucuuucuguguuguauacgaugacucucuccucauaugguuuuuuucuauuguuuaccaaagucacccaucuugacuuccuggguugauaacuguagcgguaaaucuccaacccuaauaagcccuggcaaugaaagcacaacucaauuaauaugaauauaugcugugagacuagauagggcagaucuaccgcuauacuaccaucuuccccauauaagagaccccuuagaacuuguuucuccaggccaggugcuucugcuccacuuuccuucuuccuccuccucugucauuucuuucucucucucucucucucucucucucucucucucucucucucucucuccucucuccucucucucaaaaccuucagcuccaccauccccucuuucuccgcccaaucaccagcucuuuauuuaucacuagccuuuauuuauaaauuaaugugggaagcagguuuacaggaaaucaccugagugcugacucauuucuuauucacagccccucacaggacaacagcauuaacagcaaauacaguuagccccagggcuauccauaacagauaacuacugcuaaauucugaguccuauuuuaggucuuuaggucacucaaggcuuuaaucagaagguagaauaucaaacgccuuuccccauuuaacaaagccccuuacuguuuagauauuauauugagaauguuuauccucagcaaacuuccaugauucugaagucccagagcaguuaaccuauuaacaaauuugcuuauuuucuguauuuaauacacucuugaaauaaagaguaccuaaagacuucuuuguugaauaauaauuuuguuaaugaucagcugacuccauuuuucuuccuuuuccuaguuaaacaauguuauaauuugauuuauuucuuuauuguucccugugguauuuuucucuaaucauauaccaagcuaaaggucaacuuguuuuguuuuuguuuucuaacguguucuuccucuauaaucuugucauuugcacauugcaaauuguuuccauuguuucaugguauauucugggaacugauuggccauaaaacuacaacaaauaauuuuccugugaucauauagcuaacuaaacuaugaacugcaaacacuucacuuuguaaucaaaggucagagcccaacuauaaaauggcuccccugcuuuuggccacuucucucuccuacuuccaaggagacugcaaguuuggcucagccauacaagaaacuuuuaccuuguaaccuugcaguguuuacuacugguuuuccacaccacaaguuugaggagaugggcauuccugccuuuuuaagacuuucuggguguccaugcauguacauccuugcguaccacauuaugugcagaugucaggacagcuugugagagcucucuccugccauaagggucccaggaaucaaaaucagacuugacauuagcaucuuuacucauuggggccaucuuggcagcccacauucuauauuuuccaagguuauuuuuauacuuuuuauauuauuucucuuucuuuugaaucaccuaucuaugugugugucuuuguauguacgugcauauagauucaggucuccuggagaccagaugagagcauccccuggaauuggaguuagaggugguuaagagcagccucugcaagcuuccuuagccaggaucaucaucucucuagcccccagagucucucccuuacaguguuuguuuuauuuuuaacuuuugaacuuucuuuguauagauauuuauaugaaguuauuugcuuauuauuucuucagguaucaauuuauagaagaagcuuuucagaaucaaaaagugaucauagauacucuaaucaccaaacugauggaaaaaacaaaauauauaaaguauacaggaaaucagauccaaaauagguaagugcauuuaugacacuauacaucauugaccuguaguaaauguauacauuucuagauuuucuuuucuuaacuuacugugaaguaucuuguaaguaggagacacugcucuaugugucucaauaguguucauuggggaaauugugucagcuuuugugcuggucaucuaucauaaccuauuacucuuucuugaagcagcuaggggacuuggaauuuuguuucauuuuauuuuguuuugaaacaguuuugugggguuuuuuuauuuuaagauagggccucacuguagaguccugacuguucuggaacccacuauguagaccaaguuggccuugaguucacagagagcacuuaauucugccucccuaguacugcauuuaauggcauguaucaccacacccgauggguuuuuguucuuguuuuuguuuguuuguuuguuuguuuguuuguuugugguggcuuuuguuauagguauaauuccauuaccuaaaagaaauucuuugguuuuucaagacaggguuucucuguguagcccuggcuguccuggaacucacucuguagaccaggcuggccuugaacucagaaauccgccugucucuuccucccaagugcugggauuaaaggcgugugccaccacggccuggcuguucuaaaagaaauucuuaaaugcagucuagccauuuuccaauauuccaguauugguauaauuauuauguauuguauaagucauuauaauauauuuauugucacauuguguucauauaucuuuucauuuuuauuuucaccagauugugcuauuuauuuauuuuuauuuguauguuuguguguauguauauauacaugcuguacgggcuaguuuugugucagcuugacacagcuggauuuaucacaguaaaaggagcuucaguugaggaaaugccuccaugagauccagcugugggacauuuucucaauuagugaucaagggggaaaggccccuugugggugggaccaucucugggcugguagucuugguucuauaagagagcaggcuaagcaagccaguggaagcaagccaguaaagaacaucccuccauggccucugcaucagcuccugcuuucugaccugcuugaguuccaguccugacuuccuuggugaugaacagcaguauggaaguguaagcugaauaaacccuuuccuccccaacuugcuucuuggucaugauguuugugcaggaauagaaacccugacuaagacacaugcauugcuuucagaggccagaagagaguuuuggaucccuggauauauauuacagaaggugucugauguggguacagagaaaugaacccagguccccuacaagagcagcaacugcuacagccucuugcuguuuuuaacccuuuucauuuguauaaagauucaaauuaacaauauacaauuuucuuuuacguauucuaaucagaauauaguauguuccguagauauaauaauuagcuucaaauuguuauucugaguaguugaaaguugagugacugugaugaucaaaggcagcagcugugagaugauucucaaucucugugagaguuacccuggauuucucuacuguguguauggugugucaagguuuuguuuuguuuucuuuucuuuucuuuaacauacagauguccauuucuucuaauauaauuuguucaaagcacuagucuuagcauuucuguagaacuucaguugacugcagaaguauagaacaauucuagguucuggauuguguuccauugugauuguuuuuugggggguaguggaauugcuuuguucuguuucauuucacauuuuccacucucaggaucauaguagcuuuuauaagaaaucuuaagaucagauacuaugaauucucuaaauuuguuuucacuuuuccuuuuauauauauauauauauauuugauccuuguuaauuucacaccauccacuccaacccccuuauuuuccaguccuucgauauuuacccuccuccacaaaagaaaauuaagcauuaaaauuaaaucuaaaaaaaaaaaucucaucguguaagcuucagugugccauacugugucauacaguacacccuccuguccaacaacuuuacuugcagauguucauuagagggagucauugauccguggccucuggcuucugcuaugccaucaauacuggauccucacugggacucccccagcauuucacaaaugggguacauauuaggaugggccagcucaaaccucuggaucugggccuggguagguugagguauucagcccaucagcuuucccacaccuacucaaccagagccaguucuuccuccacugccgggugaggugggccaguucacccuagcccauggccucaugcgcuaaccuagacuacugacagccauugcagccgccuuugauaggaacacagccacaggcaucaaccuggucccagacaucaccauggccucggguggcagcacaggccucucacaucaggcucagcacaccuccaguuccaccucucuucauagugcacaaaccacucuguuucuauuguucucccaucucuacugcacacuuggucauuauaguggcagcagacugggccucuggcuucaguuuuuacuuuuugauagucauaugcauuuucauucugcuuuuugaggcggcgucacauguagcuaaagcugggcuuaaacuuucuaugcagccagugcugaccuugaguuucugaugguucuuaaaccucacaagcacuggacuugccugacaaauacagaaguggaugcucacagccauucaugguacugagcacaggguccccaaugaaggagcuagagaaaggacccaaggagcugaagggguuugcagccccauaggaggaucaacaauaugaacuaacagguacccccagagcucccugggacuaaaccacuaaccaugguagaacucaugguuccagcugcauagccuaguuggacaucaaugggaggagaggcccuugguccugagaaggcucuaugccccaguguaggggaaugccagggccaggaagggggaguggguggauuggugagcaagggaggggggaagggguuggggagggggaccuuggcgggaaaaccaggaaaggggguagcauuugaaauguaaagaaaauauccaaaagccgggcggugguggcgcacgccuuuaaucccagcacuugggaggcagagacaggaggauuucugaguucaaggccagccuggucuacaaagugaguuccaggacagccaggacuacagagaaacccugucucgaaaaaccaaaaaaaaaaaaaaaaaaaaaauccaagaaaaauaaaauagaucuuuuuuuaaaaagaggaaaaaauaaacuagccaaucuucuacuaauaaauaaauaaauaaauagauuccuuaaacaaaauagcauugcuguguagguggcuuuggucuuugaauugugguauuaaagaaucuucagguuggugcuaauuguccuuuccuuuccuuugauugucccuuucuucuccuuucuaagacauccucuugcauaugaggcauuaccaccgcaauauaucuuacccccuauuucuuugcagccuaccugauugcagaggauggaaauuacgcuaauuuugauauuacuuuauuuuaaacuauggcaauauuuccucuuacucauccuauuguaacacugaagaugagugugugugugugugugugugugggguuggcuuguuuuguuuuuugagacaggguuucucuguguagcccuggcuguucuagaacucacucuguagaccagguugaccuugaacucagaaauccgccugccucugccuucugagugcugggauuaaaggugugcgccaccaccgcccagguugauugaguuuuauaaagugguuguuuguacacgugccugauuuccuuaauucugaagcaaucuugauuucaaacaguuaacuugaaguuauagcagauacaaucucuucaauugugaccuuaaauguuagagugguugugggaggagcaggcaagaaaaauaaagguuuauuuaguuauguggaacagaguguguagacacaagauaccuccuguguaagcuguuccagcuggugggaaugaugcuccuuuuccuuucuguccauuucaucuccauuuuucucuuuaaaaaauacuaguuucauaaaacauaaacguaguucaagccaacaaaggauucagcgaggcacucaggggaaaaaaaaaagacuauuacacacaacuggguucccagcuagugcugaagaggggaucuagcccucacuagaaacuuccuaaucuuaugugcaguuguaugaguucugagacagaaaagugcagcuccaguuucuuaaaagagcaucugucugcaaggucgugccuucaaggcaguuugacaagugccacuccuaagaggagggcaggacuuuuaacagugcaagccgcucugaugagugauuuuagaaaagcacgacaucagcaaacaacaacaacaaaaaagguuguaauuaagucagaguacaauucugucuucuuuauuuuccuguacugucuaggagaaacaaguuaguaagcugucuaucuuaaagucauuaaauaacacugaggcagauccccucagcuuaauuuauuucuauguaauuuaauauuuucuugaggugguccgggcaagugucaaaacaggcagggaaaccaacuggugaaaaugaaaauucgauucaguuugacuucaucaaacuggaucaaacgucuuaagagucugaugcuaggcacauuacugcaagcauauuuaaacacaauugcauuugggaaaauuuuugcaggcaaccaucauuccaauuccagcugcacaauaacacuaaagauaugacaauauagcaacugcuuugcaaaguacaugugaccuugaagauggguucuauagcuaaaaugccuagaaucuaguaugguuugcuaccaagguagcauagaggucaccaggccauaaaauacauguaacaucuuuccuaaggauggcuucugcuagggaccuccuggucuggacuggguugaagggagacacagaguuggacgcagguguagcuuuaaagacugauaaucuucagauguucuagcacucuaacuauccugaaugcuuguugauaacuucuaaaaaguccaaaaaacuuuuuagcucauuaugaggguuaaaagccuuuagcuuacacaacuaacaccuguagugaugggcugaggaggauuaauaaguaaaguagccuuuaguucuaucuccccaggaacugugcuacucuaacucccaaccugcuaguugaaguugcaggaagaaaaagggacacuuugaaaaguaauuuuagacuuuauuucuaagugcucucuaaaaaguuuucuauguaaguucucuaagaaaguucuucucuaaaagguucucucuaaaagauucucgaaaaaggggcucucugcucucuguguccucagcauuuacacagcuuucagaauacaugaucacaugguaaaaaguucacaaguuuacacauaaauucaagucauaaauugaauaagacguuuaaaacagagaaugcuuacaugcauauccauuaagaguaaguaucugguuaaacauccuuuaucugucauuagcucaaccgguucauugaaaauuaaaacccauuauuuuugugacuaagguauuagugaaguuucauauagauaaacacagucaguauuuuaucuucuguccuuacaccuauaguaaacccucaguucccuuuuuaugaccuuugguuaaugguuuuacaaccucuuggaauaugcucuaaauuguaggugccugcuugcuaccucagaagcaauaaacacuugauugacacuugaggauuggcagacaucucauugaaguuuuaacaucagaaaggacuuaauaucaauccuauuguaaaagaucuuaauaauuacuaaaaaaaaauuagcaauucuuauaggaucaucauuaagaauuaagaaaucauguuugucuagcaucacuucaagauacucaucuuaguaauucugcagaaaucugcucaaaggggugggcuaauaccuagugauuguuauacauacuuaauaacaggaaaagcauguuaauagcaggaaucuuuccucaaauguagucuucucagcuuugccuagaaaagcaaaucugucauuaacuuuacaaucccugguggaaccaucucaggaagaugaccugcggguuuuuagcuucuccuugauggcuccuggcaggggucuauuaacugggagcuaaagauaaaaggucuagggaggaagagucugggauaacauucuggggcauuugggugaagucugccuuuacagauaacaaaaggucauugacuauccacucccagccuuuuggguaggaaacagguauuuucuucuuugaggagauaccccaagcacaaugaacauuccugguuucccuagugauacaugggugcuaagaccuuugugccccaacauuuucuaaguaggcuuauuaguaaaucuguucuaaucauauuuuaauuaauguugaaguuaaaauuuuuccuccuuuugagcuacauggcucuuacuuccuuugguuucuucuuugagcaugacuacuaacuacauccaaccucacuaaacaaccaacaaccacccacacccuauuggggcucuagcccuuauauauccucugaaaaauucccagaauuccaaaacucacacaaucacagaaaucuccaguuggcaaaaggugcuucuuucugcuagagcacaaggcaggccauaguaguugcuguggacagucugaagcagccccauacaccacaccuggggucaaagcaaaaacgcauucuuauaauauuucuguguuuuaaaagaaaaccagaauuccaaaauagucacuguaugccccccuccauuuuuauguauguuugcauguguaugagcaucugaugugugcuagcauacauucaugugccauguguacacauguguggaggccugagguuaauaucaagggucaucuuugguuuuuuuuguuuguuuugguuuuugguuuuuuuggagacacgguuucucuguauagccuuggcuguccuggaacuaacucacuuuguagaccaggcuggccucgaacucagaaaucugccugccucugccucccgagugcugggauuaaaggugugcgccaccacgcccagcucaggggucaucuuuguuacucuuacacauuauucauuuucauugaggcaguuucucucuguucagaccagagcugaaugauaugugcaguguuggugaccaauucacuuugucuucccuuucucgggcuggaauuacagguugguuuuccacagcuacccuguguuuauguggauucugggugucugaacucugguccucaugcugguguaaaaaguacuuuaaccucuaaaccacuuagaaaaguaaacuguuuuuguugucuuuugcuucuguguuccaauauagugaaaauugccaauuuaaacaccugagaucagaauaucacaguuacauagccaaacucauucccaggcauaacuguuuuguccugacuauaaauucuuguuauagucuacucccagguccuauucuuuuagauuggcauauugcuuuuuugcugugugacauauuucuuuaaagccauguucuuuaaaauauacucacuguccauguuuuguuuuacugaauuauuguuucuaaugucuucuaaugucuccaagucaauaggacuugaagauagaacuuuuuuuuuuuuuuugguuuuucgagacaggguuucucuguguagcccuggcuguccuggcacucacuuuguagaccagcuuggccucuaacucagaaauccgccugccucugccucccgagugcugggauaagauagaacuuuuuaagacuaaacauuuuggucuaguuuagcuauuaaaauauucaauuuaaauaucugccauuaauuuuuagauauuuuucucccuuucauuucguuuucaggauaauugaaauaaaucaaaaccaaaagcagguggaacaggauauuaaaguugccaucuucacauugaugguggagauaaacaaaaaagggaaagcucugcugcaccagcuugaggugagucgggcagugguaagggucugggacucagcaugcuuucccugccagaugcugccuguggcucccugccuagaacccuaccaugcacuaaggaugucuuaguccucacauuacucuacagcauugccuaacugggggagcucugugaauguugauaagucauuuuagucauugaaguaacagcuauuguaucaucaaggggaugcagaauugucuagaaaaauaugaugucuuaguuaggguuuaauugcugugaagagcuacucuuaugaaggagaacauuuucuuggggcuggcauacaguuucagaguuuuaguccauuuucaucauggcagagaaacuuggcagucaauauggcagucgguauucuccagacauggugcuggagaagggacugagaguucuacacuuugauccacagguagaaugugugccacaccguugagacuugagcuuccaaaaccucaaagcaugcccccagugacacacuuccuccaccaaggcuccuaauaguaccacucgcuuugugccaaucauucacaaauauguaugggucugugggggguauuucuauucaaacaaccauauauccacuguuagcaauauauaguuuucaaauagauucuugcaacaugcagugauguuccuuucaauagcaaaauauaauagugaucuuuuaagauuguauacuauguuaucucauggcucuaucugucuuuguugauggagguauacucugaugcuugcacaaugauagaaauaccaaacaauacauucauuacagcccauuguuagcaaugcguggcuuuuuuuggguuuuuuuuuuuuuuuuuuuuuuugguuuuucgagacaggguuucucuguauagccuuggcuguccuggaacucacuuuguagaccaggcuggccucgaacucagaaauccgccugccucugccuccggagugcugggacuaaaggcgugcgccaccacacccggccaaugcauggcauuuaauuagccuucugagagauuagguaaaauaggugcagugguuuaugccuguaaucccagcaucaaguaggcaggggcagguggaauuucugugaguucaagacuggccugacguacacaauugcuuccaggcuaaccagggcuccaaacugagacuucuuuugaacucaaaucagcaacaacaauaacauagauuuguauaauguauuucuuacccucaauauuuuagacucuuuguuuuguuugcuaauguuuuuuccccuguuuagcccaagcugacccaucacucaaaauccuccugccauagccuccugaaugcuggguuccaggcugaggucaccauacccagcuuuuuguuuuguuuuguuuuuugguuuuuuucgagacaggguuucucuguguaguccuggcuguccuggaacucacuuuguagaccaggcuggccucgaacucagaaauccaccugccucugccucccaagugcugggauuaaaggcaugccccaccacgaccggccuccagcuuuauuuuauauauggccauaguuaugaaagcagcauguacagaguauauucucaagacaggguaguuguuuguaauuauagauaaaacaguaaaagauguacuaucuugaucaucuuuguuuucuacucccauuucucuuuuccuuuuauuuuucuuguuuuuuugguuuuuucgagacaggguuucucuguauagcucuggcuguccuggaacucacuuuguagaccaggcuggacucgaacaacucagaaauccaccugccccugccucccgagugcugagauuaaaggcaugugccaccacgcccggccuguuuuuguuuuuuguuuuuuuuuuuuuuuaagauaguaucucacuuuguagaccaagcuggcuucaaacucaaagagaucuaccuguuucugccuccuaaguguugggguugaaggcuugagccaccaugugucagcuuguucaucucucuuaaauucaucaaaggcaacaacaaaaguccauguuugaccaguaauaauaugagguuacaguauacaugguauaugaacuuacuguauacuauuuaguuaguuauuccuucaguauguuggugagaaagaauguauagucaaaagcuguugagaacaagagcagaaagaaaagguuaguaugggaagacuugagguagaaacaacuaugaaaaaaauuucauucaucuuuaauucauaauugaucaguugauaagaucuccaugagaaaguccuauuucaucuaggaaaacaugaccauuuauaauucugcuacuuugaagauagguacgaaguugagaaagugcuuuggaugggaguaaucugugcucaguuaugguauuuucaagguuuugcaguaguuguuuuaaacaugggcacauuuaaguggaauuugaugauuucaguuuucuacauagcauaguuuaugcuuuggcuucauucacaugaagagcugaaaagugaggaugagacuccauaaucugugacuguguacaaagccgacagaauuaguuuugacagacuugaaccugaaaauguccuaguauuguuggauaugccucaaguuaugcgcauucuugugguucacaagucacuuuuaaggcauauaaauggagccaguuuugcuugcuaccucagaaaaccaagauaucaggacuucuaaugcucuauuuccaguccucucagaaguuuucaaaaaguucuuuccacuccaaagacacaauguaguuuuaccuaggucagugcagcuguuaaauaaauuaucuucugagucacacuuaaaguagaucugucaaagccauugccugugugcauuguccaaacaacugaccagagcacacagggagaguugcauuccauuuuucuaauuccucuaagcuaauagaagcccuguaucuuuauccuucucuccuacauuucggaugagguuuguguguguguguguguguguguguguguguguguguguguguguguguguguguguguguuuaauaaagaccuuuaaauaacucaauauggugccuuccauuuuugauugcugucuguuuccuaaguauauauuuucuguggagaaagucuauauucuaacucauuggggcaggguuaccauguuggcauugaaacuauauucugguuuuauauaguauuucuucgaaugcauuagcaguaguucuaaucucuaguaacucucaagacaacuugauucucuuuuuaauaccacauacaagauaaguuucagcuaccacuuagcaugauucuggguacuagcuauuggagcuagcagucuaggaacagacaauuggacuugcaaucucuaagauguggcacugugaauuggucaaaccauaugaugaacuggucauuucaguggauaacuggaugauacaucuguuuuacuugaguguuuugaauuugacaccuacacuaucauagcuaaucuaugucuguuuuggcaagagucauauacuaagaccagacuuacaggcaaaggguggagaaaacacuaaagcuguacguuuaauacacucagagggagccucuguauuaugaaggaaacugcuuacgaucaguuuugaucugucaguugaauacagagugguucuuauugugacuugauuaucugaaaauaaucauggaaaugaauguaaaguacagagacuaauucugaaauuauauucuuuucagagucuugcaaaggaccaucgaaugaaacucaugcaacaacagcaggaaguggcugggcuuucuaagcaguuagagcacgucaugcauuuuucuaaaugggcuguuuccaguggcagcagcacagccuugcuguacagcaagcggcugguaagauggacuccagggcuuaauagucuguagcaugcacagugaggcaggaguugaggggugcuucauauucagaaauaagccugcacaccuugaauuccugcuacucagagcacuugacugauucaaggucagccugaguaacauagcaagauaccaugaaaaaggaaaaaauucugggugugguggugucugucuuaaucccaguacuggggagguugaggcaggccacucuugucuacauacugaguuccagaccuacaagggcuacacagacagacaccacccaccuccgaaaaaaaaacaacaaaacaaaacacagagguagauuaccuauucgaucuuaauugcuuuuuuuguuuguuuguuugguugguugguugguugguugguuuuggcuucucccucccugauaccccaaggguugcucuguauaaucacccuggcuguccugugaccugcuuuguagaucaggcuggcuucaaacucgcagagagcgcccugccaaguguuuuuaccugaaaugauuuuuauguaacuucaauuuaaaucuucuuuuaucacacauuguacuggcugguuuugugagucaacuugacacagaaaggagcuucaguuggggaagugcuuccaugagauccauguggggcauuuuuucaauuacugaucauguggagaaggccccuuguggguggugccaucucugggcugguagucuuggguucuauaagagaacaggcugaucaagccaggggaagcaagccaguaaguaacaucccuccauggccucugcaucagcuccugcuuccugaccugcuugaguuccaguccugacuuccuuuggugaugaacagaaucguggaaguguaagcugaauaaacccuuuccuccccaacuugcuucuuggucaugauguuugugcaggaauagaaacccuaagacacucauauuuaucuuuuccuuuuuuuuuuucacucuguggcaagugaacccaguauaagaaaaaauaucaauaguaaauacuacuaacaccugcacccugccucaucuaaucuaauccuuuuccauguugaauaucuacaucauuguuaaguguuccuagcuagcuagccagccauuucacuggacaaaugaugagacacagggguaugccuaucaccauccuuuacagagcuauaaccagccucaccuuugagucugugauccuccugucagcuucacacugcagcauuugcuguuggagauggaacagcaucucacaagggugguuuaggguuuuguguacauacugaaaguauugccacacaccuggagcauguaggaucucuaucuggugaguuuggcaggaaacaaacucuguuucugucaagcuuccggggcugcucauuagucucaacuaugguuuaauagaaagaguguggcuuagaaggucaacagauacauauguuccgaaguauuaagauucccacauuuuuugucacuuacucuaugcaaucaaguggcagaaacaguacacauauguuacauaaguuuuacuuaauuaaauuaauaguuuuaaauuuuaaaaauacacauaauuuuaagguaagucucuucuaaguauggcugaaugcugacuuauaagcauuuuaaaaauuauuccuuauuuugaauuguuuuauuguauauuuucuaucaugauuaacagugauuuaguuguuuuuacugcuucuuuaagcaaaauaaucuuuagacucauuuguuaauuuuuuugaaaaacagucauugacuaauuucaacauuaucugccucuuucuaccugguauucuguuucuacacauuugacuuuuguuuuuugagaugugacauaucuaaugcuguuuucaguuauggugaugucacuaagcauaacauagccuagaguuuuauucuugucacaaaugucaaggguuuuucagggggagggguguuuuuuuuuuuucuucuucuuccuccuccuccuccuucuuuuuuuuuuugcuaaauaccaaacauuccauuguauaugagauugaugauauauaucacuauauauagauuagauauagacauauaucuaucuaucuuaucgcuauuuauccaucaguagauaugugaagaucuauaaaucuguauaugcauccaucaguuuguacacuucuuuuccugucuuuacugcugggagccauaacuggcacuacuuucuuucuugcuuuucuuuugaagguaagagguggguugagggaagagcacuggcaggggcaagauauuuaagguugcuguuuaauaauaaaacauuuaccuauauacuuaagucuaagucacuuugcuacuguagcugaccugccugccuuccuugaggccagaaaacugcagucucuggcauuagcaccucauagugaaaccuuggaggauuaaguaaaguagccuuuguucugucugcaggaacugugcagcuccuacucccugccuauuaguugaaguccaaggaagaaagggacgcuuugaaaagccauuauuucuuaguucuucaguucuacaaaaaguuucuacaagaguuccccaaaauguuuucucuaaaaaguucucucagcuauuuuuuuuaaucuugcucuuuccuccugcucuggugucauaauaaugcccuuuucuuccaaugcuacuacuuccaauuccuuuacuucuaaguucucucuaaaaguuuucuaagaaaguucuuuucuaaaaaguuuuucucucuaaaacguucuucuggaauucugcuuaaaaaguucuuugucucuuuguccucagcacuuaauuuucagaauacaugauugcaugguaaaagauucaccacaaguuuacacauaaauucaagucaacagagaauguuuacaugcauauccauuaagaguaauuauuuagcuaaacauucaucaucucucacucgcucuauagguucauagagaguuaaaagccuuaauuuuugugcuuaagguauuagugaaguuucauauagauaaacccagucaauauguuuucuucuguccuugcaccuauaauaaaucauuaguucccuuuuuaugaccuuugguuaaugguuuuacaaacucuuggaaugugcucuaaguaguugccugcuugcuaccucagaagcaauuaacucaugacacuugaagacuggcaguuuccacugcaguccauggcaggaucaucucaggaagaucaccugcuaagguuuagcuucuccuugauggcuccugguacuuuaccuucaugaaaauuacaauagacauggaaguccagacauuacugccaugcauuucaguucuuugggaauauauccaauuaaagggcuucuagggcauauaguacugguuugaauuguuugaagaacuuccauacuuuuuuccauaguagcuauaccaguuuacauucccaccaaucuccgacucucaccagcauuuacugugaucacuguuuaacuagcagcuguaauugcaagcaugauguacugacuacuugugguuuuaauuugcauuuaacuuguugguuuauauuguugaacaccuauucauuuagaccuauuagacaguuuuuaaagacuuuaaguaucuguguagguauaugcauacaugugcaggugccuuggcaucagauccaauggaacuaggguuauaggcuaugugagcuacccagcauguguacuaaauggucuucugaaagaacauguucuuaacugcugagccaucuuuucagcccuguuggauuuuuguuugguugguuugguuugguuuuuucaagacaggauuucucugaauagcccuagauguccuggaacucacuuugugaaccagacuguccuugaacucagaaauccaccugccucucuauuggaaauuuuuaucuuugugaaagugucuguuguucacucucuugcaugcuccccccaccccacccguguguguguguguguguguguguguguguguguguguguguguguguguauguguauguguguugcaaacuuuuccucccaauugagaggaaauuguuccucuucauuuaauuauuuuuuugaccauguagaaguauuuugugugaguuagccuuucuuuauuuuaugucuucuaauuuaguuaacuccuguuuuucauaauuggacaaagggaaagaaacuggcugauuccuauaaagugggaaaguucauucagaagucaaaucuuauaguauuuugaaauauuuaaacauuaguugcuuugaauuucucuguuaucuguugggccuuaaaucuguggaugauuuaaaaggaaggcaggaaaauuacauuacuagagccuuaaggaaguaaagcacuggucauuucuuuacugguagugagaaguacaaaggagcaaguacaaagaggugaaugaguuugcugcucuccucucccucccauuucagcaaucaaggaccuuuauauuaccccuugaaugucugcuucuggcucuacuaccagcucccuaucccugacccucaguacucagaacauggagcucuuucugaugcuuuaucuaucgcagaaagccuuucucuccccugauucacguuuguucaucuuucuuucuaccaccacccacccccccugcuaccaccgagguugguucuucuggcuugggcuacagcccugcugggaucauaggcacauaucaccacuucuggcuuagccuuuuugaaaaaaaauuauucuuacuaguucuauauaaaagaggcacucaaauacuaagauguuaagggcagaacuugaugucugucugcaucugccuggcauggugauauuaguauuauaaauaaggacauaaugugacaaggacugggggccacccagaaguguaaaccaauagucagagcugugacaugauauccaaaaguuuagacauugcaguuuuauuuugguuuacuguuucagcuagaucucaguccacaguggcagcaacccagaagaacuagggcuaggugugagccgccugcggccacgcgaacccaguacuccugaaaggcaggcuggggcugaaagaaaagaacaaggccaagacaauuuuuuucucugaucaaagcccgcgaguuuacuaagagacugugcuuauaaauaggggagacccuuuaucucccccaccccacccccaauccuuccuuugugccuggugccagccuguagccugcaugauaggaugcaggggaaucucagagaagagcagcaguaguugacauaacaauagagccaucuaagcagaaggcuacaccccuacaccccaggcgauguauucaguggcggcaaagucugaauagccugcuucaaggcugaggaaggcuacagcuagguaacacuucuucuagccaugauccacacuucaaaauagcacuauagcuaggaacugaguguuaaaaacaccaaacugugcggcauuuuagguucaaacucuaauggagcaucagacguuaagagacaagauaaugucuuggauuuggguuguuugucagauaaacaaguggauuucauacaaguauauuaaagguggugauguuauuccaccuuccaugaacauauuuagaaagagaaacaaagccagaacauguuccaaguuaaguucauuggagagaaucauuaaggacagaguuuucuguauuuggguagacaucuguaucuguauaguucaaguauacauuuguauauauuugaugaaugcuguccauaacagggccugccauccugguuucaaaguacuuaggaagaaggagugcagaguguacagugucuucugcaucagaaacuagacaauacucagacaugucaaaggaaccaggccaaguguuugcacugggugggagcuaaaucaggcacaugccuuuuuuagaauucgcuaauuauuuuaaaucuuugcauuacuuuaguuacagugcagucgguauaggacuuugugccuguaucuugcucucagaguaacguguauggaagagauugacagggugcgggagcaaauuauuauuaacagguugaggauucugggugaaaggaauggaggguucuuuuuagucuuguggcagacuuuugccauuuuaaagauuggagauguguugcaaagagaauuuuucuacugcuggugacuguaaauuaguauaguugugaauaaaaacaguauaaacguucuucgagaaagguaaaaguggaacgaucaucacacccuaguaaucugacuucggaguaaauguccaaagcagaugaaguuacccaguguugacaaccaguacuauucauuguaaaacaaacaacaaaaggcuauucaaccuauuguucuggagucugcugugagguguacaaaguucaggggcuuacauaugguaaaggccuucauguugaaggcaaaacuacauguuucaaguuaggaaaaguuaucacuuaacaaaaggaacaugcaugaauccucagaguggacuucuucauaggccuacucacauugauuccauuaaaccucacauacagcacuuaaugagucacggugggaauaaauuucaacauguuuccauauuuucauagaaacuauagcaaacugucagauguguaggaugagccuggagugcauugugugugacaugagagucaccaaguguagcucguacacuaccucaccuguauguaguccacauuaaaggagcaaaucuacuagcaggguguuuaauagagagcauuggacuguuacaagcugccaaaauuauaaucugucuuccuaagaaaacauguaaggugaaagaaaaaaauacguaagauaauucaugauaguuggcccaguuuauucuguaaaaauagauguugaaaaauacuuacauucuuugucacugcuguguguguuuguggccaaggcuggccuucuuuacuauguggugugaauuucuaaucauccaccucuggaauacaggcauuaggugcauacuaccauacccagguuauauguucuagggauuuaacccacagccuccuguuuacuaugcaagcugucuaccaauagagcuauaucuuuagccuccaguuuuauuauuagacaaauaaaauguaauuuguugugcuucagaaaaugguaaaaguuaugaggacauuggcagucuaaguugaguuaacauuucauauaugauuuauaaucagaauuguuagaguaagaauaaguaaaaaagggaaacacagggaagguucagaggguccaucauguuaugugcuguuaacuuagcccaguacaugaacuccaaaguauauucuuacauuuuagucgauuuauuauaguugugugagguauuguaauaaugugcagacauuuuacuuauucagcaguuacuuaguuaauauuuucaccugcuggacaacauucugaauguugagggacaguugaaaaacagauuuugcccuuaaagagcugcauuuuaguggcacaagaugggaagugcuaaaccuuccagauguugagggugaucacaagaacacaaguggcucagaaucagggguagagaaaagcuccagucagcuggaugauggagggagugcucacucaggaagagggucuguagccagcuggaugauggagggaguggucugaucagaaggaaggucaguucuucacaggaacaggagaggccaaaugcuucacacuagaauguugcagaagaaagaugcuuagagccaugcauggugaugaggugacaggcagagggagagcaaacuaggaaaggaagaaagaggcuuacuaugacaguuagcacagaaauacauguacaacauaaacagccugaauuuaguuugucugggguuugccuagcaggcuggugcuacagaaguacuguuucccacuguauaauugugcugcuauaauuaggagccauccuaagaaggccacgccuaagcuuauuguuuugggaggcagauugcuuuauuuuucuuuuucucuggaucuuacuacaacuauugucauacuccccugucagaacacucccacaucccaucccagcccccaaauccacugauaccuaugauaagauucuggugagagacagggagggggauggaaugcccuuuuuuucugucagccagcugaaagguucaaggagacugaggccagugugugacugcauagagauaggccuugagaagccauaguuaguauagacaguggauuacucaggaccugcugugccucccaauggaguaacuauauugcccugcccuauaaaugaguuucauaaugagcacccaguaaccaaauuuauaucucugcucagcaucaggcuggcucugggaacaugucaaacuaaacugucuggaauaaacuaacuuuguuguguauuccacgaugcguuguacuggugaaugggucaucugagaaucauucaaauaacuuuguucccaaaccaguccuccugucgaccuaaugagcaccacaggaaagaaggggcaaacgagcugggccuugcuaucucuuuccaagauagcgcuggaguaauaggaggaugagagcuuagccuagguagugcugcuccugccuggagucacuccacuagaaacaagucuccagugagauguuuugguaucuguuuauuggcuugcauauauuuauuguauucucuuuuuuucuucuuuuguaauaaaauccuuuuguucaugaacuuucuuaaauuauugccugcauuuucuccuuucuuuugaauauucucuuguuuuaucuucuuacuagugugugugcgagcacgcgcaugugcucuuguaugcaagugccuguagaaaccagaagggagguauccgagcuucuagaaccagcguuguagguaguugugagccacuggaugugauccaaacucagcagaagcaccaagugcacgacugcugagcccccuucagccccucuucauguuuacuguauuuauuauuguuguuguuguuauuauuauuuaagcuuauuuuaucuauauaguguuuugccuacuuuuaugugugugcaucacauguaugcuugcuacccaacgucagaagacgguuccgauccccuggaacuauaguuauggauguuugugagccauauggaugcugggaacugaaccugggucucugcaagaguagcaagaacugugagauauucucuagacccucucuauuccuauuuuuaguaauuaaaagauuuucaaauauggguucuguuuuuccuuuauuuccacucuucuagcucuuaccaugucccaacucaugggacaaauucauggcuauuuccuuuauuguuguuguuacacgcacacaccagauaaacucaccuccugaguccauuuaguguugcucauaauguagauaucuuuaggguugaccauuuuggauuggguaaucuauuagagagcuuagccuugaugaaaacugauacucuauuucuuggcagccauugcuuaucugaaacucuagagcugggacuuugugaaauuuccucuauccaugacauauuggcaugucagcugcuauugucauugugcaaaucuuacguaaguaaccaugucuuccuggugaugcuucucugucauguguagaagaagcuaccuaacagcaggcauauuuauucacagguaguuggccaggcuuauagucccagcugugaauucccuccuguugagcaaaccuuaaguccagcuagacaacugacuuagaugccgcauuugcaccuuuggauagcuugacaggucugcaguggcucacugccacugguugcuuuuuccccuuggcagcuuggguaguacucagggaggagauuaccaaguuaguucaaccuauacuccuauguucaaauuguaugauggcuucagcaagggcaguagcuucuguuguuuguggggaucuccugggaggaccauuaucaccccaguaaacacauuagaagaauaguacuuacugguggugcugauggugcuggagguagugguauggguguguguauguaaagccaucaccuaucucagagaauucacaguugggaauucucuaaagcagcaccaggaaauucagcucccuugaaguugucuguuaaaggaagggacuaugaaagcaaacaaagcagcgggaugucauaugacagcaacccuaccugaaguagcuggucagauauuugaggugcgggcaguugcuuuauuuguuccauuacguuuagacagaaagguucaggugaguugcuuugcuuuguguagaggaacggcuacugggaagcaagaguacuugucauuguguaggugaaagagaguugggaggugugcaagguaaugcuugugugacuggcuugcauugaguauuggcagggggagaauuaaaugagguggaagaacaggaaaaauucuaagagcaaaguugcuaggaacuuuuauuuucacaccagagggagcucaaagccccaguauccaguuggguauugaaauugucaaggauugggacagcaauguugaagaaggaagaauagguauagguggcuauagcauagaaaacaaucuauagugugagauagcuugggauuuuaacauggcuguuuguaagggcccacagcgagaaguagugagaaccagccaguucauaaucaaagauucacauguauucucuacagugccuuccuuccuucccuaagucgagauucugaguacuuuaaaagaauaagguaagaaggggcuggggagaugguucagcaguuagagcacuggcaguuauuacagaagagcuggauucaaauuucaguacugauguggcaacucccagcuaccucucacucuagucccaauagauccaguaccauccucugugggcuccaggcgugaaagugcuucacagauacaugcaggcagaauagccauacucauaaaauaaaaguagaaaaucucaacgacaaaagaaaaaggaaaagaaaggaaggagggaaaagugcaguaaaugcauggaacugagcugauauuuuguaaaguguuguuaauuguagacauugguuuuguuugccgcucuaguuggccaagugagccugggagguugaggccuaaaucugagguggauuaaaguuucaugcaauagagagcaucauccagagcaucagacagucuguacacuacaggacaagauaggaaucacacagagcaucagacagucuguacacuacaggacaggacaggaaucacacagagcaucagacagucuguacacuacaggacaggacaggaaucacacagagcaucagacagucuguacacuacaggacaggaaucacaggaguaagaugcuccaggacaagccacauaugacaaaaacacgguuuuccauguaggcacaugaaaaccaacagcugacagaaacucccuccuauccgaugcuccugggaggagcgugaacacacccuccaagaacaacacuguguuuugaagaaacuaggucucaaguucuuaucuuguuuucuuggaguuuucucacaagugcucaaaauucugacaggacucuguuuuuuagaccauguucugacaguuuuaauuuuaugguacuuuauaguucaauaagcaauaauacaucugagucauaccacaaaauuguuacauuugaacagaaaauuuuagguggcccucguuuuuguuuuuuuguuuguuuacuuaucuguuuaaauaaacagacauggucuccacauaguccugcugucuuggaacuauguagaaccgggcugugcucaacucaagagcuccuccugccucugccucaggaguucugguuuguauugcuuguaugaccaauuuuguaacccgagugagauucuuugcacauauaccagagacuauuuuaggaauucacugagucuaucacacauuauuugcauuagaaauaugcuaauguuuuucucucugcuuccuucuagauuacauacagguuacggcaccuucuucgugcaaggugugaugcuucuccugugaccaacaccaccauccaguuucacugugauccuaguuucugggcucaaaauauuaucaacuuggguaggccauuguauacauuuucccuacaugacuguuuuggucauaacauguuacugaacauaacauugcuauucauuaucuuguuuauacucacugggaaaacagugugucaucaauuauaugcauaugguacacaaaugcaugaauguauaguacuuguuuugagaugauaugaaaauacauuugcuuacgggguaccuaaguuagggauuuaggaguucuucuccucauagaauccuguuugugcuugcauuuuuguuuuuuaguauguaugggaaucuuccugaauguauguuugugcaccauguaugugcagugcccacagagucaaaaauagggcaccagauccugcuggaauuacagagggcugugagcugccugccugccauaugagugcugggaauggaagagcagcugcuaagcaaucucgcgcaaccccaagaauccuauuuguauuguuaccucugucucuaucagagucuguuuccucuaacuguaugugaugugugggcuuugaugcuugggggguguguguguguguuacacuucccaugcagcuagugaacagccuucugccuauguguucgugugugcauccguauacuggugccugcagaguccagaaaagggcauuugauugcuguagcuggaguugcagggugguugugaucugccuaacaaggguacuagaaacagaacuugggucuuccaaaagaacagcaagugcucuuaaccacucagcuauuucucuagccccaaguuacgcuuugugcaguggggauagagugggguaagacaagaaaggucuccugugguucagggcagccuaccuugacuauguagucaaccuacccaacauaaaaucauguuauuaugugacuuucuuuuccccaucuugccuuuuauauugaacuucuuacuuugcaagccguaguagcuuuguaggggccagcacugucaccaugucacaaggcugacaacaauuuuuaaaaccauugcucaagccccuguugcucaacugcuuuaucuuacgaauagaagauuuuucuuuuuucuucccuucaauuuguuuuggguuuuaggucuuuucuuauccuggucagguuauaaauugugugaauguacagauagggagugugucuguaaguaguugaaggauaacauacagagaaguacuccgucuuaaauaucaggacucauugagucagagaauagcaucuuggcaacauuaggaaguacauaaucuugguaagcagugcagucgaaaggaacacucagcucucuugcugugcugcuacguguauggaaggauucucuuugcucuuaaaguuucucccagggaagugaugggaagcaaaagcucagaagcccccuagacauuuccccacagccagcauuuccuugauggcaccuuggugccuggauuucuuuuagagucaucaaacaugacugcucuucacccucaagacuacauugugugugagaaagggagcagcugcaggagccagugcuuuucucacagcuuacuaugggaaaggaagacacaggcguagacgaaugucauccauacaaaggaagaacaaaaaagaaccagggaagacuaggugauagaggacccccacccaaccaccccagcaggccaacaugagacauaaagguggucauuugcuuaucaaaauauauagccagaacuagaaucaagcacuuugaucuacccuacuuaaaaaaaauuacauagacauacaaagcacgggcuggaagagggcuguucuugaaagucuuauuauuuauaaaugaauucuuauucuuagaaguuaaguuuuuauagaauauaaauaaaaaccucauugggacuccuccauuuuuaauaguuuauaggauccuguguccaaaauucuucggcaauuaaaguucaacucaguagcuauauaauaugugguauuucaccaauuaccaaacauuuuuaucuuguucucuuuucuuuaauuagguucuuuaguaaucgaggauaaagagagccagccacaaaugccuaagcagaauccugucguggagcagaguucacagccaccaggugguuuaccuuccaaccaguuauccaaguucccaacacagaucagccuagcucaguuacgacuccagcauauucagcaacagguaauggcucagaggcaacaggugcaacggaggccagcaccuguggguuuaccaaacccuagaaugcaggggcccauccagcagccuuccaucucucaucagguaaauuuggaagcaggccuguccuaacuuagauaacuauagaguaauuguguugagcagcuuacaguaacccacacacugccaccaucuacauauuaaaauugacugcauugaaggauccuugaucuaacauauaguuuugagcucaccuccaaacugauuuaaugauuuauuuacuguaucuccuuucagccucuaugcauugucaucaguucugggaggcauaaauguucuauucccaagugacuugugccucuggccgauguuaagugugucucacuaagucccauaggugcgucaggcugagcaauacuacgagagucaauuuggaggcaguauuuagaaaacuacacuugauucuagaaacuaggacaguauucaccagagaaagucaggcagucagaauccugucuuuucagccuuuuaauuuuuccugagaaaaucuauauacuaucccuauuccuauuacaugugugguggucugucauuuugcaguccucugauuuauuuauuauuuauuuauuuauuuugacauguauuugcauuguguggugauaagugucugugugcauguccucguguacaggugagcaugcacacgucacaugugcaggccagcggcagacaucagugucuucccuuauugucauccacuugcuuacugagacuggucucagcaagugccuuagucacugagucaucucuccagucccuccagucugcuuuuugcucuguguacuuuuaguuaacccaguucuauucagguuagauaggacauacuagaugaauaaagacuugguauagaggugccucagucucuuuugcagaacuuacaacucuguuaauuuuuaucuucuuccuguuuggacagaaggguuaguaaugauuuuguaaaugacacaaaugagcuggaguuucauaaaagucauguacauggggcaaaacuaugcuaagaagucucauuacacuuaagaagaaaacuuagcucaaacugucuuagcaacaaaagcaaaaaggaaacagggcuaauacagagaugacuaacugauaaaaagaaaccauuaguuagaagaacagacuuuuacaggauuuuaccaacccuaggauauauagccuuuuuacuagcaauuuaacaaaacaugaaauagcuuuaaaagaauucuucaacacuaauugagaguuacagacauacagcaugcuuuuguuguuauuugcccauuuguaaugcugggacacagcccagacgccugcgcguuggaaagcacauguucuaccaccacuacggaguaaacccaucaccuuaauugccuuucuauaacggggaugauaacucaguaccugugaagaccguacuuauccaugucugcaguggcagacaaauacaugcaagcuuacagccugcuuugucuauagcauuuagugcugucauuuauauaaaaucucgacuguacaacuuaauuuucuaaccuagaaguacguuucacaauuucccuuguguuuuauuuuuagccuucuaugagcaccagucuucuauccuacuacuucuuaaaucugcuaaacaccuauuuccacuuuuuucuuuucuuuuuuuuuugcugucaauuuacccucuugcuauguuuuuaguuucuucauuuuccauuagcuucuguacauguaccuuuugugcacugccuucuaaaagugggugucuuguguuucuaguuauguguaguaugcagaucauacucuccauuuguccuacggacaaguagauugaaagcguugugcuuuuaaagucauucacaugauaguuucauaauucuuccugugaagaugagccuugucacuggccuucuuaaagagccagguggcagcaaagauggaacgcuuuauuaugugguaaaauaaguggagcagacuugauagauggcugauuuagugcugcagagucugcaccacuacaguguggauaaucugcucauuugagaacgaugacagaucaucacuguucuugacuuagagccuugcuucucacagugcccaggccugcagucucaccaagcucuguuauuuuccucauuugcuuuuuuuucaucuuguaguucuugaaugaauuacuuuauuugugcaaaauaucacuaguuuugcuacuuauuuuaagauaucugguauuuaaugauauguggagcuugucaaaauguucucauaaauuaacccaacuguagcaguucaggaaacaaggagaauacaccuuaugcaaugcuugcccgaaagcuucuuaaaaguagacaggguuagcauuuaguccagugcccuagggucaagugauaguuuguuuuguuuuguuuuuugguguuuuggguuuuuugucuguucauuuguuuguuuuugguuggauuauuguguugagcaauuaccaaaaggauugagacuaaggugacaggaaauaccuguucucccuuaaaaaucauuuguauguuuuuccuuuaaauaaauuuagaaaaccucuccuguaauuccucacuguuuucuguuuguguuuucaugguguaaaacccucaugucccaaguuuuuaauaggaaaaucaaaaaguuguuagggcuucuggcucguuccuuuaugcgguuauucagcaaugcuauuucuagucuguaucuuggaacuucaguugguccagaaacacuagacagaucugucuuucugugguucuguaauacauucuuagcugagggagaaaagaagcaauuaauuuagaguaggacaauaaauuccaaaaguaggaagaauugggugagagcugcacucuauagcugucuugguguggccacaugaacaaggauucacuugucaccaggcggugguggcucacgccuuuaaucccagcacuugggaggcagaggcaggcggauuucugaguucaaggccagccuggucuacagagugaguuccaggacagccagggcuauacaaaaaaacucugucucaaaaaaacacaaacaaaaaacccaaaggauucccuuguuucugugaaugagggacagaagugcuucuuucuuuaggaagucugaucauaaaugcaguuauggugucuugaacaaagaagcaacaaguucccaacuaugaacacaaucaauggucaaaaagucuggcaugugagcuugggguuugcuaaaacugcucaguuugaagacagcauugacaggagaugcggcagauaugccucuccacccagccuuacccauccaccagugucagacgugcuuucuccugcucaucucucccuccuccucccuuucucuccucucccuuuucuaagugagcccauucauugcuucuugucuuagugagucuucuguggcagagcuguuauccuugggaguuuauacaguaaugaucuggccucuuugggaggcuauuguuacugcagugcuuuuguuucuuuuuucuagcauccgccaccacgcuuaauaaacuuucagaaucacagcccuaagcccaauggaccaguucuuccuccuuauccucagcagcugagauauucaccaagccagaauguaccucggcagacaacaauaaagcccaaccccuugcaaauggcuuuuuuggcucaacaggccauaaaacagguauguguuaccuuucucucaaggugccucucuguacuucaggucauaggaacuuacauguagauaguagguggagguaagaaaauuguguuuuguaaucaaggaguccuugcauacucuaaguguguauauaaucaagaauugauuuaacaucuccagauuucauuuaauaauauuuaaaaauucauacuaguaucugcuucaccauuauaaguaaaaguuuaaauuguugcuuggcaucaaauucuauuuauuuuccuaauuuaugaccuuaccaaauaauuauuuuuagcucucacuccagcuaguugcacaguuggcagcgauugcuuuaauguacuggccaucccacuggcccagaaaguaguuuuauguauaaauuuaccaaauuauaccauguucguguaaugauaaacuuuuuaguuaguaagaaacuaucauguuaccuaauuuuuaugagauacuaucucauuucuguguguuuuaucuuguacauagauaacaaccccaaaaaguuacucagcaacaaugauucguuauucauggaagggaaggaggaaaaguauguaggaauaagauaaagauguugaguguggaggugcuaaagaugacauucacccccaaguucauguuccuauguguacauuuuacaguuacacacauacauaaauauguaggauuuuuuucagaacaccauguuucagagcgucgcucuccggugucacccauauauaaaugaugauguaucugggcagcuuucugccgacuguccuugggauagcuuucaguucucccacccccagauuuacucugaguuuucauguuuuucaaauacaccaaauauugaaauaauuuuauaggggacaguuuguuuuucuugccuuaguacauauugccuuuuuuuauuagauauuuucuuuauauauauuucaaaugcuaucccgaaaguucccuauacccuccccccgcccugcuccccuacccacccacucccacuucuugggccuggcauuccccuguacuggggcguauaaaguuuguaauaccaaggggccucucuucccagugauggccgucuaggccaucuucugcuacauaugcagcuagagacacgagcuccgggguacugguuagaucauauuguuguuccaccuauaggguugcagaccccuuccgcuccuuggguacuuucucuagcuccuccauugggggcccuguguuccaucuuauagaugacugugagcauccacuucuguauuugccaagcaauagcauagccucauacaaaacagcuauaacagggucccuucaaaaucuuucuggcauaugcaauagugucuggguuugguggcggauuaugugauggauccccaggugggguagucucuggauaguccauccuuucaucuuagcuccaaacuuugucucuguaaauauauugccuuuuuaaucuaacuauccaucuauacuguauuuuguguuugcucugaagcaaccaaacagcaagcagcaugauucaauuuuguauccuucagcauaccuagucuuaguuuguguuuaucucaacuuccagugugaaugagagggcuuuccucaguaaggcuuaauuacuuauucauauaugaaaaguaagaaagagaaguauaaacaucuuacagcucugauuuguggcuaauuauuuuuaggcauuuccgguagggccaaaagaaacuggaauguuuucaguucucuagcuuuacuucaaagaaauugcuuucuguauguuuauauuucuuauacaauucauauauauguuuauuuauuuuucaaggaugugaaauuguuuucuaguauaugcuaauuauuuuuaccagaaaaaaaguuuauuuuucaguacucuuaacacacgcgugugcacacacacaguaugcuuccuucucuccccccccccccccccaaacguucuuuccauccaaauaacauuugagcagaaacaacucuuccucuuaucugugaugucugaaaagagugaggacuuacauuucucauuuugcuucucaucuugguacuccaguggcagaucagcaguguacaggcuccgcccacaacugccagcagcuccuccuccacgccguccagccccacaaucacaagugcagcuggguacgauggaaaagcuuuuaguucacccaugauugaucugagugcaccggugggagggucuuacaaucuuccuucucuuccagauguaaguucauguaaaaucuguacuaauuuuccucugaaaauuggcaguaaauuuggauuaaguuuaagguuggguuuauugguuuaucagcuauuucugaaagcuuagucuuauucuuaggaauaaaaugugaguaaaauuagaaauuaugaauauuuagacauagaaaagaauguugcucuggguucugauguuaaagguguuugcggaggaugugucauaggaaggagggacguggggacgagaguggggggaguaugagcggaggcgaguuccuggagggucaggccugcagagcugcacaagaggcagaacagcacaccugccuacuugagcauauuaaguaguauagucagucuucagaaucuugaacuuugacaagggacuuuuaaaagaaucugacuacaggcagaaaauaagagugugguauugcuggcuucccuguccgggugcugugccugcacauguguugugccccacaugaaugucugaugccuuuagaagccaaaagagggcaucacacccuuggaacuggaguugcagauaguuguuagcugccaugugggugcuggagagaaaccccagugcucuggaggacagcugaggcuuuuaacuacugagcucuccagcccugcgagcucaggucggcucagugucgugacauacgugcaagcagacguaaaacacuuacacuugggaacuuuuuacacacuuuaguuagaaggaauuauguacaggauuaaacuuuuaguuuuucuuugcuuuuuuuuuuuuuuuuuuuuaguugagaucaauuauauuuccuaaugaucauauuauuaaucucacuagaaucauuucaguuuuuauaauguauauauuuuaaauggguagugcauacuuuuuuaaugcucauaucagacuaaggaaaacuuaauauaaauuuuaaaaaauuugcuuuccacaauauaaguuauuuuuauuacauuaagaaacccaguucuugccaggcgugguggcucaugccuuuaaucccagcacaugggaggcagaggcaggcagauuucugaguucgaggccagccuggucuacaaagugaguuccaggacagccaaggcuauacagagaaacccugucucgagaagaaaaaaaaaaaagaaacccaguucuuuauguaccaucugaaaacuauugacuaaaguaguaccuaagaauauugacauauaaauggcccuaucuacuucuuccccccaacaccauagaagagaauccauagaaaauggaauuucucuuccuuuuuuucuguauucaauuauguacaguuuauacccuggcuuuaggacccaguucucuuacagaaucccaacugagaaaggcuacaaaggcaugaagggauuguguauguuccuaggaaacuugguguauuuaggcauggcaaaauauuuauauuuaagucauaaaaagcuuuauuaaauguaacuuaucgucugugugugugugugugugugugugugugugugugugugcgcacacaugauguggugcaucugcucucuguauauuuaucguggguagacuauaaagaguaaccuuuaguuucuugcugggggaaguugucugacagaacucucaguuugugucucacuugagcccuuagucucagcauuccagaggcagaggcaaaagcagguggguuaaugguaguucuaaggucagccucgucaguaaauuguguuccaagauagccagggcugcacagagaagcccugccucaacaaaaaagcagaggaaggaaagauaacacuuaggauugaaguuuucucguaaauuugcaguuguuuuuaguuuucaacauuaauuugcccugaaauaauuucuucucucggaagauugauuguucaaguacuauaauguuggacaacauugcaaggaaagacacagguguagaucacgcccagccgaggccuccgucaaacagaacggugcagucaccaaauucaucagugccaucuccaggccuugcagguaaagccaccuuuuggauuuguaaauguuuucugguuuuaacucguauuuuuacucauaauaauuaaguuucccucagccucauuuuugguggugaugaggguucugccucgauuuuuaaauaacaaugauuacuucuauauacauuuauguguguguuuccguaucugugccauagugcacauguggaagccagaggacaacuuggaguuggcuuuucuccuuccaccaaguggauucuuggcuucaaagcucagguugucaggugauaagugagccuauuccaccaaccugaguuuuuauaccauguaaaacuagaauucuucacaaagaaggaaacacagguuccuuuuguaguuucaacaaaauuuauucgcauuauagcaaccaaagagcaaaguuuuaucucagugucauuaauacauuuagaugcugugguaucaucucuuucagaauguaauuugucuagcgucaaauguuauuaguuaggauaaaaagaggagagcaguuuugguguuuuguuuugcuuguuggaguuuaauaguauuuaauaauguuuaacguagggaggaaaggagaugguucacuguauaagagcacuuccugcuccuucagaggaccaugguucuguucccagcagguccaguuauuugugggucucgaggggacugcuccugaaaccaaaugggggugagagagaaacggagccaagcacagaaaagacagagucaaucugaaucuugucaaggccucguuguauucagcaaaacuuguaguuuuuauacaaaaagaccaaaggggaaacaacccuuaugcagaagggcgggggagcagugguaauuuuccuuggugacuacaaggggagguauacuaucuaaaaguacaccuuaugguuaugacaucugcuguuugcgucagucaggucuggagucaucuugugguaauucucgaaacaguccgcuggugaccuuugucuggacuuagucagcuuggggaggagguccagcuuuaugucuuaagacuugguagucaucuuuuucacuuggauuauuauaaagaauuuaguuuugacucccaacaccagcacacacauggcggcuugcaacagccuauaacuucagugcugaccuccccaagcauugcaugcauaggauacacuuaacauacauacaggcagaacaaucaaaucacauaaaaguaaaauuuuaaaaaauaauauuuuaguauacuuaauugauugccacaagaaacacuggaaauauacuccuggagucuugauauaggaggugucucuugugugacauccuggggagacauuaacagauacauccagauaauaugcuggugacaauuagcuaaagcaagaacugcacucaggucuagcccggugaaccagugagcucaccauacccugccaguguggcugguaacucagcaaagaggaucccuguagccaccugcacgguuugcagccccaccccccaaccccaccccaggacccugccaaagagcucuucuguccccgcacuugccuaacauaacuucuucagcuuccugagucucaggagccucccuuuucccuggaggagagacuuucaguucuuaggaaguuagccacaaacagaaucuucuuggaauaaugggaaggagaguacuuaauuuuuucagcaauguuaccaaaaaauaaggugguuacaaaauuuaaguagagguuccuauuuuaauaauaaaccuacaauaaaauaaaagacaaaugcauuugaauaaauaaggaauguucuuggugaugaaagacgggugaaucaguaaucccuacccaauaaaggcaucuagcaaaauagacuaaacaaaacuguuccucucuccaguuguagaagagucuaagcagguucugguuucuuacuacugaauuagcuacgauuuuaauugugaugauagcggugauacagaugucagcgggacccuuccuacauacuguacugaaggcaucauauuaauauuucugaggcugacguuuaucuccuauggacugcccgacacuagacagauucccauaugaccucuacugccuccagaguagggauuucacuuacuauuaauagucuuacaccuacugcuguaugugcacauguauauaagugccacagcaugcauguagaggucagaaaagaguuugugggaaucuaaccucuccuccucauguguggaucccagggauagcuagggucauccagcuuggcaggaagcugcuuucccuccugagccaguugagcuccugagcugagguucuuuauggcagcaguucagaaccucuuguuuauucccucacaucugagucugacuuucacuuuugcuaugaauuguuguuggguggagccagggaugcagcuggagcugucaggcuugcugacuaguaccuaccccuaagccacccucuauccccagaacuccuuuauauuagccccuuucucuucuguaguuuucacagacccugcagucuucuaccuaugacgcuacugcaggaaagacuuaaaaguguuuucuuaguggaacccugguugguagauauccugugauggacagacuuucucccugccuagaaguccauagcgucaugacuguaaacuuugguguaacaaaauauuaaagauaugccuaugguuuuguagaguuuuauuggaugguccugguuuugguauaacuuaaugaacaguucaacaaacuugauugcauagaugauucauucaccugugcgugucuguuuccuucucagggccuguuacuaugacuagcguccaucccccaauacguucaccuagugccuccaguguuggaagucgaggaagguaaacagauuaaccguauuuauggguauagucuucccucgguauccauagagaaucaguuccagggcccauccgaguguaccaaaaccugcagauguccaaguccucugugguacaguauuuguauauaaucuggucauaucuuuaugcaugcuuuaaaucaucucuagguugcugaugcugccuaauacaauuugacuguuuaauaguuacuuguuauauugcauuguuuagggaauaaugacaccccccauccugaagaaaauacuuagaauagucaagucauuuagguauaaaucagguuuuaguaauuuucagauccgugauaaaucuguuuagaagguuaguauguaaggccuuucugucaucaucgaggaaaugaguacugcauuccacaacugcgcuuuaaacaucauucacugcugauauacguuacuauugugaaguggcaguauuccagaauguucuucaguuuaccacuuuuagguugucugaucgugucuccuucuccgucuuucucccucacagcucuggcucuuccagcaaaccagcaggagcugauucuacucacaaggucccaguagucaugcuggagccaauucgaauaaaacaggaaaacaguggaccaccugaaaauuaugauuuuccuguuguuauaguaaaacaagaaucagaugaagaaucuagaccucaaaauguaauuauaccaauacuugcaguacuaaucccauuuaagaggcaagaaaaggauuucuuaaauugaguuucccuccccucauggcuccagauugugucaaguugacauaaaaguagcuggcacagugucugaugugucauuugaauuacacauuaguaacuaaaauaguaguuuuaguauuaguagcuacaauaaaccaucuuuacgucuuacugcauugacuuccacacugcucacuuuacugcuuagucuuuaguuguagccaucgggagauuaaaggggccccuucagacuaugcauucuacauaaauggcgauguccucucuuugguugcagacuaacuauccaagaagcauacuuaccucccuccucuuaaacagcagucagagcucugcuucugaggaaaccguguuacgaucugaugccccugauaguacaggagaucagccuggacuccaucaagaaaauuccucaaauggaaagucugaguggucggaugccucccagaaguccccugugcaugucggagagacgaggaaggaggaugaccccaaugaagacuggugugcuguuugucaaaaugguggggaacuccuaugcugugagaaauguccuaaaguauuccaucuuacuugucaugugcccaccuugacaaauuuuccaagguaaaacgauaugucugucuaaaguaugaagcacaggguuaggaguguggcauagugcuagagcuucuuagcuggcaugcucguucccagggagcgagacaguguucuagagcaaagggguugaccuggaaaggaaugacaugggggggguacaacuggaaaggaaugacaugggggggguacaacuggaaaggaaugacauggcggugggggggggggauauaacuggaaaggaaugacaugggggggagaggaaggcggagaagggauuuuuuaaaucuaacaauuguaaugaacuuuugacuauuguuacaaagauuuaaauuccauuuggcacagacguauacuccagaguucccuacagugcccucuucccugcuuccuagucuuuguacuucucagaaagcucaucuguugugauaaacagucauaggcccuuucugggccuuguggcccacaccuguaaccaagcauggaggagauagaaggagggucacaagugugauguuuucucagauauucauguuaacuucuuagaccuuugcaucacauuucugccauuucuuuucuguacuucuuuguaccuaguaguaugugauaaauaggcagaggauaaaacccuguccaaagaaaccugccauagguggccugcaaguggugggaaggugguggugaagacagagcuccgacauacuuagaacucaaagguacauuaucccaacaguggagaauggaucuguacuuucugccgagacuuaucuaagccagagguugacuaugauugugauguucccagucaccacucagagaaacggaaaagugaaggccuuacuaaguuaacgccaauagacaaaaggguaagugucugaacauuuccacucaugauuuuauacugaauucuuccaccuuuaaguuucuuucucucucuucccucuauauauaaagagagaagaagcaauagaaaacuauagugucugugugggguuuuuuuguuuuuguuuuucgagacaggguuucucuguauaguccugacuguccuggaacucacuuuguagaccaggcuggccucgaacucagaaauccgccugccucugccuccugagugcugggauuaaaggugugcgccaccgcaccuggcuuguguguuuguguuuaaacucgugcaugaacgcucauccaugcaucuacacauggagaccagagauuauccuaacauaucuuccucuuuugcuuuccaccuuacuuuugagacaaauccugucauugagccuggagcucacugggcuagacuggcuagcuagcaaguaccuggaauucacuuguuucuccauccucccucauaucaguuacagguggaugcuaccaugcuuggcuuuuuugcuuagguuuuaggaauccaaaucccggugcauagaaaaagcacuugacccacugaacuauuuagcuagguauucaaaauaguauacuugagcagaguaaaguguauaucccuuauagauagagcugggcuuuggguugugagggauagugcuagaacaaauuggagaggaggggagaaagagaggaagggaggggagagagaaggcuaccugggcagugagcccugaguucccaccauguccaccucuuugcuucugggaauacuacuauacaucaggucaucuagcuuccuuaccuuccgcuuggaauucaucccagguauuccccacugacugagccaucucuuuaguccaacuaaaucuuggcuuuuuuuggcaggccaagaagagacaagaauucacuguguagcccaaacuagccaaaaacucuguguaguauauacuggccuugaauucacaacauuccacuugguucugcauuccaaguacaugcccagccuuguucuuuguuucugaucuuuuauuuuauuuguuauuguuauuuuugauuuauuuuguuucguugagauggaauaugacuguuagugcagucugucaucaaacagcaauccuccugccucagccuuccacgugcuagauuacaggaaugcauagcuuuagucugagcuuuuaaauuuugucuaccuuaauuucugucuuguuucauuuuuaucacugguuuucagaaucuuuugagaauugacaguaagauuuacuucuaauguucuagaaaauaauuccagggcuggagagauggauggcucagagguuaagagcacugacugcucuuccagaggcccugaguucaauuuccagcaaccacaugguggcucacaaccuucuguaaugggauccaaugcccucuucuggugugucugaagauaccuacaguguacucacauauauaaaaauaaauaaauaaauucauccggaaaaaaaaaaaaaaaaaaagaaucccauacuuuggucacaugaaauuuuauuuaacauuuagcuauuuuuuaauuacuaaaaaguuuaucaaaauauacuuuuaaaaagaaaguaugaagcuugacauguaggcagauguguaguacaguguguguucccggagaggcagguguucacuggucccgaggggaggaaguagcagaacgcacagcaggacacuucugugugcaagagagaaaagacagcucuuaccugggaaaaggcuguagcacuacauugauuaauaaauaaucagcaugugagccuccuccagugacugcugauucacacgugcagaccggagugauguggguaaggaggggcacucauccuaagggacaaauguguauucccuagugugauuggcuuauucgcucaauuacaggggcucucguauccauauucccuaagcuguuagcaaauucagauggaaagcaaaacccaaagauucaguguuccuuacugauuccccgggcuuuaauuuugaauugagacccgugaauucuuucagaaacuaagguaugacuucauucuuauuuguauuuuucauuagaaaugugaacgccuacuucuguuucuuuacugccaugaaaugagccuggcuuuccaagacccuguuccucuaacuguaaguauuagugucacauguacagguuuacauggagggauaacaguaaugucacauguacagguuuacauggagggauaauuuuuaaauuuuaugagaacccaauuucuuuaucauuucaauaauuucuuguaucuaauccaaaucuuuuugugggugguccuuugggggaguguguauagauaugugugugggcagcacacacaguuuuugguuuuugagagaggaucacaguaggacuuaagacccgaggauuagucucugcuagcucuccuguaauccccaggaaucugccugucccugccuccccagagcugggauuauaagugugugcugccaugccugacuuuuuacauagguuugcauaggugcuugugaucaaacucaugucuucauacaucacuaacacuuugcugacugagccuucuucccagacuccuaauccaaaucuugaacacacacacacaccccuuacuauuguccugcacacucuucugccacugguucccuuccucucacucuuuccugguaugcaugugugcaugagugagugcuuuaaaucuaaaucccauauaagacaggacagaaucuauccucacuucccacauugcucugucucguuuccucgacagcacuacucuggcuucccucacacagaucuaccgugcuuucguguccuauacacccuuuguccuucugagucacuuagcgugaugaucucaagcuucauccauguuccuacaagugaagccauuccacuaaauagauaaaugcauguuaauugcaauuagcugauaauuucuauuugcuucuugaguuuccucaucccacccaguuuacuuuuauauugggacaguuuuuuauguuugcuguaucucagaaggcuucuauggcaugaguuguuguggacaauagccaguacuuuuuuuuuuuuuuuuuuuuuaaauaaaggccucucuauaggucuagacuuacaaaaacaaguagaauuuaauaauggagaaaaucagagaaucaucauauauacacacacauauguauguauguauauauguauaugugcacgugugugcauacacacacagagcuauauugaaaguaugauauaacuuugauaucuuuagaauacuagagaagcucccaugcuuaaaguauuuucuccaucuaugguaucugaaaguucuuucugaaauugaauaaauguuguuuugguuuucuuuaucgugguugugguuugguuggguuggguuuucuaagacaggaucucauggaucucaaacugucccgagggaaaugaccgugagcugccugacccaccuacucugccucccagugacauuuauacuuacgguguguuggguuuuaaaaauuaaugcaaacuagaaaaaagaaaacauaaauaauuuagcuugagucaggcaauuucaugguagaaaauauugcaauuaaacauuauuuuauguaguuaauguguagcucacuguguaacacuggcuggccuggaagccauuauguagaucaugcuggccucgaaccuggagggauucuccugcaccagcaauccauuuuugauauuuagguuuuuauauuuaaguguuuagaacuaagaguuuuccuuuuuuuuuaauauuuauuuauuuauuauauguaagugcacuguagcugucuucagacacuccagaagagggagucagaucucauuacagaugguugugagccaccaugugauugcugggacuugaacucgggaccuuaggaagagcagucggugcucuuaacugcugagucaucucaccagccaaacuaagaguuuucuaagggcacuauggauuaaacccauaugugugugugugugugugugugugugugugugugugugugugugugaauauauauauauguauauauauauauauauauauauauauauauauauauguauguauguauguauguauguauguauguauguauauaugugugugugugcacacgcgcccgcaugcccacucacucuacuaagcuacagccccaguccaaaaauggaaauaagaacuucagggaaaagaaguuuucauacccaaauggagcaggguauagagaagauagaaguuugugccaguacauacuuaaaaauauaacccaaauuugaugcuuuuuaugauucuggcuuacauuucuauuaacaguaccagcagccacaaguuaauccccuuuugcuuuauaaaacucaccucauuaauccucugaaauugccagggucuggaauaugccaugauuuugggcagggucaagcucuucucuccuuggaauaguacaagacaguccuguugcccguccuuuuuagauggguguuugcuugcuuuagaaacaggcucuuauugucuagccgcugcuggccuggaacucacuggcuggagcaggcuguggaagucaucgagguccugcugccucugccucccagggcugguacuaaagccaugcaccaccauggccagaccccucccuaaauguacaagguaguguuguuggacagagcagccgggcuuuacaagcacucacccacucuugaacuccuggcuaaccuagaacuugcuguguaaaucaggcuggccuccaacucauagaccugccagccucucccucccaugaguugggauuaaagguauauguuacauacccagcuuaguaauuauuuuuuauuuaacaaugaagagggagcauauagaagcuuuaaaagaaaauacuguguagcauuugcuagccuggaaacccuuuuuuccauuaaaaaucauuguuaacuaguucacauaguaauucuauucuuaguucucugaauaacccauacugauuagaugaauaacaucauggcugaacugauuuacauccccucaguaguguguguaagggcuccauucuccccauaguccucaucagcauuuacagagugugugugucugugugugugugugugugugugugugugugugagauuucauuuuuuaaugguagccauucuggcugggguaagauaguaucucagugugauuucaguuuucauuuuccugacugcuaacauuaguaaacauuuuuuccuuaaugcuuauuggccauuuauacuuuuucucuucuaguuuaaauguucagaggacacugugcaauggagauauuugcacauucauauuuauuauaguacugugcacaguagcugauagaauaagccuagcuguucaucagcagaugacuggauuuaaaacauacuguguauugcugagugguagugacauaugcuuuuaaaucccagcucuuaggaggccaagggagguggaucaucagguuucaggccagccuggucuacagggcuacauccagagaaacccugucuugaaaaacaaaaccaaaaaaaaguuauauaugcauaaugaauuuuuagucagccauaaagacugaaauuaugucauuuuuccaaaauauagauauauagagauaauucucugaaugcagaaaagguguugcauauuuucucucaauuaugggucugcggguauuugauugauauaugccuugggaauuggggagggaagacuuuuuguauaagucuugauauacuuaauuaucuguauuauauccaacguuauauacaguaaauauauaccaauauaaaacauuaaguuuuuagagaaacugacacaaaaccugugugaaaacauaguagcuauuuauaaaugcuuguuucuuugauuuuguuuuucaccaaugacaaacuaaaaugaagaaaaauagaauauacuauaggaccggguacaauuuacuuauuuauauuauaauaacucauuuguuuuguaaggugccugauuauuauaaaauaauuaaaaacccaauggacuugucaaccaucaagaaaagacuucaggaggauuauugcauguauacaaagccugaagacuuuguagcugauuuuagauugaucuuucaaaacugugcugaauucaaugaggugagauggggcgaggccacagcaauguggagagugaucuuaaccagacagcuugccagcagggaggucccaaggugucugugcaauguugcgugucuaccagggcauggcagagcuugcuaaggaggcuuauccacacugaguuugcaaagguuuaugugugguaagugcaaauccaagccugccugaggcugagacaguguagagucaggauuuaucauuccuuccuuugauuugcaagcuaugcauuuuuagacuuugacuucugaguuuaucuugaaauaguaaggauguaccaaacaguucucaguuaaaaucuacucaauucacuuuauauaacugugucuuuuuuguucauuguuguuuguucuuuuguugacguuucucauccuacccaugaucuucuugucaccuugcuggugugacccaucccugucacaccacuccuucuggaaggagucaguacaaaguguaaccccagacuaguauuuuguuuuaucuuagugacaucccuaaguacuuuuccaacaguccauuacaaguuucauagucgugugcaaaauaggaacagaauugugagagauuauuuuuauuaacgaaaccugggucuuuuggguguuaauuccuaccuguauuuuuaucccacagccugauucugaaguagccaaugcugguauaaaacuugaaagcuauuuugaagaacuucuaaagaaucuuuauccagaaaaaagguuuccuaagguagaauucaggcaugaagcagaagacuguaaguucagugacgacucagacgaugacuuuguacagccccggaagaagcgucucaagagcaccgaggaucgccagcugcuuaaguaacgccgcacugggccagcgcgcugugcuagagauuucucaucaaaacuaaagacagcaaaaggcuugucagugaucuaaggguuugugagcucucugcucuguuuuugcuguuuacuggacuuugguuucuuucauaacccauuucuuuaaccucuugucaaugaaaauaaaaagaagaggaaggaaggaaauguguacaagaauaaaagaaggaagagaagguagaaaaagaagaaagagcaaagaaggaaaagacauucuuccccuuguuggauuucauacaggagccuggagugagugcuacacuaagaaagaaauagaguuugacauaaguugagauuuuagugugaucuggaugugugauaauccauuuuuagaauauuaauuucauuacccauuaauuauggccaacuguaaggagauaguccuguuacuauucuuaaaugaaguccuccccaaacgugaauggaagcagaguucuuugccaggcugccugccggaaaagguguagacagaugcuacuaagacaccaaauaguguccauguaagauggcaacugcauuaaaaaaaaaucaggaaaaacaaauguuugguuauuguuuuguuuuaucuugucuguuagagaugcugggcauagcaguucuaaagggccauucucucauggauugcuagaucggccuuuucuucagcuucggugagggaggaagugugugugucaaguguugcuguuugauccgccccuccacucuccccuuacugugcagagcugcaaguugcuaguggcuuuucuuucuuuuggggggagaagggcggagugguuggguuuuuugagacauuauuucugcaguauuacuguaguccuggcuguccuggaauucacucuguagaccaggauggccucaaacuuagagaccuaccugccgcugccucccaaaugcugggauuaaaagugugagccaaaggcucacagucacacucaguagaagcaucaaauauacaauagggggcaccaauauuugauagauuucuauagcuugugcccuggggcugcccuguugaaguucccugaaugggcuuucaaucugucuuucucauuucaaauaagcggauguuguggaguugggaagagaucauuugggggaaggggaaggaauucuaggaacuauucuuuguuggcuuucuguuuccuugauuuguuuuuuaacaacuuuauauuucaucuuugaucugccuuaauucagaauuuaauuuucuuuaggagaaaaaagauuccuuuugcuuguuuggugguuuuuuugggggguguggggggagcucagauaaacaaagcaccaaaugagauuaagguagaauaaaaucauugaguacuguuguacuagcccaauauuuga

SEQ ID NO: 2913 - RNA, 11868 nt, Mus musculus
cggggacgcgcuggcgggccauggcggaccucacucugugcgcguuccucaccaaggugcugugugcucacggcggccgcauguuccugcaggaccugcgcggccacguggagcugucggaggcgaagcugcgggccgugcugcggcgcgcggguccagagcgcuuccugcugcaggagguggagcugcgcgacggcccgugggacgcagaggccgagguggcggcgggcgagggcgcgggcgcgggcucaggcggcggcgccacggccugcagggugauggccguguccuccgcgcgccucugcgcccgcuaccagcgcggggagugucagggcugcgaccagcugcacuugugucgccgccacaugcugggcaagugcccccaccgcgacugcuggugaggggcggaguccucaguguccagcggggcagugggugcgggcgggcgggaugcgccuuccggaugcuucucggcgagccugggugggaugggacaaaggccuucgcgcuggccgcccugugcaccuagucgccgagagaaauaauauggaaggucucuccacugagguuuauuauucaccccccccccgccccccaauuugcugucccugucccaggaugcuaggauguuccacaacagcagcccgguugaauccguguugccacuuuugaauucacuuaugccaaaugccgcuugagggacaccugggggcuuuauggcccgcggaacuucuguucccuucucucccuccuuccauaaccacagcccuuucgcgcuuaaaaaucugguguccaaucgcaggaaacugguggcaggauggggugagggcauagugcugcauagcccaagcccagugcuuugcagcaauccgggaagcuuucuagugcuuucuuuguaguguugguggacaaagagaggccagcagcuguuguuggccugaagauuacguuuuagucuuuacaaaaacagauaaguaaucucaaaaaagccugaggguaggguacucacagaacagggaaaugaccccuggaagcugaguugccucaauccgaauuguuuuauuaguacuuggggaauucacuugugaaguggaaaugcccuaggcagaguuagacccaccagccucuucccucuucuugacccggccuccugacugcuuugaacucuucuaggucuaccuguucucugucccaugauauccacacaccuaucaacguccaaguccugaaaagccgggggcuuuuuggccucaaugaagggcagcugcgaauccugcuuuugcagaacgaccccugccuuuucccagaggugaguccuugagaagucgccauccuaccaucaacuguggcaaggcuuucucucacugaugucuaucccucgauguuuguguucuuuuguugggauaggaucuuaaauagcccaggauguuagugaacuugucauuuagcugaggcuagcuuucuguucugcuaauccacgccccuucaaaggcgaaggugauagggagccaccucccaccaccacuuuagauguucauuuuaacugcuuuuuuuuuuuuuuuuuuuuuaaagaaacucuuuuuuuuuuuuuuagauuuauuuauuuauuauauguaaguacacuguagcugucuucagacacuccagaagagggagucagaucucguuacggaugguugugagccaccaugugguugcuggaccuucggaagagcggucgggugcucuuacccacugagccaacuuaccagcccccauuuuaacugcuuuuaaguacuaugauuugguuccagauacuuaaacacuacccauuuuuauuugcuggagugguaaaauuaacacauuuguuucuauuucugugaauuuauuaacaaaagaaucaucucaaauuuaugagacuacccauaaaauaauuuuaaaagauuuauuuauuuggggcuagaaagaaggcuuagagguuaagagcacuggcugcuuuuucagagguccugaguucaauucccagcaaccacaugguggcucacaaucaucuguaaugggaucugaugcccucuucuggugugucggaagagagcuacaguguacuuauauauaauaaauaaaucuuuagaaaaggcaauucuuaucuuuuagaaaagauuuauuuauuauguauacaauguucucccugcauguacaccugcacaccaggagaugauaccagauuucauuguaacugguuaugaacuacugggauuugaacucaggaccucuggaaaagcagccagugcucuuaaccucugagccaucacuccagcccccuauaagauuuuaaucuggcaugaucauuguagacauuccugucagaggcaggaggaacaaacacuuccauccagaaugucucuuucuacagccugagguauuuucuuaucuuugagggaccugagcccugauaaaaucagauccauggcuucaaugcaggaaagaauuuuggggagagcucauaugaaguaggguuuauuaacagaccuuaaaaacuagauauauuuacuggugaguuuuuuuggguuguauauagggaguaguguagcaucugugugguagugcaucccuguaaccauagcagcagcagagaggggaaacaucucugaaagucugagaccugccuggucauagagugagcuccaguccaaauaauuccaggcauugaaacccggucuuaaaaaacaaacaaaaacccauagugaaucaguucaccagauuagauuagcuauugucaaaagagaagaaagaaaggaaggaaggaagaaaggaagggagggagggagaaagaaagaaaggagggagaaaaagaaaggagaaaaaguagacagugugaugaugaaguucucuagaggcuaaagauuugagaguucagggccagccugggauacacagcaagagcgucacuugaaaaugaagcaaaccaaaagacaaacccaauucaagauaaaacaaagauaaauuauggcaaggaugcugagaacucucauacauggagcaaccaguuuuggagguuuuucaaaaaacaaaaacaagcuaugcuuggcagcucacuccuguaaucccaacacuuggcugaggcgaaaggguaacaacaaaucuugucucaaaacaaaaccacaaaucccagcacuugggaggcagaggcaggcggauuucugaguucgaggccagccuggucuacaaagugaguuccaggacagccaggucuacacagagaaacccugucucaaaaaaccaaaccaaaccaaaaaacaaacaaacaaaccccaaagcacagggaccagagggguagcucagcuccuagaguacuugccuagcaugggcaaagcccugaguucuagccuuggcaucuccuaaaaaccagguuuggaggcauuuuugaucccccugucucccuaaggugauuacagccaugcccaguuuuauucagugcugcggaucaaaccaaaacuccaugcauguuagagaaagcucuccuagcaaucauguugggcagcuuaccuauaacuuuggcucuaggggaucuaugggcaccuguacucauaugcauauaacccgcacacgcacacgcacaucuuuaaaaaagaaaaaaauacaggcgugguaguauccauaccccauagucauaaugguggagaagagagacaggagaacccuggggccugcugaucagccagccugucugaaucagugaguucuaagucccaugagagaccuugucucaaaaaaaaaaaaaaaaaaaguggaggaugacuugaaaggacacccagugcugaacgcuggccuucacacgcaugcgcacauccacgcuccccugccccaaagaugccguuaacuucucuuuuaguaccgcuauaguuuauuggcuuacagguaagagugaaaaccauugaaaccuugcuucgcuucugccccaggucugucagauguacaacaaaggugucgauguccuuuauggcuacugcagccucaaggauagaugcaacaaguuucacgugugcaaauccuuugugcgaggugaaugccccuuucagcccugcaaacgcucccaccagcucauccaugcugccacccucaaguugcuagaggaccaagaacuuaguguuucaagcgucgugaauuuccagauaaucucugucuacagacauaagaaguugcacaagaugcuugaagagaaagguaggcaucaauggggaccucccaaacauaugugacaucacauaggcaaccgcaugaccugcagaccuguugccaagauaacaggcaacauauucccagaauccacuuggcucaccucucaccuuuaccuguguuacaucauuuuccauauaaauaaggggaaugccuccuccucucucucuuuuucccccuucucuuucugccuccaccuuccucccucucugucucucccaauaaacuucuuacacguggaacuguuuaggcccagggugccauguucagacuggagccgcuguuuuaacacaucaccaagagguguggggcggcgaggaggugugcugagguuuucuggucuguggaggaggaggagcagugaauggaagucagccugcagacaaaacauuuccugugcuaauugcagccuuuuccuuggaaagguuaagacugucaacauuuuauuugguuguuacuuuauuuguuuguguuguguguguguguguguucuccaacgcauagguguguaugaaggaaggaggcagaggaagccagaagaggggaucagaucucugugaggucugugaggugcuugcaauuacagcaacaaauucuucuaaucacugagcuguggccuagccccagcuaacauugcaugauacggaaauaugauuuuaaccaaagaagcgaagacuuuugccaaguuagaggauuugcccaaguauuugagcaugguagcuucugggcaaauugggagccaagaauuugguagaauaaucucaauagcucagcugggaacaugggcagguaauguacacaugguuugcuuuugugaaauugaacuaaaguuugucccuauuuuuauuuuuaagugauuuugaccacauuacaggcaacagacuagcuagaaauaaaaccacaugucuuaaggagugcuggagagaugucucagcaguuagaauacuuguugcuauugcagaggaccaagguuugauucccagcaccuacaugauggcuuagaaauuuuauuauuuauaaaauaauagaauaagugcuagagcgaaggcucagcaguuaagagcacugacugcuuuuccagacguccugagcuuaguucccagcuaucacaugguggcucacacccaucuguaaugggaucuggugcccucugcuggugugacagugacaugguuacaguguacuuauaaauaaaauaaauagauauaauaauaauaauaauaauaauaauaauaaaguuugucuuagccacuguucuauugcugugaagagacgccaugaccaaggcaacucuuauaaaggaaagcauuuaauuggggcuggcuuaugauuucagaggcuugcaucaucauggcagggagcauucauugugacaggcgcagcaggcaugagacagagacagagagagagagagagagagagagagagagagagagagagagagagagagagagagagagagagagacugagagauagagagccugaggacacuggggccuggcauggguuuuugaaaccucaaagcccacccccagugacagcuccuaauccuucuaauccuaucaaagaguuucacuccccggugauuaaguauucaaauguacaagcuuagagggaccauucuuauucaaacaagcacaaaguugcaaggagauccgcuuuguuguaacucuucuagcccaguuacagagaaagugcugaucuggcugugggcaaacugguuuuagcuuauuaucuuuguucacuaauuuaauaucagaaacaucuccucaaguugcucuuagucuuuccgacugcuuguuuuaauuuauuuacucccccccccccauucuaccccauucccucccauguugcuuccaacaacguagaauuaaaacagaaagcucaucucucuucuuccuuucagaccacucggcuucuacugagcaaccacaaggccuugggaaacaaggagcccucggggcuguggaagccaggccuuuccucccugcccgugcucagucgcccaggaagccccaauaaaccugaacgagcuucggaggaagugagaagccccuguccaucuuggaggaucagaagcaagacuuuugcugagcugcaguuuuuagccggucuuucucucccucacuuaguaucauuggcaacuguaauaccuaccucacaacuaacugaucgccaggacccaggguggaaacgaaaauacacuugcggcugagggcugagguuggaccuggagccagccaagagaggguaaauucugagcacguaauccagggugaauccugaagcuguagucucucucugcagccccugaaugccuucgagccucaauggagggcagguuucuucugcugucugcuaggucccgcugguguuuucuagacuccauuuacauagcuuauguuauggacaucacaguuugugaacucuguauuguuuguuacuugggcuuauacuuaguuccuuuuuugcaaagaauuguuaauauaaguguaaucaccucccuuauucuguaauauuucauacuccuaacaguguuugaauaucucauuuuguaucugugcaguauugaauuuaaaagccaauuuguaccuuugcuuggcuuguaggugcuaaacaauacuguuuucugauacauauuucuuuaacugucuguguggauaaccucugucccugcuuucugugucucuugcuugauuuugugaauuucccauguugcauuuuguggcuugggcccucugugcugucaucaauacuguguucauaauauucaaguuucuggguccauccucagucagcaacccagcuaaugaucucuggacucugcucggagguuucuaccucaccccaccccucucucauccucuaucgagccuaucagagcucagcugcucuauccugaaggaugugugguucacuccuuccaguuauaucuccccgguguggaugggacagaccaucaggaauccauauauaccuugcccauuucguggucucucccucccuccucccucuccccuccucuccuucucccucucucuccuccguccucccucuucccuccucccuucccuccucccuuccuccagccucucuguacccacucauccuguuguuuucagugugugcuuugcugauauuuguuguggucauguuccccaauguaacuguguaaaaagauuuguguuucuuuccauaacgugacauuugagaaauaggagcaauuuaguaaguuuucauaaagccaaacuuaccuuauuuggagaaacuuuuaucaugauaccaauggaucaaaggagaggagggauguaaaaguguccuuuccaaaccaguuuccucuuaguggacaguaagcucgcggacuuagggcuucucacuucaguugucaguaacaguacuucugagauuguguuuuauauucuuuucuuucuuuuaaaauucaaguugugacauuuuuuuccuagugguauuuguguguguguguguguguguguguguguuuguguguguguuuguguguguguuuaugcauugggaucaaaccaagggccuugcccaugugaaacaaaguccuccaccagcaagguacaucuaaguccuggacuaaacuuuaaaguaaaauuuuaguccagucccaguggugcaggccuuuaaucccagcacuccagaggcagaggcaagcagaucugugaguucaagacugccugauguacagagugaguuccaggcuagucagagcugcacagugagacccugccucaaaagaaauugcauuuaauuauuauuacuauuuacacucugucauuuuccuauauguauuuugcuguaagccaucuuaaauccuugaugggaugggguggcucaguguguucucuuuccaucaauagacgugguagcucuuacagugguagcucuuauaguauugcuuucucaugugucucaccagcaugcucucagauaugauguuccuggucuguaaccauuguugcaacauuuuauucaaguccauaguauuucauuuuaaguuuuaguucuuuugggaauuuagucuacaaaauuaucuuuuuguguauaugauacugggaaugggccuguggcucaugagcacuaggcaagugugcucuaccucugagcuguauucucagcacucaaauuauguuauguaaguguuaccagaucgagucuggcugcucaccccaugcugggcagauaaaguuaagagaugugguacugagggaagagggugauuuuauucacaaaccuucguagaaaggaaggauggggguguuuggagccugcucgcuggggagcuaacuuggggucaguuuacacuagugggugauggcugaccuugggcacucucucgcggugcgugggccagagaaugcgcagcucuuugcuuugucuuguguuuucauuucuucaugucucagaaacagagcaguguuuccuuggacuuuacuuuucaaauuaguuccacagcacacagggaaaugacucccgggguggagagguccugagcccucccccccccuuguguaaugagcgaacuaggcuucaugaucacgcccccaaccgauaguucaaguggagccuugucacuuuacugcacaaacuucucuagcucuaacacgagaauucucugaggacucucaggaaucgcaaccgguuuccuccagcccuccccccaccucauucugagaccauuauccagucauuugacuuaagacaacaaguuauugauuguccuuauuaucuuuuccucauuccauggcaaaucuguuuccaaguguuggaaguucuuucccccucagaaaccuucuaaagggucaguuuuccuuaccucucuccaccuucagacacugcccuggugcacacccccaccucucccugccuugguauacacacacacaaaacugucacugccuuugugcacacuucucuuauguauuucauaggcacauuacucaaugauguccagguuaauuguugaguuuuuuuguuuguuuuguuuuuguuuuuugguaugaggugcuggguaggcucuuauacccaugguagccaugguagccgcauuuaaauauugauauaguuggccuuugaagauuucauuuacucucucucauuuauuuguugacacggucucaugcagcccgggcuagucucgaacucacuauguagcucaggcuggguuugaacuccuuauccccuggccucuaucucccaugaggugggggugucggugaugcuaccacaucugccucuaaaguggcuuguguuucccugcuuuuaaauacguuuuacuuauuuacuauacguguuguguuuacguuuuacuuauuuacuauacguguuguguuuaggcuuacggauguagugaugugugugguucggugauguauauguggaggucagaggucgccucccuguugucaguucucgccuuccauaugugggagguggcuuuagacuuguaauccugcugcuccuuaagugcuagggucacaggugugggacacaccaggcucucuccucuucucccugccuccauuccagcugccugaucuuuuggaagcaaaccuaaggauauugcaguucuguuucuccugccgaaauuuucaucggccuccaucacgcagggcaagcauccuacguuaggaugcacaggggcagagcaacagguaaauggggguaaggaagaagggcuguggcaagcugucccaacaguggugguuccucacuuuggguuucuauccggggauauggacccagaucuccauauuguuccguuuuucagaagaagccagaaauacagauuuuugugagauaugacuuuggugauuagguauuaccuuuuuugguugaguuuuaggaacaaaaagguuagagucugcuguuguggaacaugccuauaauuccagcacuuaaaagcuggaggcagaaggagccagaguugaaggccagucuucauaacacagugaguuagaggcuggcccagcuacuagaaaccaugacucaaaaaaacaaacaagacagaugccaaaauuuccaccaacuugaauuuuuuggaauauauuucaucuuauuacucuuguuugguugguuaguuguuuuuguuuuucuuuugaggcaagguauucuaggcuggucuugaacucaguauguagucuacauuuuggauccuccugcccccaccuccuaaguguugacauuacuggcauuugcuaccaugccccacuuacucagugcuagggauugaagaugggacuugaucauguaagcaagcacucugccucccgaggcacauccucaggccuagcccuggacucagucuuuaaaugcuguugccucuucuguaaacauaaucacuacuucccucacugugccucaaagccuggcaaaauuacaauugucaagagucacaauaacccuuacugacccugaaaaggugguuuguagaccuccagcuuauaccucacgcuccauccaaagcuuugguuuugagcaaaaccauuaauuauuccucguggcaauccugacacuuagaaguuagaacacuucuugucagauacugaauaaguugauucagaauaugcuaauuuucauuguuuuguuugcuugguuuugguuuuauagguuuuaugauuuuguuuuguuuuugaaacaggguuucucuauguaauggagcccuggcuguccuagacucacucuguagaccaggcuggccuugaacucacagaagccuaccugucucugucauugccuuugugccccacacucuaccugagugcugggauuaaaggugugugccaccacuucuggcucugauuuuguuuuuuuuuuuuuuauuuaaaaaaaaaaaaagucagggucucacuguagcccugacuggccuggaacucauuauguagaccagguaggcuggaggcaucugcuaggucuauagguguucauguucaccaccacacucaugaucaccacaacccucaguucagguccuuuauuuaaaaaaaaaugcuuacacuuucuuuuuuuccuauugagggugcuguaugaugcaaguaauugaaucacugaaguuuagagucaacuucuguucaugaaguggguugcccaucaaggaugcucuccgucccacaucagugugucccgauuuuccucacuguguuuuuuuauauauauauaaauuuauuaugcuaguucuuuccugauuauuuuguguuuguguugcuauucucuauggggaucucucuggaguacugcuaacuuuuaagaugaaugguuaguuguaauaacuggagauggccugucugucugaauagaaaaucauagcuacaaagugauguguuauggagcuccaucauuucauguuuaauacaaauaaaaguauuuuugguauuucuucauuagaguuaguuguuagcuucacucuauucuuacuuguuggaagcugaagacuugauaaagugacucagucuuuuaauaucuucacaccuugcaugauugauugcauucaauguuuuuauaauauugaaacauccuuaaauuuauaauaaaucagcucugugugacuauggcauauacucuuggcauuuuuuuuuuucuguuugcaauucacugagauucauaaauaaaacucauuuguaucuua

SEQ ID NO: 2914 - RNA, 2450 nt, Mus musculus
ccccucaccagcagucgcggugggggcacuugcccagcauguggcggcgacacaagugcagcuggucgcagcccugacacuccccgcgcugguagcgggcgcagaggcgcgcggaggacacggccaucacccugcaggccguggcgccgccgccugagcccgcgcccgcgcccucgcccgccgccaccucggccucugcgucccacgggccgucgcgcagcuccaccuccugcagcaggaagcgcucuggacccgcgcgccgcagcacggcccgcagcuucgccuccgacagcuccacguggccgcgcagguccugcaggaacaugcggccgccgugagcacacagcaccuuggugaggaacgcgcacagagugagguccgccauggcccgccagcgcguccccgccagcccggggccuccaggcuccuccccgccgcggccccgaccggagccugcgagcuguagggggccgggccucagaaggcagggccugagccccugcaacauuccuggcuccuggguuccuggcagauaccggauaacagggagggcugcaaagaauguaaacugcugaagugguucucccagccugggggcgcgcgccuggaauguuagcuagcaccugggaggugggggcaagaaaaggccgagaucaaggccagcguccuuugcaaaggggaguuggaggcuagccuggacuacaugacacccugucucaaaaaaccuaguaaggaaccagcacaguggguaaaaacuuccuaaguguugggguccaugagucgccccacgagcuuacacaaaccccgauuucagucagauagggaugguuuauugaacacacaccauaauacugaucaaucagcuccaugccucagaugggauugagccaugauauuguugauuuuucucugucagcuuauaaauaaacauuuuuccuauugucaaauuggugacaauauacauaaacacccacuaaaccuaaaaggauuuuccuuccuaacaauggacaaauuccuagcguauuauuccucuacggaguggucgagagauauucuaugguuucgucgcuaugauuccuuaauggaaaagaacccuguugcuccuguagaaccugccuuucccuguguucccucccuacuaagaaacgguuuacauggaauccuuaucugcuuaccagggagcccagccgaaaauguaaacugagaagugguuccuugggauuaccuuguaaagggucugcucucaaacaauccuucucuguuugccucugagagaagccgaccuaagauacaacugaaaaaagaaagauucaaguugagaaagggguuagagaggaaugaaaaccacaugcacacagagagaagagacguucaagcaagauagagauagggaagaauuuuacuucaagggcacugauguuguaagcaaguguauccagaaguuuaauaagacugauucuguauguuacagaauagauggacugggaagacagcccaguggauaaaacacuuacuagacaagugugaggcuggaauuugaaugcccagauccuauacaaauacaggaagaugugggggccacuuguaaugcaagcacuugguaggcaguggcaggauccacaggggcagcuaauuggcuagacuaaccaaaugggugagaucccgacucagccaaagaccuugcccuuagaaauauauucaauuucagaauucuggauuguaauucauuccagauuaaaagucugaaugaguaccgugaaaaaauuugaaauucugccaucuuuucagagaguuuuuaaaugcuagaggccugauaucauauagggguaugguaauuugaauuugcuuggcccagggaguggcauuauuaggagaugcggcuuguuggguagguguagccuuguuggaggaagugugucacugugaggguaggcucugaaacaaguuuucuccuguuugccuucagaacaauauguagaacucucagcuccuccaguguuaugucugccuggaugcugccauguuuccugccaugaugauaauggaccuaaucucagaacuaguaagccaucccccaauuaaauguugucccuuauaagaguuaccuuggucacggugucuccucacagcaauggaaacccuaaaauagaaguugguaccaggagugagguauugcuuugauaggcaugaucauguuuuuucuuuggagaaauguggacuuugggacuuuggauuugggaagcaaugguaugcuuuaaguggggcuuaaagggccauccuaguaggaccauaaaagacauuggugcugaggaugaucugaacugugcagaccuggcccaagagguuucaguggagaagaauuucaguauguggcauagaaacuauucuugagauauuuuggugaagaauguaacugcuuuuugcccuugucugaagagucuacccgaggc

SEQ ID NO: 2915 - RNA, 2450 nt, Mus musculus
gccucggguagacucuucagacaagggcaaaaagcaguuacauucuucaccaaaauaucucaagaauaguuucuaugccacauacugaaauucuucuccacugaaaccucuugggccaggucugcacaguucagaucauccucagcaccaaugucuuuuaugguccuacuaggauggcccuuuaagccccacuuaaagcauaccauugcuucccaaauccaaagucccaaaguccacauuucuccaaagaaaaaacaugaucaugccuaucaaagcaauaccucacuccugguaccaacuucuauuuuaggguuuccauugcugugaggagacaccgugaccaagguaacucuuauaagggacaacauuuaauugggggauggcuuacuaguucugagauuagguccauuaucaucauggcaggaaacauggcagcauccaggcagacauaacacuggaggagcugagaguucuacauauuguucugaaggcaaacaggagaaaacuuguuucagagccuacccucacagugacacacuuccuccaacaaggcuacaccuacccaacaagccgcaucuccuaauaaugccacucccugggccaagcaaauucaaauuaccauaccccuauaugauaucaggccucuagcauuuaaaaacucucugaaaagauggcagaauuucaaauuuuuucacgguacucauucagacuuuuaaucuggaaugaauuacaauccagaauucugaaauugaauauauuucuaagggcaaggucuuuggcugagucgggaucucacccauuugguuagucuagccaauuagcugccccuguggauccugccacugccuaccaagugcuugcauuacaaguggcccccacaucuuccuguauuuguauaggaucugggcauucaaauuccagccucacacuugucuaguaaguguuuuauccacugggcugucuucccaguccaucuauucuguaacauacagaaucagucuuauuaaacuucuggauacacuugcuuacaacaucagugcccuugaaguaaaauucuucccuaucucuaucuugcuugaacgucucuucucucugugugcaugugguuuucauuccucucuaaccccuuucucaacuugaaucuuucuuuuuucaguuguaucuuaggucggcuucucucagaggcaaacagagaaggauuguuugagagcagacccuuuacaagguaaucccaaggaaccacuucucaguuuacauuuucggcugggcucccugguaagcagauaaggauuccauguaaaccguuucuuaguagggagggaacacagggaaaggcagguucuacaggagcaacaggguucuuuuccauuaaggaaucauagcgacgaaaccauagaauaucucucgaccacuccguagaggaauaauacgcuaggaauuuguccauuguuaggaaggaaaauccuuuuagguuuaguggguguuuauguauauugucaccaauuugacaauaggaaaaauguuuauuuauaagcugacagagaaaaaucaacaauaucauggcucaaucccaucugaggcauggagcugauugaucaguauuaugguguguguucaauaaaccaucccuaucugacugaaaucgggguuuguguaagcucguggggcgacucauggaccccaacacuuaggaaguuuuuacccacugugcugguuccuuacuagguuuuuugagacagggugucauguaguccaggcuagccuccaacuccccuuugcaaaggacgcuggccuugaucucggccuuuucuugcccccaccucccaggugcuagcuaacauuccaggcgcgcgcccccaggcugggagaaccacuucagcaguuuacauucuuugcagcccucccuguuauccgguaucugccaggaacccaggagccaggaauguugcaggggcucaggcccugccuucugaggcccggcccccuacagcucgcaggcuccggucggggccgcggcggggaggagccuggaggccccgggcuggcggggacgcgcuggcgggccauggcggaccucacucugugcgcguuccucaccaaggugcugugugcucacggcggccgcauguuccugcaggaccugcgcggccacguggagcugucggaggcgaagcugcgggccgugcugcggcgcgcggguccagagcgcuuccugcugcaggagguggagcugcgcgacggcccgugggacgcagaggccgagguggcggcgggcgagggcgcgggcgcgggcucaggcggcggcgccacggccugcagggugauggccguguccuccgcgcgccucugcgcccgcuaccagcgcggggagugucagggcugcgaccagcugcacuugugucgccgccacaugcugggcaagugcccccaccgcgacugcuggugagggg

SEQ ID NO: 2916 - RNA, 90997 nt, Mus musculus
cagacuguugagaggaaaaggggaaaacugagcaacagccacgacuguggacgcgagcgucucgagugugcgcaugcgcccgcucagcggccugcuucuauuuaugugggggauccaacauggcggcugcggcgacccuggcgauggcgguggagcccaucagaacguaguagcggggacggggacccgguccgcacucacgguggcguccgcggggacagcugagggugcuggagggaagaaaagugacggagagcagaaggagaggcgggcaggcgcgccgugcggcgucgaggcgagagccggcucgagcgagcgccgagggccagaacaguggggauggcggagccgcgcagagucgcguucauuagccugucaccggugaggcgacgcgaggccgacuucgcgggcgccgagcgcgagcccccccgacuggagccgcagccguaccgcgagccggcccgggcggagccggccccccgcgcugacgcgcagcccccggcgcgcgacaagccgcucccccagcgcgaggucagccgcgccgagccgcccauggcgcugcagcgcgagcccccgcggcccgagccgccgccgccgccgcugccccugcagacucccccuccgcgggagucggcuucccgggcggagccgccgccgcgaccgccgaaggagacgguucgccuggagcuggugcucaaggaccccacggacgaaagcugcguggaguucagcuacccggagcugcugcugugcggagaacaacggguacagagggucccucccucccggccgccccacagcccgggcgccuccggacccgccgccugcccgggcugcucugcacuucgcucgccccgggggugggguggcgggggccgggcagcuagacggggcgggagcugcgcggcucggcccuccuggguggccgaugcugcccccaccacaccgcgccgagccgguuuuccugugcaccuuucgaaaccucagcuuuuuccuccuuuuccuuucuguuccccacaccaaaucccgaggcccugugagccgugcggcuagcuucuuguggcacuuccaucugucguuccgguagaagggaagcgaaaaaaaaaccuugggggacacgccccccggucugaagcggagagauugugugaccccuucucggcucauccucauccuuccucaacccagcuguaccgugcgccagggcugcugagaugggcucguggccgggugguuuauuuuccuugauugaaggggauuuaagagaaauuaaacauuuucagaaacuaaugauuccacguuaggaaugaaaaaguggauucguaaugugguugcacuuguguugguaaauauuguuagcuuuguguguguguguguguguguguguguguguugaguuugugcacauugucuuugaauggaaaggucucuugucuuacccgguggcugcccagucauauuauuugaguggcucucauuaguucgaauugggagcauuuuguccguuguggauuucuggagaaugacggaaaaaaaaaaaaaaaaaaaaaacauucgcuuuggaucaaaaaaaaaaaaacuuaggaaaauacaucgguaugcuuuugagggaaccggugaacaaugggauuaggacagcgguuugucggugauuguaauuuuuauuguugugggcuggugaucuuuaggaaggggagaugggagagagagagacagaggcaggagacagacauugcucucuuguuuagcgacuaugcucuuuauuaggcugggcuuucuaaugaacugcagaauucauuauuuccuuucaacuaucuuuguuuugcaguggauuacucuauagucaaaagucucacauugaauaauaucauuagucuguguucauuuugcgccaguuaauccuuugauggcuaguuacaaguaugguguggccaucauuacuaaauguuuucagagaaaucgaauuguuagggguagagaccauuuuggucacuuccacuaguacuuuguccuguaaacucaauucauucauaacccuuucugguuuuauaauauaaaugcuucuuuuuugucuauuaaauuggaacauuuuccaaaaaaaaaauucuugcuuuucuaauauuaaguguacaauuuuuacaauuuguguaaguugcagaugcaaaacauuuuguagaugggcaugcuagucugugaccucggcacucuggaggcugggguggaaggauggagagaguucagggccacauagugagaaccugccucaaaaaaacaaaaaaaaaaaaaaaaaaccaaaccaaaacaaaacaaaaaaucaggugacaaaauggcucagcagguaaaggcacuugcugccaagccuaaagaccuaaguuccauaacuaguauccacaugguggaaggagagaaccaucuucuacaaguuguacacacacacacacacacacacaaaguauaguaaaacagcaagacaaaagccauuuuuaaguaaaaauacauaauucuaguuaguguuuugucauugugcaaauauauaggaaguaccuacacuaacccagauguuuuguuuugaaacaggauuuguguagcaccagcucuccuaaaauucacuuuguagaccaggucuccaacucagaucccucugccuccugagcacugggaucaaaggugugcgcccuccugccaggcuaaccuagguguuuuaaucuguuuuuagcuauaucauacuuauauuuaaccugcuauauaggcucuguggaauuuaccauuguguaugugaucuuuccuuuaccuuuaaagcaauguuugguauauggcuauauuuuuauauucuaugggacauaugaauuggguuuaauuuuuauguuugcuucauagauauuaucaauuuagggauuuauugguccaauuuuuuucauuauauagucaaccauauaucuuuucuuuguaauuccacaaaagaauuuauuguuuuuuauugugguguacuuuuguaggaaaaguugccacauuuuccuaugauuaguccuguuuaacauauuuauuauuuaagaauguguaaauuacacuucuguaaguggauugugauaguuccauaaagacagccuaggagagugaccaacuagagaaugucuggaaaguggugaucccaaaaugucuccuuugggaagucuguucuuuuuuucaaugcuaagaaugaagccaagggucuugaacaugccagaccagggauaugcucuaucauuugacaugacuccaaguacaccccauccuuuguuuuugagacaagauaauuuuaaguugguaaggcgccaugaacuuauuuuguagcccguauuggccuugaauucacaaucuuguuguuucauauugcugaguagcugggguuauaguccuguaccaccaagacuggcugagauuaguuuauuuuuagaguuauaauuuuuccaaaguaaguuuaauuuugaguuacuauaauuaaauaguguaucauaguaggauaagucaaauuagaaaaaaaagucaauuuuuaaauagcuguaugucagugaacaagauuugucagcugaaaguugguagcuguggacuguuuagaacaguauguguaaguaccaucugcacugggguacauuuaaauaaacccccuuucuaccugcugaaugaagugugcagucccaacuagcagguagacaguuggaauucuuuuguauuuaugaggaaaaguauauuuugguuaacucuuaacaagcaagaucaccuugcagguuaggucagcccuuugauuuguuuuuucuuugugguauucaugccauaacugugguucagguggugccugagacauugggaucgccccugcccugaaagaucaguuuguucaccauugcaauagugcauuaugaaguauguuuuggacauagcaaauacguaagaaaaaaguucaguucuuagcaaaccaagaaaucagauaaccugaguacccguuugagaacaaaaugaauuaaauguuuccuguaagagaaaaaccaugauaauagaggugauaccugcacuguuccagaacucuguuauuccuuugcguauguuggauaagacuuguaaaggauuuaccccggcuacuagggucaaaggacagaaucaucacauugauaucacacauagguagcugauaacuugcaauuuguuucaccugggugggggagauucuugaguuuuuauugggaaaagagaugguucuuuguagguguuuguugcuuugaaggaaggucucacuguguagcccagauuggccucuaauuucugucagacuucaucccucaaccuccugagugcugggguugcuaacauucuuaacuguaaaggagacaugagucuguuuuaauuuuauagaauauauguaaacaagagguagauuuuguugccuuauuaaguacagaaaauauuuuagaacaggcugggcauggugaugcucuuuguaucaggguacuaaggcaggauugugacuuugaggcuagccuagauuguguagugaaauccugucuugaaaaaaacauuuagaaugacauuuuaagaugauucuuaguuaaagaaaaauauaaaucuuugugcauacuaugaguuaggcuggguuggagguaaagcucagugguagagcuuuuuuggaguagacuagcaugugaaaggcucuggguucaguaaaaguccccaucagaauaaggaccuaguguuuguguuuggauuucccagugaugggagggaacaugcugacugcuucagucaguuccacuagcuucagaugacuggcuauacccuauuuagugcuuaccuucccuaccagucuuauuuugcuaguuuguuucccauugaauuguuuuauguuuuuuauucauaaugccaauuaggaugagaaaguauaaauauuuauuauuacauuuaaaauuugauucuaaaaucaacuccuuaaaaucuuaagaagucucuuuuuauucugaugugcugggaaagaugaccuucauccugccuucauccuacccauguuucccugccauguuuugggcugauuuugugugucagucuuuauauuuaggaugaaguaccuuaguuccaaauucaggauuuuauccugguuguaauauacuuucauuuuuaauuauuuaaagcugcuacaucaguuugaaaaaauuaacccuuuaaaacauuuccuuugagaugguuuugguuguguacacguuuaaucccagcauuggaggagagaaccagaaggaccugugaguuggaggccauccugguguauguaguaguaaguuaggucauccaagacuacauaaagacccugugccagaaaacaaaucaggcaaacaacaaaauuggauuuacuuucaaaguaaauuuuuaaaaauuagacaaaaauaguauuuuuuaaaaaguagcucuuggcuuuuuuuguacauugaaaaguaugcauauaaaaacacaugguggcgcacgccuuuaaucccagcacucaggaggcagaggcagguggauuucugaguucgaggccagccuggucuacagagugaguuccaggacagccagggcuauacagagaaacccugucuugaaaaacaaaacaaaacaaaaacaacaacaacaaaaaaacaacaacaaaaaaccacaucugcuaaaaauacauaggacuauguaagacuggcaaccugagcucaguccccacaguccacaggaagaugcaggguaagaaccaaccugguaaaguugcccuuuggccucugugugugugcacuacucccucauccccaccaugcagcagacaguaacauuuuaauuuuuaaaaguagugaagucaggaaaggauacaaguuuaucuguuuuagcaaguggauggugacuugcucauuguguguguguguguuuguguguuuuaaacuguauuuuagaacaguguuucauucuacacuguuagaaggaagccaugaugagcuauugcaccuuuuaacuuuguguauuccuugaauugauauccauugauaggagauagaggauacagaaauuauugauucuuagucucagcagaaagccaggacagcugcagauacuuuaguaauaacuuauaggcauaugaugaauccugauucuauaauugaauaccauuuuagggauauuaaguggcugaauuagucuuuuuuagagauaauaucaaaauaaaauguauguuuucauauuuaccuaauguuaguauuggggagaaauugcuuuauuuggaaugggaucauuuugcaaguggagucaauuuagauuguuaacuucuuaaccaucaaaagacuguacaguguguguaagucuguuagcuguguaccaucauuuaaaugaauagcuuuuaaugcuuuugaccuauuuguuuauauuaggaaaaccugacucauugaaauuuaaagauauauucaagucuggaaaauaauacaauggauguaguuaugaaauauacaauacugagaacaucuauuugauauacuauuaaauguauauuuagucauacugaacuguaguugacauaugauuaauacauggcaguguaguugaacuaguacuaauacuuguguuuuuuucccauuuccuuugaaucagaagaaacuuguucauacagaagauccauuuacugaugagcauaaggagaggcaagaaguggaaauguuggcuaagaaguuugaaaugaaauaugugaguacaauaauguucaccuagguaauuuuacccucuuggccuguuuucuuuguguagcuaguugggagggccuauaaauagcaacugcuuacuuaucuugaucucacaaauugaagcugaaugaaugguuuugacagccagacaguuuuacagguuuguccugacucuauuaguaggcugcauucauuacagucaguuuuucuagaaucuaaacaguuuacuuaacaaaucuuacacuaaaaaacuguaagauaaguaauauuuauuguaauuauaggugaagcgaaugagguucuaagugaugguccauggccacacaagaucaagaauaggcaacaaauccaacugcguguagcucuaacccugucuccccaccacuguuguggagaacuguucuuuuaguauagcaguuuaccagccugccucccuuuaagagaacugcuuuagacuguacuaagccccguggaaucagaaugaaacuucauuauaucauguuuaccuuaaauauucuugucugcucuguauuccaugcaacaauguauuaauucuuuuuuuuuguuuguuuguuuuucgagacgguuucucuguauagcccuggcuguucuggaacucacuuuguagaccaggcuggccucgaacucagaaauucgccugcuuugccucccaagugcugggauuaaaggugugcaccacuaugcccggcaauauauuaauucuucuguuaauauaaauauauuauaaaaguauaauauaauuuuucauauaccauuuccuccaauuuaaaaaauaucuaauagaucauagaaagcucuacucuuaugucuugacuuaugaugcccaaaagauuacucuugggauuucucucccuuugguaccacaugugucuuguucacucccauuucuacucccauuucuggguauaaauucaguagucucugugaagguaucuggcccagugccuaccuagugccucacaugggacucaaguaacuuugauucugagcaacuccuugcuaagcauuuacuaccacugaugaauuauagcuuuaaaguuuccuuacuaauaaagaaaaaaauaucugcuuccucuaccuuagagacuuggaauaucaauaauaaugcauguaucagaguccuaauagcuucaggguguuuauuuuuuguuuuuguuuuuuaagggaccaugauaaacuuggugaucaaaaguaauucugcagauccauauaaaugaaauaguugaagugaucauggugucgagcaugucuguagucccagcuccuugaggacagaggcaggaggcucacaacuaauuguaggccagacagauuugauuugcacagugaguuucaugucggggcuaaaacccagugagagccugucucugucugguuuuuuuuuuuuuuuccucucugugucugucugucccuuucuucuccccccucucuuuucugugcauguuucuaaaaagucugaguuuuauuuugcuauagacuauaaaacaaauguuagauugucaagauggcucagcagguaaaggcacuuucugcugagcccaguggaccugagcuugaguccugaaacucagaugauaggaaaucugacuugugcaaauuguccuccagccuccaugugugcaccaugcuaugcacaugccccuuccccaaaguaacaaaauacauguaaaaaugguuuuugucugucugucuauacuaucuaucauaucuaucuaucuaagcaggaucuuauuauguagcuuuagcuggccagagcucauagacuagccugccaagugcuggaauuaaaguugugugucaccaugcccagaaaaaaaaauaauaauuuaguaaguauaaaaauuguguugagugacuuaauaaguuuuaaaauacuuugaacaguucccucggauggcauuaggaagugacuauuacaaaagcguguaaucauuuguuguuguuguuuuucgagacaggguuucucuguguagcccuggcuguccuggaacucacucuguagaccaggcuggccucgaacucagaaaucuuccugccucugccucccgagugcugggauuuaaggcgugugccaccacacccggcuuguguuuaaucauuuuagaaaugauaucauucacuggugagcuauaacuccugagaaguuagagcauuuuuguccuuuuauugguuauaguacuuaagacucagcuugcuaaaguuuuggguagaguuugggcaaacuuguuaagaucguucuacucauaaaauggaaauaugaguaaauuuaguguucuaaacuaacaguggucugcaaccaggcuagauguagugccucucuagugaguccaaguuguucuacaucaccaagcuccaggacauccagaacuacauagaaagacccugucuucaaaaacaaaacaaaacaaaaaguaaaaauaaaauaaaaaaauaguaguaugaaaccagcccaccauaguuguagauucugccucuauggacucacccaacugaaaaucagaaauauuccaaaagaagagaaugaaauguguaccuguauuauacaaaggaagacuuuuuucuuaguauuauucccuaaacaauacagguugauaacaauauaacauugcauuagcuauuauaaauaucuagagauaaaguauauugcaggauauaaguggguuauauauaugcacuauaauauuuauacaggauauuugaacagccauugagcauucagagauuuuaaaauuuuuuagggguccugaaaccaauccauaauaucaaggguugaauguauauuaaaaucauaaaugcuuuuuaaaaaaacucuaaggggguggguagucuuaaagggaaaagaaauccuugcucaaaaaguaccuuuuuguuuaauucugaucauuugcuuuguugagccauuuuuauaauguggccucugaccuagauaaauuuucaauuucuuuaaauuccugcagauauauauuaaaaucauaaaugcuuuuuaaaaaaacucuaaggggguggguagucuuaaagggaaaagaaauccuugcucaaaaaguaccuuuuuguuuaauucugaucauuugcuuuguugagccauuuuuauaauguggccucugaccuagauaaauuuucaauuucuuuaaauuccugcagauauauugugaaacaccaguuuuaggacaaguggaagaucuuacaccuauaaguaaugguuauuaaaguguguguuaauguuucugugcugguaacuguuuccguugauuuaaaauuguaggcuuuuuauuagaagguugaaaucagcauggauauacaaagauaguucuaagggacuggaguagaaacugagaugcuuuauaaccaagguguuuucuucuggcuguuaagaccagagucuuaucagugaauguccugcuugcucugucggcaauacaugaugagugagugucgauacuuuguucccgucacugucacuggggcacuggggcccugucuuaggaauggcuuguuuguuuuucaguuuacugauggaaucauucagcauuggcuugagauacugacuaucagguuaagccaguacuaagugacucagugcuaaugacugagucaucaugaaggaguacuuggaaaaagaacuuuagggacuagagagauggcucagugguuaagagaacccaauugcucuuccagagguccugaauucaauucccagcaaccacaugguggcucacagccaucuguaaugggaucugaugccucuucuggugugucugaagacagcuacagucuacucacaugcauacaauaaauaaaauauguuuaaaaaaauucucuagaaagaaagaaagaaagaaagaaagagaacuuuaaaaggguucuucauuugagacguaacaagauggaaguaaauucugauuuuuuaaggucuacuuaaugugugaauuguacaguauaaaaagauucggaaaauuaugaauuaagacugugucauagggcacaguaaagauacugauucaaaauagguuugucuaccagggagggcacauugccagucugucuugaauuccuuuagguaaauguuaauguuuaaaauucauagugcauauguuccuuuugggugucuguugaauguguuguuccaaggcagaaauggugguacacacuuguaaucucaguacuuggaugcugagauagggagauuacaaguuuugagaacagccuggguugcauagcaaguuccagcuuugggacuggaauuacagauggguguaaaucaccuuguggguccuaggcucaaacugccagggcccucugcaagagcaacaaguguucuuaacuuuacugcaugagccgucucuacaacuuaaacuuaaaaaaaugauauacuuauguauuuucugugguguguauuuggaugugcauauucacauuacauguguggagauccaaggacaauuuauguuuucuccuauuacuuuaggucucuggggaaucaagcuuuguugucuggcuuggcagcaagugucuuuaccacugagccgucaucguuggcccuuagauguuuaauaaacacucauaguguccuuucugugauuagccugaauuuuaaauaagacuuaacaaacuguuucucuuaguccuuauauauaaccuuuuguuuuuuaauggcuauuagcauugauugaucauaguuauaugguuuguauuuauaucauuugaugcuuuuauugauaggauuuuugugagguuucagauuaauauaauagucaaagcuuuaguuagcucuuuuugauuaucucuuuaaaauugacacuuaaaaggauuuacaccuauuuaacaguacuacucgauucugcucuauugagcacuaacaauuaacaacagucauuuuuaauggcaacaagcugguaacuuugauuagacacacaugguccuaagucuaauuaccaauaagcuguuuggucuucuguauuugcucaucacaacagacuacggauuuuuuguuuuguuuuuagauuucccaaggaaaauuauacucaucuaauuguaccuugugcccugaaaguaucugaugagcaguggcugugguuguguguaguugugacuuuaauuagcauucuagagaaaaauuuaaaagucccccagauucaugagagagauaagaguccgugagggguaagaguccgaagaaagggaaaaaaugaggaaagaugagcgcaugugcuuaggaagggauuucaagggaccaaaagguuuauguuagaaaguuaugagagcaagauggauaggcaauugaacauuccauguagaaaaccuugaacuuguaaauauuaaggccuuuggauuugucuuauaguaacauauuucugaagcaggagauuauaggaagugguaugucugaacuauuuaucagacguaguaacgguaaacaugaagugagguuagccaagggauuggauacauuuagguaaaaauaauguccagcuuucuagaccuggcguuauaauggaaaggaagugaggugugacuaaaucugugagcaaagguuugugggagacagacuugagguagaaauaauaauucuaaguuuaaccccaggucuggcaaaaauuuaaaaguuaaaaggaagaguuugagaaggaaggaaaguaaagaagaaagaacugaaugacaggcuuugaagguuagaauuauugcgguauaguuuaauuacaagcuaucaauuuuaauugagcaacuuagugaguuuuaauaaaggcaccgcagucuguaagugccacugcagucauggcguaggccaguuuuaucuccccauaagguuucucuguaucucggcagacaguccucuaccacuagcccaagccuuggcaaucucugggcuguuucuguuucuguagguuuuugcauuucuagaauuuccuguaaaugaacccugucuguguggggcuuugguuuaacguggucuuugagagucaucuaugugucucaugugucagugggucuuccaguguuuuauucauucaucacacgaaggacauuguacuguuuucagaguuugaggcuuuuauuuauuuuuauaaaauacaguuuucuguuuucuguucauguugaggucagaggacagcauauaggagcuauuuucucuccucuacucuguaaauuccagagaccaagcucaagucaucagacauggcugcacagccacauucaaagccaucuuacuaggccccacauuuaauuuuacacuaccauacauaaaacugcuccaaagaagucacacagacauuuuauacuaauguacauuuuagcacugaggcagaaggauuagcccaauuugaggcagagauucacuguguagcccuggaugucccggaacuggcucuguagacuaggcuggccuugcuugaacuuugagaucaccugccucugccuccugagugccaggauuaaaggcucgaaccaucaccaccgccagugccuggcaagauaacuuauguuuuaaaaaaaaaaaaaaaaaaaaaaagccagccgugguggcacacgccuuuaaucccagcacuugggaggcauaggcaggcagauuucugaguucagggccagccuggucuacaaagugagcuccaggacagcuaaagcuauauagaaacccugucucgaaaaaccaaaaaaaaaaaaaaaaggcacuugcuaccaaaccuggaugaccugaguuugaucccuggaaccuacaugguagaagaagaccaaugcuuacagguuaucaucaggcuuccacauguguguuguaggcccacacaggaauaauacauguaaaaggaaaaagacauacauuuuuacugugcacucuuucauguaguaugcaugcuuguguuuguuuuguguucaagugugcucucaggggugugugugugugaaggcuagagaaccucauuuuguugaggaucacaggaucuucuuuugcauuuggcuagacuggcuggccagugagcucuggguuccgcccugcacugguguuacaaacacguacuacugugcccuuucuuacaaaguggcuguuggguuuguuccuuuuuugagacaggguuuuucuauguaguccugccuguccuggagcucccuauguagaccaggcuggacucaaacugacaaacauccuccucuuccuucugagugcugggauuaaagacaugccaacaugccuggcuuguuuguauguauguauguauguguguauguauguguggaugguuuugguuuguuuguuucugaggcacucucuuacucuauauagccaaggcuaaucucaaacucaggaucuuccuguuccugcugggauuauaaguauagauuucacaccgggcuguuagaucccuuuguaucuccacaagugaaauagaaguuuaguuugcguacauccuuguuaauacuugcuauuagcacuuuuaauauuaucagguaucgaagugugugugauccagaguagguaaaagcaugcauguggagaugaggaggacaacuccugggagucauguuucucuugcccugaguaaagucuggggauugaauugugcaagugucucuaaccucugagccaucuugcuagcuagcuaaguacacuaugcacaaaaccauggguacuguguagagacguaccauguggacacugaauucuaaaaagugacccccacaggcccuguaacaucucucuuuuuuuuucuagauacauuaagucucuguaacugucuuuguuuggguuuuauuucugugaauaaacacugugaccacaacaacuuuuauaaaggaaaacauuuaauuggggcuggcuuacaguuucagaaguuuuguccauuaucauugucauggugggaaacgugggcaugcaggcagaaauagugcuagagaaggagcugagaguucuuuaucuugaucugcaggcagcaaggagagacugugacacauuggccagacuugagcucuuaagaccucagagcucaccaguaacacacuuccuccagcaaggccauaccucuaguaguacuauucccuaugaccaaacauucaagcaugugucuaugaggaccauuccuauucaaaucaccacaguaaucaugaguuaacucuccuuccuaagcguugguguguucucauuuguggaaugugaaauagaagauggaagugcuuagugucugaugugaauaguagcugcugucaucauggucuaguuacauaacuaggggaguuaaauacagauuuuaugccuccaugaacuggugacauugagaucacugcccuuuuuucuaguucaacuggguuuguuccccaugugguagccaaguaguuuuacucaggggcucccacaaguguuuaguugcauuugucuugucuaagaauauaaauaucuuaggaaagacuugaguaggucaucuguuauaaaagacuccauacaacugucauggaauuuacauuucuucuggcuacaguaguauacagucuauaaaggcuggcuuguucuaugugcuugguaaauuucuuaaucagauuaucuuugcuuuuaguuguuuggggguaagaacuuaaauucugggggcuggaaagaugguucagugguugagagcacugcuauucuugcagaggaccugggcucaguuucuaucaccagugucacagacagcucacagcuguccaggacuccacuuccagaggauucaguggacccuucuagacuuugugggcaccaggcaugcacaugguauaccuauagacaugcaggcaaacacuuaggggcauaaaauaaaaauaaaaguuuuaaacgaacuuaaaucauuucugauauuuuaucauauuacuuucauaaacucacuguguagaagagugucauugaauuuucagucuugucucagccucccaagggcuggaauugcaggcacacuuuucaugcuuuaauuccugacauguguuaggaggacuacuaagaauagaauccaggacugcacauaugcuaaguaugcacuuggccauugagcuaagcuacaacccuuaguggauacuuugaaaucuuaaguacugguuuaaaauauguuuuuauagaccaaaaaaauuauuuauauauauauauacacacacacacacacacacacacacacacacacacacauacacacacacacauauuucuuacuagaauuuaaaaaguuuuaacauacuucuuuuuuuguuugcuuguguuuugaagacaggauuucuuuguguugcccuggcugucuaacucacucuguaaaccaggcugaccuugaacucacacagaucugccugcuggaucuguuaccaccacuuggcucccacuuuauauauuaacuguucccauugagguuguuuuccugggagacggacauagauugagacagguuagauguuucaauaucaguauguauggcaaacaguauuuauuuauaauuaaccuuuguuuuuuguuuuuguuuuuuuuuggggggggggguuucgagacaggguuuuucuguagcccuggcuguccuggaacucacuuuguagacuaggcuggccucaaacucagaaauccaccugccucugccucccaaguccugggacuaaaggcgugcgccacuaccaccuggcuuccucuaugauuuuuaagcaucccugaaccaucuccucuuccugugaagagggaggaggaagaagaggaagcuaggaucuggucuaucaacauguuucuuccaagucacugugagcuuugcagaaagaauaagagaacuuaguuccaguucucacagggcugacuuuaaugcaaauuaagucuaguguuuaaagaugguuacauuuaaugcaauuuuaaauaaaaacuaaaugaaaagaaaaugauacuuuaagggagaaaaagacuacacugaaugauaaauacugucucuaaggcagugcuuacucucagaguaacuuccaaagguuuagccgggcgugguggcgcacgccuuuagucccagcacccgggaggcagaggcagguggauuucugaguucgaugccagccuggucuacagagugaguuccaggacagccagggcuacacagagaaacucuugucucaaaaaagaaaaaaaaaaaaucauaguggagcuugaaucuguaaauguaaauauucaaagugagguuuugaagcagaucucauauacuuguuuuccugguaccagaggaaggcuacugccagcuuaaaguacuuaucccaagcuuauaugaaacuuugagagugugagcaacauuuuguaacugagauagaaugagcucuuuaggggcuagagagauagcuuagugguuaagaguacugacugcucuuccagagguccugaguucaauucccagcaaccacgugguggcucacaaccaucuguaaugggaucugaugcccucuucuggugugcaugaagacagcgacagugaugguguauucauauaaauaaaauaaauuauaaaucuugaaaagaaaaagaaugagcucuuuaugcugugauuagccagggucaaagugagguguaacuugaauaaugcaaucuccaagaacugguuuguuuggccauuguuuuguuuuggaaacauuuuauuuaaaaauaauuauagguucauaaguuuaauacaguagaagagacucuuguacucaucacccagcuagauacucauaggggucaugccucacauaacugcagccaucaaaacuggagaguggaccuuggcagaggacacuuaagaauagacuagacaacagaccugaucugaccaccaguuacuguaugcacuuguuuucacagucaugcauuccauguguacaguuauauaacauauaaguauagcuuuuaagaauagguuuugggggcuggagagauggcuugguggcuugcagaaaaccugaauuugauucccagcacccauaucagauagcaugcuacucuguaacacuagcuccaggggaucugauacacucuucugcuuccugagggcaccuacacuuuauguauguauguauguauguauguauguauguauguauguauaugcaugcaugcagugcacaugcacauauguauauacagugaauguauauauauguguguguguauauuuauauauacauauauacacacauauucacauacugguacaagcauguguacucacaaaacuaaaagucuuaaaaaauaaaaaaagaucuagagagagauggcucagugguuaauuuuagaucacuuguuugucuuacagagaaugcaguuuaguucucagcaccuauaauuaacucuaguuacagggaauccaguguucucuucugguuucugggggaaccaggcaugugugcaugcacauacauaugcaggcagcacucauacacauuagacauaauauuuuuuaaagauuuuuuuuuauuuauuguacacaugagucacaguugcaugccuauggcauaugggaggucagaggauaacuuucaggguuagcucucuccuuuggcugaucuagauugauuguuuuuuguuuuuuuuuguuuguuuguuucuuggagacaggguagcucuggcuauuuuagaacucacuguguaaaccuggcuggccuugaacucaagagauucauuugccucugccucucgagugcuuucauuaaaagcaugugccaccauguccagcagauugaccuuuuaaugucuuccuuggcuuuaguaaccaugauggcuuugcagaacacugacuuuauagccuuauggcucaacaaaggcuacagacuuuuuuuuuuuaaagauuuauuuauuauguuuaagugcacuguagcugucuucagacacaccagaagagggcaucagaucucauuacggaugguugugagccaccacgugguugcugggauuugaacucaggaccuuuggaagagcagucggugcuucuuaaccacugagcuaucucuccagccccuggcuacagacuuccuggcuacagacuuuugacaggaagaccgcagaguugaaaaguaauuuuuaauaugucaaagauagaugccaucaauuugacuucccacuguuaguucugacuaugugguugaagaaguguugacagauuuucuaccuuauaguuacuuuguccaguuuauucuacucugaagaagcagucacucgugcacuuuacaugcaagguauggggagauccaguugucuacagaggguuucucuguaaaaauugugugaauuuuucuaacaggucuuuuuguuauauauuuauggaaacaguacagguacugaauaagucuaacguaucucuucuuugcagggugggaaagcccguaaacaccggaaggaucggcuacaagauuuaauugauauaggcuuuggcuaugaugagacagauccauuuauugauaacucagaggcugugaguaauauaucuucaauauggcaguaagcucuuggcaguaaacaucaaggcuacuuaaaauaucucauggauguuuauuugugcuuuuuaaagcuguauagcucaaagguuuuuuaacuguagauuuacauuuuuguaauguuggcuuguuccuguuaaguuguuacuauauugcugucauaggccagguuuuggcaaacuauaaagggccaugugguaaauauugucgacugugggccauaugguguucuuacagcucuucucuugcucuagcaugagcgcagucauggagagcauguauguagauuaguguggcaacguuaagaguaaaacuuuacugauagacuauaacauuuaaacucauguaauuuucaugcaucgcagaauauuuaauuugauguuauccccaucacuuaaaaaaugcaaaauucauucuggcaggcuguguaacaaacuguuaggcugagcuuggccagcaaguccugguuugccaacaagauaguaggccauuacuuguauguaguuuguuguacuuccaggucuuucaagaauauuuugaguuugaucgguugcuuauuuucagaugcauaguuagcauuaauucccagagaaaucauuacuccuugcccacacugagaaguaaaguuuucuaacaggacaaaggcccaguauuauauacugucaaccccagcauugguagagaugggggaucaggagcaaaaggucguuccugagacauaacagauugaggguguagucugggauauaggagacccuaucuaagcacauaagcacauaaguacauggacucacauaagcacaugcccucucuuguacacaagcacaugcauucauucucauacaugggaaaaggaauaauguccuaaccaaaugcugaaaaugguuauauuaagcuuaaucaaugguagaaaacauugauaggcuuucuuaauuuuguaaaauuuuauuauuuguguuuguguaugagccuaggauguucagagagguguuagcucccugaagcuggaguucuaaauaguuaugagcugcugauaugggugcugugaauugaauuuggguccucugugagagcaauaugugcuuuuaacacuaagccaugucuccagcccaccgauauauuugucuuaacuaagaccuauugaauuacaauuucuggguauaugauuuaaacaagaaauuuuuuuguuauuaggacuucuuugguuuuauuuuucuagcuuuuaaaagaaucauuuaugaugcuggggagauggcucaguuggaaaguaucuaccaugcaagcaugagaacuugaauuuggaucucuagcacccauguaaaagugccgaguacuggguagauagauccuugggcuggccauucaggcagucuggacagaucaaugagagacugaucaauaagaugaagagagggcuggugagauggcucaguggguaagagcacccgacugcucuuccgaagguccggaguucaaaucccagcaaccacaugguggcucacaaccaucuguaacaagaucugacucccucuucuggagugucugaagacagcuacaguguacucacauauaauaaauaaauaaaucuuuaaaaaaaaaaaaaaaaaaaaauaagaugaagagagacugaggaagacacccgacauagauagaccucuagccuccauacccacaugcaagggacuguacccucauacacacacaugcagcacauacauacauaaaucagugaugcuaaaucggcaacaaagcacaagauggauagugaguacaagguaauguauuccccagaugucccccaccaagaaguaaacauaagacuuuuuuguagucaucgagaaauuaacauucaacuguauauccuuguaaaaaagaaacaaauauuaccauuauauauauaucuuaaauauucuuuucuugaaauucaacaucuucuaguaguauguauuagcguauagauauacugcuuuuaaugguuguuacaguauauuauuuacugauuuuaguaaaaauaguuuuaauucucaggguuauguguuugcagguaguugagcaucucaugugcauucaucuacuugaauaaacauauauucagaauacuuuauagaguucagauaauaugacugaggcagauugcuagcaguggaauuuauugaucaugggguuuccguccugaagcaagcuucuggaggccauuuuggaaugacuuauaaaauaguccuaaagguuggugcucuagagugaaaguuaguuuggcagauacuuauaaaacuauuuaguuuguugcuauuauuguauaccuuacuacaguagugguauauuaagcacaaggcuuuaccaccaguauguuuugaccaaauucugcaaccuuagcucuagcauccaauuucuuuuauaaaaggaagaugaaauuugggacaacaagaauuauuagugcucugucuuaguacaugaauuaaggcuugccguguuuuguaguagguaaaguguauguucuuccauuuuuaucugaguauuagauuauucuaaugccuaggauuaugauauccuuugagauuaucauaucuuuugcaguacuuaauaacgguacuuaaauauuuuaugauuuguaaauuaguauagcuuuugcauggcaauacagcaguuguugcauauauagugacagguggagcuuauacuggugagagugauuggaaugauugucagcacagugcacacuggacaucauguuccuaaguuacuugugcuuucuuugcaaggcauauuagcaguuguuuagaguagagagcacuuaccauuacuaaaacuuagcaauuggcaaguuaagauuggaauguuucuaucuagaguauugacugcuacuuggaacuccaagaaguccaagguuccaguuuuauauuaguuccuaauuugacauuugaucaagaaagcaugugucaguguucucccaaaguuauguugagauuaaaaauaacauaaauuuaaauauggugaagaguauuaacuaguaucaaacauuaguaacaaugcuaauauguagauuuaaaauucugacuuacccaaaaggaaaucauucauggcaguugcauguacccauacuuuuacuuaaauagcuucucaaaguuaauacuguauuuuagaacacauuuuuuuuuuaauucuuucuagguuuugggguuuuuaguuuuuguuuuguuuuguuuuguuuugagacaggauuucuuuggguagcucuggccguccugaaauguagaacagacugaccuugaacucgagaucugucugccucugccucccuccccagugcugggauuaaaggcauauaccaucacccccagcuauuuuuuuuuuuaaguuuuuuugcaucagaaucuuacuguauaacucugggugucuuggaacuaggcuggccccagacucacugagaucuuccugugcuaccaugucuggcuagaacagguuuagauucacagcaaaacugaacagaaaguacaaagagcuuccauauccacuggcuacacacacacacacacacacacacacacacacacacacacacagccuccuuuacuaucagcauauugcaucauggugguuggugcacacacacacacacacacacacacacagccuccuuuacuaucagcauauugcaucauggugguuggugcaccuguuacagaugaugaaccuagucaguacuguuaucaccuaaguucauaguuuguaccugcuagugugauagacucuguugguuuagacaaauacuuauugacauauguccacuguuaugaccauacagaguaguuucucucuaaaaauucucugugcucugccuguuuaucccucuugcccccugaucucugggagcuccaacaaucuuaguggaggggagggcuucucugaguagcccuggcuguccuugaaaucgcucaguggaccaggcuguccuugaauuuagacguucccuugccucugccucccaaguucugggauuaaaggugccaucacugccuggcucaguuuugacucuuuuguuuguuuguuuguuuguuuugguuuuuuguuuuuguuuuuucaagauaggguucuuuguauagcccuggcgguccuggaacucacuuuguagaccaggcuggccuugaacucagaaaucugccugccucugccucccaagugcugggauuaaagacgugcgccaccgccgcccagcaaucauuuaauauuuuuaauacuugaauaaagcaauuuucaacuuaguuuuguaucugauauaugaaucauguaccaauuuagaccagaugacuaguaguuuauuuuauaauuaucuguaugcguguuuuaccuguguauaacugugugcaaaacaugcaugccugaaaucugcagcagucagaagaagacaagaccccugggacuggagguacaguuucgagccaccaugugggugcuaggaaucgggucuggguucucugcaaauuaguccucuuagcugcugagacaucugucuaguccucacuaauauuucacacacacaaaaaaaaucaaaaucaaauggaaaagggucugucauagaugauuucauuuucauuguguauguauaugcuggguuuugauauaucauauuuuuuuuuacuuaguuugaagaaaauuggaaagcuguugcuuuaauaaggaugaauuuuauagguauaagauguuaauuuguacaguuaguaaccuuuugucauugaucuuuuuuuaaaaaaaaacuuuuuaaagauuuauucauuuagguaugagugcucugucuacguguacacuugcaugucagaagaggguaucagaucccuuuuacagaugaccacgagccaccaugugguugcugggaauugaacucaggaccucuggaagagcagccaucucugaaucaucucaccagcccugucauugaucuuuuaaaaggcaccuuguucuuuuuauaauucaaaucuaagacaauuauuaucuauucaaaggauaccuugcuuguauugauuuauugucaguaagauuuccaaauuaaaaaucaucuauucccaguggauguuuauagucuucugcuaccucauuacugaaaggccuaaaaucagucucaguuuuauuuuucuaaacuguaaaggacugagcaugugaaacuuccagaaguuaauguugagagauuugccuaaguucuuguuagucuuggcaaaggauuuagagcuagaauaucuuaaguuguuucauugccucuuaacuuuguucuuagauggcucaauuacauaccugugaguuuaugcugagcagugcuagguaggguagaaagcccaacagaaggaaggcuuagagcacuuacgauugcccugaguaugcgggugcguguuuucccucaugaagaagugauugguuuagcaaauggguugagaguuggcuggugacuuuacuaaaggcacaaauuggcuuuggauagauucuuaccuguuuuccacuuguaaaauaggaauaauguuugccuucccugccugcaaaggagucaugaggaccagagagaagcauccaugggaagaaucauugaggacuagugguauuuuucaguauaugaagccuacagggauguuuaugucaucacauggucauuuucaucuuucucuuucauuccuucacuugccaguaguacugaucuuuuuuccaugaggugugaagagcagugcgucuaguaaaucgaaagagcacuuuucucucuucauuucacucuuugaaauucagcauaauuaaacuuuuucccuuuuccauaaucuuugaaaggaaucaguuaaaaaucacaucauagcugggcaugguggugcaugccuuuaaucccagcacuugggaggcagaggcaaguagauuucugaguucgaggccagccuggucuauaaagugaguuccaggacagccaaggguauacagagaaacucugucucaaaaaaccaaaaaaaaaaaaaaaaaaaucacaucauaacuuuuaugcuuagcuuuaauaauuuucucccuuucccccuccucucccccucucucgcucuuccucccucuuucuuucucucccucccucccucccucccucccucccucccucccucccucccucccucccucccucccucccucccucccucccucccucccuccuuucuuucuuucuuucuuucuuucuuucuuucucccugagacagggucucucuauguagcccugggguuccucauacaccagguuggccuugaaauucacagaguucuaccugucuuuaccuccuguauucuuggauuaaagaugugugccauuuugcuuuguauucaucauauagugaccaauagaauauugauuuuccuugcuugugacaaggcuguuuuucuucuuuccgucuuucauuuauuuucuuucuguuuguuuuuuuguuuguuuguuuuugguuuucuaacagcuuugacuguccuggaaccugcuuuguauaccaggcuuuccuugaacucccagagaucuuccucucaagugcugggaucaaaggugugagccacuaugccuggcgucuuuuuuuuuaaagauuuauuuaaaauuuuauuuuauauguccagguguuuuuuuuuucugaauauguauuucugcaucacaugugugccuugugcccacagagauuaaaagagggcauuguauccccugaaacuugaguuagaaaugguugugagccaccaugugggugauggggacagaacccuacccgguccucuguaagaacagcaaaugcuuuagacugcuaauccaucucuccacucccaaacaaaacacugugcugcaucugagugcugcgaggcacagaaugcuugcuuuuucauucucaaacacugauugcuuaggauuggccuccacugggcgaaaugauaaaccuuaaacuauggauuuuugaggcuuagucuaaguuaguuucccagcauacugcuugacuauauaucuuuacuugcugugaaauugguuuucugcuuuccuugaagauauauacuuaacuuuucuuuuaaauacuugaaaauauauuucuacuuacacacagaggcaagacaaagacuuuucuguaucaucuccuuauuaauaaacuuacauauugauaggguuuuaaggacuuuuucucugaguggucaguucucugcuuuaaucuguuuugacuuuucauuaguuguugucaugaaggguagcgguagggaacacuguaaguucuugauuuguaugauaagcuuauaaaagggccaaaggugaaagguuuuuuuugcuucugaagcugcugcuuguuuguuuguuuguuuguuuguuuguuuugggcuugucggauguguuuuuggaacaucauccaacaaguaaacugaguucuaaccaaaaauaaaagaaugguagcaagaggaaggggauaaagaacaacaccauuagucuuaacucuuuaucagcacgccaucugucaggguucuucuggaaacuccucucuuaaguauccuaacuaaucagcaugccuuuuauuccagacacugacucuuucuaaacuuacaauacuccaucaacaucauuauugcaguuuggaucucuuccucucaguuauuuuaaaucaacaauuaguaauuguuaauuuaauaguuaauuuaaaauaaauauaauuuuaaaacaauuuuaaauuaguaauuguacauauauuauggggcccaguguaacacugauaauguccacauuuuuagugacgaucacuaauuagccuagauaaucaccuagcuauuuugaaauacaaucagcgaguuucucccucaccccuuucugaccucaucucaaaccucugguaucuaacauuguacucuguacuuuuaugaauucaguauagaguccacauacaaaggagagugugugguauuaguuucucuuugcuggcuuauuuuacuugacauaaugucuuuuauauauugaauuggauuuucuggcuuuuuuucuucuuagaaagggucucacuaucuagcucuggcgauacugauacagauacugauacagugucugauacucacuguguagaccugacuggcauugagcucacagagaucacccuaccucucucugccuuccagagagugguauuaaagccaugugccaucacacccagcucuggcuuucuuuuuuagugccaaauaauguuucauuuuuauauaaguaaauguaccacauuuuaauauuccacacauuuauuguuggacaccuaggcugcuccaguguuggcuuuugcaaaugaugcugcauuugcuacaggagcauggcguaucuuuggcauacugacaucauccucuuugggaguaugccucguagugggauugcuggauaugcaguuaguauuuaaggaaguugucaguaagugcuguucuuugacauaaacaugacauagaauuauagacaggagaguauauuugaaacuuuuuuugcucuaguaugacgaauuagucccugcuucucuaacaacaaaauauggaggcuucuauaucaacacuggcacucugcaguuccgccaggcuucagacacugaagaagaugauuucacagauaaccaaaagcacaagccacccaaggugaguuugacaucucagugguaaggaaagcauagaauuaauaugauaugucuucuguuuuauuuuguuuauauuuuugcugugcuugcuaaaaaauuagcccagguauucuuguaugcuaaauauauguucuuauuacugauuuguacacccaggccagaauauuuuuugauuauuuauuuauuacuaucauuguauguguauguaugugaguguguggugaguauauguauguauaugcacuacucuugagaguuggauuuuuccuuccacugugagcucugguaauugagucggcccaucaggcuugcgugccaagcacuucugccugcugagccgucuuucuugcccaggauauauuuguagcacugauuggaacuuguuacguacaucaggcuggccucaaauucacagaaauuuaccugcuucugccuccugaguguugguauuaaagacaugugccaccauaccuagccuuaggauagacuuugaauauuauuugugccacaacuaugaacauaaggaaaaguaaaaaauacaaacuauuguuuagugaaauuguacuuaauuauuuguuugaaauuauugauguguggguaggaagaauagcuuaaugguagaaucauugccuccaaaggcccuggauuugaucucugcauuauuucaaagaaacaaaaaucauccaaacaaccaaccauuaaucucagaauaugggagguuaaaggcagguugaucuuaaugaguuuaaagucagccauggguucagggugagacccugccuccaaaaauaaaacaacaaaaugggcaaauaagaaaguaggauuuucuguauaagaacuauuccuaacuguugagcuuccuucagaccuaauuuguaacaacuucuguuguuguaccguagcugagaaucgaagcuuauccuuaauuguucucugcuauggagucacagacuuuauuguuaccagaaucacuaacauccuuacugaaaacgucagcucugaggucccagugaccugaggccuagccacaguuagaaggcuaucguggcuugcccacagccagcauggccugguggugagugagaaacugaguaagauggaggacaguugaagaagguacccauugguacccccuggcuucauaugugucuguacuuacacaccuauagacacauacagcagaaacaacaaccaccuaggcaggaguguucacagaccccaaggaucuguacauucagcugguaauucugacacuuaaagaaccacuuuaaaacuccuaccuguacugcauuacuagauacugauacagugucugauacaguguaugauacagccucuuauuauuuuuuagguucccaaaauaaaagaagaugauauagagguaaagaagcggaagcggaaagaggaaggggaaaaagaaaagaagccaaggaaaaaaguacccaagcaacugggguaugcugaauaagccuacuaagaaauuauuaccacaguguuccaguaucaucuuggaaauacauauuuaccacuaauauauuuaguuauguuuaauuugaccuuugcaugucaucuuagagacucaugguguuucagauuacacuuacagauuuuucauuugacugucuuauucaauacagcuuuuuaaucuaaaagaaccaguuuaauccacauguguugucauaaaucuauaauucuaggacuugggagggugaagcaggaguucaggguauccugaggaugacauauaaggagugugagugugaauuccugucauuauccagauguugaagcugcuaacgugaaaguauaauuuaauaagaaacuaagaaaauaacuuuguucugccaucucccacaugauucuuuuaauuauuucacuuauuuacauaggggauuaacuuuuaaaaugacaaagccuaacuaaucuuuuuuuuccuucacagaguuguggcucucaauucacacaagucugaaaaaaagaaaaagcgguauaaagauucccuuucucuggcugccaugauacggaaauuucaaaaagagaaggaugcauugaagaaggaaucuaccccuaaagucccagugaccccaucaucuuccucucugccuaagcccccuugugucacaacagcccuuggggaugacaucccggacuuaggucugaacagugcugacccagaccucccuauuuuuguuagcacaaaugaacaugaacuguuucaggaagcugaaaaugcccuagagaugcuagaugauuuugacuuugacagauuacuggaugcuacuucugacggaaguccccucucugagucagggggagaaaauggaaauaccacccaucccaccuuccccucucagguugugcccaaggugguaccuacacuuccagagggucuacccgugcuucuugagaaacgcauugaggaccuucguguaguaaguguaaugaugcuuuugcuuuuuauuugcuacacaaacucuuagucuguaguuuuaagacaaaaacagcccacagucucaacuugcuguuuuccauaaucuguuuuagaugcuggcuauguacauagaugcauuauggaaauguaccugaaguuacuugguggaagcuauuuuaacauguagcuguuuuauuuuauuauauauuuuuccaauuccaagggaucaaauccuggguuucauauaaccuagucaagaguccugccaccauguuggacaggaguggagagaacaggcauucuugucuuguuccugauuuuuguggaaaugcuuucaguuuaucucuuuuuaacauaguuggcuguggauuuguugucuuuuacuacuauuauguugagaucugucuccuguaucccuaguuucugaaauuagaggcuuuugccaccaugccuggucuguuauugcuguugcuacauaguuuuauuucacuauggccagcuaaaauuaaaggaauuauuuuaguuuucuuuauuuauugagauauguuuugcaucucaauauuuuagaguaggguuccauggacugcugagaauguauaugaucuagugguuggauggaauguucuauacauauauauuagauccauuugaucuaugaugucauuuaauuaauucucuguucauuuuuuauuuauuaugauccaucuauuggugaaaaggauggucaaaauggggcauugaagccagcuacugauagaguguguguguaucugugucucugugugugugugugugugugugugugugugugucuguguuuguguguuuuaacuuuacaucuggaaguauuugcuuuguagagguaagugcaucaaaauuuagugcauauauguuuaagauuguagugucuugauggaucauucccuugaucaguaugugguguccuuauuuuaguuggagaagucugucuucuuggcaugucucuguccaucauugcacucuaaggugguuucugucucugguggugagguauguuucuuggagguaacagaggauaguguuucuuaauucauuuugcuagucugagucuuuggauuggaggguuaagaccauugaugcuuacaguaguuauucuugaaagguauuccugucauuuuguugauuuuuauuguguuuguuuuucuuagucuuccuuuguuaugcuuuccuguuacuauuacuugaaugugccaaacucuuucuucagucccaaguguuccuuuaagguuuccucugugaggcuggcuuggugaucauaaauucccuuaaacugccucugauuaguacagauaaagccgcgcuggcgucaguagucauccagacuuguaaagcgccugccugcccgagcccuccuggcucuguaguaucuaauggacaaccagcugcugcucucaggcgccuggcuuucuguccgacuguuuuuguccugcagcuuucaauacucuuugauuuggacauuuaguguuuuuuggcugcuacauguugucuuuugguccuaucuguuugauauucuguaugccuuuugcacuuugguaggcauuuuuucuuaguuuugugaauuuuuuucucuaugauuuuguuaauaauauuuucuguaaagugggggcaugguggcauacauccuuaauccuagugcucaagagacagagacagguggaucucugugaguuugaagucagccugaccuacguagcaacaggacagcaaaagcuacauaaugagacccugucuuaaaagaccaaaaaaauaaaacaacaacaaaaacaaacaaaugaaaaauagcaagaaaacagaagauauugugccuuugaccuguguuucuucuuccaugacugugauuuauagguuugguuuguuugucugucuuccuuuuuaaggauuuuuguuuuauugauuuuuuuuaaagauuuauuuauuuauuuaugugaguacuccaucgcugucuucaggcacaccagaagagggcaucggaucccauuacagaugguugugagccaccaugugguugcugggaauugaacucaggaccucuggaagagcagucagugcucuuaaccacugagccaucucuccagccccuuguuuuguuuuuuagauuguguguguaugugugggaguggaguggguuguacacaugaguguaaugccuuugaggccagaggagauuuuucauucuccuggaacuguagauaaggugaggcuggcuucaaacuugaaaucugccuccaaaguacaggaaagaaugcacuuccugcccagcuauauguuacuuuucuauuugugugaaaguaccuugaccaaggcaacuuaaaaaagaaaauauuuaacuugggccuuggaacuuggguuccagaaaguuauagccucugcacaucauggcagaaagcagcaggcagacaggcaugaugcuggagcaguagcugcagccauaguagcuauccaagcaggaagcacagagaucugugaguggcagaggcuccugcuucacacucuucuauuguggacgccuuucucuuuacuuuugccauucugugccuuuggccauuuugauuuguuauauuuuaguuuuccuuaaagauaagauauaaguugaaguuuguagaccuaaucugagugaguuggggagauuuuguuuaugauuuuuuuuuguuugauugauuguuuuuaauuguccuggcauuugaaugcagggcuuugugccugcuaggcaagcacuguaucacugacuacugccauaaugcuuuaauuugaccucccucccuccgucccucccuccaucccucccucccuuucuuccuuccuuucuuuuuucuuaauuuucuugacaaucuuguauuugaaguacaagcauuauuuacguaaguggaaaguggcuaaauaauucacaggaacucacaucuugcgaguaacagaagugacauuuaagccucaggagucaccucaucuucaugcuuucuccauuuccuuuugcccuaacccaaauugcuugaguuucuucuaggcuuuaaaaagcacuggugaugugacugggcuuucaaagaugaaguuauuaguaacauuaaguacuguuugaaaucugggcagugauggcacacaccuuuaaucccagcacuugggaggcagaggcagguggauuucugaguucgaggccagccuggucuacagagugaguuccaggacagccagagcugcacagagaaacccugucucgaaaaaccaaaaaauacaaacaaacaaaaaauacuguuugauuagccaaagcaaaacaaaauaaaaacugaugcucuguuuugaguaugcuguugccauucucucaagggauaguagcccaacugccugacuuuccauaccucguaguugcaggcugggagacuaaggugcagcaugacuaugauuuuaaguugccaagguagcacugcauagcauacacacugucauauaagccacccuucuucauacacucacaagguuuuugugggcauguccuggucuuaaaaggcucagugaugucucauaucaaaagacaagcugucaguaguagccaugacagggucacuacagcuuuuuuuccuaaggcuuuaguaggaaauugccaauuagaagauucacuaacugauaugaauucuucaugucuuugaaauaugaggauggugcuuuuucuucaagugaugaaaauuuaucuuuggcuugaacauuugcaucugccugauaaacacuuucuugcuguucauauuuacuuugcaaugaauaaauauccuuucaggcugaaccuuuugacuugaguucuuucucucucucucucucucucucucucucucucuuucucucucucuuucuuccaaguuucauuuucauucuggcuuucuuuguacauuuccucccuccacaugccuaaucuacguucugucugagaagcagguccuggaaauuugccuuuucuaccuaaagcaugugaaauugucagauagguugguagcguggcacaggugcccugguguaucagcucuauccagucagugugcucucagacuugagcugcgccucugacuuccucacucuguugugcugugagggaucaugccggaguuuccaccuuagaaacucuuuugcgucucaccugguuaagaggaacuacaaugauggcaauauuguccucaaacucauguaaauaguuugugcugguuccuugauaauuaucuuggguuuuuuuuuuucuuuuaagauuuauuuauuuauguauaugaguacauuguucguguuguugucuucagacacaccagaagagugcauuggaucacauuacagaugguuugagccaccuugugguugcuggaagcugaacucaggaccucuggaagagcagucaguaguaguacuuuuaaccucuaagccaucucuccagcccgauaacuauuuuauucuuaauaaaguagaagacagacuacugcaauaguucagacacugcacaacuugcuaacaccuuugggggcaucuuauguaaggguucuaaguuuuugaccacuuaguuauaagauuguggagguagaauacaacaucugguuguuuauguagauucuauaugacaauaaguaaaaguauagacuacaaacuauaaaaguacaaaacgagcuuaaacaguucauacaccuauaucaucaaggacuuuuuauucuaucagaaacgaauaaucuuguuuuuaaaaaauuguggcuugaggacugggagguuagcucaguugguguuugggaacuugucuaauauauacacggugcugguuucacucaguacagaaaaaacaauguggguugacauauugguagauaaaauccagcaguuugaauaaugaaguagcaucaaagacaggagcagaaaguacuauugccuggcagguuuuuuuagauacauacauauuugugacauugaguacugagucugaguuuuuggcuaaaucuacuucuuaaucacauuaaggcuuuuaagauuauaaaguuuaaaguggacauaauggaaaaugccugucagcccaguacucuggagucuguuucaggggaucaccaagcucaaaacuagccugugcuauauaggguccuaugucuuugugugugugugugugugugugugugugcgcgcgugcgcgcgcuauauaggguccuaugucuuugugugugugugugugagagagagagagagagagagagagagagagagaguuauaauucuucuuuauggguuuuuacuuaaaggaaauaucuguucuuuauuuuuauuuuagacaguuuggcaagcaccauguaucacaggauugacacucaguuuucaguuuucacuuuuugugaucuuugaugaugauuaagucuuaaaauaggcaaugcuaaugucuuuucacauugcuucuuuuugaggauaguauuucccuguaguugucauucaaauggcccgugggaaguugcuuuauuucaagugguacuaucaauuacaugcguaucuuuaacucacugugugcuuugcuuuuagcaucuuagagauucucucuguuuuuaaaugcucugugaaagagagccuagcccuguugccauuuugauuuuagcacacguaacugauuuugaauguccaaaugcgacauuaauaagucuuugcuuuuuuaaaaaauauuuauuuguuauguauacaguguucuaucugcauguaugccugcaggccagaagagggcaccauaccucauuauacaugguuauaugagccaccguguuauuacugggaauugaacucaggaccucuggaaaaacagauaguacucuuaaccucugagccaucucuccagccgaaguuucugccuuuuaggccuuugagucugugcuguuaaagccacugcagcaaaaaugcaugauagccuguuggauuuggaucucaaauggcuuugccugacucugggucagaauguguguuauuucacugauaaugauuguuuacuaauuuuuguuauguuguuguugcuguuguuguuauuguuagacaauucaugucaguauuguugugaauuauauugccuguuuuucuuauguuucucuaggcugccaaacuuuuugaugaagaaggaaggaaaaaauucuuuacacaggauaugaauaauauucuucuggaguaagugauuuuuaaaucuuuuucuuuuuaaaccuguacuaggaauaaaucucaaugauagaauacuugccuggcauucaugagguccuaaguggaaagaaagaaaagagaacagaugacgaauuuugcaggcugcugagaauauaguuaguaaagugcuugcuuagcaugcuugaaacccgggauucgcaucagcuggguguggugguacaucuguaauuccagcacuucagaagugaaggauggacaguugaaggccauccucaacuacauugugaguucaaggucagccuggacuacucuaucucaaauaauaaacuaauuaauaaaagcuuugcagagaguagugauguaugccucuaaucucagcaccaagacacugaggcaaaagaacuacaaauuugaggcuagcuugggaucuaaguugagaguugaagagauggaucaguggguaaaauacuugguaugcaagcuuguucuuaauuugaauccuagaacccagaugaaaggagaaaacccacuccugguguuaucccuuuagcuccacacacuugacaugcauucacccacaucugcauacauguacucccacuguaauaaguaggugguugaagggcuaaggauauaguucagcugguacaguucuugccuuuaauuuauaaaggucuggaucagauuucccagugcugcauaaaacugaauguggugcuuuauaccuauuguuuucauuaccuucauacuuaaaaaauaggcuucucacacauaaguauguuucuagcggaguaacaguagaguucuuggucagccuccauuuuucaguuugaaugcagguguguggaagagaugugugauucaucauauacuugugcugauuagguuacguuuaacuccagagucccuagacagugcagcuguuacucaucagguuguccaaguuccagaaugagcucuccccagccauuguuuccauccuuauauacuagagcagcucuuuucucauggcuaauacuggccuuuguacucuuucccauuccauuucacuguucuaugauagagggaacguauucucccccagggagugccaagagcccauccuugugcucuggcagcacagguagacauaccauuagcaguccacuaagaggcuucucuuuuuauucuuuccccaucugucacaaaacaaaucucuuaauugggaagcucauauacuuuuguuucucuuuuaaggauauaugucuuuuuauuucauguguggguauuguguuuuauuaacaaaauaaagagccaaggaucuacuugguagagggcagguuuggugaggugggagagguaccuugggaggcccauucugaggcauuccuucccccugagcuagcagccauucaaagcagguguaguauggaauagaguuuauuuggggcauaggaaggggagaagagacgguaguagggacagaaaaagaugcacacggaggugggggugggggccuagggggggaggaacgggaggaggagaggccugccuugagcacagggagugagaagggagagggggauggagaaagagggaaaaggggggucagggagagaauagagucagagagaauaagagagcgaggaggcggcaaacagcucucuuuuauaguaagccaggccuaccuggcuguugccagguaauugcuagauggcgccuagaaggaaugcuaacagguuuuuugccugcacauauguuacugcaccaugcaugugccuagugcccaaacaguuucagaagaguuugccagauucuuuugaacuagaauuauacacaguuguuagguaccaugugguguugggguuucuggaagagaguuagggcccuuaagcaucuacaccaucuccccagcuccuccccacacggcucguccuucaaguccgcagacucagagcugccugguuuuccauagucacuuuuuauugcuucuggccuuucuuucucuguccuaaacccacaugcugaggguauagacugaguugcugcuguaauagcugugaugauuauuugagguagaauacuuugacauuauuacccagguguauuggccucaauauuacuuccuuuuguugagaaagaaaagauuaguuucaugguucaacuuuuuguucaugguugaauuugaccugaaucaacaaguauacacaauauacucacuugauuuccuucccuguuaccugaagcaggcauuccucauagauaaugaacuucugacugccuagcacuaguacucagauugcacuaggugugcacucgcaguuugcuggacaugaaaaccagugacuuuuuaaauugucuccuugaguuagucuagaaucucuuuguaccuggacaguuuguauuuuacuuucagacucaacuaauuuugcuaacaauaagacaagucuagaaguccuucuguugggagccuaggcccuuaguaacugucuagccaaauggcaccaaccaaacauuucugaguagcacucauuaaacaugacauuucccagugucaguacuuguauuuaaccuucuguucacauucaguuuuuuuaauaucagagauuuuuuucuuaaccaguugaaaaaaaugugauuuuugucuguucuacuuuuuugaaauuacaauauaucuauuuuuuccuuuguuuuguuuuguuuuguuuucuguguagcccuggcuuuguagaccaggcuguccuuaaacucacagagacccaccuaccucugcuuccugagcauggagacuagcgguauauccaacuaccacccagauggaauugaaguauaucuuagaggugauaaauucauuugauauagauggguuucuaaucucccuguauguuguccaacaauuaucuauggugacuggacauaauuuguuacaaaaagccccaguuucuuuuacuuuguuauuuuuuuguuuugacaccagucuugcuguauagccuuugcuggccuggaucuccuacauagaccaggcuggucuugaauucagagaaauccauggcaccucuuucugaguaggauuaaguguacaccaucaacccagcucagagccuucaauaauggccuucaaacugacgucuguuuuguuuuguuuuguuuuucaguaguagcugccaauuauaaucuuuuccauuuuuagagauaccuuauuaauauuuucucucugcuaaaauaugguaauuauuacaagccuugcaaguuuacuuuuaaaagaguaaucaagcaagaagagaaaaguauuaaucccacugaaugagauuuaaagaccaccaacccaaauuuuuuggucaaauuaagcaagcuuuauuuucugucagacagggcugucucccuaaaaugggguuugagaaaauagcauugaaaguagggcuuauguagcccaaaaagcuugaagacugaggaguuugauagagguuuugaucaccuaggagcuuggcaguacaguucaaaauuauuuagaaauuuaucaggacagaggucaggguauaaggugugggacaugucaaauuccagaaaaugggucgagacauggucaagaguuuuguggaaaaugggaaggaacuuauuuugaccuuguaacaagauggcuucuaaucuuagauaaagucuggcuaguccaucauugcccccuugucuuagguauaccuuucaaauccuuuuuagggaauagucauuuuuaucuggcagggagcaaguauugacaguuuuuuaacuggcgaggggucaaauuuguaucauggcuagggucucuaauuagaaaguaaagaaagagggcuggugagauggcucagcaguuaagagcacugacugcucuucuggaggucaugaguucaaaucccagcaaccacaugguggcucacaaccaaccaaaaugagaaacaaaaaaaaaaaucuuugggccggagcaaacgggggcuggagcaagcggcacagagcaagagggagaagggaaggggggaaaaggaaagaaaagaaaagagaagagaggggaaaggcaaggggggagggggggaaggaggggaaggggaagaaggggaaggggaagaaaaagaaagaaaaagaaagaaagaaagcuagcuaguuagaaaguauaaacuuuuucuuaaagccauccucuuuguucuguauagagcagguugaguacuauaucauuguagaacuauuucaguuaaugaauuuacuaccuguugauaaaucuuggucuguuagguuuuaauagguauauuuuuugacaaugaggggacuugguaugccaguaggcauuauauguagccacuuuguccccuuuggcagggagucuccuuuggaccuaauauuccaaccucuguugaaaauaagggguggugucuucucuucuguaacugcuucuuggcugaaauugucaggacccaggaaggcuggaauguuagucaaaggccaggaaggagauucaggcacugggacugaaucagaagccaucuggcucauugauccugcuggagagacagaacacucaugucugcugaacugguucaaaucaccuugcagcaaguccacagcucuccaguuuugucgaacaaguugugucuggcaugauauagaucaucuuugaaacaauuuguagugagcagaugauuccugggugguguuugucaaccaaguagaaaucugccaggacagauagagacuggagaccguaaaguuaaggaacuugaaagaaaaguuuacguuuggacuuucucccuacggggauagguaauaggcagggaaauuuagggugcugauugucaugacuugugacaggucgauucaaauugcaaaucaagaagcuuauuuaaauaguuuuugguuuuuugagccaggcuuucucuguguagcccuggcuguccuggaacucucucuguaguccacguuggccucaaacucagagauagacuugacucugccuucugagugcugggauuaaagacaugaguuaacacugcccagccaaagcuuauuuaaaauuuuaaguuuacaaaaaaaaaagugagaguuuuagauagguuagcuuugaacauuuguagcuacauuguuuguaaucuguauugaaauccacauuguagaaaaugcagcagcuaacaggucugucuguauacuagcuggaguagacucaugguuuugaacaaauuguaaaccaaaacuauagcguuggguuaaaaagcaugaacauucuguucucugcucaaaaggcuggcuauacagacucuacagcaccuuuaggucuauaacuuaaaagccagccagucuugagcuuguggcugguaaugguaguuagugccucaccagcuugucagaacuccauugaucaauguuaaaacucuaguauaacaauaguauagcgagggaaagcaaucuaaaacuuuuauuuuuaaaucaccuuuuagacucuuauaaguuauucaaguuuuuuauauccuuagauauuuauaacuuucauuuauauauuuuaaauuauuuuaaaccuuuaugcuuuauaugaaccuuaauuuuuuuauccagguauuuaaacauguaauugauugagagaagucacugcaaauuaagguuuuuuuuuuuuuuuaaguaaaggaauaguaaaaaguuacaucugaaaccuguuuauacuugaaugugaagccuguuagccugugaguuugccuuuuucaucaugagaacuaauagcuccagaaaagcaaggccuauuaguuuugguggugguggugggucuuuucguuuuguuuuuuuuuucaagacaggguuucuccguguaguccuggcuguccuggaauucacuuuguagaccaggcuggccuccaacuuagagaucuaccugccgcuaccuuucaagugcugggauuacaggggugcaucacuauaccugguucaaggccugguuuucauauugacuuaggcagaauaaagauagucaacccaacagugcccacccacagugugugcagggcccuggcagcaggugagguaucgggcaguuuuccccagugguuagcaucaccauagucuaggucugugucucaaccaucgccuuuagagaucugauggucaccucuaggagcugacauuucuaucuaucguaggauuauuuuuccauuaaauagaugaaaugucauauucaguagaacucuauaaaguuguaagggccauuuuacuaaguauaccugauuuuaaauaaaauuuacuuguuuuuagcuguuauaaguuuaaccuugaaaacauauauaggaguauaaacaguuuauuucuauaaauuuuauauuuaguaugacuauaaguauauuuuggacauauuaaaauuuugguuauuuauuagguaacuuauuacuaacuuuuguauuuuaacucuuuacaacaaguuacuugcuuuuauaagauuagaauuuguauuuuaucccuguuagccuuuaaaaaaugaaacuuuaucaaaaugaaacuauaagucaugagaguggcaacuuuauuuuccuagucuuuucauguuuccuggucuuuuccuggccuuuucaauguuucaucauuauagauuaucauagucucuugucugacucaguuuaucaaagcagcuaaagcuuaauaaaaagaagaggcaagggcuggcgagaugguucaguggguaagagcacugacugcucuuccagagguccugaguucaaaucccagcauccacaugguggcuuacaaccacccguaaugagaucugacgcccucuucuggugucugaagacagcuacaguguacuuauuguauaauaaauaaaucuuuuuaaaaaaagaagaagaagaagaagaggaggaggcaaagagaccauguauagacuaaguuaauuuuuuuuagccugaauaaacuuuaaguaaggaaagacauucuauaggcucuuugcuguugacugcuuagguuauuguccugcuacaucauaggauagggauaucucagggcaccucugggagcccuguuauaucucuuaacagagaagaaacagggcacaaucauaaucuggacaagacaagaccaaacuuuagcaauguaaauaacucagagcuuaauauccaggauucauuugugguccuuuggguuccucuaaagggcccaaggcaccucucuggcuccacccuugacagcauccuauauagccuucccccugggcuccaguuggcuucauuucauuauggcugcugcucuugauggucaacauauggcacuggcauuuccauauuugcucaggucccucacugcaguugggccacauuuuccucaauaguguuucccagacuccaggaauuccaauccugcuguauagugccaagguuuagcugcucuccaugacccuuucaugccuuuuaaaacuaguaccaucuuguugacucuucuuacauuacaaaguuugguugcuaacacaagauagguuuuuggauauaaaugcauggaggugcagcuuuaauauuuuauuaguaaguauucuuuagucuggauagaggugacuaaacuguaguuggacaauuauaggaacuaacuugguguugggcuagucccugggcauugguuucuacccauacccuugaaucuuuguuguauagacgaaccauaucuuuugauuggggacaggacuuucagguagaagauauucuucugacaucagguacccuuacugucccagaaaggaucccagcagaccgguaccagaugucauagcaggagaugccuuacuuaccaauacugauagaggucuccucagacagaugcuugccaauuucuuuuugaguggcaguucuaagaaucugccguuugguaugucuuggggccuugaauuaucuucaagguccacaccuccugaggcagcagucugcucugaauuugaauuggagucuugaucucucuggggccuccagaaguuauuaaacccagcuaauaagaguaaaggccacugaaccaaaauuuuugggcauuaagcaagcuuuauuuucugucagacaggcugucucccuaaagugggguuugagaaaaugguauugaacauaggagaaaguagggguaguauagcucaaaacuacaagagugggguuuccaaggguuguguuaccuaggaacucggcagagcagcucaucaggguagagcugaaggcauaacaauacgucagauuccagagaaugggucaagacauggucagauuuaaguuacacagaaaacuggaaggaauuuaucuugaccuuguaacaagauggcuucuaaucuuaagauugcaucaggcugcuccaucaaaauaaaauagcuacuaggcaaaaugcagauuuaacaguucucugcuccaaaaaaaggaagcgugaccaaucauuuacacuaaauugaauaaacuguuaacuacacaacugugucacaguuacgauagggaaacaaaagugaagaaauagcauggacauauagcugggugcuaggagcuuugccuuucagauaccuucagggaaaguacuguauggagugugggaaugcggguuuggaaacaucuaccuuuuuuuugcuucuuuuuuccuuccuuucuucuuccuuucuuccauugauugauugauugauugauugauugauugauuuucaaaagaggguuucccuguguaguccuggcacuugcuuuguagacuagguuggccuugaacucagugaccugccugccucugccucccuacugcuaggacuaaagguaugugccaccaccaccuggcuccuuuauagcuuauaugcugcuauguaaaagggauucuguguuguuuacuuuugugugcuuuuuguuuuguuuguuuguuuguuuuggucagcaucgaguuacagcuacaagaacuagguccugucauucguaguggugucuacucccaucuugaagcauuugugccaugcaauaaggaaacacugguaaaacgucuaaagaaguuacaccuuaauguucagguaaguggaagaguaauuucuacaucuuggguuuuguaaccaauaagcaaaaagauguuugcucagagucuuugcacauacuuuauaguucuaucuuuaauaaacaugggauguuacaaaagguuuugagagccccuucuuuagggauggcaagaugagaguugagaaauuauaguucuuucuuguucaaagcaaguuaaugaauaaagaaauuguauuacuaucucauaucuuguguuuuugcuggcaacuucagacauuggcaguuagagccaaaauucaaaugacaaaaaugaguaacugauaaaauagaacuagaaguagaaacauuuuuuaguuuuuguuuuuugaaauggucucacuacaaagcuuuggcuagccuggaacucacucaagacaacaggcugaccuugaagucacagagacccagcagcagugcugggauugaagcuaugcaccaccauacccagcccugagaaacaccauuugcauaguauaagauacuuuauuuuccuuuuugcaaaggacauaagaccuaaacuagcccaggguuuacauuugguugcugggacuuuaggccuucaccauuuugcuuguuuuuguuaguguguauuuuuaucuccuguaugaauauucuaccuguaguaaauugguguaccaugaauguucauagugcccacagagggcagaaaguguuggcuucccugaaauuggaagccaagguuguugcuagcuaccauguggguuaggggagcagacucugggucuaucugggucuaugugucuuucuuuucuuuucuugagauagggucuuccuauguaacucaggcuggucuagcgcuggcuauauaaaucagacuggguuaaaaucauguacaaccaugacuggccucaccucaccugguuuuaugcuuuucuaagaaucaaaacuacggcuuaaugcauguuaggcagaccuucaaucugaccuacauccucagccccagauuauaaaauauucuggccagcuguagugguaccaccagcaccagcuuuaaugcugcauucacauaccagcauucuggaggaagaggucaaccuauucuacauaaugacuuucaggacaaccagagcuacauaguaaaaccccaucauaaaaacagcaagaaaaagaaacaaaaaacacaaacaaaauauuuucagagaaacauuugaaauuugguauuugaaguuauuuaauauuccauuggauaugggaaaaagacaccaucuaucuuguucuuguugcuauuuauauaagcuuuuucauaccacuucuauccauaaacauuguauugcaagcuuuacauuguucgagcuucauauaaauagaaacaacuuguuuucuguaacuugcuuucuagcacugugcuaugcuucaguuguaagucuacaucuaaaacuauugcuacugauguguauaaacuucucuauuauauuaauagaucucauuuagcuucuguuuucuguuuauggauauuugauauuuuccagagagguugucuuaguuauauaauucuucaagaaaccuugauaguaaaggaugagauuuuuuuaaaaaaugauauauuauuccagauaccauuauaugcuuaguuuauuaauugauaucauagaauaguuaacaugauuucuagucauuuucauguucuaaauauaucuuuuaucaaaaauuauaauguuuuguuguuuuaggacuuggggugcaacucagagguaaagauucacuuacuuaguaugccugagucucugaguucaguccucauuauaaaaaagcaaagaaaaucagugaagaaacauuuaagauauuucugggccuaugacaauaauaaagguuuuaagcacuaaguauauguuauuugcaagaugaaaaugcuauuggcugauguaaggugucagauauaaaauucuuucuuucugugcuaaacccauauggagaagaguuucuguuucuuucauuuggccuugaauuugaguuuugcuugcagcauaacuuaaaaaugcuaacagcagcugggacagcaggauguccacaucgguagucaccaguuuuguaguguaguauuucagaguagugucuucuuugggucucucuucuagcuaggaguuaaacaguagucugggcaaugucucucccauucucuaguuuauuugcauuacaauuaauuuguaaaacuuauugaccaagccuugggcucaugauuaagaauguaaaguagcaggcaaaaacugggacucugcuuggugagauacaaucauccuaguuuugccuccaaugugccuuuuugguuuuuugagacaggguuucucuguguagcccuggcuguccuggaacucacucuguauaccaggcucaccucgaacucagaaaucugucugccucugccucccaagugcugggauuaaaggcgugccccaccacugcccaaugugccuuuugacaaaucagugcuguuggagaaaauagcuguguuagauaaucuuuucaggucucuaaucaguaugugaaaugugauuuuacuauugaagucugcuuauacaguaaguuuuguuaggauguuuguaaaaguuccaaauguauccccuuccuaggaugaucguuuaagagaaccucuacagaagcugaagcuggcaguuagcaacgucaugccugaacagcuguuuaaauaccaggaggacugccaggcucgcagucaagccaaaugugccaaguauguaccucuccuuugagcuggcuuuacaaaaaacacuuuagcucauguucuuaaguaguccucacccuugugaaaccauguaugucacugaaaugauguguugauuuuuuuuccuaauugucacuccccacucaacugcuuugcugucagaagcacagggcuuuaucugguuaauauccauauuaacaaaacaagaacccagccaagcgugaugggacaugcuuguaauagcaauuaggaaguuucagcagggugauucagguuccagacuagccugcacuucauacugaaaugcuaucucaggcacugauacugguuaggcauuacaugcugacuaaucugacuaagcuggggcuagacagagauagcuuuugaccuaaaggaugagcauuuguaccuccguauuguaggucagaggcuuguuuacucagccacuuuaugcuguucagaauucaccauauuguguagaaauaguuucuuguuuguucuguuuugaguaaacauuuggcugaacaacucuaaguauugugaacucugggugaaaacuuugcuuuauaaaguguuuuucaauuuucagguugcaagcagaugaagaacgggaaaaaaauggauccgaugaugaugacgaugagaaaccagggaagcgagucaucggcccacgaaagaaauuccacugggaugacaccaucaggugagcucugucaguugucacuuagacaaggguagagugagaagaauccacagcacaaggggacuagacuggaagcagucaaagacuaguuaguguguaagaaaacaaacucauggauauuaaucugaugcagucacuucaggguguuagggcucaguuucuauauaacacauucagucagcucuugaggggaguggagccauucuaguugcagaggacaagcauguaauaaauauacuugugugaacugcuugcuguaccccaggaaaacaacuauuccuuucagucauuacuuaaagaaagguacuagaggccauuguuuacugguaggggugugacugugugcaaugaaugguuaauguuuauuauuucucuuaucauugucugaauucuuuauugucaccagaugugugugcuucaaaaauaccuguuuugaguuuuauuuucuuuaguuucacaauucagauuucuguaucaauauauauuuuuuuaaucuauuuagaacuuuguuauguaaccuuguugagaucaaauugggaugcuaugaauuagagccaaauaaaagccagucugcugaggauuaucuuaaauccuucauggagacggaggugaagccacuguggccuaagggcuggaugcaggcaagguaagacaugugcuuugcugggauuucgaugguuuugucuuguugucaauuuuauuaaauauagauuugcacaaaaauacacuacauugauuuugcuaagaaauuacauuuuggggggggcgguacaugggaagauuuggauggaggaaagggaacggagggguauaaucucaaaaaauuauuuaaaguaagaacuuacauguucaacauucuauuaauauauaguauuauagaccagggcuacauugagagauccccauuucaguaaacaacuacauguaugcucgcgcgugcguguguguguguguguguguguguguguguguguguguguaguaguaguaguaguaguaguaguaguaguaguaguaguagauuaucaccacuuaacaaaacauguuuuauggaaauagaaauaaguauaaagauucuauuuuguuuuuaaaucaauuucuuuuccuguuuuugcucugaguuuaguaauaggaaaaaaguuugugggaugaugguuauaaauuugaggggcuuuuaaugcauagagggaaacuccaugcuggauuuagagcagagcuugcuaugguggcacacacuaguaacagaacuagugagaaugauacagagggcuugcagguuugaagccagccuaggagagaguuccagcuugggcuguauaguaaaaaccaaucuuaagaaaugcagucacucuacaugguggugcacgccucuagucugagagguuauguaaagcaaaaacagaaagugaagcaauaccauguuacuguaaaaauaauguugucuuuuaauguuuccagaaugcuuuuuaaggaaagccggagugugcauaaucaucuuacuucugcuccgugaguagacccugaucccagaucucuccauuuguucuuauucauguacggcuguaagaaacaaagauggaacuggagagauggcucaaugcuuaagagcacugacugcucuuccaagaguacugaguucaguucccagcaaccacaucguggcucauaaccuagaaacagaggcaggaaucucugugaguucaaaguuagcugggucuaugagaucaaacugaccuugaacucacaaagaucuguuugccuuguacuggaagucaccaccaugccuggcuggaguaauuuuaagagaauaacuuggcuaucaaccuaccaucuuuuguuuuguuuuguuuauucaaggcaggguuuugcuuuguagcccuagcuacucugaaauucucugugugaaccagacugaccccaaacucagagaucugccuacaucugccucccuagggcugggcuuaagggcaugugccaccaaagccugguuucaaccuuuuaucuuaaaguaacauaaacuauugauuugcuaaaauucuaaauacaaagaaaccauauaaaacuuuucaugaaauacauuauugaauaaagcuguuaauaguuuuguuugguaauguaguacccucuuuugguguguauguauauguguguauguauauauauauacacacacacacacacaucuacaguguagucauaugcauuaaauaaauaauucuuuaaagaaaaagaaagaaagauuuuuacuaaagugcugauugacauagguaagacuuaagucuacuuuuaggucaucucucuguuaccacccuuuguuuuguuauauuguuuucacugaugacuuuggaaacaguccugagauacucucccagucuagguugguauucuucuauggggagcuaugcagggagcuuagguuagcuccucuuguucuuauugucuguguguaaaacuacaucagaugagcugaucggauaguguucuuccuuguguacacagaaauggguauuuccuuaguaaaaauaaaaaacaaaugucuagaucugcaaaauguuucuguggauaaaagcacuugccuuauaaaccuaaauuagagcccuagaauccaauggcaaaaagagaaaaccaacuccugaaaguucaccucugauuuccauauauacacugaggcaugcuuauaucuacacacacucacgaaugaaaucaaauuuuaaaacguguuaauaccaaaaauuaaacacgggucccaguauaugcuaggcagguacucuucuacucagccacaugccuaguacagugagacuauuaaagaaugagccuuuauucuccuaauacauaggagaaugccagguuuuguuuaugguuguguauugauccacugggaaaauagcucaguucuuugaguacuuaccuacaauguauagagauaaugguuuuaucgcuagcacuuaaaaagggguuauugaaauauauaaaguuaucaaguuauaauuugcuuagcacuuuaauauacuuuuaauuaucauuuugggaaugauauuauaaaacugcugcucucccuauauacaugcacuuagaagaaauagaaauuucuaguguauagaaaggacacuguuaguuuauuaucagagaucuguuguguuucaguuauucuguuuuuucauuuaagacagucuugcuuuguugcccagucuggccuuaaugggcuccccgugacccuccugucucugcuucucaaguagcucagaucaugacuacaugcuacuaugucuggcgcccauccgugcuggucguugagcuacauccuagcuccauuguuacugcuaccuuuguguuuuguuguauguaugcaugcauguauguauauauguuuguuuguguuuuaauuagaaaauaggauagauaagccagacaguguuuguacuuuaaucccaguacuggggaggcagagacaggcagaucucugaguuccaggccagccuugucuacggagugaguuccaggacagccagggcuacacagagaaacccugucucaaaaaaccaaaaaaaaaaaaaaaagaagaauaaggaggaggaggaggaaaggaaggaagaagggaaaaaaacaagauagguaaauauagcuguccuaaugaucuacuuccuuccucuuaaaagggcauggagaauuacuauugccuuccugaaacuacauaauauuggcagguguuucaugccaguuccuaaauguucaaaguuucuugcuuuauuuauuuugaaacugaaucucauuauauagcccaggcuggccugaaccuuaugauauagaccagagugaccucaaacucacaaaguuuucuucucgccuuuuaacuaauuaauuaucauucuaacaacuuuuauuugauuuuugcaauaauguauguuuguuuguuuguuuguuuguuuguuuuucgagauaggguuucucuguacagcccuggcuguccuggaacucacuuuguagaugaggcuggccucgaacucagaaauccgccugccucugccucuggaguucugggauuaaaggcgugagccaccacgcccagccaaaaauaauuauuaauaaaaucuuuaaaaaauuuuucuuaaguaaaaugucauuacuaacccauuucccuuaauuugcauuugauauaccuuuaagcuguuucccuacuucuaauuguaaguucuuaccaaucuuuugaaauccgucuccuuaggcaucaguuuugaguuauuuuauguuuuguguauuuaugugugguuuuuaauuuuucuugucuauacuucuuauuuuaguaauuacuuggccuuuuagucaauuugaauuagaaaaauauugcuaaguauccccaggcaagcugaauacuuauauguaguuccugccuucaaggaagcuucccaggaguggaaaaagacuagucugcuguaaucugugacauacaacugcuuucgaaauggccuucauuuuaaucuuuuaucauagggcaaagaaaaaggugauuccugcaucaaaacccaaagucaagguaagaguccagcaaaucuauaguugguccuaauuggugaguguuggcauggauuuuuaagaugaaaagaacauaugcuguuuagcaaagauuaauagaugcuaaauuccuugauuuccaugucauaaaaguccauuugaaaaauagauucuuguggagcagugggaauuugcauacauugacucuauauagaaauauuggauuaaauaaaacaaaugcucuuuaaaaacauaguugucuggacauaguuguaugugccuuuaaucccagcccucaggaggcagaggcaggcauaucucugugaguucaaggccagccuggucuacagagauaguucuagcauagcuagggcuacauagagaaacucuguuccaaaaaacauagcuaagauuguaaauagaaaggagaaaauccagagucaaagagaagcuacccaguugaucuguugcugaggccucauugcccuuggaaagacuaccaaucacuuuauggagagacuacauauagagugagacaugguuucuuuucacuuuauuuucagaguauagcagguaggauuuucuggggauaguauaagucagaaauagaaaagaagccaguguaaaacagggcccugagggggauugagagauggcucagugguucuucuaaagguccugaguucaauucccagcaacuacgugguagcucacaaccaucuguaauaggaucugaugcccucuucuggugugucugaaacaacagucuacucacauacauaaaauaaauaaaucuuuaaaaaacaaaaagcaaaaaaacagugcuuugaaagaauuccaucuuuaguuacagaugaggagaagagggagcaguagagaaaugaagaguuaugucuuggccaagggucuagauuagagaagaacaguccugccugaaaaugucccauguguuaggacuuuaauuugcauuacuuggcaaagccuuacagguggccuaggacagcagauaaaaacagguuuugugccauguaauguuucacauccuaggcuugcuuacuugucagucaaacauaggcuauagacagagcucagacagaguguagacuuugcauggcagaggucuguguuuaaucuuaccaccacagaaaagacccaagauaauaauaaaaauaaauaaauaaaacauaacaaaaaaaacaaacaacaaacaagaaaagcuaugagcuuacuaucuacuguuuggaauauaaacuacauggcagggguacauuaguauaggcuagaaucaguggacaccacaaacaauuaaauccccaagaggacaggccauagguuuauuaauuuagaacauaaaauugccuggacauagugguacuaaucuguaaucccagaacucuggagggagaggcagaagaauugcagcaaguuugggaccagucugucuucuacauaacuccaggucacucagggauacauagaccugcucuuaccuccaagaaaaaagaacauauugacagugcuaaggagaaucugugagcccuaucacauuucaucuguucuuuagccaggaacaagucuuccuucacuaccaaagugacuauuuaagguacaaaggcagacauauccauaacauagguagggcucauuugauaagugcuugcucuagcauccuugaagcccucacaucauauaaagcagucaugguagugcaugacuguaaucucagcacucaguauguggagacaguagcaucagaaguucaagcugacucuugacuugauggaguuggagguuaacuugggauaaaaaagacucugccucccccaaaagagauaauuaaaauagaaacuuugugcuggugauaccuuugauauuauugccccuaccucaguccuuuacucucuaaagaugaaguuuuaguaauagugugcuuggacugucaacaugugcaagcauguguccaugucuaccccucaucugagcaagcaguggagccuaaugggguccuacccacacuacuauaauagugaggcuuuuacauuguuggaauaaaaguguaggacaagugcuauggaagucagagugugacagcauucuuaacagcuuacuuacuguaacaccguaggcggugcugguaaagacccuuccuguucguucuuuucccacuaugcugaagguaagugauguggcuguauacaucaguauauaagacucuggguuugggacuuuuucauccuaaggagcuaguagcaccucugaugaucugugcaguaguuaugucuuuaucuuaaacaugaaaucuagcacuuuauauuacuaucaacaaauaaaugguugcucuuuaacuugcuaauauuuuuucucugacuauuuuaaaauauaauucucuuaacucuuccuugaauuuuaagaaaauuaauuuaacagacaguauucacuuagauguuuagcauuuuaauuauugauaccaucauauucuuaggacaguaaaacuuagacuuaagauuuagacgagugucuucucacuuguaggagacaguaagcacauacuugauacguuacaaaugaugucagucaaaauuaguagaaugauuuaaauaugguugaguaacucacugguuuccuaguagaguggugguugggagcuguagaaauacaagggagcagagagcaagaguuagcaccccagcaaaccuuauuagacaagagucauagucuugauguagaaaugaagucccuucccagcaccaggacagugaaagugucugauaaaccgggauggacauagguucugaacuucuaauuuaaguggaguuaacgagugaugucaguuaguauccuuuagccccauuuucagguccugguaagaugacuugcaaggacauggugguguagugugucacacacuguuacuuggagagcggguagaguacugucuuaauguuauuuugguuuuggcagucuuuucaagauuucuugcuuuaaaauaaagggcccaguacuguggcauaugauuuuuauaucaguacuugggaggcagaggcacauauaucuuugugaguucaaggucagccuagucuacagaaggaguaccaaaacaggcaaagcuauaaacagaccuauaucagaacaaacaaaauaaccaaaaauuaauaauuuuagucaucauaagaauuucuuagccuuuuaaaaacuaaauuuaaaauuuguaaauuaacuguauuuuuuuuucuaauauaaugcuacuuaugcuaggaauguagccccaaaaaagaccccaaagcuccugcauccgugguggcuucagguggcgguccuuccacgagcuccagcacauccaucguugccucagccagcucuagcucagcaccagcccaagaaaccaucugccuugaugacucccucgaugaagaccuuucuuuccccucagccucacuggaucuuguaucugaagcucuagcugucaucaacaaugggaacaagggccccucaguugguucaaggcuaaaugugccaacuacaaaaccucguccaggacugagagaagaaaagcuagcaaguaucaugaguaaguuaccacuggcuacucccaaaaaacuagauucuacucagacugcucacucaucaagucuuauugcuggucacacggggccaguaccaaagaaaccccaggauuuagcucauacugguauuucuucaggccuuauugcugguucuucaauucagaacccuaaaguuuccuuagaaccuuugccagccaggcuacuccagcaaggacugcaaaggucaagccagauacaugcuucuuccucuucacagacucaugucuccuccucccaagcccaagcugcugccuccucucaugcucugggaacaucagaggcccaagaugcuucuucguuaacacaagucacaaaggugcaccagcacucagcuguccagcagaacuaugugucuccauugcaagccaccauuaguaaaucacagaccaacccaguggugaaauuaaguaauaacccccaacuuuccuguucgucccaacuacucaagacuucagauaagccacugauguaucgccucccuuugucuaccccaucaccuggaaaugguucucaggggccccacccccuaguuucuaggacagcaccgaguaccacuaccuccaguaacuauuuagccaaggcuauggugucacaaaucuccacgcaggguuucaaaucucccuucucaauggcugcaucucccaaacuugccgcaucucccaaaccugccacaucucccaagccuuugcccucaccuaagccuucuguuucacccaagcccucucugucagcuaagccuucaauaucuacuaaacagauuucuaaauccaacccagcucccaagccugcuguaugcccaaguucuucuaguccaaacacacuaguagcccagaguagccacuccacaaguaacaacccuguccauaaacagcccaguggaaugaacaucagcagacagucucccacucugaauuuguugcccucaaaucgcacuucuggccuuccgacuacaaaaacucuucaggccccuucuaaacuaacaaacucaucauccacuggaacugcugggaagaacagcuugaguggaaucccaaugaauguaccugccagcagagguagcaaccuuaacucaaguggagcuaauaggacuagucuaucugggggaacaggaaguggaacacagggugcuacuaaaccguugucuacuccacauagaccaaccucugccucagggucuucagugguaacagccagugugcagguauguauggacuguguauuuauauaaugaauguaagauugagcaaacuuugacucaccuuaaugacuucccaggugauacauaaaacacaugguauguguuuaaaaugggcugaagacaaccacgccuaugaaauguucuccguguugacauccuagugcgggguaaaguuuucauuggaauguggguuuuucauuucuucacccaaguaucauguuaggccuuguguaugcugccauacaccuguaauucuagcacauggaagcuggagcaggaagaacucagguugaaggccagccugggcuauaugaaggggauucucagcuaaccugggcugcauaacagaguuuuaaaaauaaaaaaauaaaaacuuuagacagugggcacguuagcugagugauagucucucuaaugugugaaaccucaaagucaguccccaauaccagggaaaagucaaguuuaccuuaguauuuguucugaaaaacaauacuugagugguuauuuaaaacuuuaucucuuagccaggcaugguggugcauuccugcaaucuuaauucuugcaagguagaggccaguuguucagaagcucuaaguuaccuuugguuacacaucagguucaaggccagcauggguuguaugacacccuggugagggaaaaaagucuucacaaacucucuuucucucuuacuaaaagcaaaaauauauacauauauauauuaguagugcaggcguuuaacauauauucacucgacuaccuuuucuucuuuuauaaugugugagagggcaugaugugcauagugggugcagugcuuuaaaaggccagaagauggcagcagauucccuggagcuggaguuauaggcaggugucagccuuggaugcuggaaaccaaccucuagucaucugaaagagcagcaagugcucuuaaccacugagcuaccuucguuaguuaguaaaucaaauuuauacauuuguauguuaagcauuuauccuccccaaaauuuuauuuuacauuaacuuuuucauuaugcauaauccugucugcuuaauguagaaugccuauauaccacaucuucccaauuugcuaauuuuuaguguaaacuugccucucaauuagucaaggcuuguuugcuggaagggacauaaauaguauuuccuucaccauuguuguugcauaccugaucacaucuuuguguauuguaacacccgagagugcacuucauggcucacaaagugccacucagaauuccuuguaugguauuuaggauuauuauacccuuuuauaagugaugaguuuucugugcugagaauagaaaauauaccuuuaaaucccaguauucuuagacuauagcuguauuuaucuaauuucauuaauuuuguacuuaggacauaaagaaccucagaacugacuauuuuuucagcucaagaauauuauauuuuuagucagugagauggcugaauggguaaaggugcuugcuacuaagcguaaugacuugaguuccaucccugggacccacaugguaggaggagaacagacacucgaaaguuguccucuguccucacauccacauaccauggcacaauccccugcccaagaauaaauguaauuuuaagauuuuuuuuuaauaaaaauaaaggcuauguuauucuguguuugguaguuguuucugauucagugcuuuguuuagagacuagacauuuguaugcagaccugccuaccugucccugaaguugagauucccagcauaugcugcuacacccaacuuuuuuuuuuuuuuaauugggacagcaccuuacucuguagugcaggcuagcuucagaauuguagcaauccuccugcuacagucucccaacugcugaauuuuagucuuggacuaaaacaucugauauguuguucauauauuucuuggcucugacuucgaaaucacuuguacuguguuaauuuuucugccuugucuauauuuugaagcuuucucaagagacuuguucuucauauaaaugauguggcuucuuuaauauuuuuuccuccuggaagucauguauauucacuaugagcaaauuuagagagaagacaaaagccgccugugugccugugugcaccaacuuuuauuuguaggguguucuaaggcucuuuucaaaaagcugccuuacauaauauuauguuguaaaaccuuuuugaaaauacaugugcuggagagauggcugcccuuucagaaguccugaguuaauucccagcaaccauaugguggcucacaaccaucuguagugaaaucuagggcccucuucgggcaugcaggugcacaugcagauacucauacauuaaauagacuugaaagagagagagaggcaaagagagaaagagagaaagaaaggaagagaaagaaagaaaggaggaaagaaagaaaaagaaagggaaagaaaauaaauauuuuaugaggugcagguacuuaaaucuuugagaaugugacucaucugugaaaugaguugucuaagccaaugcuuuuaaguucuugcugcuuccuaauuuguggaaugguaauuuaaugaaaauuuccccuugcuguuuguagaggcuucaugcaguucaguauaguguaagacuugguguugaauacacauuuaauaauaccaaguuaucauucuuccacuuauauccuucuuccccauuccuguagguucaggaauacuaaucauaagaaaaugaagcugagugagguguccuuaacuuauauuucagcacuaaggcgaaaggaucacuugaacccauaaguucaagaccagcaagauaguaagaccuuuccucaaagauuguuaaagaaaaaggguagaaagguaaauaacaaaacgcauacacugauuauggggauuauuuguuaaaauuguuaguuauggauaagaucugggaauuagccuucauuacuauucauauuugcuaaagaagcaacuuucuaaaauuagccuuuaauuugagcaaaggaaaaaauaugaaauuccaacaaaaguaguaguuccugguccauacucuucucuuaucauccacaguuuuguuuuuuugagagaaggccuucaagaaggccacugcuuccagugugcugggguucucggcaugcaacaccaugcccagcuuguaacaaaaugaauggcaaccaggugugguguggcucgccuauucccagggagaggcguaacaucugaguuugaguucagccuagugcucagugaguuccaaaucaguccaggcuccauagugagcauagugggaccuuguacaaagaggaaugaaugaaugacugaaugaaaaacuuaauuuuauacauguuaccauuggauaucuuguaacuuccauuauaaaaagaagaauuucuguucucauauagcuguacuguuuugcugaaauggugaucagacuuugguuaaaucuuccaugacaugcugcacugccagaguuauggcuucguuacuuuccuauuauaaaauguuaggggaguuuucuacacuuaaaagauguuuuguguaugguucuuuaccucaaugccuccaaguaccugguuaaauuguccuucacuuuuuucaccucugaaaucugucugaccuucuugcauuugauuaucauuuaugccaaaggaagcuauucacuaucuuaagaauaacugaucugucagcaagaaagcuacaugacaaaaucugugcuccagacaaguuccuucucaguacucuuccacucccaaauggcuuggugacacggaaaccccaaggugcuugccucuuugaucuguuuuuaaucucucuuacugguuugacucaggaaaagucaacaguuuauuuacagcuggguaguuguugucgugcauuagcaucucugaaguguucucagcagcuugaggccuccagaugccuauuaaagccagcugcugaaagcagaugguccuugaugagcgaguaaaucuggggccuguugcucucaaaggcugcaccuccugucuacaaggcaucugcaggguuaucugaagcacagugucuuuugacaaagguugaaagcucaaaucuuauuauuaauucugucuacuuucuacuuaauaaccucccuuccagaacguucuuccucuuucuugaccuucaacuuacugacuuuauacgaccccauauuuaccucuuuaugauucuagaagucaucauucaguaagcaaacugaguacuaugugccaagcuucuucucugugcuggggaaccagggugaacaacauucuauuaccucuucucuauuacccguucucguggaacauaccuuuuuagauaaacuaaauacaaguuguacuuuuaaaaaagcaugugcuaugaaaagauuguuuaaaauugguuguugcuaagaucauugacuacagaagaccuguuaaaguaaauacuauugaguuugagcagagagcuggagaaacagggcacagccauguguagagaagauggaaguugguaugggcuagaggaaacaacaguauaaacaugccaagugaaagagcccuccuguguugugugagcaaagacuggggagagacccacacuaugucaaggggaccagggaggacuugggguuuguggaagggaggcugcuagaaagaagucuuaccugagagaaugguauggcugcauuucagaguauuauucugugugaaugggaaaccucugucucaccaaacagaauggacaacuuuguaagaacaagugccuaccugccagagaaagcgcuuuccauucaugguuuuccucaaauggagacagcuuagaaaccaugucugauuauggacacucuguauucugccuauguagauaauguugacagcuuuucugugcucccaaaugugggauuuucugcuuccuaaagugucccuuaaagaaacuucuacaugucagugugacauggagaucaccuggcauuccaguccuauaaauaaaaucagauuuggaaaauucuuagaaaguauaaaacauuaguuauaacauauuuuuaauugcugauauucaaguuauuuuuaaagauagggacuugccccaauuuaucuuuccucucuguuguaaugcuucaauuagauucuugcagaaauacuuuaauagguucaacucauuugcauuauuuacuguuuucacugagggcguccauucaggauacagccuugagacuaccuugaugcuacgauagauuuaauguuuaauaugaagaaauuauuauugcuuacuuuuuaacugauacaggauccuuuuuauccuaguugcuuuaacuggauauuuuuucauaaauguacccuguguguaucagaaucggcauaguaaaaaaaaaggcuggcaacccuuccuuccaagugccacuuaccagaguggugaggauuaguucuuaggugugaggaggaaacugcccuacaguuaugagcccugcaggcuaaguucgcagucccaacaccugaaaaagaaaugcuugcggaaggcaggggagguaggacaaagugggaagggggggcaugucagguaaaguguuggaaacccacauguuguuaguugcuaaacucugauucauaggauuaaaccugaagugacaggucagaacugagcuuauaaaucuccuugguaacaaaggagaggaggaaagaggaagaaauggaggaguggaagcaaacgagauggcuuuugcagagugaucucacuuucuguucagcaguaguaugaacccugccauguauaauaugaauauggcacacauguaugggaaaguuacauauauuuucuaacacauucaagcccuuaccaggccuggugaugucugaggccuucauguaaucacaguacuuaagauguugaagcuggaagacuuggauuucaauuuuaaaaaagcuuuuggaaguucuagcuggcccaaaacuugcuauguaaaccaagcuggccuaaacucacagagauccaccuggcucuaccucccaaguucugggauuaaaggcuugcaccacugaugcccggugagaaagcauuuacacuuagaaagucuaauuuuagaaaagcagaguaauggcaaccagcuuucaguaguucuggggaaacuagacuggaaaauggaggaggcuaugcuugacuaagauuuuaaaaaggaauacaaguaguaucagauuauuacugggagauggguagaaucuagacauaacagugaagauguacaaagagagucuggggugggguguggagagguacugugcuguccuacaguuggaacccuuuguggugugguugggcaguuaucagcucuaaagaagcacagggaagaucaaggaugaagagcuuucagagggccucaucuccucaggcccugggaugagggagcacuaggugaggacagcagugcaggccuugugccagaggugugaaccugcagagucccaguggaaguggcuggaaugacuuccuagugacucgcggagaagcagagaaggggaaauguagguuuuggacuuugagacuuaccagcaagaaugggcauugaacaucuaagccgcagacuacaguacugacaaacgagcuguguacacagaaauacucaacuaucacuugcaaacuuucagaaccauuauuaguaacucuuuggauuauauuuuucaccucagucuuaauuuccuugauuuguuagaacaaauaaagagacagucuugcauccaugaauauguuaaaucaauuuagggacauugcuuuauuucuuaucuguuuugaccccugguuucuacacaguccacagcaggagcaucauuauuggcuaaugccucaccucugacucucaugacaucaccuuugucuguaacaaaucaaacugugacuccuuuugggaugcuggguggccuuguuccagugaccaugcccuuccaguuucccuuggagcuacuuggcuuuggaacggacacagcuggagugacagccaccucgggaucuaccucagcggcucuccaucacagccuaacccagaguaagugcugcucuacuuuaaaugggaugaaccaucuaauaccauauugcuauugaaaugcaacauguaagagaaagucaaaguuuggggguuucuuauuauaaucaugacuguaucuccauaaguuaauguuuuaaguaugugugcugugauauuagaaagcccuuggcgcugggacuuacacugguguuagcuaaggcauuauuucuaaguuugauccaagggguucacaucuugagaucacugaccaguguguuuuccucucagauuuacuaaagaguuuacagccaggagcucagcacgcggcagcccuuccucacucuccucugccugcucacuuacagcaagcguuuaacgguaagcaagcugcucauuccuacugucuauaagaguuuagagaugcugcguaaauguuccucaaguggggggaguggagugacaaaacgccagggaaguguuuccuuugacugccuccucaguggaguggagugacacaacaccagggaaguguuuccuuugacugccuucucaguggcagcagcacguugaagaaaaaggaaaggaugaaugagaucuguuagacagaagaugacuuuauuuauuuuuuuguuuguuuuauguacauuuuauguacauguuuagccuacaugugugucagauccccuggacaguugugagcugccaugcgagugcugggaauugaacgcagguguucuguagaagcagcuaacugcugagccaccucucaagcccaagaagacuuuuuugaaggguuuuauuauauagauguguugcuuaaguaugaauuuauaaaauaacuagccaaagucauagaugcugcaggaaggcccagcaaacagguaaaggcccuugaguccccagaacucacaaaaaaaggucaaugagaccaacuccucaauaguguccucucacuugcacacaaacacuguaguauacacguuauugcacacaugaagucuuucuuggaaggcaaugucaagagcucagcaguuaaagucacugucugcucucacagcagaccuaaguucagcucauggcagcucauaaccauauguggcuuuaggagagaugaugcccucuggccuccaggcacacacauggugcacacacauacaugcaggcaaaacacccagacacguaaaguugaaacuaaaauaaacugucuuuaagcugcuuuacucuugagcauagggcagaaauuagaagugugcagcagucuugaggcaguagacucccauuaauccuguggucagaugcucaaggcucauccuugagagaaggaacagaaaucccaucugcuuuuucuguacuugauuugguaacuauauuccuguugugugauucaguuggagacugauuggugugaaugugaccaccaacaaggaaguagacaaacaggauucuuguugcucaaaaaacucaagcucugugaaaacuaacuuccuaucugguuaauaccacuuucccagaacaggaaagggaaaacuaaguauuuucaaaaaaaacuaaaauugaaguuuaaaacuguugacucaaaaaguacaauaaaaggcauuaaacuugaguuuagauugaguuugaaaagcuucaacaucacuucucuuacuccacauagaaaacaaaacaaaaaagcuuuuaauagaccuccuaugggaaucuaauaaaaauaacugauugaaagagucucgucuaguaaaugguugauaguaagagcccauuaguguuuauucucuuuaucuuaucuaaaacagaggccaaaggggagcuuuuuuuuugguuaguuggucaguuuggucuguguuuugaaacagggucucacuguguagaccuggcuggccuggaaugugcuuuguagaucauaccagccuugaacacauugcaugcugugcaccaccauacauggcugacauaauaaacauuuuggacuuauagucucuacaaucuuuuuuuaaauaacuacccaacuuuuuuaucauuguaaaauagccacaauugacuuauaaacaaguaaaguugacuuccaauauaaaacuauauuagcaaaaacagauguggccagacuugggcaugggccguauuguaccaaacucugcuauaaaaaauuucacaguccaguuaaugggauugcuuuauuuugauaguuaaauuacuuugauaauuaaacaacauuacuuugaacaauauccuacuuuaauaguauuauuaaauaauuuaccauuuuaauaauuugguuauaccauagaucaguucauuucucucuacaaauguauauauugugaaugaaaagaacccugauuauuuaguagaacuauuacuacaacuuugaaauaaucauugacauugaugcagcuuuucuuccaaaagagucuguguuuugauuuuuuuuuaauguuuuucaagauacuuggauaugacaugaguagauaugaccaugugacuuaggauuccucuucuugugaaguuccauuccuuugucauuuucucucagaccuggcuucuguuugggucuuuguuucucuauccagugcucugggcuguuggguaccacucuggccuggggaacccuaucuucucuuccuccaauguuuuuagaaguguuuggcugagaguuacauagaacaguuacauauguucugccaaaagugaccuacagcagcauugguagauguagaaacuaaguugcuggauuucugaguucgaggccaaccuggucuacagaguuaguuccaggacagccaaggcuacacagagaaacccugucucgauaaaaaccaaagaaaaaagaaaccaaguggcccagcagcagacuugcaucuaguaccgcaagguuaggaccuaaacaaagacauagcugcauuuuuuuuuuuuuuuuuuuuuuuuuuuuuuuaccaccaaugugcuauguucacaauacuugggaauuaccacauaccauguuauggaaaaauauuuaauuccacuuauuauaagaaaauaaaacuggccuaaucuuccaaagaaaucaaaagauugaguaggucccuugaaggugggcauugugugaucugauugcuuuagaacccagcauugaacaugguuaugagguaaauaaauggaaugguacauaccugccaggauaguuuucauagaguucucagucacuaccagucuacagaaucaacuucuguaauaccaucaccacgugagguaaagguuaucauuuuagaaauguaauucacaauaaacugauucuucuugcuuuugcuuuugcuuuuuuacgaugugcaaaacauaccaauuuaauguuucuuuucucagauggaggccaaaguaaaggggacacuaaguuaccacggaaaccucagugacuuuccagcaagggggagaggaaccacuuggcuggcuggcgggaccgaccugaugggaagucuuggcggucacagggcugcuguuucuguccauguuuacaugcuugucccaagcacuguggugaggaggaaaagagagaaaauguuacuugagcaaagccagugcaggaggaagagaugcuuuugugcaaagucagggagcuuuggucuuuucaaacccaagcccccauguuaaccaacuuaaagcagacucagcugucaaacccacagaagugucaaucugacuguauuuaaaaaaaaaaaaaaaaaaaaaggaaagaaaagaaaagaaaaggaaaaaaacuggggaagaaggaaggaaguuaagaggauuuggguaaauggccauccauccuggggguuaggucugaacacucuacagauaagugcauaauaaaagcagcuacaaguagaauuagcccaguuuaaggagacucagucaugucugucuaguagacagauuuuccacagucaguugcaugaggcucuccagacaguugccgaagaguacugugcccugaaauguccugagcaaacuugaaucuucuccaguauauagcagguccccgugcgagucaguggccugaagauacuuuagcaaagcugcugugacacagugauguguaguacuauagcuucuagguuuuuaaagucaggaaaaggagccugugcucuuacgagacaaaauguagauaaucccuuuuuauaaaagggucaguuucacccuccauucagaaguaaguacugcacuccuuuccacaguucacuugucaucugguauugacugguuaauaguuauuucucguccugauaugcagaagugacugcucgcauuuucucuugacaugugcgucuuuguuguugggcugcugcuuugcugcucaucucucuugcagccugccaagaacugcaaacucccaguucccucccugcacagugcucuuucacuagcgguacuuuaggugacuagagcuguugauauaaacaggagugugcacagcaucugucucuucaugggucaaacaaauagcguauguauaauaguggacuguuuuucauucugaagugguauuuuuaaagggaugaagucuaauaggaauacggaugugcacaggaugugcacaaaggaccaccuguuauaacuaucacaaugaagcuuuaugacccaugcccagcgcaggauguuuucagcauuugggaucuuaaaaguuuuacuaugacuuacucagaauauuaauauucaagucagccuacagauuauaagauucguuaauucuaguuuucauaugcgaauagaggcaaugaagggugugaaggggaaaacacaauuuucuugggauacauuuuauuuugccucagcuauguuugugguguccuugaauuuuaaacuucugaguauuuucagacuauccaagaaaaagcucugagugauacaaauuuaguuuauauauggugacagacuagccugguaauaacaagauugcuucuauaaucucauuacauauuacucuguaucauuuaaguuuauucagauaagaguguuaaccagaccccauuuuccuuugaugagcaaaagucccaagaagccucuaggacuauaauaaccaaccgcagaccugcuccaauuuuuaugccuauaauuugacuucaaaguuucaauggcgugcuuaauagcaaaaaagucaaugaauaauugaaagcuuuaguuccaagaacucguuacaguaaaggaagaugauuuuuuuuuuagaagaacauugaaacuagauaugauggcccaugcuuguaauccuagaauucaggaagcugaggcaggaagaucucagguuugaggccagccugaaguauuuagcagcaagucccaugcuagucucuacuggacuaacaaugagagcugucuguuuccaacugucuuauugucuuuuaauguucaauuaauuaaaaaucuauuggacuuccauaucaggugucccugacagcaaguucuucaaugucacuugcugccauaugaaaauaaucuuuaaaaaguucauaaaguucuucaaaaaacuggggccccuugcuccaggcuccuucgcgccucuucuccuuccgguuuggugcagaauggguugugagcuguguuuuuuucuuuuuguccucuuuuguuacuaacauuuuucuuuuucuuuuuuuccuuuuucuuuuuuaaaauaaaaagcauagauuuccccuccuuaccccuccuuuuacaauggucucuucuccgcucuaaguccucccacuuccuaguucaaguuucauuugugccccgacugccccccucccugccccauugcauuguuugugugcggcaccugcaguagaaaaucccagcucuccaggucggucugggagcuccuccacccuccuccugucucaaaaaagaaaaagaaaaaaaaagagagagaaaagaaaaaaggaaaacaaacgaaaguaaucacugauauaauuucuugacuguagaaauuuacuuuaccaauaaaacaaaugaggaggcuauguaagccccaguagauauuuuggaaagauauugggauguugcagagaaguuugacuugaauuuagcacguuaagguucauuugaaaggucucuuagagaaacuugaucagcucuuacgccagcaccaggaaacuucguuucacaggccugcuuauacuucauaaauugcuguacuggggugucuguugaggaaggcagccuguacuucauuuucucuacccagagagaaguccauguguguuagugucucuucuugcugauacuuguguauuuguguauuugcagacacauacauauucauauaaaucaaucgauauuaaaagucaaacaauaauuguagguucuuaaauccaucgauucugaaccaugcuauacgaagacccuugaugguucucuuucccaugucauuuuauaagauuacccugggcucugagacuaugcuguguaaaauauauccuguuuucugucagucuugacuccuuaaggacugcugccagauccccaguccagcaacccuuucauguuauacaagugaaucaaaguccuuucuaaauguaaauacauuucuuucuauaucauaacauugaaaaugguguccauacuuuaugguuaccugucuuuacaguuuuuauuacuaaacaagcauauaaguugguuauuuuuuaacagagacuugcaauucauacuguauuuuugcacuuaaagucaaauuauguuauuuuuaaaauggugaauaacuggaaaggauaucuauagagcaguguguaucacuaaagaacguuagcaacauccaaaugcagaaguaaaucagcacacguaggucccauucgaugggguccuugauucaggaauauuaaacugucuguuuccaacugucuuaucuuugaaauugccuucacugaugugaugucuaagcuguuacuguauauaaaggugauccucaguauucacaagcaauaacagucagcagcgcuguccucgggcagcagugcuggaccacagcuggagacuguuugcgagccaagugucaugcucacucagagccuccaaaguaaaugcaagcaauaaucucuacuaaaaucaaauuauaguucuucuccugcuucugagaacaaagagugaaaaucaugauuuuaaaacaaucuggagaaaagguuuggagaaaagaagccaaguuaauguauaauaacaaaguccugauauuuugaagaaaucaagaagauucaauuaguacauucuuucaugcccaccaccccuuugauggauguuauuagcccaaauuaucuuguuuugugucauaaacaauaaauaaggcuuauuugggucccagcacuggggaaagaacugggcauauaccuguggguauauauugacuguggguuugacaccugcuuggaaacagcuuauugaaagugaucuuaauccagaauauuuuuucccaaagcagaucuaaauuguuuacuaugcagagauggaaaggguaggcaccccuauucucucuccucuuguuguccucucccacagcccuucccaccucuccuugauucaagacuuucuaaaaugaaaauccuacuguuauugcgacugccauugguuaugagaacucuguucuuugggaaugucucuagaacucauuguccuacuugcugcuacauuggaagaugaucuuugccuguguuggcugacuuuaacugcuuuauuuguaggagacuuugucauguccuuugacccuguguagaagaacuaggguacuuuacuuuaggaguguacuauaaaagcacacugguccucguauuguuagagaaguuugggauuuguuccccuuguugguuuuuguuuuguuuuauuuuucaaauugaaaguagaagaaagaagucuauaguccaggccggacuugagcacugcccugugcuucagcacggugcuucugcugacccacguucucugaagggcacuuugauuucuaguugugcaugugcggcucuuuguuugguuuugcuuucagggugcuuuugguuuuguaaaaacaaagcagagaaaaguacaguaguagauaaaugaucacaaacauguuaugcaauuuuauuuuauaaaguuuuaagggaaaaguuuaucucguuguaaauaaguucuuaucucugguaaaaugcuuauauuacuccucuaaaccaugcucaauucaggccuuugucuuuguuaagugccuuuuauuucuuucuuuuucucccucuuuugaaacuuucaaacacccucaaguacagacugaugaagucaggggauucaggagaaagaaucugagccuugccaaaaucaugucauguaauaauucucuuccuucugcuuuguguguguggacacaaguaugagguacacagcguguaugaaaccaggagcagcugugccauggcaauccuucuaagcacugcccuguugacauugcagaacuucugccuuguuuauuccauugcuuugaguugauucagaugggcagauugggaaguagucuuugcacaugaugcuggcuucccuuucugaauaucuguagaaguuaauauauauguguguguguguguguguguguguguguguguguguguguguauauauauauauauguagggcauuauauauauaaagcauauguguugguuauugcaaacauaauaaacucuguggacuccuugacuauuucuggauguaauccacuucucucuaccccucaaaucuuucaguaguagugugugagaaagcaucaggauaacaagagcauuuguuggucgaggugauacgaugcccuaugcagacaagauucaguacuagugcuagaaccaugggguggugucugaauacacuuuggaggagguuggcacucaugucaauauuaaaagacguuuucuucuggaaaaugaucuugaaauuguauaucugaaacgucaauaaacuuagauuuuuagacagugaggaaacacuuguauaaucaggacguacuugagaaauguucagucuguuuauugccagaugaucagauuugcucugauuucaugauuguuuaaaugucuuuccugagcaaaauaaaauaacuuucaguaucuaagacuugagggggggguucuguuuuguuuuuguuuuuagauguaacauguugaaaaagacuaaguugaacugauccucuguauaucuacaaaggacccccuuuuaaguaaaauuuuaguugaaaaaggagacuuguggcuaaaagaagagguuccuguagcaaagcuguuguuagccagcuuaggaucaguagugaguguuaauuccuaaacuacuuuaucuagggggaagucauuuaaccuuugugccucagauuacccaugagacaauuggguauaauaauaaucaccuaccucccagggauaucagagacuuuacuauuucaaaaauauuuuguuuuucuaaaacauucuauauaauuauaguauuaucuuccugcagagguugaaaaaaacaaauguuuuucuuauaguggauauaaagagcacccuauggucuuuaaguuaaaaaaaaucacuggaauuuuaauuuagauguauauuugauauuuaaacauaccauauuuguugugugguauaauuauuaguuucagauuaaaucaaaggggaaugaacacuaaguuucuuaacuaucaauagauuuuuuaaagcuuuuaugauguuauuacuugugugauauuugcaaagguugugaaaguaaaguuagauaaaguuugaauuauggauaaaugauccugaaaguuuauagccuccuuugucuacauucugaaucuaauuuccuugcaguacuugccuggugauggaaaacuaauuuuuuaccuuucuaagaguaagucagauccuggcauacgacuccugcaucaguaggacucuccaccuuugccugggggauaaggcaugagcagccuacacuagggcggcugugcguucuuuuaacuuuguauuucaugcuucuucagccagagccaucaacuguucggguuguaguaaaaugggaggaagaucgacaggauucacucccuagcuagggcagagguaaagauggucaggauagaaggaaauaugauuucccaaacuccugggaggaaauuagcaucauuuuaucuuccccuccaggcaugcacacuaaguaguaauccauaacauuuuucucuuuaaaacgauaacaacaggaacaaauggguacuacaguuuuuguuagggcugaguagugcaugugagagugggggcgggagggggguagucuaaaugacagcgaauauucagggucagagagaguggagugcaggguguugaggagcaauuacucagcucaggugaguuaggagguagcacugggcugaagcagccagcacaucugggcugacccagaacuggcucagaccuagucauucucuaguccuucuaaaaucauuuuugggauuuuuguugauuuuuuuuucucuccaguagccucugaauaucagcuaugcagauaagcauaugcuucguuuuccacauuauauuccuauucauuguucaauaacauguuaagauuaacccaaaugaauguguguguuuccucuagagaagaguaacagaagccuaaaauaaauaucaucuguuuuccuuugcccuaaaaugugaacuuuccauaaaacgcuagcugaagauccuuugcucaugcagaccuagaguugauguuauggauguguuugcacuuuuaugauagugucaccucguguaaugcugagaggcuuagguuaguguucaggaugacagagcugcagacuugggcucugauuaaaauuaguuucaaauaucaauguugaauuugucuucauuucuuucagucuucagucuugccuuuggugugagcucuuaaguucccacuugcuccacuacaguauaaauuaccuguuguuauaucuagggagagaaagugaauuguuuccauauccucuucucccuuacuuugccaucugcucucaguucccaucaaguuaguguaaagauaguguggggagaguuucaucuuaguggaggauacauauauauauagagagaguuuaguggaaauaccuuugaguagccugaugcuaaaugacacuuuucuuaugcacacucaacguaccauuugcuuuaagguggcuauuugugaucuccuuguguugugauguuucuacuugucugucuuuccuauguauuuccauuucauagcagcuaguauucaaacuuuguauacauuuuacacugcuacccaaacuagucagugacguguuuugaaguuuucaugguacaaauuaagguucuauacauaguguagaacuugguggucacugaugacugggguuucuucucuuuucauuuauauucaauaaauaaauagauuucauaggcugagagucugucucacugggcacucuugcccagcauguacguaagcuagagcuccacacagcagugcacaguaacaguaaguagacuucauuuuuacauagccugggauaccaguguauuuuacauagccugggauaccaguguauuuuacauagccugggauaccaguguauuuuacauagccugggauaccaguguauuuuaagauucuucagaagaaaugcagauuuucauuaggggcucacagcagucugccuugcugacuguuuucauacagacuccuuacaacagagcucuuuugccaaggucugagccaaccagaucauugaauccuaguuaggaccuaaguccuaauuuuagguuccucaaaagaaaaacauuacuugccccgacuuugcuacaauauucuggauuuguuuguuuguuuguuugcuaaaucugguuguuagauccuuguuaauagugcucugguuagaauucaguuaagguuauuugucugagauaacacgagagucagcagcaguccagacuagccacugugugugugauaaucugugcugaaguuuccacaccagauuguauuuucuguacuuagaaccauagacuuuccuccuguuauacuuaucucugcuguuuacagaaacguuaugcccuacuagaaaauucacuagcaaaauuaccaaggauuugcccccauuugggcuagaaauauaaaaagaaaaaaaauauuuuucuuaguugacaaaaguauuugguuuaaauaguuagaaaguugagccagcuuuggucaguuuuccuggcauuuuggcucugacuccaucauagauugcguguacacuuugacauguguucaucagggacccucucccaguaaagauugguuuuccucccacacagcuuucaggacagagagccaagcuuuucagugaccuguuuucagcugucuuugaaagacuaucuuauucuagaaaaugcuggcgugcuaaacuguucuuggaagagagugugcuaguuugacccuccucauggugucucuuguccuguuaaacuuaucagacuucaaggaaaggaagagaaaucucuggugaauuuugugccccaaauaaugaacuuaagucuaaccaaggugacuaagagauggguguuuucucucucuacucgugagcaagguuuauuuaugguuguaagacuuaccauggaacugcagaccuauuugcccagaaaauaagagucagaauuuuagucauguuaagcacagauuucgaacccuuugguaaaguuagauaaggggagacuuuuguuuaguagcagaaggaaaaauaauuauuuauacagugaguauccacccugcaaagccacuucccaguauggaagcagcuccucuuuagucccuucugcccuacacagaugcuaccauguuugcaagccagucuccaagaaggagccgaggaguugaugguccuuuagaggagaggccucaguuacuggguugcaucugcuuguaggaaaguguguuugcuaacuugaaggaauauaugcuguacuucaaauaagugugugacuuaaugcuuugggauuuuuuuucccucuaaaacuggaccugaacacagcuuugaguugguauuuguaauaaucucaggacccgaaagauuguagcauuuagugugucuuaaaaauuauguacuguaccagccauggaguuuuguaaauauaccugucucccuuuuuuuguauuauuuuaguaaacaauaaauaaauaaauaaauuuaauaaaagggggugaugaugauguguguguuugugugugugugugacugacucuguguguguguguguguguguguguguguguggcucuuuuggaggcaaacuggugcuuguugaauuucuaguucaguucagcaggaauauagacaaacugcugcuguugacccuuacaaugagcaaggaggagguccuucauuuugcccucuggugguucauguaguacuagcaaaauggaagucaggagcuaaacucuucuccucuggccauauugccuuuguguucuuggucuagcuccaacauucuuugaccucuggcauuaaagcuuccacacuuugaagauuccugguuuuagagcucuuaaaacuuuccuaagagagagagagagagaaaaagggggggcugauuauaaaauaaauaaaaagcaacaaaagagccucacauuucauaggaccgcuggugaauuuuagauauuuccaaacaugcaucugagaacuuauuaaacuagccccacagugcacuccucagugcggggaugucuguguucauuuugcuuugcgacagccuuguucauauuccagguguaacuagcaaaccuguuuuaaaaugagagccuuauucgauucaguguagauguuuccuggcuauccuccaagacaggaccuuuuuacaugagugaguuuuucuuuuuguauauguuaauguguuuguuguauuaaauaaagaggaauguaaauauuacucugugucucuuguauuauuggguuaacuuagguuuaaguguuccacugucagcagagguugagguuuuaaaauaauaaaacaauuugcagugacuugaugguguacaaaaagaauucuucaaacuugcuuugccaccagacauuugaguucuguucugaaacaacacaggagggcuccaggaaguagagaaagcuugaggugaccucugagcuguuggcugucaggaagcagugacaguuagguguacuuggagaugugugccugaguggguggagucugagaaugcaggcucacuagauccuuccuguaggcagcaguguguguguugggugauacacaucugugcauagcaaauacagacaagaccauagacacccaagauaggaaacaggguuugaguguuuguucucauuuuuuuuuuccuuuuacaugguguaaagugucuuguccugaagcuaaaaaggacuaagaacuuggaacgggaucagcugcuuuuagagauuuauuuugauuuuuacuuagauguguguccauguguggguacaugaguggaauguguaugucauugcucauaaaggccaaaagaauugacucccuguagccgaaguugugagacagcugaaaggggggcugggaagugaauuuggguucucuggaagaggaacagaauguggucuucagcacugagccaucacuccagaucccaagagaugcauuguccucagucaaaguaguuaaaagaucuguuguugggccaguaggauggcucaguggggaaaggugccuguugccaagccuaauagccugaauuugauccuuggcccauaugguggauggcgagaaccaacucaggaaaguuacucugugaccuucacauauuugugcaaucacaaaaacacacacauacucucucccucucaaaauguacuuuuuaaaaguccauccuugguuugauacacugucuuacccgaaguaauguauaagcaauagcuuuauuauuauuaaucauguauacuaaaaaaaaauuuuuuuaagacaggguuucucuuugugaccuaugcuagccuugaauuuauaauccuaccucaaacuccuaaaugcuagauuacagcucuaugccgaugcuccuggcagacauuuuuuuuuuuuuuuuuuuuuuuuuuuuuuuuugguuuuuuugagacaggguuucucaaccugcguagcccuggcuguccuggaacucacuuuguagaccaggcuggccacgaacucagaaauccgccugccucugccucccaagugcugggauuaaaggcgugcgccaccacgcccugcuccuggcagacucuuacuucaucacuuauucuguauaugaaaauggaacgccuaaguuuuuugaagaaaagucauccaaaaagguaaaggguuucagaauaagcuagugguuuagagagucaagaaaugaauggguaagacuaacgcugucauguagagcuccaugaggagcagggguagaagaaggugugguagaggcugaguuggagacaugcuggucuacacaacaaauuucaggcgagccugagcuagauaguaugacccuguuguuucaaaaaagagaaagaaaaacaaaagaaaccaguuuuauucuuuaccacugagcaacagaacauggcuaaggaagggugcuaaguggaauuucaagcuagauuuaacaaauuguugaugaagaugcuuuuuuuuuuuuuacacauuccaggggugggagugugcagagguuugggucaaaguguguugcuagcauuacaguaacaguauaggaacgcggucuaacaugaaauuagcuugguaagucaaauuaacacuucauaguauuucuuaaaaugauccaaggcaagcaugcuacuguuugggagauggacaggcgcucagaucauccucagcuauaucaugagcuugagaucagacggggcuacgugaguccgugugagagcaagaguaguguuccguuguaggagagauccugugcuuuucuaaggccuccucucccgguauauacuaguaugucuugucaucucaaaaauguguaucacccacaugugccuugauguggguauuuccuuucuguuuguauuuacuguccuguguccugguguguguccuucacugucuccccacuauuuuuuucuaguaggguggcauagugugaaggagaacagguuguuauuagacagacuuggguucacauggcuccacuaugaaagucucacuuaaacuguguucuugccuguuucucccccagugaguguggcuggaauugagacaugcagaccguaccuagcagaaugccuagcacauacuuguaauggcagcugcuacaguuauucucaguacgugguuccucuucauuuuucccguuuuuuccaaacauaaaugaaacagucuuguaaagugcugugaucauagcuuagcauacaaguauggauaaaaucuaguuaaaaugcuuuugucacuggcguugggaacuccugacuuaaaaaguaaggggaaucuucuugcauaccuagcagucuuucaaagauuacccuuguucuggagaaguuuuaucuagagaucacucaaguucaucucuucacuggcagccugccugcugcuggcuucaggcuuuugcuucauagccaauuggcuacugcuguuccaaaauaauaguaagcauguauggcuggugaugugucaguucaaaaguauucucuucacugacccuuuaaucccucgcccuacacugccccguccuaugagcaccuguugcuuuucugauguguccccuugugcgugcauccuggugaguagcauugcugugcgugcacucagauucaguguaugcaauugauacuaaacuacagaaguuuccugccuuugcuguuggguuaucuacauuagucuacauacuugugugcugucauggucuguugcgucauuuauacuguuuacuacccuacugcaaacugcucauccucuagagguggguacccuaguuugucguuaauuccuuauuaccacagaaaaacuaaaaaacaaaccaaaaaaaguuucuagguagucuucccuucuggaaauuccuuguuaucuuuugcuugcuuuucgguuguagacacucuccucuggucagucuugggugucacacuuuuacccauccccuuccuuuuaacuuuguguauggcauucuuuacugaacagaaaucuuugcucuauaauaguccaauuuagccaaggauaguagugcacccucaggagacuaaagcaggaaccuugugaguuuugagaccaaccuaagcuauauaaugagaccuugucauaaagggccugggggagcgaugagugcaaauauuuagguguuuucagggguucuuuuaaacauacuucccuauccuagacagcagcuuuccugcuucauuuucuccucgaagacuuagacuuagcuuaccuuugucuccucuucuguuucgcucaggcacuuccccagaaucaucuaauaguacuccccuaucaguuuguggugucaguucugauggacagaggccccugccccugagcucugcucucccccaugggacugugugcuucugcaccagcaccgugcugccugccacuccugcgggguuagaggaugcuucacaucaccuccccaguuguccuuguccaccuuuguugauugagcuaauuguggauuuuuauugucacaugaauuucacauuguguggggcuggcaagguggcuugauggucaugaacacuuguucaugcagaggacccagcugucccuaccugguagcucacaaccaccuauaacuccagccccagggaauccaguauucucuucuuacccuggugggcaccaggcacacacaugguacacagacauacaugcaauuaaaaccucauacccaucagcuaucuacagaaaaaaauguaaaucuuuuuaauuuuuaaauucacauuuaauauagcacaagccuuuaaucccagcacuccaguggcaaagguucauucagguccaaggccagccuggucuaaagaacugaguuccaagauagccagaacugcguaaaacuguauagugagcgcuuucucucucucucucucucucucucucucucucucucucucucucaucacauugcauuuaaaaauuaagcugaggcggauagaguuggcuuagagguuaagagcacugucugcuccuccagaggacccaggcagaacucagcacccacacacagcucauaaccaucuguaacuucaaucccaggggauccaaugcccucuggccucuuuggggaaccagacacacauacauggugcaggcagaacagcuauacgcauaaaaaaauguuuuaagcuugucuuaguuacuuuucuauugauaggaagagacacugaccaaggcaacugguuuuugcuuguuuguuuuuguuuuuuuaagcauuuaacugggggcuugcuuacuauacagaguuaaguccauuauuguggcagggagcacggcagcacacaggcaaacaaagcacuagagaaguagcucaaagcucacaucuaaucuacaggcacaaggcagaguuggaccugguguugauuuuuaaaaccucaaagcccacuccaagugauaccaccacaaggccacucuuguucuucucagaacuguuccaacuaggaaccaaccauucaguacuuaagccuacgggggucauuuucauucaaaccaccacaaaguugaaauguuuauuuagauggaauucaauuuguagagugguuuuaaacucgaauacaaauaucuguggucuguucauucauuugaaugguuuuugccuucuguguucucuacuuuucucuguagaggucuuacagacuaucauuucaguacccaaugguugucauuuucacaaaaagauccuagucucuauuuucuguacuuuuguuacuuguguuaaagaauguaauuagccaagcagggucgcacacuccuguauccuucaaacucaaauagcugaggcagaaggcucuugacuuugagcucaacuuuguccacugagugagacugucaaaugucaaagcaggagcuuggguggggaggaggacagagaacacgcuaaggggaggagggaggcgggaguaguauuaggggcuggagaauggcuuagcacuuaggauggcuugcucagcucuucuugaggauacagguuugauuaccagcauccacauggcaacugggagccauuugccacuccaggcccaggagauuuauugcccucuucuagacucucuugggugccaggcaagcacauggcauggagacauacauguagguaaaacacauauacacuugaaauaaucaucaucaugaauuaaaauccuuuauuuuuguucuuaaaguagcauuagauuugaggaugacaggauagaauucuuuuaaugggaagauaaauacggaauaaggagaaagacuuggaacacauggaauuuaagcugaagcacugacugggcuguugccucgugcucucuucucucaaccuccugauguugacuccaugcuaccuugcccagcuuugcucucucccuccccuccaccucucucuucuccagcuuuccucaucugaacacugcagaugugcaacaagacgcuuuauuuaccgcucgccucccccccccccccaccacuucuuuucugcucugccagauggggcccagacacuccacaauggagccacagugaggcuuugcuauauauuacucaauuucccucacugcuauuuuguggcaggaucuggccuugagcagaaaguucucuugauucagcuaccuaagugcuggcuugcagguuuguaccaccacacccauauuugaugauauauaugcccagcaccuuugcuaaacaguuguuaauuuugguggaggugguauuggagauugaacccagaaccucacacguggaaagcaugagcuccaagcuacauccugccaucuauucuaguaacuccuauugucauuuuauuagacaauagaacagugaaagugucguuuuucagaacugggguucuguguauggaacaaacuuagcaagcgcugugccaccaaacugugccagcuuugccucaccauucaguucguugacuuuugucuacugggugucucccaugaugcuaagcaguggccaagcucgcaucuauauuccuuaccaauaacauuaaacuccagaguaaaauuuucuuuagugugauacauauuugaauucccuuguguuguuuuaugagaugggcuguugauauguagcucaggcuggccuggaacucaacugucuucaccucccaguccagggauuacagaccuguaccauuaugccuggguuaugguuuggauguaugguauuuauaaacuuagaguuagccgggcaugguggcgcacgccuuuaauccuagcacuugggaggcagaggcaggcggauuucugaguucgaggccagccuggucuacaaagugaguuccaggacagccaggcuauacagagaaacccugucucgaaaaaaaaccaaaaaaaaaaaaaaaaaaaaaaaacuuagaguugcuugggaauguagaucaucauaugcucaaguugaauaauuucaaguauuuucccauaauauuugucccuagcaacacucacaaaaugcugggaaguauacucauuguacucuuuauuuguauaaucuccaucugcuguuucaguuuccacacuccauuuugcuuauguacaucuucucccccuuauucagucuuauuucucuugcucauuuuucaaagaacucugaaugucagcggguaugugcucacuguaggaucuuuaaaauauuuuuauguguauaagugcuuuuccccauuguauguaugugcaucauguauguauguguauguauuuauguguuguguguguaugcauuguguauguaauguauguauguauguauguauguauguauguauguauguauaguaccuacucauagaagccagaaggugucuaugcccuggaguuggagcuccaggaggcaugagcacuggaaacugagcucagaucucugcucacagugaugagccucucuccagccccuaguuuccauuuuuaaacuguaaccuauccccucaggcacauugcccuucccaugggcugcuuuuuuuuuuuuuuuuuuuugagacaggguuucucuguguagcccuggcuguccuggaacucacucuguagaccaggcuggccucgaacucagaaauccgccugccucugccuuccaagugcugggauuacaggcgugcgccaccacugcccggcuccaugugcuuacuaaguaguauauuaaguauuaguauauuucuaauuuauuauaaaauauuucaagaaguuucuagaugggcuucccaaguuuucuguuuaacuaacaguugaacugaauauacuugcuauuuuucacuuaucacuuagaaaaaugaugucacuguuuucccuccuuccuggugcuucuguuuggaagacugaugucacucucaugcuuugcugguuuugaugcucucagauuucacucuuuugugcccgacuuuaggauuuccugcccuuuggugcucccggagaccuuugaguuggugcugcuuauuguuagguuuuaggauuuauuaucuuaaugacaucuguuuucuuuuuugcugagacuuuuguauuguguuggguuuuuucccccauacuuuccauaucuuuuucuucuguuuuugucuuuuaguuuuuuaagauaggguuucacauagccaggcuggccuugaacuugagauguagcugagacuagcuuugaucuucucuuagccccaucuccaccaucuuagcacuuggauuacagaggucacaggugugcaccaccacaccagauuuagacaccuugaagaucaaacaaagcagagguccugugugugcuaggcagacacucuuccagcccagcuguaacccagccugugugcccauuccuguucugucuugguccuuuuggauuuaucuagcacucugcuaagucuguuuucuuguugugaauauacucuugacguaacuguuuguuuuaaccuguguuuauguuuuucccugggcuuaucagcuuucuuagcuggugauaucuaguaagagaugagaccaagguccuaagaccagcaagucaguugggagcaucagaccugucccagugcaaagcccuggcauuaccuuggucccuaaucaaccugauuuuucuguuuauguguaacuuuacagugugcacacccaugcuccugggucaugcuauagagaucucuaugcauugaaauguuagcuaugauuccugaguccuaggcugcuguuuugguuuuauuugcauggauguuugugcaccacuugcauguuuuuacccuucagaggccagaagagugugucaauucuggggaacuggaauuacagauguuucugagccaccaugugggugcugggaauugaacaccgguccuuuggaagaacaggcagugcucuuaacugcugagccaucucuucaacccuaacguguguuguuauaauuauuuugagacaagucucucuauggagcccuggcuguucuggaacucacuauguagaccaaacuggccuugaacucauagagguucucaugccucugcugggauuaaaaguguauaucaccaugccuggcuaaaaguguauuguuuuuaaaaagaguaucugaguuuguauuuuccagacucuagggacauuacuaacccaagaccacuccaaacuaagguuuuagcucaggauguugggacaacauagaaugaauuuuaauguguuggagugauuaagaauuaagaauucucaugggaggaucccuacccugucauucgccuagacuuugaaguaacagaaaaaucuaucaggaaagcagagaugaaggggguuugcuuggguguuuucauucucuguaagaaggucacuucuccagccccagcaugcuuuguggaucugugaccugcccuccuacugugccagucugaggccuuugcgccucuugacuuccagaugcaaguugacaugcacaguccagcccucccucuuauagcaguguagaccgucaggggaggcugcagugggcucuggccugucccucuuccaccugaccaucaccuuuccacuuguuucagccguaucaggcuucagaaaagugguuuauauguuaaaguuuccacaagcacuuaucgacauaaaucucugcacaucuaauuguacauaugugaaaacuauacauccccuguauuuuuauugaaauacccagguaagaauacaauauaaaaauaguuaauaguucuguuuaacuaucuccacacagcccaguucauaaggcaaacuguugugugucaccucugguccgucagauaaccuacuucaagaacaggcguuccauaagaaaggaagauuaaccgugauaaccaugguaacccccacuaaaauggggcucuuucugugucaguuuuaccagaaaccccaaaggcugagaacaaaacaauagguguccuucugaguucuaaagggaggagcuggauggccaaucguguagcccaugcuaagagaccaugcagcccuuagcuccgaguccagaaggaccgcuagcaucuaccucugggcuguaccauggaccaggagaagauuucucugacagcagcuccucucaucugagacccagugaggggccuuccagaggaccaguguggccagcacaccuccuagagacugagagacuuuagagauugguaccaccagacuugcucuuaaaagucuacagauagacagucuguggccagcaccuuuagaagacagcuguucauggaaucauuggcauucucagaaucuccguuugccucgcagaggaagggaggccaauuugaccauuuucaagaagaaauccauaggagacuuugaauccaguucccaguacugcugaggugggaugggguggggagcgggguccagccaaagggaucacucagagggaugggacggcccaaugcaaugaaagacugggcacacauucuagcaugcaacugaggaggccccugcaggacaagagacugcagaaggcuuugcauaccugugagaaaguacaacaagaagagaagcaacuuuccaaaucuugucacuagcggugacacucagccaguguccagcucuaaaaaccaagggaaaccuggucucugcugcccuagcacagaagcuagcaaaaaacggggagaaggaagggcugcaagaaacagaaaggaugcugacccacggauggcccuucugccacagacgaccuagcugacacgugcgcagccaagcuuccagccgcacgcacgacuuuugguguuuugauuugacaguguaugagacuugauuccuagcaaaagagacuuaaaaaaaaaaucacaaaauguaaccaguguauuacccagaagagccugcuaacucuguaguaaguuucauccagguguaggaaaaaauguaucauuguugggaacacuugugaggaaugaagggugaucucugcuguccuugagccuguucagaggaaguuuaaaguuguaucuaccaaguuaguaaaccagcauggcuguguuuggagcuccuggccacagugcagcauagggcaccucagcagacagaggagaacauuucauccaguaaggcucaguauuuuaaugugaaacagacugaacuuuuucagagccaaagauggucuagcaucuccuggaaaagcugugugacccaccuccgguuuauagcaggagaggaaggaagcaucuuggagguuccugguggccaaagggaaaagaaauaccuuguccuggcgugcuuguuaauagucacauuuucuucugauuguaauguucugcaauuuaaaugcuacaggauguuaucaauagaguggaucugaucaaaaguaagaccuuagcugggcaugguggcacaugccuuaacaugaagccuaaggcaagggaauccccauacguuugaggccaaccugggcuacaaagugaguuccaggccagccugucuggaaacaaauauuagcugaaaguuagacauuuaaguaauugcagaagccacgauguggugauaaauaggcauggaccucccuuccagagagcuggcagaagccacucaccuauuuuccuuugacaaaaagccuguucuccgcccacgguggguggggcaccugcucuccgcccacaggguggggugcggguggggcagaggcuaucgggagcucuugcagcgcagaucagauugaucguuuggaaaccagccuucauuccauguccuuacaggcuccuuugcaggccaugggaacucaaaguauaaaaaggucacuucccaucucugccuucaagguuuugggugugacuucuuacugccagugcacucaaagccucagguaggacgagagagugucugucacuggcugugaguacucagugacuguggaggcuaagguagacaacauucucuacuagccuccaagccgcggagaucgaccauagaggaauccacacacuucugcccuaggcaccagacucaacugagcuccuauacucugaagugcuguguggcgcaaauauccccuaacucccaacucagugcagccucuagugccccacacucggcugcugccugcaucagagcccugcagugguuucuuguuuucgcauugaaccuugacugacccagcuaccuagcugaaaaacagaaagaaauguauuucaugggucucuuuaaguuaaaggugauuuuuuuuaaagcuaugagauauuaacugucauuuuaaaagaaauaugcuaugacgagaaacuuaacaauggaugcuuagaaguuuuuaggacugugauuucuauuguccaaaauaauguaauaaacaaugguuuuucaaaauacugaaaauauugaauuacauuguuuucaauaaaauaaucuuugcugagaaauuaggacuuuuuaacuguuaauaaaaguauuuuccaaau

SEQ ID NO: 2917 - RNA, 7412 nt, Mus musculus
cgcuuuccuguaguuuggggcucaaggagacacagggcuacacugucuuuuggguaagacacuuuuuaagacacuguaagaaaauuucuuuuggguaagaaaucuauuuaaauuauuaaugccacaaaucaacaggcagucagcagcauugaagagaaugcaagggcaguuaagacucaaaugucagaauggguaucucuucuucugguuucagagggaaggguaggugagcuuccaugucaagaguccaugcuuguaacuaggauguuuuucacuccuggaugggggggggggggaaggagaaagucuuacaaucaaggauguaaugugugauaaugugauuuuuuuuuuaauauagagaagguuuauuggagaaaaggaaaggggggaggaggggagagaggaagaagggaugaggggggcuggggacauguaggagggaagaggaacagagaauagauggagagggggagggggggugggagagagaagauggggaggggacaagagagagggaagcuggggagggagaggggguugaggguaaugugugaucucgaugugaagagguuggaaggagaaaccccguuuaguuagugugacuucaucaugcagggguagcucccgauaacuuagaguucguuagcuuggggcugguacccaggagcagcugcuagggaagagagacauaguugcggaugaguuuggucuagguucuaacacaagggaguaacuuuuuuuuuuuuuuuaauguaauuugcgacagggucucacggaggcuuccaauuuacagagauccuucuuccuccuaagcaugccacuacgaaugacaaagcuaacuguaaccuugucauagagagccuaaagggccuagaacagcuucuaacauacaccgagcaagucaaaagacccagagaguaaauaggaauacuaaggcgauaugcaggcuguugggacugaggaaagaggcuagcucagauaucugagcagaggggaacaagaagcggccggagcuagacgaagguuaacauauaaaaagcuaaugagguagggucuacaagggcaaccuuaaauagacugaacugcuucuuagaaaauaaagagccacugacaccucaaaaagagguuuuaugacagggcggugauggcgcaagccuuuaauccccgcacucgggaggcagccuggucuacagagcgaguucccggaccuccaggacuacacggagaaacccggucucacuccucacccccuccucccaaagugguuuugucuacgguauacaauuaggaacaaaccuaaauucuaauuaucccuaauuucuacuauaguaggcacuaauuucgcaccgucuuauacuuauagcccacuugaaaauucgaaaacugaaccccauucuaauacauccuuggcugcggaaauggccucagcgcuguaaccggaaacagaaacugaccacuaccuaaacgccaccuaacgaccagcuaagagcgaagacaaacccugaaaguagcccaaucggaaggggcuuggcuuuuccuguuacaaucugacaaagaauaggaccagagggaggcucgaggaacugguuuccgcagcccguuuggcucugacgucucccgggcccacuuuugcgcaggcgcagagcuacuacgcacagaaacacgaacacguaagcaaaagcgggagcccguucggcuucguggcauccacuguuugcagggugaagcgguugacucuuggcaucuaaacuacauuucccagcaggcauccguuucacacugaggcugaguuugguucucugugauaggguaaaaacaauaaauuuaagugaugacguacgaaacaggaaauaacuugauuaugguguuugaggacaucaguagaagaagccccaguggccuaauggauaaggcauuggccuccuaagccagggauuguggguucgagucccaucuggggugguucguuuuuuuuuuuuaucuauuuuaacaucaucuaauuagaugauuauugcgagucaaacuuacuguuuauuuuauguauuuagagacaaggucucucuaccuaguucuggcuggguuagaacaaacugcagaccauaauggucuaugagcugugagauccgccugcuucugcaggcagugaaggcgugugccacaacgcccggccaucuuguuuuaaaacuagagaacugcggggaaaaacaaucaaacaaaaaaaacaaaacgaaaaaaaaaaaagccaggcgugauggcgcacgccuuuaaucccagcacucgggaggcagaggcaggcggauuucgaggccagccuggucuacagagugaguuccaggacagccagggcuauaccgagaauccaugucucgaaaaacaacaauaaacaaacagaaaaacaaaacaaaacuagagaacuggaugugaggcuuuacuaguaaaggggcugcaguuugccauaccaggguaugaguucauuuucuucuccuaggcugcggggaccauaaaguuggaggucgguacguuuaauuuugacaucccugguagaaacaguaagaucuuuuuggcgugaccuauguccagacauccacauacucuccugccagacaccuuuccucagagacucggcggccaucagcuuacggcaguccaaagggacgcagucagaagggccgagaggauucggcaccuucccuugcucuccugguccccugaggugccugucacucgcguuucccuccaaggguggucgguagagggcgcuguggggcggagugggcgggggaacaccucgcccgaggcagugagggaccaggcucuccaaggacagaaaaauggcggcccugggguccccggcgcgcacucugcggggccuucugagggagcugcgcuaccugaacgcggccaccgggcggccauaucgcgacacagcggccuaccgguaccucguuaaggcuuuccgagcacaucggguacggcauccgcggcugggugggcuccaggucgcgggagggcggaugagggggcggucugcgcaggugauagagggucucaggacaaacgugucugagucacccuguccuccaccugcgggucucaccacagacuccagcccuucggcuaaccugcggucugaaauccccuacuggcccagaagccgcguggggcgcaccuuccuagggacuucguaucugccacccaccgggguggagcugucucugacgauuucauugguuugucuggugcaugggguguggaauggaguaaggagcgggcguugugugaaguggguccuaggggucguaagacuuaaaggcguaaggguacaagcauccccucuccucauccuuucuacauuaaaguuuuaauaggaagcaguguuuuugugauuugacggguguguguguguguguguguguaggugugugugcgcgcgccugcucgcgcgcgugcuuuugcuugcuugcguguugguggggaaugaagauacagaauuucagcauuacucuggcugaccuggaauuugcuguuuagaccagauugaccuugaacucacaucugauugcccuuuucuccugaguguggggauuaaaggcaugggccaggcaaaugcaauuuuuaaggcaauuuaguggggaauauucaagaguugaagagugguacuguuuuauuuaguacuagccuuucaccacugaggaaagcaauaucuuauauucuauggagaugucacaucuuuagccuucugcaugacaggauacaugacauguuuuacugguguaacaaacauaaacauacagaaugcuauccuugggaagugccauugugaaauccacaguucauauuccucuuagaaaggaauggaagaugguuaauuuuccaaaugugguaaugcucaauucucugccuuuuggacaagaucaaauacaaacacuaaggcucggggacagucaccugcccaguucugcuugaucaagcauggcuacaauuuaggggaauggaaacuuaaguucuugagcaauuaucuuaacuacagaauuugagcauugcaaaacuuuagaacuaaaauucacuuaucuuuuaaaaaguuauguuagguacuguguauuaagaacuagggccaaauaucaagaauaagauguggcagguguugguggaacauguccuuuaauccuaacaauugggaggcagaggcagguggauuucugaguuugaggccagucuggucuacauagggaguuccaggacagucaagacuauauagaguauccuugacucugagaaaaaacaaacaaacaaaaaacaaacccaaaagauauacauguaagaagcuacagucucccugaagagccauaaaauaagaucauguuuagcauaaauaagugcuaaggguauagauaaccaggggacagugguaugaagaagaggugcuucagaaagucuaguaggcuauaauuaggcaucuggaauuggcaagugaauagagguuaggaaaaguaaggguacagggaaagaaaacauaacuaaaaauuuaaagaaagcauaauuaaggcaaacccaacaguuucaaagaggggaagauaaguagguagguauauaugacugcuauuguaccuuauagagguaacauuauuguccuugaagguacuuuguaguaaagguuuugaaguuccucacaaaaagaauuugggagguaaugguagucauaucucagacuuugagcccagccuagucuagaguugaauuccaggacagccagagcuccauagugaaacccuaucuagaaaacaaaacaaaacaaaacaaaauaguaacaacaaaagaaauuccucaggaaaauaccauaaauucaugcucagaauucuagggcugggccaggcauggcgauccacacuguugaucccugaagcauaggugggcagacaccugaauucaaggccaaccagagcuacccugucucaagaaacuaacaaaaccaaccagacaaaacaacaaaaacgaccccucaagacaccaagacugauugugagaggcagcacaacaguacuuguuuagcaagccugaggcccuggguucuaccuccaggacuggggagaaagagaaaauuugagaaaccgucuucuacugaaggcacauaagaaugugggggaugcuuuuucauuuucuggcucagggcuaaaaaauuucugugcucaucuuuuccacuccuuagggagaaaagaugcaaccagggacaucucuuuuuuccccuacuuuuaucuuuuaauaaauauauuuauauaucuuugugggggagcaugcgugccaaacaugggggucagaagacaaaggagagucugguuucuuuuucuacuguguggguuucagggauuaaacucugagcaucaucaggucuggcuggcagcaaguguccuuacccacugagcugucacagcaacuguaucuugaucuuuggagauaggacccaagugauuuccaggcaggcuaggauacauagugagacucucuccuaagucaucuucacauacauaaacuaacucugacccacgagugacugugcugucacacaccuguaaaucucagcauuuguaagaccaaggcaagaaggcugaaucucagaccaguccuugcuacacagcaugaucuuccuugucuuaaaauguuuucauuagagcaguugagcgcugcuguaguacauuaaguauuacauguucaaguauuacauguucuaguuuucaaaucgagaaaaggaauuaugucugagaaaaggaauuaugugugcaguggugcccagggacuaauccacacauccccaauuaugcucaaauuuauguuccugcuccuuccucacaaccuuggaaccccaaaauaguuaaggacagaauacuaaaaaugaagcauugugaagaacaaccauuaucuggagucauuguggacauugauauggacuuuauagcuucuuaauguccuuagaauucagauuuuccauauaguuaaauuguaaaaaccaguuuaauaucaaaacauacuuauuucauauacauauguugauacauauauguauacauacauauaugaucuucauuuuguuacaacugaguacaaagccauuauauuuguuguuguuguuuuuguuuuuguuuuuucgagacagaguuucucuguauagcccuggcuguccuggaacucacuuuguagaccaggcuggccucgaacucagaaauccaccugccucugcuucccgagugguggauuaaagacgugugccaccacucccggcucaaagccauuauauuuuagauaaaauaaauuuuugacuuuuggagugaaagguguuagaucucaggagggggggggugguccauauaugcagaagugcacuugagcuugaguguaggacucccggaggcuacauaaaagccagugugccucagggacagguuuucuacccaauaaaggagucaauucccuggcagaaggggcuuggcucucuauugaacugcaucugugguugcauaucagaguucaugcuagccuguaagcucucucagucccuauucauaaguucuccuuauucacaucaaagccuuauccuguccccucccacccuccccaucccaacucccaggccuguuccagcucacucaguccugucccucuccccgcucccagcuacgcaguccuuuaauuuacuaucucuugcugucucuuggccauggccagucuauuucuuuuucucucuguuguggacucuccuagauacgucuggauguucucucucucagucacaauaaaaaccacuccauggaguggucauuucagugcauucuuuaauguacccacucauguacaaaauguauaugcacuguuuaagccauagaacauaaagcagccuuaauuuguuuaaagagaggaaaagcaugcauucuuuauaugacaaauagcccuggaggucaguuuucuaauucuauagugcuucuguggggguauuaaauccauacaugugcauguuuguauuuuagguuuacuuuguagagaaagcauauuaauucucccucuguggguauguggauacaguagguagugugaacaggcugucugacuuugcuaauuacuuuuuuagguuaccagugagaaguuguguagagcccaacacgaacuucacuuccaagcugccaccuaucucugccuuuugaguagcauccggcaacauguagcccuucaucaggaauuucauggcaagggugagcguucaguggaggagucugcugguuuagugggccuccaguugccccgucagccuggagggaagggcugggagccgugaugcagagaguccucagauguuccuucauucaagaguuuaaccauuucuaacaauauguaguuaucauuaaaucuuuuuuaaaguguggugu

SEQ ID NO: 2918 - RNA, 1328 nt, Mus musculus
guuucguacgucaucacuuaaauuuauuguuuuuacccuaucacagagaaccaaacucagccucagugugaaacggaugccugcugggaaauguaguuuagaugccaagagucaaccgcuucacccugcaaacaguggaugccacgaagccgaacgggcucccgcuuuugcuuacguguucguguuucugugcguaguagcucugcgccugcgcaaaagugggcccgggagacgucagagccaaacgggcugcggaaaccaguuccucgagccucccucugguccuauucuuugucagauuguaacaggaaaagccaagccccuuccgauugggcuacuuucaggguuugucuucgcucuuagcuggucguuagguggcguuuagguaguggucaguuucuguuuccgguuacagcgcugaggccauuuccgcagccaaggauguauuagaaugggguucaguuuucgaauuuucaagugggcuauaaguauaagacggugcgaaauuagugccuacuauaguagaaauuagggauaauuagaauuuagguuuguuccuaauuguauaccguagacaaaaccacuuugggaggagggggugaggagugagaccggguuucuccguguaguccuggagguccgggaacucgcucuguagaccaggcugccucccgagugcggggauuaaaggcuugcgccaucaccgcccugucauaaaaccucuuuuugaggugucaguggcucuuuauuuucuaagaagcaguucagucuauuuaagguugcccuuguagacccuaccucauuagcuuuuuauauguuaaccuucgucuagcuccggccgcuucuuguuccccucugcucagauaucugagcuagccucuuuccucagucccaacagccugcauaucgccuuaguauuccuauuuacucucugggucuuuugacuugcucgguguauguuagaagcuguucuaggcccuuuaggcucucuaugacaagguuacaguuagcuuugucauucguaguggcaugcuuaggaggaagaaggaucucuguaaauuggaagccuccgugagacccugucgcaaauuacauuaaaaaaaaaaaaaaaguuacucccuuguguuagaaccuagaccaaacucauccgcaacuaugucucucuucccuagcagcugcuccuggguaccagccccaagcuaacgaacucuaaguuaucgggagcuaccccugcaugaugaagucacacuaacuaaacgggguuucuccuuccaaccucuucacaucgagaucacacauuacccucaacccccucucccuccccagcu

SEQ ID NO: 2919 - RNA, 58569 nt, Mus musculus
auauuuagaaggcugagacaaaaaguuugcaauucaaggcaagccaaggauacaugaacaagaucucaucucuaaaacucaagaauaaucacacaaauggccauuauuuuucugcucuuucacauucacaaacggucaaauaccugucauuaaauuuugggaacugcccuccaccaccaaccaccccgaaauaguauuuuaacuggguuucauuguacacaucuauaaucuugagcagugaggcaaaggcucaaucaaaggucaggaguucaaagucauacccuguuaacacagugaauucuaggucagcuugcacuacaugagaucuuacccuucaaaaagugaucuuaauauauacuaacuuuacuaguuaauauauuauuuccccuauauucuagaagaacaaaagguguuuguuaacuacuagguagucaguagguaauuagaucuuuaaugcagaaacugcuguuucaguauguugguuacauaugguuuuuauucaggcuugucaauuaagaaauacaaaccaagcaacucuuaguugcuucuacagguucacucuuuccuuacagaagcugcucacuacagcucugaaguauaguauaggcagcaagagauuuggguggagcaacaauucaucugaaauccagaguuaaauauuuacuuccuuuggugccuuauacagaaaggcacuguuaagauguuacaaaauagaaaauaaccacagcaaauaguucuaguggcaacuuacuaucaacaaguuacagugguggugaugauucuuuucauuuuuuuuacaauuauagucuuuaaacucuacacacacacacacacacacacacacacacacacacacacacaagugcuauuaugaaauagucccugcccccccaccccccucaauauacugaacauagcaguuucuuagaacaaaaaaaaaaaaaaaaaaucaaggcaagucugauuucaaauuuucaauauaaaagcaaaaguauguaaugcaacagcuguucaacuuccaacucuauaggccccuaacaaaacagccccguguuuaaaugucuccagcacacaauccaguagaaaugcucaacuguaaucaacuaauaaccaacgugaacagaaccuuagaaaagaaguuacaauacuucccuucacccucuccucuuauaguuggaggaacagguaucaggagauauaaaagucaaaggaagaagaauuauaauggaaaaaaaaaauccuaaagcugcugcuguuuggaauagaaaagaagacaauauuuuacaaauguucaaaaacugcaagacauuaacacaauucauucacuaucacuccuaacuugaaagaauagagaacaguaucucaucauauaaacuguuauguucagguucacaaaaaacuauggauguaguuuuaggcuuuaugaaggaaaacagguucaguucaaaucauuggauacuauacaucuagucugacuggaucggugucuagaacugucacccuuuacaacuauaaacaauagcauguaacuccaugggaagcuuaaggauugaagauauguacacagcuaguuagaucuccccugcuucacgcucuucagagcuccuccugucuucugaucugccauuagcacucucauaggaccgcuucuuaucuuuucgaucucggucacgaggugaucugucucuugaacuccugucucugucacgugaugcuaagucuugaucucugaaucuuucuuuugaggaucugaaaaauauuaauuugaggagcaaaauauguugggacacccaaaauccaaugaaagaauaggaucaauauuuucugauagcugaagaaauagguaagaauauaucugagaagagaguuucuuauagaauagaguccuacuauacagcugaaaagggcaccaaaacaaaauugggaagaacaaauagcuauacaguuaagggcaaaagagccuaaacuaaacaauguauucuuaguauuucagagauaaaguuucuucaacuaauaaaaaggcauuuaguauaaaaacaauauauaaguaauugcuuuuauaagugaaaaguaucaagauuccaaauuggauggaaaccaaugaauuuguacagcagucaucucuugugcuaaauaaggauuugaaguguuguaaauuacaagaucaggguguaugaguuauucuuuucuaucaacuuuaaaaaugacagaaaugcaaaaccauccauagcuuucugguuuuauacaaacaggcuucggccacauuuguccuaugggcaguauguugcaaacuagguaagagaacuacuuaauauggcuuuaaauaaccauuugcuaauuuaaaaaucugguucacuauucaagugaauucauuaaaccaaaauguaaaguaucaaaaaaugaucacacuauaauaaaauucugccgggcaugguggcgcacgccuuuagucccagcacuugggaggcagaggcaggcggauuucugaguucgagccagucuggucuacaaagugaguuccaggacagccagggcuacacagagaaacccugucucgaaaaaccaaaaagagauaauaaaauucuaacuguuccuaguacuacuaucuucauucuaaccccaucuucaaagauauauaaacaaaacacccucagauaugcaaccaggaaaaaaacaaaacagaaacacauuauguagaaccuaacuauauugguuagcauagaauauauacuuuucaacaccuaaaaugaauuaacaacaaauaucacauuuauuuaguucuuuacaggugguacagaauguuuauacauaauuuaucucaaucaagguuagaauuauaaucagaggcacugccaaguccugcauaauacuuauuuuuuuuuaaaguuggaguuuaaaguuggaucucaauaugcuauguuugcaugcuacuaacccagaaaacacaauacuuucagaaaaacauaaggcaagauaaaaaauacuacuauaaccaguuugaaaaauauagauaaggagaguauuauaguuugaauauaaaacaguccaaaaggcucauguacuguugaagacuugaaacuggugauggugcuacagauaaagguggcuagcucauaaagaugguacaaccgcugaauuaacccacuguaaguucauagcuaaacagccauuaggaggugguuucuggcaggaggaaacaggucaagaggggucuauuuuauuauaacuucuaccugguucuuuguucucuaugccaugguguucugguuaggcaugggcccagaaacaauucaaaaguggccaugagccgggcguggugguacacgccuuuaaucccagcacuugggaggcagaggcgggcggauuucugaguucgaggccagccuggucuacagaguuccaggacagccagggauauacagagaaacccugucuuaaaaaaaacaacaacaaaaaaguggccaugaacugaaaucucauuuucacuucacaaaagugugagcuaaaaauaaagaccuuccuucucacaaauuguuuucuuuuuuuuuuuuuaaacuuuucacuuuauuuauuuuuuuuaaagauuuauuuauuuuuauuguauauaaguacacugagcugucuucagacacuccagaagagggagucagaucucauuacggaugguugugagccaccaugugguugcugggauuugaacuucggaccuucggaagagcagucgggugcucuuacccacugagccaucucaccagcccacaaauuguuuucaaauacuuugucguaauacaaaacuauggcaacagaaauuaagauuuaaaaagcuugaaaaaucaacaccaauuucaagcauucuacuugaaguuauauaagccuuuuuccccuuuuguuuuuggaaucaaguucucucucccuagcccaagcuggccucaauuuaugacaagccuccugagccucagccccucaaaaguuaucauuucaggagccccugcuuaauaagcauuauacaaggaaaaauaauaauaaccacauuccaagucuacacaagccaucuucaaagcuucuauuaaugauagaaaugaucacuaagaacaugacauuagaugcuggcaagucccugaggucagugauaacugaaaaagaacaaagacaugaacuaauguuuguacaagauuacaaauauccuccuacacaccauuuguuacuuguuacuagugaaagccuaauaagccaaaugucucuauuaucucuaaugaaauauggaaaaacaacgggauguaauuaaauuauuuggcaaagaauucugaacccaaguagugugacuuugaagucuacuauaggacagaacacccccaaaagcacaaaauugcugaagguccucacugaccuaugggaacuguugccaagacaagguucauauagacaaccuacuuguaguaacagagauauaaguacuucacagcaagggcaagaaaacagcaaacugccaagacuuuuaauggacuuuuuuuaccaucaaaaacuaaacucacauauauaacaauaauuugauguuauauauuugaaauaacaaguaaucauuugcuuuuuuguuaaaaacaaugauguuuuaaaaguaauuugaauucaaagauaugaaauacucuugagaaaagcaaaauuuuuaauaauuuuacaaaaauaauccucuuuugaacaugcugaauauggugggaaguuuuccuauauaacuaaacuucccaaguucaggaagccucaggaugacacagugauaggacagacuucccacccaccccucccaucuccaucaccaauaaagacaaguaagauaaacaucagaaaaaugacagcugagcaggucaacacaagaaucagcuagauccuuuauugccuaaaccacccgauucucagauuuagugugcagauuuagaaucauaaagaacacuaccaaaaaaaaaauguuucuggccacugcacugaggacaaacccaguuuugaaauguaagaagccuacagguauuuccauacuuguuuaauuacaaccaguuauucaagccugauccauuaccucaaaccaguuuuaaagaaucuuucugaaaauuuuccucaucuaaauuuauguuauuuauccuaugauauucaguuuaucacuuuauaaucuguggcuaaguauucucccacacagaaaacuccauagagcaacauaaaaaugguuguuuauauacacuacuauuacuuggcuauuuuuuaacaagccuagcacagaggaaaguaucuaauucauaaagccaggcagggugucauauaccuauaaucccagcacucaagaggaagcugaggcuaaaggaugaauaugaggucaauuugagcuacucaagagcuuggccuccugaccucucccgcaagcccuccccccaacagacacacacagagacacaaggacacacacacacacacacacacacaaaucccuaccuaguuaaaaaucacuuuaagggcuacuaagaacauagacagaaauacacaaaauaaaaagcugauugaaagccuauuaagaaacucagcuugugauuucagggaaaggguaacucagucuaacaaagauuuugucagcuuucuguggguuuaauuuauguggaguaagccaaagaaaauuuaagacuaguaacuaggguuuccgaguuuuucuccuauauuuaccuaauaauaguugucaaggagggaaaaaguaauuuuaaguauaguuuaugcuccauaggauuaugugaccugaauuuugggaauuaaacagcuccacuauauucuaacccuuuguuagcucucacuauauaauuaaugucugcucucauugcaucuuuugaaguuuccugcuauacuaagguguuuuguagcuuccuccaaacucagaauauucccauuacacuaaaggugaacaugaaaauguaugauuuauacuguggauuaaacaacauagcagaaucgguuugcucuuuagaagugcaccaaaauguggaaaacaggcaaacaaagcuaaacaaugcuuuuaaugaaaggacuucucagagucccuauuuguuaauacauauuggaaaacaaauaaacaaaauccccuacaacccucaagaguauuaguaccuaaaauuauuugccuauaaaauaguuuuuaucagcaucccucccgucuccccaacauuccaaguaaagaaaagcaauaaccucugcacauacuggcuucaauuucuuacuccggcucaugcauuaacugugcaugaacuacucauacaaucagaaaaaaauguauacaccuacaauugaguacauaucaauauaucaggugcagguuucaagccaauaaucuaagcauaaguaacauaagaaacaaaaggcuaaaacauaaagguagcuccgcauccucugaucggcacuucaguaccuccucuuggaucgcucucugcuccuaucucuugaacugugccgacuucucugguggcuacggcugcggcuucggcuacuggaccuggaccuguggcgauggcguuucucacgagacuuggaucgaguccuccucuugcguucucgugacauggagcgagaucggugucugcgaugcucucuggaucuagaucuacaagaaaauaauuuauuucauuguuagugcuauaaaucucauuuacacuaaaguccuuucuuuuguuuuuuguuuuuuguuuuuuuuaaaaacguuuuuuuuaaauuuuuuuacuuuuaagaaguuuuuguguguacacgcacauuaaagaacacaaguguaggucagaagacaaacuucuuccauaaugcgggucccaggaauucaacucagguuaucagggguugguggcaggaaccuuuaaccagcugagccaucuuaccaguacugagaaguuauucuucaguagcuguacuugauggcaauucuauucuaaauaaacuauaugugcaauggaaauaaacugcuaauguguuauuggcuagauacuaagauaucaaaauaaaaacaagaguaccaauucucagaagucaaccaaucauuuauaaauuuaauguagcuugggcuaguaagauacacacccacuaguagggaaaaggaaaaaagaaagcuaagcaguuaaaagugcaugugguacaaccuugaacacuagaguacuacauacagcacagaccuguaaugccagcucggaaggcagaggauagaaaaguguagaccauagccaaggaaacccaaaucucagacaaggaucauacagcauuaaaagcauaaauaaugcuuuuaaugaaaggauuucucagagucccuauuuauuaauacauauaggacaauaccaaagcccucuuuuggccuucauaacacucacacacaguuauguguauacagauaaacacguacaaauacacaaacaaaaauagaaauaaaaaaggauuagggcauauuguaaaaaauugauuuugaggccagccaggacuacauauacauagugagauccuuuuaagaagcauuuauuuauuucguguacacugacacucucuucagacacaccagaagagugaucagauuccauuacagaugguugugagccaccaugugguugcugggaaucgaacucaggaccucuggaagagcagacagugcucuuaacccccuagcaagcucuccagcucccuuuuaaaaguuuuaucaggaauauggaagaaaaauuaaggcaacaaucaguauuacaauuucaugccaaauuuuaaauuuuucugcuauucuuuuaagcauacuuaaaaauuuuagggggcuggagaaauagcucagcagguuaagagugguugcuccucuucuaugacacaaguucaguuuccaccaugcaccugagguagcauauaauuccagcauuccuaauuccaguuccagggaaccuaacacacuccccugguuuccaagggcauucccucuccagcucccaaacacauaggacaugugcucacaaguaaaaauaaaucauauuaaaaaaauaauaaagaacauuuuaaggauaaaccacccuuucucugaauuauauuuugaccacuaaaguuuuaaaugucaaugguaagccaaauauuacaguguaaacaaaaacaaaaaaaaucaggugagcauuuuacaaaaacaugaaugugugugguggacucugugugugugugugugugugugugugugugugugugugugugugugugugagugugagagagagagagagagagagagagagaaggauguagauagcaugaauagaacagaaauaugugagggaaaacaaaaagaagauaaguuuacuguuuagcuuaaagucacuuuaagaggacagaagugaugauguggguuauguaugcuuguaaucucagcauuuaggagacgaaggcagaaaggaaacucagacagcaugggauacuauaucuagaacauggcaaaaaaggaaaaaagaaaaaaaaacacagacacuguuuaaguuuaaguuggauuguauugauaauuccaaauuuaaaacagauaaaucuuagggcauauaaauuacaccuaaauaauauaaaacauuucaaguuaccauuaaaauguaguauuuuuucauaauuucaaaagcaauuaauuaggugacacaauuuguuuguaaauauuuuaauuuucuuuuuaaaauuuuuuuaauaauuuuuaaaaaaauuuuugaauuuaaaucuugaaauacaaggcuggccuugaacucacaaugcugggauugaaggcacgagcaccauaucuagcuacagaagaacuuucauauaaaaauguuuuuacauuucauuuuuauauguaugaaugauuugcuugaaugaaugccuaugagguauaugcaugccugguaucaacaaggucaaaagagagcaccggauccccgagagcugcuaugaacugccaugugauugcugagaacagaagcuggguccucugcaaccagugcucuuaaacacugagccaucucucuagauccuauagaaggguuuuuuaagcacuuagcuccagucuauacuauauagucaaauaaauguacauauuguagacuucauguuuuaccacaauugaauaguuucuucaacuaaacagaauuucccauguagucaaaggcagcugaaaccuugcucuguggaacuguguaauccuguaucuuguuaucuguguaaucuggggcucuuccuucugcucaugagcaauggaauuccaagcaaacacuggggcuauagaaaugugcuugcuaugacaccugauucuaaaaacaggcacaggaaggcugucuguccauuccuccauccauuuagugugacagaaagauuguuuuauuuaccuaucuaucaaaagaaagaucuaucuaaucuaucacaagagaaagaacaccagaaaagaagguacaggccuuaaauccuggcauuugagaggcacagguaggcagaucaagccuggccuacauggugagaacaggccagacagggauacauacauagugacacucugucucaaaaguaaaauaggggcuagagagguggcugcucuaagaaacgccagguucaauuucuagcaccgacaugauggcuaaaaccaucuauaacuacaguuccaagggaucugggcacaaagcauggaugccguacagauagauacacggaggcaacacccauauacugauaaaauaauucaaaggaaaaauuaagauaauuaaaucuacuuaaaagaauuuucaccaaugauguuuuguuuaaccacucuugagcucguuaaccuauuucuaauacauaauccaacuuuuuaaaaugucaagaaaauaauaugcaaaauauuuacuauguaccuaaccccuaacacauuuuauuuacaagagaaaaaaacaguaaaguaaauucaaguuccugcauuguuggaguuuauaguuuagagacaaguuuuuagaaaucuaccucuaguaaagaaauaaguaaauggaaaauggguaguaacaguuuacauaugaacaggaagaacaggauuuucugacaagaucccacugaaaacgagaaucagccagcauagacaggagcacucauccauaaagugcuggaaugggagcacguucaacauggugaaggacuagaagaaaucuauugagcuacaaugaagugagcaaacaagagcagcuugaagacuaaguauuuuaucauucaaaccaggaagcucuaagcaguguguuauauaaagugaauggaaguauuauugugugaaaacaaaauuaucuuauggcacacuggacuacacugucaccagauguggucacagcucagcauuaaggaauauagaggaaggagaauaaugaacucaaacaagauccugccuagaaaauuaauaaacuaggcaugcagacauaugccuguaaucuuucccaacagucuagaagaaagacccacgaguuccagaagacaaauuggagucaaacagggcuacacagauggcucaacaagacucaaaaagaaaaccaaacaaaucccauacaacagcagcaaaaucccaaguaaaaggcuauuuguauuuccaacugaauuuuguuuuuauuucaaauugccuuuaaaaaacuccugucacauacauauuuacuauauuucuaaaaaguuuuuugugugugguuuuuuuuuuuuagcuugcucauuuaauaccagagugguaauguacaauucuacuuugauaaaacuaaguaguaguucugauuauguucugagcaguuacucuucaauugcaaggcucacaccugaaguaccauagagucagugguaauuguuuguuuguuaguugugagacaggguuccucuguguagcccuggcuguccuagaauuugcucuguaaaucaggcuagccuagaacucaguagauugccugccccugccccugccuccugaaugcagggauuaaaaucacacaccacuaccaccuggcuagaucacuaguaauuuauuaauucucacugaaguuuaaaagaaauauauucuaaaaacauacauuugaaaaauacaacuucacuauuauauccauaugcuacaguaccuaccuuuugggauucuugcuaugugaucgggaccuaaaaaaagaauaucuacuuuuagaaaagugacuaaaaauuuuaaacuggcacaauguucugcuauaugacaauuuucuugaguucugacuuuuauguuacuucuauaaaaacaagacauguacuugaaugagagucucccccaacaaacaacagaacucuauagaauuccccuccuugucacagaaguuccuucaacuaggcaccuggcuuagaaaacaauauacuucuggugacugaaacugucugcuuaucauaaaaacuuaauucuccaaaacccacuuccuaaacuagaacaaaaacagaccuuuuuuuucuauagcuuuuacauugagcuuuucucuucuggaaacaaaaauguuucgauauguaaaaugaccauucugaacuuacaacuucacacuauaguccuagaaaaaugaugucaagcuuagaccuuugucuacuuacacaaauuauauucuuuuauaaagaauacagaaaauuaagaaaauuagacuauagggcuggugagauggcucaguggguaagagcacccgacugcucucccgaagguccagaguucaaaucccagcaaccacauggugguucacaaccauccguaacgagaucugacucccucuucuggagugucugaagacagcuacaguguacuuacauauaauaaauaaaucuuuaaaaaaaaaaaaagaaaaaaaagaaaauuagacuauaagaaaauuaguauuucuaauuguguguguguguguguguguguguguguguguguguguguauaaacuugggugugcaugacuuaaaagguuagaaguauuggauccccugaaacuagagucacaaaaaauuauuaccuguucaauguggacaaugcuaguaaggagacucagguccucuuugcaagugcagguccauguucucaaucacuaaagccaucucucuagccccaaaaugauuauauuccuucauauuuaaaaaaauuuugagggcugaaaagacggcuccacgguuaagagaacugacuguucuuccagaggucuuaagaguucaauucccagcaaucacaugguggcucacaaccaucuguaaugggauccggugcccucuucugguuugucugaagaaagcagcaguguacucauauacacaaaaugaaucuuuaaaaaaaauuuuuuuugccuguauguguacauguauguuagucaugauuuuguuuaaaaaaaaaaaaaagucuuugccuacauguguauauguauguuaaccauguacaugugugaggucagaagacacuggcgccccagaacuagaguagaguuauggaugguugugagcuaccaugugagugcugcuacucugggccauuucuccaaccuccaaaugauccagccccagauuauacucuuauauagcauacucuucucauuucccaguacaaucucagaacucaauaaacaauuccaauuccaugaugaguacaacacugcaguaguuuaucuugugguaugaauguauauauaauggcaagcauguuuaaaguaugcuuuggacugucuuaacuauauauaguucuauucauucauugugcaaccagggggaaguuauauauccuaccuuaaucuaucauuuguuaagagaggaauagcaauguaaaugugaaaaguguaaaauguuccccaaacucugacaugcugaugaucugguccccagcuggcauaucuaaucauucagagcuaacuggacccuaacuauuuuaacuaauggauaaauacugacaauuuuuuuuuagauguauacauguguauugcaagcuuguggauauucauggaggucagaagguuuuagaucccauggaguugggaguuacaggcaguugugaacugcucaauguggcugcuaagaacugaacucaggucuccucaaagagcagcaaauguucuuagccauuucuccagcaccuacuggcagauucuaauuguuguuagguuacagaaaccaguaggugugaccuaguucaaagaaauaggcucuuugaagggugguuauuaucccuggacuuguucugaaaacaucuugaaguaagcaacuuuucucuaccauggcugguuguaucuuucagccaccaggauguucggcucacagaaauguagcgagcaaaccaggugcugaaacuucugagaccacaagucaaauaaaucuuuauuuuuuuaagcucuuuucucaaauauuguuuguuuguuuugagacaggguuucucuguguagcccuggcuguccuggaacucacucuguagaccaggcuggacucaaacucagaaauccgccugccucugccuccccagugcugggaucaaaggcgugugccaccaccacucggcuuuuuuuuuuuuuuuuuuuaagguagucuuacacuacagggcaagauagcuuuaaacuaguuacucuccugagugcuaagauuacagauaugaacaacuacaccugcuuuuuuuucauuuuggggagaaugagaacucacuauguaacuuaacguacuacacagauuaagcuagucucaaagcugccaauccuuuuauuucaguuucuuacguuaggauuauagguaugaacuaccaugccuagcuaaacauuucuccaauaagguuauauuuugcaaucaaaagaaauugaggucuugagaacugagauugguuaugaguccaccauaacucauaaacugggguaaagaugugagccucaauagaguucuugggacuuccugucugggcauguugguugguacugcaauucuccuggucuuucauccccagaggucccaguuccgcccuguccacugcugcaucccaagggucuauaaaguuaccugguacacaacaggugagcuaugagugcugucagggcuuaccuccguggcacuggggggaaacucaggcccaguaaccccagugcagggggagucagaaaaaggauuacgaaguaaucaacuggggacuggagagauggcucaagcacugacugcucuuccaaagguccugaguucaaaucccagcaaacauaugguggcucacaaccaucgauaacaagaucugaugcccucuucuggagugucugaagacagccacaguguacuuacauauaauaaauuacauauaauauuaaaaaaaaaaaaaaaagcugggcggugguggcucaugccuuuaaucccagcacuugggaggcagaggcaggcggauuucugaguucgaggccagccugaucuacagagugaguuccaggacagccagggauacacagagaaacccugucuugaaaaaaaaaaacaaaauaaaacaaaaaagucaacuuucuuaccaucuacaaauauugcagucccacaaacaauaugaggucauuuaacuaacucaaucaaaucuuaaaccgagaauuccaacauuauuuaaaaugcuaucuacucuauacaaguaagaccagccuaagacugaguauagugacuacuucuugaaauuucugcauuuaggcaguugguuuggguuuaacaauaaaguaauauagaugucauauacaacuuuuaauccuaaaaaucaagaggcaaaugcaggcauaucuccaugaguucaaggccagucuauucuauauagcucuaggacagccaggagggguauagagagaccgaccuuguuucaacaaaaauagugauaucagcaauaaauuuauaauuaauugcaaaaaucaguugcggagaacaguccucugacuuauacauacacauauacaaaaaggguacagacacgccauacauacaaauaaacaagaaaaaacuggaaugaugaggaaaaccucaguauauacuaacaaagagauaagcucugaaguaagauugcuaaguggaaaacagagauaguggaaggagcaagacagugagaaacacagaggaagaaacaaaggguuucucaaaauaggugacaacaacauagcauuguacaguuuugccccuaaaguaaaaaggauugccagcuaaauuccaccaacacuggggccagugaaaugaacagacacagaaugcacaugcaugcacacgugcacgcacacacaaauuaugaaaugcaaaauaaaguucaccuaaacugagaguaauaugcuaagaccuuuuaaguuaguaugaccaauaaaggguuuuaauuauuuuugagacauauguuaacucugagagaagguauuuaaauaucauagauguacuauaaucacgaaacacuaaaaaucagaagagguuaauuucuuuauggcaugacugucuacuauaaaguucugaaaaggugcuauaaaacaaugucauauuugugucauguaauuuuaguugccaauggguaaaaaugacuuagaaggauguuuaaacauacuaaauaugaugaauacuaaauuuaacaauguuaauauaagcagacgugugugugaucaaguuguuaucaaguuaaugguguugcacaccuuuaauccuagcacucaggaagcagaggcaggaugaugucuauaaauucaaggcuagacuagucuacacggugaguuccaagucagcucagacuacacagagaaacccugucucaaaaaacauaaccaaaauuauggcuccuauaauugagaaaauaauaguuuaauauaaaaacaaaaacucccauauauuuucucaaaaaguauaaaauaaacgaaggauaaucuuuugcacuggaguccuugccuggcacacaacaagaacugggcucaaggccuaacacuauaaccaaaaaguagaaaaggccaaaauucuguguuauaaaggcacaaaucuagccuaauaugaauuaaucaauggguaguaaaagguuuuacuguaacucauauaaucugaagacaugaaacauucuuuauucgauuuuccacaaauuuugaaagaaaugagaucaguuuaguugacuaagaucuguuaaaggcugaagaucucuaacauaaaaacacccaagcauacucaaaaaccuaggcuuucuaaguuuaaagucagaucagauuuuaaaugaagagauguuaaacagguaaggcuuguguacucacaguuccaaauucaaaacuccaaauuucuaaacauuucuggucuaaagcauuuuacauaaauacaagcuauugaaucuguauuguuucuauugaaauagucuugcauagugaaauuuuucaggacaaaaguuucaaaauuuccguguccagaaucaauuuaauggcaucuccaaguccuaucucuuucaggcuggagacuugagcuucaaacacaagcacuauuucugacuuaguacauaccuccucaguuucucccguucuucucucucccucucuucucuucguuucagacguuccugguuucucuucuccugcuucucagcuacaacucucuuuaagguaauaauuauaaaaucggucauaaauucacugggcauauuccuuaauuaucuuuaccuuaaaccauaucuggcuucccacauaguacaauuagcauuaauauaauuuaaaauuuugugaggugcuacaauuauuagacuucuagaauuguuuuuccagaauuguagaaaacaugcaaaaccucuuguuucaccacgacgauuuuuuuacaagcaggaaaagcaaguaugcuacuaaacucuagucccacccacaucauuccucaaugacauuuaauaauguaauuaauaauaaugguauuauacuacauugucaacagagucucaauaccgccaaaucagaauaaacaauaccauucaaagccuaacuaauuacaguacagggagacugagacaagaggacuaccagaaguucaagaucagccagaggugcaaaaaaaaaaaaaaaaaagaagaagaagccaaagccuuaucaaugaaaccgaggggaaaaagaaaaaagaaaaaaaaccaauacagaccaaaagaaucagguuacgcaagauaaagugaggggcauuaauuuaaacaauguaccuuuaauucuuccagcuucucucuuauuucaauaaaucccaggugcaauuuacccccaaaaugaucagccagucgccugucauugucaugaagaccuaaauacgcagagcagaccucgcagacacgaaguuucugcugcuggaagcuggaagcuggcauagaguuccgauaaacuuccuaaacaaaaggaagaaaaacaaugcucacacaaauguucuuaaaacaauguaagaaaauauaguaaauccuuugaguggcagcucuguuggaggucaaggcuuaaacuauccuuuacauuccaucucccugugaugccaagacaacagaugaaagguuaucuucaucaggacucagaugauuuguacucauacauuucauuuaaaugguauucuuaauauacauugguaaauuugccaacccacuauccucuuuuccuuuacuaauacaauccugggggggguuucuuguuuuuuguucaaagcaguuaauaauauaguuuccaaaucccuauguagcuuuggcuacgauaauacagauaaaaauagcuggauacaaucuacuguaauugucaugaaaauaauauucuaauaguuugaagucaguaaggaauugacaaagcaaaaaaauaacagcuuaaucuuugguuucauaaagguuuacacgacuauauugcuguaagcuaugaauaaaggaaaaaaaaucccuuuaucucaauauaaauuuuaaggggauuuuuuugguguggguuugaguauauacaccaaauauaugugagugcccacgaaggccaggugucagaucccacagaacugaguuaccaaugguuguaaaucacauuauauacgacugaauacaaucuauguguagcaugggaauaaggaggugguuuuuuuuuaaacuaccacaagcggguauagcaauuaaaacaauuuguuuacaugauauaagauuacugaccugucccauaaaacagcauauuguacugcuauagaaguaaaaucacuguggaaaagaguagguagcacaguguauauagguguguuccuuuuauguggguaacuaguuuaauuacacguaugaguuauaaauuucaauacagcaaugcuuccaauugucccaaaaauacuuugagacaaaacccaauaguguaacagcaacugcuuaaguauuucuaaagugauuuaauuuucuuuaauaaaauuuuuaauaaauuugaauaaaauauauauauucucuaagaaguauagacacuaaccuuuuaccacuauuaagaauuuaccucuuuccaggauaauugggucucauaauaagaccuuaucucaaaauaaaacaaacaaaaugaaaaaagaaaaaagagauuuuaccucugcuucucuuuucuuugcccgugcuuucucgacuucauccaugacuuucugagauucuuccacauuuccuucagcuccuaguuguuccacuuuggccaacaacuugccuauuuccucauuuaacucaugaacacgcucugccuagaaaaacaacaauaaaagaucaugaaugauaaauaaagugaggacaggagagauggcucagcaguuaagauuacaggcuguucuucuagagaaccugguuucaauuccuagcaucacacuauagcuaauaaaagcccuauuuuggccuucagaagcacuaggauggcaugugauacacagaaggcaaaacauacauauacauaaaauuuuaagggaucuauuuucuguaugaguacucugcugcauauacaccugugugccagaagagggcaucagaucccuuuaaaauggucguaaaaauacaauaaaggugcugggaacugaacgcagguccucuugaacagcaagugcucuuaaccacugauccaucucuccagacccuggaaaaauaccaaucuuaacaaacuagugugccaauaauaguuacuuuuuuuauuagauauuuucuucauuuacauuucaaaugcuauccccaaagcucccuauacccucccccccgcccugcuccccaacccacucacuucugcuuccuggcccugguguuccccuguacugggacauaugaucuucgcaagaccaagggccucuccucccaaugauagccgacuaggccauccucugcuacauaugcaacuagagacacaacucuggggggguacugguuagcucauauuguuguuccucuuuuaggguugcagaccccuuuagcuccuuggguacuuucucuagcuccuuuauuagggguccuguguuccauccaauagaugacugugagcauccacuucuguauuugccaggcacuggcauagccucacaaaagcaagcuauaucaggguccugucagcaaaaucuuucuagcauaugcaauagugucuggguuuggugguuguacaugggauggaucucugggugggacagucucgugaugguccuuccuuccaucucagcuccaaacuuugucuccauaacuccuuccauggguauuuuguuacccauucuaagaaggagcaaaguauccauacuuuggucuucuucuggaguuucauguguuuugcaaauuguaucuuggauauucuaaguuucuggcuaauauccgcuuaucagugagugcauaucauguguguucguuuguuauuggguuaucucacucuuucuuaaaguaucuccaaccuaagauauuucuuuccucaaagaucauaguauauacauggcucaaagcaugcauaugcuacacauacaugcaugaaaguaaaacagucaugagcauaaaaauaagucuugcugggcauugguggcauaugccuuuaaucccagcacuugggaggcagagacagguggaucucugugaauucaaagcuagccugguuuacacacugugucccaggacagucaaggcuagagauccugccuccaaaaaccaaaagggggaaaacaaaaggcuuaaaauuauuuuuuaaaaugauagaacuauacauguacgugaaugaauaaauacaugcuugacugacaaauucuggguaauauauaauuaucaauaguacuguuauauucuuguuauauuaguuguuaacauuugaguagguaaaaauucuauagauaacuuaucaauaaucaaaaaguuggacugagccuggcauagaggcuuuauuaaucuuagcacacagaggcaaaggcagguagauuucucugaguucaagaccugccuggucuauagaauauguucuaagccagccaggauuacacacagugaaacccugucuuaaaaacagcaaaaagaaaaagaagccagugaauaagacaggguaaaaguauacuuuauaaucucaacacuugggaggcagaggcagaggcagaucucuugugagucugaauccaguauggucuaaaaaugaacaccacaacagacagggauacaaagagaguccccuauuucaggcaauuacaauaaaaccgaauaaaacaaaaaacccugauacuuugaacuaaugaaauucuuaccuuugcagccacuucagcacuuaucucuucuugaguuucugcuagucuuuucuuagauacuucuguucuucuaucacaaucugcaaugaaugacugcagaugauccauggccuagaaaauuuuaauauaaaacaauuacuaccacaaaucaauguuauccugaacaaucuucacaaaacaauguauuuugaguaguggaagaaguccuagguaaagaaaugcuuuccuaucacacaggaagcccugagauuaauuuccaacacuccugcagccucuuccuaaaacaagaaaaucacagggcugaggacaugguuagugacagcaugcgugagccucuggguuucaagcaauucuaaaaaauaaaaguucaggaaaaggaaacaaacaaacaaacaaaaacccaaaacccucaaaacaguaauaaaaaguaucauuccuaugguaucauaggaaaaaaauaaaauaaaaagccaaacaaugacaauuuagaaguacacuccuguuaucucagcacugagaaagaauggcaaacugaagagcagcuugaauaacagcaugugucaagacaaccaaagcaauacaacuaagaaaaugucucaaccaagccaagaugaccugauugcuacuaagccuaaagacuugaguuucauuuccaggauacacaacagagaaacaauuccugaaagcuaaucuuugaccacagacagacagggaaacacacacacacaacauggaagaccacuauaaugucaguaagauuuauuucuggauauuuagguaacuauuuguauccugugguuuucaaauuacaauaaagaggaaauaugccauuaacaaauuuaacaaugccuggaucaggaaaaaaaugcaaacaaaugagguauaucugauuuuauaaaauaaaugucaaaucacuaggcaugauggcacacaccuuuaaucucaguucuugagaggcaaaggcagacagaucucugaguucagagccaaccuagucuacauagcuaauuccaggacagccagagcuacacagagaaauccucucuccaaaaaucagaaggaaaaaaaguaaauuuaaaaacaagcauucaacuguagcaguuugaaugagauauccaccauauacucgagcacuugaagacuugguccacaguugauagccuucuucagguuuaagagguaugcccuuaaugaaagaagcaugccacuaggucaggcuuuaagguuucaaaagccacugccaguuuguucucucacuuguuugcugucaggccucccugccaugaagugaauguagacucucauuccucugcaacuuuacauccaaguaaguuacuuugguccuggugguuuuaucacagugauagcaaagugaauauuauguauaucagcuaaaaauagaaauuuauuguacauacacugaacuuaaaaaugagacaagaaauuccacaaaguuaaaucacaaaacaaaucuucuuucauuuccuuauauaaagucaaagauagcauccuaaaguaguaaaaauaacaaugaacucaucaagaaauauuauugguucuaugaaguagcuauuuuggcugguuuuuuauauauauaacagaauaaauccaagauguacaaaggauuuaaaauaagccccucacagggcuagaaauauagcucagcacuugcuuuucuuguaaaacaccuguguuugguucacagcauccacauguagcucacagccaucuguaacuaccaggguaucugaugcuucaugaguaucagauaugcaccugaugaacauauacucaaagaugcacacucaagugcaaaacauucaaacagacacacguacaaaauaaaaaucuaaaaacugaaaauaaaaacauagaagaggaaaacauagaugagaauuauuuuaggucaaaauugaagagauuuuucaaauugauaaaauaaguauuauaagcacugauuagacaguauaaauaaaaauacuaucuaaaggaaaagucaucaaaagaaaaauaagauaggaaaauguauacuauacacaagaaaauggguugacuuucauaauuuauaaaaaguuauauaagucaaccagaaagcugauaacacucauguuuagcaaaguuggaaaauccaugcauuaugcaugauguuaaguacaaucagcacauucaccuucacacauaaaaaugcaaaauuaaaacccuuacacucauucucuccuguuugucagcagugcuuugacaacagugugcagcacaaaagggaaaauccuuguaacuuacgcccagacaguauuaaauguauuucuauagaugguuuucauuuccauuaacaaaaguuuuuagauguucaaagagacaguagaaccuauuuauugcuagcuaaauaaaauuaccuaauuucacugaugaagagcagaagauuuuuguugaccacaaugucuuauguacauguauuuaaaaagaaaauguaaaaaguuuuaagagcuauguucuguaaaccauauuguguaauuuaauuucucuuugccugcauauauauauguauaugcacagugucuacagacaucagaagagggcaucagaucuccuagaacugaaauuaugcuugugaccgaaaauaugagugcccuuaaccauuaagccccacguuuaucuuuauacgagaaaucuuucuuuugucuucuucuucuccccacccccucuuuuauuugguuuucaauuugagacagggcuucguuguguagccuugguuaucucgaccucauugcucuguagaccaggcuggccuugaauggaagcuuugccugccucugucucccccgugcuaggugugccccaccaccacacagcaagaaagucuucuauagaaagaaugauauuaaaucacucuguaacucauggauaccuaaacagcauuuucuauuucuuuuauuauuuuacauuaaaagcaugccaaacugggagguggguggggguggggugaggugaagcaugccucuuaaucccagaacuugggaagcagaggcaaguggaucucugaauguaaagccaaccuggucuacagagcuaguuccaggacaagcagaguuuaaaacuucuguguugaaaaaaaaaaaggaggggaggggaguggcaguggcaggcagugguugguggcacacuccuuuaacccuagcaccugggaggcaaaaacagguggaucucuaaguucaagaccagccuguucuacagaucgaccccccaggauuaccagagcagcacagagaccuaggggagggauggagggauagaggaugagggugugugugugugugugagugugugugugagugugugagagagagagagagagagagagagagagagagacagacagacagacagacagacagagagacagacagagacagagagagagagaaacagagagagagagaaacagagagagaaagggggagcaggggcuggugagauggcucaguggguaagagcacccgacugcucuuccgaagguccagaguucaaaucccagcaaccacaugguggcucacaaccauccguaacaagaucugacucccucuucuggugugucugaagauagcuacaguguacuuacuauaauaauaaauaaaaaaucuuaaaaaaaaaaaaaaaagaaagggggagcaacaugguucagaggcugcaggauagucuggagauaagugcuuguuacuaucaguuaagacuuuuauacagccgggcagugguggcgcaugccuuuaaucgcagcacucaggagacagccugguguacagagugaguuacagaaugaguuccaggacagccagggcuacacagagaaacccugucucgaaacacacccccucaaaaaaaagagagagagaguuuuauacauuuucauaaauauucaaucucauauacugaacauuuugaguuagggcuagaucagugauaaaguacuugucuacucuguauaaggccuuggguuucaucucagcacuacaaacugggguagugugggugaguauuaucuauauaguaaccuucauacuaucacaaagauacguuccuaaguaagagacacuaguuuacguucaaaauuuuaccacaacagacaauguaauaugaaagcaaaaccacauacaucaaguucaaagaaaaagucuuguucuuuggacgcaauuucauaaucugcucuuaaagccaggucauggacuuucaagcauucuccaagauccauucucuaggaaagaaaauaaagacaauauauuagaaacauguauuuuaaaauucaucacuaucacaguucucuucagagaacuguauaauauacuaagucaugcagugaguacacuucuucauuuaaugaacugucaaaauauaaaauuuuagacaauuagagcugaggagguagauugguugcuaagugcuuaucuggcauacagaaaguccuggguucaaucccuagcccuccauaaacucaauauggugguacagaccuauacuaucagugcuguguagauagaaguaggaggauuggaaagucaaaggccagauacauagcaaguucaauaucagccugggcucaugaggaaaucucagaggaaaaacacaaaccaaaaaaggggggcagaaggggacgaaaacuaugauucuuuuuggaaugugauggccuuucuuguuuuauuauauuuuauuuucuuuguucacaugcacagacacuugccauggaguaaauguggaggacagagaccaacaugugggaacugauucucuccuaccaauccuggggaucugaacucaggcuaucacugagccaucucuccagcuccagccugauacucuugagauguuaggguuauagauauuugcugccauagcugcguuguuuaccacucauuagauucauuuuaaaugcauccucaugagaaacauuuuucugggcugaugagauggcucagugguugcucuuucacaggacuugguucuguucucagcaccgacauggcagcuaacaaugaucugcaacuauaguuacaggaggugugacacccucuuuuugcuaugacacccucauccagcaccaggcaugcaugugguacacagauauacaugcagauaaaauacaacagaugcaguguggugguggcgcacgccuuuaaucccagcacuugggagacagaggcagcugccugaguucaaggccagccuggucuacaaagagaguuccaggacagccagagcuauucagagaaacccugucucaagaaaaacaacaaaaacaacaaacucacaaaagaaaaauuaaucuuaaaaagucucagguuagaggaucucauggcagacagacaaacgacaaaucggggaaggaaaggagggaggaaagaggcagguguggaggaagcagaauuguaguaguauuacaaacacauuuaguggaacguuccugcaaucauagcauuugaaacacugagacaugaagacugcaaguuaggggccaguaaucagucagugucuuccuucuaccuccaaagaaaaacaaaaaccaacuaauguaacaacgaaauuagagcaucuucuacagcaaucugagacuuacuuguauaucuagaaacuaaaaugacucagccaaccuugcuuuuuugccaauaaccuacauauguacaaaacaaaauauacgaacaaucauuuuguauaguacccuaaaaaauaggacauucacuagauaaagauuuugaaaaaauucaaaagauuugaaagaacugauauaaagcaggcaaaauuuaacuaaucauaccuuauauuuacaaaaauuuacaaguaguuagguaugaacaaagaauuacagaaauucuaaaacuagucaagguuuggguuggugguaugagccucugaccccuagggcuuagaaggcagaggaggcacuuugugcauuugaaccaaaucuacauaggguaccuauaauccuagcacuuaggaaccugaggcagaaugaucuccaguggguuucuuagacuacaaaacacugccucaaaaaauuaagcuaaggggcuagaaaaauggcucaacacucgcuccuccuccuccagaguacuccacuuaaguucccagcacucaugucaggcagcuaacaaugaccuguaaauauagcucaggaacgugacaccuauacagucaccugcauauaccuggcacacauacacaaagauacacacccuaaaauauauaaacacacacacacacacacacacaaaaaaaaaacuaagaauauuuuacaguauggcauaagauaaaucugugugaucuaaaacugugcucuacaaucucauaacaaaucuauuacugguuuuuuuuuuuuuaaagauuuauuuauuaauauauguaaguacacuguagcugucuucagacacuccagaagagggagucagaucuuguugcggaugguugugagccaccaugugguugcugggauuugaacucuggaccuuuggaagagcagucgggugcucuuacccacugagccaucucaccagcccuauuacugguuuuuaaugaauacuuugauaauuaacuuuacaucuugauuuucucuucuaugauuucaccuuaucuggcuuuuaugcacauuuuaguauuaagauaccuggucucaacuauucaucuuucaaaaugugcuucuuaggucagaauuugcucuaauauauuuuuuuauucauuauuauuguuuguguguguauggaagggggccuggggggaagugagugucacaggaugccugugaaagugaaaaaaacaaccuuguagagucuguguguucccuaccucuacauuuauuuuacaugaguccuaaggauggaauucugguugccaagcuugcauacuaagugcuuuuauccaugaagccaucuuuaccagaccagaguucauucuuaaaagcaagccuucuagaucugggaacucagcucagugcuagagcacuuacuuagcaaauacaaggcacagaguuugggccucagucaaaaacaaaaccccaaaacaacagcaaaaacccaaggcaacuaaaacuagccuuaagagauuuuuuucacuucacuuguguccuucuaaaacuagcuauaaugagguguaucuguaccccaguaucuucagagucaaccucauuucuccaggaacauuucuccaaggacaacagguaucacaagacaguuuuucugaauuauagaaacaguccguugcuuucucuuuuguauccaccaugacaaaguaucugcuuugauaugguaucaggcauaguauuaaaagaaaaaaaaaaaaaaaaguccacaaagaaacuccuuacaacuuccugcccuuguaaaagucaaugcaaggggaaaccuaccuuggucaacaauuuccaugacccuaguacccuaagcaauuaaaagccacuacagaagaaaccacaacaaaaauacaccgaggaccaaaacaauucucaagagccuuugccccucuuaagcuccauccagacaccacauaaaugaagcacuaaugcuuccaaaaccaagugaaaacauacuggcugcugccggugauacuucucuucagaaauaaagugaauaaaacaaaauaaaaugcuugguuuacucugauuucaaaccauuucaaauguuucuccaagaagucuugaccaauuauuaucucugauccuaauaauugcucuuuaaaauuccucaacaucuacauuuuuuccuguuuaacaaaguagauucuauuaagugcuuuuaauuuuuuaauuucugaaaguugauguuaucauuccaaauggacucuaagcuuccuaagaaaaauggucuauuucuguuuuucucucuacaaaccauguuuugcacuguccauguuucccaagucauuacuauuaaauacauuuggcuugaauaagcaacucugaagaauuugagcaauauaaucuguacaaagguacauggauauaagcuuuaauaauuuuuuucuuagaaaaaagaaauaucuuaagagccucuuuaccagaguuugauggaacauauaaccauuaaaaaccaugaucuugggcuagaaagguaagguucagggguuaaaagaucuaguagcuuuuccaggaccaaaggucaauuccuaggaccuacaugauggcuuacaacagucuguaacucuaauucuaggggauuccaaugccauccucuagccuugaagggcaccagacacacauguggcaaaacacccauguauguauguauauaugauguugaaauaauaaauuuuaaaagaucaagacccaugucccuucuaaugugccuaguaguccaagccuauaaaauuaguauuugaaagacugaaucaggaagaugaacaucagccagggcuaacacaggcucucuuucagugugugguggcauauacacuuaauuguaucacuugggaggcagagagagguggaucucugaauuccuggucagccuggcucuagaguuccagaagagccagggcuacaaagaacaacugucuuggggguggcguagugucaacgaaacucuccuuuagcaaaugguuuagaaagagugcucacacaacacaaaauuuaaauuuuucacacauccuugacaagugggagagagauggcaaaaagacauaaaauauguuccuuauaugugugugauuuagaaauacauuacuaagcuagugguaugaugggcauggugcucaugaaauucaaaaacagccuggauacacaacuuuaaugcaagcacugccugggugaaacuaugaggaaauagguggggugggaaaugcacuacgaugagacauuuguuuuguaauuuugcuuuuguuguuuguuguaguaauaaauauuaaaaaucccagauucuucauggccuuugaccauuuauguuccuggauaaaaaaugcacacagccaucauauuuuuacuaugccuuagauagcacaauagcuguuaugcugacuaaggguuuugagguuuuagagauaagguuucucuguguagcccugaauauccucaaacucaagaguauauuaauauauguguacaaacacacauucacacacacacaccacuaaaacuagaaacaguaauagaucuaauuauaacuauauguacaggaauguuuaguauuguacuauacaccaaauuugaaaacaaaaugaguuacugauauuaaugucaguaauaauaaucauuggauaaaauaaaaggauccuauuauaaaauaucauacaugagcgggauacgguggcccacaucuuuaaucccaccacuaugaaggcagagccaugaggaucccaaugaguucaaaggcagucuggucuacauagugaguuccaagacagucaagacuauagaagggaccuugugucaaaaaauaaauuagcuaaaaauuauacuacacaugguuuuaauaaacuuaaggcagcuauaugaaaaccucucaauaauaucaaaacaauucaauacaaugcuguuucucaaaacauauacuaggugccagguggugguaacgcacgccuuuaaucccggcacuuaggaagcaaaagcaggcaggucuuugaguucaaagccaaauuggucuacagaauaaguuccaggacagucaaggauacacagaaacccugucuugaaaaagcaaaaaaacaaaacaauaauaaguaaaaaauucacacacuuguaaauggagaaaaaauuuggauauuauauaaaaaauauacuagacauuaagccaaauccaaaaaauaaaaaucuccauuuaucucuuaucaaccuccugauucugaaaaacucauuucucuuucuuuucacaaguacuuuucgauuguuauaugaaucaaauaagagguuuaugaaaacccuuucaagauaacuugugcaaacugacuaaacugaguuaauaaauucaauggagacaguuuugaucacugucacacuccucaggccucuaucaggagccaccacuccuugugcucgguuccuugccaugcagcauuaucauccagcaaguauugaagaacaaagaacauguucucuugacucaaaacuuuccagugcuuauauuuucaaaacaacucauggaagguuauuucuaucaaguaucaggauguaugaggugcauuuccaggaaguaaagucauuuacacacacuaaagacuaauaagcaauauguucagcacauuuugaaagaauaaaaaauuauacccuauuuggagaacaaagaguggcauaacuagaaccaaaugacuuucuaggagagaauuguuggaagugguuuauauauucaaaaccaugaacaucaguccaguaggauggacugagaagaaaaaaggagaacaguaaguagaagggaauauaaagacauuacuacuaacaacccacaauuaauaccacaaucaccaucaauggauaguugugguugcucaagccaguaggauuugcugaaaaagacaggauaaucauaauuaaguucaaggcuagccuggacuacucaggagcuggaagaguuugcucauugguuaagaacauuuguucuugcaaagggcucagguuugauucccaguacacacauggaagcucaccucuuugggcaucaggcaaacaugugguacaaaacacucuuagacacaaaguaauaacaaaucuaaauuaaguaaauaaaaauaaaguaaaaauacaacaguucaauuauaaaaguaaagagaauggaggcaccuagaguccuaaaaagguaaaagcagaugggaacaccaucuaugauccaaguuccuuauacuuuaguuaauuuaaauauuuaacuuaucuuuuuguauuuucuuauaaaauucuaaaaggaagaaugaaagacacucaaauguguaaugauaauuuagguaaaguacaaacagcaaguaauauaaaaguagguaacucagccgggcgugguggcgcacgccuuuaaucccagcacucuagaagcaggcagauuucugaguucgaggccagccuggucuacaaaaugaguuccaggacagccagggcuauacagagaaacccugucucaaaaaaacaaaaaaaaaaguagguaacucucagaacaaagugguucaaagacgaaccacagaaaacacacuacagguuuaacaugcauagcuuuccaccuaccacuguuaggcacacuauuuucuaaagcaaaaaucacgagcaucuugcccuuguauuuugaacccucagucccuuccucuguuguauuuguuaaaucacuuagcauccaaauguaaugcuugcuuaaaaaugagagaaaccauaacaugacaugcaaagagcaaagcuuuaacauagcaagagguggguaugaauuucaauuacaccaguacggcuuaaaauaaagauuuuucccuauaaauuccaauccuuacauucaaaauuaacuuuauguaguucuacuuaaagacuauuuuuauucuuugacaaucuuaugcauauauguaauuuaucuugaucacauccaaccccaauucuccuucuacucccuucauauuuccagaacuucccuucccuccuucccauugcaugugcauggguaugggccauucaccuaagcaaggugaacuuaacagcaaauuaucaauguuaaaaaugaguaucuggccgggcgugguggcgcacgccuuuaaucccagugcucuggaggcaaaggcaggcggauuucugaguucaaagacauccuggucuacaaagugaguuccagggcuauacagagaaacccugucuugaaaaaccaaaaaccagcaguccuguuuuucuaacucuucacaauuuacuuucauguuuguuuacaagacagagucucacuauauaguccaaauuggccucaaacucaaaauccucuugucucaacuucccaagugcugacugcacagcuaaaguaguacaaccaugcucacaucuuagcauuuauucuguaaauguuuauuacuuauuuauuuagaggcaggaucacucuacauagcccuggcugucuugcaauuuacucuguagaacacagugaccuuaaacucauagagaucugucugccucugccucccaagaccuggaauuaaagauguaugcguuaucuugcccuacagaucuuugcauuuuaaagauuguaucugguuauaguuuuguaucugaucugagaaaugcaaaggguagcuugaaaagacuaagguucaucuuaccucucaaagaauaucuugacuaaaaaaaaaaaaaaaaaaaaaaaacuacacaugccuauucaaguaguacagagaccagguaucauaguggaaaucagaagcuaaauuauuaugcuaaggcaaucauguauaagcuugacaaguuacaaauucauagacaguggcuagucuagguagagaaaaaaaagauccggggccuaggaaacauguaaguggaugcucacagucagcuauuggauggaucacagggcccccaauagaggagcuagagaaaguacccaaggagcuaaagagggaucugcaacccuauagguagaacaacauuaugaacuaaccaguaccccggagcucuugacucuagcugcauauguaucaaaagucagccaucacuggaaagagaggcccauuggacuuacaaacuuuauaugccccaguacaggggaacgccagggccaaaaagcgggguuggguggguaggggaguggggggaggguaugggggacuuuugggauagcauuggaaauguaaaugaggaaaauaccuaauuaaaaaaaaagaugaaaaaugagaaacauacuaugaaagaaaaauaaugauaaaaauaagaccauugacuuauucaggugacaaauagagagaacaaggauuuguuuuacacuauauacaggaaaaaagcacacauuuuuaaugcagaaauagcauaugacccuagggugguggcauacaacuguaauccuagcacugcagagauaaaagcagaacugauacaacuugccagaccaacccguuuugcauaucaaguucuaggacagccagagcuaccacaaggagacucuuaaacaauacuaaaaauguuaacauuucaacuauucaauuacauuguuuuguuauuugcugguaggacuucagagauccuuccccccccccccgccccccaaagacaaggucucauagagcccaggccaagcuugaauuucuggccaaucugucuggaccucccuccucaguguuggaaucacucccgacuacagauaacauuuauaaaaacaaauacugugaguuugcuuuaccuuuccauuaaacucucacuaaccuggagcccuucuuaccuccccuuccaauuucuuccucuacucaauuccaguauuuaauuucauuacuccaacauuacuaaaauaaauauaacaaagaauauaaaaacccaucucacuuugcaaguuuuaucauacauauuugaauaaacuuacacauuuauaccuuuauauuuucuauauaccaaaaaauuuuuucauaagacauuauaugauugcuauuguauaugcucaccucagagagcggcacgauuaaagguguggcccuguugugaguaggugugucacuguggguaugggcuauaagacccucauccuagcugccuggaagccaguauucugcuagcagccuucagaugaagauguagaacucagguccuccucaaccaggccugccuggauacugucauguuccugucuugaugauaauggacugaaccucuaaaccuuuaagccaaacccaauuaaaauuuguccuuuauaagacuugccuuagucauggugucuguucacagcaguaaaaccucaacuaagacaaauggucaaaaggaaaaaaacugaagcccagucucuucucuuuuuuuuuuuuuuuuuuuuuuuuuuuuuugauuuuuuuaucccacagucucuucuuauaguccuuggugcucuggauucugauaugcagcccaggcuauccccaaacuugcaauacucuagaauacuacagggccgggcgugguggcgcacgccuuuaaucccagcacucuggaggcagaggcaggcggauuucugaguucaaggccagccuggucuacaaaaugaauucaggacagccagggcuauacagagaaacccugucucaaaaaaccuaaaaaaaaaaaaaagaaagccuaaaaaaauucuaggaauaugcuacuacucccacuuaagaggcugcaauucuauauaggccaagcaaaacauuaacugccuuuuuuuaaaaaauauuuauuuauuuauuauauguaagcacacuguagcuguuuucagacacuccagaagagggcaucaaauuuuuuguuacggaugguugcgagccaccaugugguugcugggauuugaacucaggaccuuuggaagagcaguuggcgcucuuaaccgcugagccaucucuccagccccauuaacugcuuuuaaccccauuaacugcuuuuaaaaguuauuuuucuuuaaagcaaauuuuguguguguguggggggggggggggggggcagguguugacucuuucuacuuguaaaccaagugaaugcagugccuccagaggccagaagaagguguuggaucuccuaagacugggauuaagaguauuauaaacugucaugugggugcuggggauugaacccagauccucuggaagcacagucaaagcucuaggucacuaagucaccaccacuucagccccuuaaaaguuaucucagcugggcuugguuggccagacuauucaucucggcuguucugaggacugaaggauuuuaagaauaaauucaaggggagcaugggccagagagaucucuccucaaaauaaaaauaauacaaagaggauuaggcauguagcucaauauugagaucuucccccugcaugcuuagaaaaggccguagauuuaaugccaguacacaucccuacaaaccccaaguucucuuaaugagcagaaauaaucacuuuuuagugggcugguuggagugguaauaaauaccuuuaaucccaacaccugggaaacagaagcaagguaaacuuaaggccagguuggucuauaaagugagaacgucuucucuaccuucccccaacaaaggauuuuaucaaaucauucuuuuugcccuauauuuuuaaaaaauaucugaacgauggagaaccucaaaguauuugauguuuguggcuaaucaacuguauguauauuugaaaguacuuaaaguuuuuauuagcauguguuugauuugcuuuacaauuaauuggugcauuuguaacucauccucccuuuucaaucaagagccucaaaaaacacaguaguuuacuuagacuuuuaagagcaacuuuugcugggcagugguggcgcaugccuuuaauccugucuccaaaaaauauauauauaauaauaauaauaauuuuugaguuugauuuaauaaauucaaacaaucucuuaagaugauauacaagauucagggggaaagugaggggcuguuucuugguccuucuguaauaauaaguauuuuacucaucagcuagcugggagguuugaccugcuacaguuuaccccuuccuccagcccccaaccccaugaggcuacuauacuguugcuaaaguuaauaaggauaccuaaagugguuugaauggcaguggaguaggauagguuucaaaagccuuaaggcaggcccccuguaagucuccgucucugccuauggaacaggauguacaugaagcucucaguaaccacuccagcaccauaccuuuuggacuguuuccuagccaugagugauaaugaauuagcccucugaagcuauaagcaaguucuuuuccuuuguaaacguuaccuugaucaugguugucucuucacaacaauagaacagaaacugucuuaaguuuuuaagcuugucuaauacccaguugucuccaacaccagaaaaaaacagcugugguaccaugcuuguuagggagauagaccaaaugaucaguucaaagccauccuccaacaaaaagggaagcgugagaccagcuugggaugaguacacaaagaucuugucucacaaaaaaaacuaaagaacagaacagaacagaagacaagacuuugugauuaggagaacuggcuccucuuccaguguacucagauucccagcacaagggugaaaaacagcucccaacagucugaaaucuaaaugauagaagaaaaaacugacuccuauacguuguccucugaucucuauacauauguaguagcacaaagcacaucaugcaaacacacaccauuaugauuuuuuucuaaaaaaaaaaaaaauuaaggcuuagggguuguucaagaauguuuaaaaagauguguguacuucuugaaagacaguucagcgguuaaaagcacuuguuccuagaaccuacauguggcuuaccuguaacucuaacuccaggggauccaacacccuuuuccugaccucuacuggcaccaaacuaacacauaguagugcauaaccuacauauguguagguaaaacauucaaaaaaauaaaucuaauauaaaaaaaacuuuaaaaaagauguaguaggauacaaucuauaaccccugaacuugguugaagaaaaaaaucugaaguucaaggucauccaugguuauauaaccaguucaaauauaggcaguguuauaugauuuccugucucaauaauggaaaaauaaguagcaauggauucugucauuuuguugcucuuauuuucuagguuuaucauaaagucauuuugguggcuaaagagauaaaucagucuguaaaguacuucauuuaugagcucaaggaccugaagaugagccccagugucuuagguuacuauugcuugaugaaacagcaugacaacuuggagaggaaaggguuuauucggcuuaugccucuacaucauuauuuaucauuuaaacaaagucaggacaggaacccaagcagagcagguacuuggaggcaggaggugaauagaggccauggagggguguuguuuacuagccugcuaagacugcuuuuuuuuauagaauccaguacuuaagaagguuuuuuuuucccuuaauagaggcucucuccucuucacuguccuaagcuugugucaaauugacauaaacuagccugcacauccagcacccauguaaaaugccagauauuaaggcugagggcauaaaagcauaaggauuccugggauucacugggcagcugcuuuggcauuaucaguaagcugcaggccaggugagugagcugugcaccaucaccaaggaggagaaagguguuucuaaggaagauacccaauauuauuguuugccuuccacauguacacacacacaccaauauaaacacauacaaaaaaauuacaaaaauaaaaaauuuauuuaauuuuuuguaacauuaaugugaaaaaauucuggggcuagacagaugauccaacauuaagaguacuggcugcucuuccagcaggccuuaguuugacucccagcacacacauggcaguucacaacugucuagaacuccaauccccaaggacccaauacccucuucugaccucccaaguaccaggcacacacagggugcacagauauaaugcauuccuacacauauuauaagcaagcaaauaauuuaaauguggaaaauaccagaguagucuacagaugagaaauuuauuauagauuauaaauggauugguaccguagaaaauaucuaaaaguuaugcauacuagugcuugccuauaaucccugcaaucaggauuaucaacaaaauaaaauuuaaaaugaaaacacagaaacacuaaaaaauuagcuuauuucuuauuaauaugugucacaguccuuagugcuaagggcugaacuucccacaaacuagauuuuuuuuuuaguuuguuguauuauacuuagaacucuuuucaggcuuuuauuugagaaaaagucucaauauguagcucaagccgaccucaaacuucagauucugucuucagccuggcaaaauacuggaauuccacauuuaggccaccacaccagauuuaggacacaguuucaacuguguuuccuauuaaaaaugacaaagaugcuuccuauuccaugugucuugauacuuuuaugcuuaggagauaucuuuaauuucacuuaaaaaauaaaaaaacacucauuugggcaucuguggucgggguacucacugcuuaugaaaaguaaucuggaaaucuuuucuucauuccagauauuucuggcaaaugagaaauaaaaccagggucaagauuuauccccuaacaauuccccaucagcaaguguaucugugaagggaaguuacucauaauuucaaucaaucaaauuauaaaguuaaaagaucuaugccauuuaaaaauaaaggauaggggacagugacccugugagaacaugccccuggcaaaauauuucuuucaucccucuccagaagagaagagaaaauaagaaaaagcaccuaauacagagccccaacuccuacuucguauguauaaaaugcccaaaaugcuauaaaaucacccaucuuuagccauguacaaacaauaguccuguguacuaguugauccacugucuucucugucagucuacagacagaaaaggcuuuaccaauaacuucauuuuucuggcacacuauuaauaaaacaauaaauaaccacauacuguuccagaaaggacaucgugggggcaacaguugagaagguggcucuugcauacucugucaucgcugaauuugauucguugacgaguaguaucuccuguaauauagaaaaguuaauaauauucaagguuagacaacuagacaauauuuauuuuuuuaaaguccuaguuauuacuagcuuuuggugugugacuaucuauauacacacacuuauaaaucaacccaggagggauuaguuucuuauaaaccacccuauagaaaaacuauuuuagacagcaugcaguugcagucuauguacugcaaauguaauucaaauaaauagucaaagugggaaagcaaagcauucuguuaaauaacaguacuucagaaaagcauaagauuuuagagcaggaauggacuuuauugguuaucaaguccaacuccuucacauugcagaucagaaaaaugaggccccacgagguuaagcaacuugcagaagacccaccaagaguuucuacugguauacaauggucucuucuugacaguaagcacuaauuuauuuuguaauuauuuacauuaauugaaaaacauaaaaguaaucuugcaaacauugcauacacacugcgaauccccacugaaccccagacgccauuucuuccacuacuuuguuccagcugaagugucucccuuuugcugcugggaggaguuagaggguagaauaagguguuuaagagcguacaaaccuggaagaaggacuuauacaccagucaaacaaaggcacauugccuaaaugaaaugcuaacuuuuaauaccuccaaagauuccauacuuccaaguuuuauguggucuguucuauauugacaaaccaggcaaaauaaaauacauuuugugcucauauuaaaagaaaagaaaacccacacaacuccuaagcaacagaagcaaccaaccugcuuaucaaauacagcuauuuacucaaaaguuuaaagacucuagagaaaggaaagguagcuaacuagaguaacaaaauacaaauguuaguuacaauuuuuuuuuuuuugcuuagaauuucugaagaaauaaaagaaaaacucacaaggguaguuuccucuaugcagaauggugugcccuaaaaaauguaguuuagccuuaaauugguaucacuguuaaaggaaaaccuacugaugaauuacugaagcaaaaaacaacugaaacaaaccaaaggagauuguaaaaacuucugcaguucacauaccuagaacacuccaaacauuucaacuaggaaguaauucuuaaauuaaguucuacauuuucacaugugaauaacaaacaaacaaaaauuccaacuuuaccccuugcaagucgucuuauauuguagaguuuaacuuaauccaacuaaacaccgugggguaagauuuuguucaaauuguuuuaacuugauuaagaagauuuaaagaacauucuaauuugcaacuaggacacauacauuuuuaagauaauauuccuaaaaucauagcuucagagcaguucaacaauagguuuucugaggcuagucucuaguagguuauuugugacacaauuuggaauaauccauuuaauguucaagccugcuacuauaauauaggauacuuugguggucuuuuacuuccuuuuaaacacaacugcuucuguuccacauucauuaacacaucugaaaaguuagugauaacucacggcucggcgaaugcggggccuuucugaaacucccuugcagauugaaguaggcaggcauagauacauugaaccuuuacaaauaaaacaaggggccagauuguucaguuuguauagaauagacucugccagcaauuucaauacagcaccuagaaguacauguugacuguaaagauucuugcauauaaaaacaaaagugaacaaaaucagagugcucggguuuuuguuuuguuuguguuuuuuuuuauuuugauuuuguuuuuguuuuuuuuuuuaacaauacugauuuaacaaguauaagcccagagaaaauugugacuggagauaacaaaagcccaagacuggagcucuaaaaguggcccuuagacuagguaagaaauauuucuuuaaaauauguuucaaugaagacuagugagugccucaaguucuuaucagaaccaaacuaucacaagcucacaccagaaagcaaaaaauacaguagaagcuuuuugaccacagaaagacuucaaaacaugauuaugugaagaacuuuaaaagugauaaauuuuuagggguuaaggggcacuuacaaauuucguacuggcccuauuacaaaugaucuaagcuuuuugguaaugaagcagcagugucaguucaaucaauuacaaaacauagcucaugggaauaaggauuauauuuaacggaggucuuagaauaaaguuaauauuuauggaaguuuuaauaaucaaacaucaaugcuuaaaaaaaucacauuaaauauaagguauacaugcccugaugauauuaucagauaaagcauuaauaauuacaaauauagaauaaccuuggugagcuuuaaaauaaugaaggaaucuauaucuauaaaugccaaaaaaaaucaccuaaaguaccucacuuauagguauuccauaaacauuuauuugaaaacuauagcaaaaauaucaaauauagcuuucagauauuagccauuauaaaaaucuuuuuaacaaaauaauaaaacuaacaguacaagauauaacaaugagggacuugcaagugaaugucuauugauacuucagguucuauuuagggagacuuuaugcuuacgcauuuuuaaaacaauuuggcuacaaaauuacaaaaucauucagcauuugaauaaauuugggcuuaugacauuaaguauaauuuaacuacauacuucugaaacagaaauguuuguaauuuuuauuucugucaugguaucuggcccaaaccauguuuuucaaaagaaacaagguaaauaguauccuuaaauggggggagaaaaaaaagagacuggaaauaggcagugaauauauauaaaauauccuuauaauguaggauuuuaucaaacaugcuuuauguguauuuccuugucacugagucauacccaaaaaaaaaaaaaaaucugaguuaaucccccuaauaaauucucaaauguuugaaagaacuaauaaugggagaaacugccccgucaaugauaauagaucuuaaucauagaauaaaaccuauuagugacuccauccucugugcuacaaaauggaauaacaaauauuuugcuccuaaggagcugaauuaucauuagagauguaagacauauaaauaacaauaauauaaaauaguauauacuccaagugccaaagagauauuuugaacuaucaucaaaagguuggagaaacuaggaaaggcuucauggaauaagcagaagccaaaaucugaacacuacauacaagacuuuaagaggaaaaauaagcauuccauaccagaauauuaucuuugacaaauuuuacaaacgcuucaagguuuggggaacaguaaguaaacuauagucagcuuugguacacggcugaguacaucuggaaauacacuaauuagagccaaagauacaauuuuuggagggugaaauuuggugucuuaaacucuuucuucaaucuguauucauuguguauauaugaacuuuuaaggaauuuucuaaaugaggcagcaauuagaucaaguugaaucaaaaacaaauuaucuuaccuauaaaagcagguuucucugucacaaaaaucaauuaaacuuuauauauaaugacaauggcaaggucuuuuuguuuguuuguuuguuuguuuuucgagacaggguuucucuguauagcccuggcuguccuggaacucacuuuuguagaccaggcuggccucgaacucagaaauccgucugccucugccuccagagugcugggauuaaaggcgugcaccaccacggccgccuaagcaagguuuuugaauaagguauuaaaccuuauuuaucuauuuauuaaauaauguuuuuaaagauuuguuuaugagugcucuaucuguauguacaccuauauaccauaaugguugaaagccaccaugugguugcugggaacagaacucaggaccucuggaagagcacacaguguucuuaaccucugagucaucucucuagcccaaccuuuuuuauuuuugaggcagggucucauguagcucgagcugcccaugaacucucucugacucugaugcuccuguucuacacaagugcugagauuacacacaugccugcaccuccaggucuaaugaggaaucugcuuuagaauuuuggguggccacaaguuuuucauuugaauagaagcacaaaaaguucuauuaaucauguccauuaaacaacuaacuaugaaauuguaaugaauuacaauuucauugccuuuuucuuguucaauccgcucuugggugucauaaacaguucagaacacuuguguauaaaguauacaauaaaagcugaaaugaauaccacauaacucucuaguaacugaaccuaagguggcacuaagacaucagucucacucugggauauggacuggccuccucuaaaaccaggauuccuacucaaacuguacucaauacugcuaucaaaauucccuucaauuugcugugaaggaaaaagaggcccauugcaauacccaauauguaauuaugauccuacuaccugauauaaauuguauuaguagcacauaaaaccuuggccuaagugguaucugacauuguacacaaugcaugcuauuuucccaaaauccacgcccgcucccccucccccucaauauuucccacccucucccuucccuuacaaacaauaaaccaaaucaacuuuuauaaauucaggugcuauuuuaaaaacaucaaaauuuuacuuuacccauucucuccgaugcucccuguauuuuuuuaagaugugaguggaugaccaugcuaugugaucaacaacugugaaguuagcaaaagugaacugaguuuaguauuguaauuucaaaagaaccuuaaaguuuguaauauuugacauauuuaaugguaggcagaauccuaucuuacuguauuacaucaggcauuaauggcaagcaauuuauaaaagcagucaauauuucuuuguacagauuuagcucagagcucagcuuugaaaucaaaagugagcaagaaauacaucaacauacaaagcaacggauguauccugugucuauaaaugaaggcagaggcagggacagggaagcucucccacaauugcuagugugacaaagugucuaccaccaaccaccaucuguagauguuucuaggaccuuuugucacucaguugacuugagacacagcaggucccuucccucugaauaagauccacaccccuucaaugaacuaaagcuagagcuagaaaaaacaaccaaccaguagcgucuuguuuaccuaaccucucucuugagucccugaguacagaggaagcauuauaaccuuuccuuccaauauaaaucacacuuccacauaauaguguagaaauuacauaaaaaucuaucguuuucuagucuacugcagggcaagaaaucauuuaagaugugcaaaauuaaacccaugucuucacaugagccaaggugacuccuggagucaaucugaucauccuuauauaauccuccuugcaccuuaccugugucaccuaucuuuacaaguuuuucaacauuuaucuauagaaaucuuuuuggcaacuaguuuuuccuugagacagagaagcuggcuaagugucucaaacuucagcucaagauccuucugccucagucucuccaagagcugaaacuauagguguacaccacacccagcuuguaauuacuuuugcuuuuauauguaugaguuuugucugcagguauguaugugaaucacacuugugccuggugcucuaaagugagaagagggcagagaaugcucuuaaccacugagccaucucucuagcccuuguaguuacucuuuaaaauacuuauuucccucuucaugcuaccuuaauaaguguauccuguuugaccuacuguauauguaagcaauuuaaaguguauuuuauaagaaaacaauauuuuaauauaaucaaagauccuuugagacuacuuaauauaguuaauauaguugguacuuuuauaagauguuccuuucugaauggaagaagucacgcugagcaguagcagcagcucucucuucaggaaaugugaacauaagacuacuauacaguuuagaaauggcaguauuucuuuauaguccauuaauauagucuuauacguuaauaaucacuaauagcuacuaguguaauuccaaccauaauccucuugacaaguuuaaagagaacaaugguuauuauagggaaaaaaacuuccaagguaaauauggggacggggagagcuauggguuagaaacauaguaugcagcccuggcugcucucaaacucacaauccuucugccucaguccuccaaguacuggaauuacaagcauauaucaacaccuagcuaguaaugucaguguuauugaguauaaucaaagacuuuugauauuuuacaaacuuuuaaaauccaaaaucacuuauguaugaaaaccauguaacaaaauuauauaaaaacaaugaaguuggagaaaaggcaacuauaagaugcuaacagaauagcaauaaugaaaauguaagagcgaagauucuaaagaaacugcauuacaaggcugugcuccaaacaugucuucucucacuacacaagcaaagggucuugacaaacagcaaaaaugugugccauuauauucuuuuggacaacuucaggaguuuuuuuuauaaacauacuucuggaacuuaaagagagauauuacaaaaaccuaaaguguugacuuagaauuggaaaaguaaguuaauacaaaacuaggcacagugccucaugccuguagccucagaauuugggagacggaggcaggacugccaguaagcuugaagccagugagugguacuacauagugaguucuagaccagacuaaggagcuauagaguaagacuuugacucaaaauauuuuuaauaagcuuauacggaauuuagcaugcaugccgaaaguuacagccugcuaaauuuuauucugacacaaaguugcaguucaauucugauacaguaacaccuauacucugguuaucuggugccuucuauccagaguuuuccuacauacaaaauuagaaacaauggaagcuauguuuuuuucuuauucuuuuaauucuucuucuuuugagaugugguaucucacuauguagaucagguuagcuagaacuuaggauucuucugccucagcuucucaagcuacaucuacaucuacauuaaaggcuaucuuaagaaauagcugaaaagaaccaaagaugauacaauuagcugauuuguucacuaaaaagacucccagaggugggugugguagggcucaccucuaauacaagcauuccugaagcuguuccaggcuaucagggcauagugaaacccugucccauaaaauaaguccccaauuguucaaaauaacuauaaacaucaaggaaaacauccccaaucaaaauucaacaaaggaaaggaaaaacaaaaaacaaaaaaacaaaagagagcacuagggacaacuuaaggacaagcuaaaaugaaaaacacaccucagaaaggggauguaagccuuaaagcuacaaaacaguacagcagagaaacuguaguauugaauauacucacauucucaagagcugccucuggggacucugccauucacuuuaaaauaugagcaaaauauacaagguacuacuuguucauucauauaguuguuuuguuuucaaaaucagauaauuauaaucaguauaaaagaaugugucacuuaaacauaaguguuaauuuguaaauauuuacauauuaguuuuuuuugucuaucugggauuauugguagcucauaccugugaucuaagcacucagaagacagaggcaggagaucaccuaaaauuaaggccaguuugggcaagacagacaaagagaugaagcaaacacacaccaaauuucuaagaaaaauaacaacucgggagauagaggcaggcaggucuuugugaauuugagacgagguucaucuauauagggauuuccgggucagccaggacuacauggagagccuauuugaggggggugggaggguggauggguggagggagagggacagaaaauaugaauugggggaugccaaggaaaguaguugaaauucuacugcuaucaauuaauuacacccuaaaguaugucaaccaacaauucaauuagaauugugagcugagagugguggcgcacgucuuuaaucccaggauuuaggaggcagaggcagguggauuucugaguucaaggccagccuggucuacagagugaguuccaggacagccaaggcuacacagagaaacccugucucgaaaaacuaaacaacaacauguuacuacugugggggaauagcccaacgguuaaaggaacuuagguacuccugcaggugaccuaggcuggauuaucaccacccacaucagaauagucauccgcugucuguggcuccacuccaggggccucuuucugccuucuucuggcacuacacacacggugcacauauacacaaguaggcacacacacaaauuuaaaaacaaaaaaacaagacaaagcaccacuguagucaaauacuccuucuaauacuacaaguuaaauugugacauaaauucccuauacuauuaauaguuucuagagucuaagauaaaacauguuuccuagaaaguauaucccucucuguuccauaaaucacaaucauguucucaggguuucuacugcugcauucucauuucacauugccacuguguuugugacauccugcaaaacuaacacuaaaggaaaaaugagaaaccaagauaaauaaaguaauuucauucugcaggucuagaugaucucccaagagaugaccaagaacucucuacuucacaaguuuugugguuucugguuagucauuucuauucauaagcauggauauacacuggauauagacuggcaauuaauuuuacaucuuauaugaaaaccuagaacaguauuuuccaaaauaugaaacuggcacagaugauucgggauaucauucaauuucauaaaaaacauauuuaccacacaguaagaaacauuaacucggggcuggugagauggcucagugguuaagagcaccgacugcucuuccagagguccugaguucaaaucccagcaaccacaugguggcucacaaccauccguaacaaaaaucugaugcccucuucuggagugucugaagauagcuacaguguacacacauauaauaaauaaauuaauuaaaaaaaaaaaaccggaauguuauaaaaaaaaaaaaaaaaaaaaaaaaccauuaacucaagaaagaaguuucuucuuggcaauguuaucuauuuaauauugaccugacaaacuaacuuuaagcauauggaauuuuaagugacaaguguauaagcugggcaugguaguguacccccucgauccuagcacuugagaaguagagguugacagaucucuguuuugaggccagccuguucuacauucaaaguucuaggcuagccagggcuacauugugacacccugucuaaaaagaaaaaagaaaagaaagaaagaaaaaggaaucuaguucuauuagcaugccuuucuauuuguacuuauuuuuauggcaauacaaaugucuuuuuaaaauuaauuuaagcacaaaccuauaaugccaacuccuuguagaagcaggaccacaacuucaaaaucugccuagagcuacagaggaugauaaaaagccagccuaguacauacacugaaagccagucuaaaauaccaagugcuguaauguagcacaagugcuuuucuaccuuuguagaagaucacagguccaauacucaguauuaccccaccaaaagcuugugcacauacacacacaaaauuaaaauuuuuagaagguuacuugacaaaaaauauuaagucagguaaugguggugcacaucuucaacuccagcacucaggaggcagagaaagguagaucuuuggaguuuaaggccaauuuggucuacagagcaaauuucaggacagccagggcuacacaaaaaagcccugucuuaaaaaaaaaaaucaaaaaguauuaauaggaaacaauaaaacaaacaaacaaaacccaguaaggguggggaaacauuuaucuacaacaagguuucuugaauuuucaaugugcaucaaaaccaagauccaagcaaggugccgaaugccuuuaaucucagcacuaaggaacaggaagagucggaucucagguccagauacaguuaacauaagauccaauaccauacagauucacucucaaaagacaaaaaaaaaaaaaaaaacucaaauaaauaaauaaaggcucuuacucucuucucuucuccucuuacuccuguuuccuuauuuucuuccccgucucucuccaaaugcucauagccagccucucugccuuucugucucuaauacuccuaaaacuccccuccucgugcccuaaauaaacuauucuauacauaaggaaggaaggaaggaaggaaggaaggaaggaaggaaggaaggaauuaacaagacuuucuuaaaccuaauuguugguuugcaucucaagaauaagcauuugacuacaggaaugccgcuguugcuagucugggacacacuguuacccagaacaguagccaacaaauuuuguuuuguauggggggggggggggggaagaccuuagaguuugagacaaucucauucuguagcccagcuggccucaaacacagaaacucuccugccucagccacucacuaggcagaauugcagguaugagccacuaccuggccaaauaaguguuuguuuauagaguguuuugucuagcaugcaugaaagccuaagucugauacccaguaaacaaaguuagaugagauagcccaugccuguaacucuagcaaucaagacaaucaggaagaucagaaguucaaggucauccugggauacaggaauuucuacuuuguauuucuaaaaauaaauuuauaaaaacgaaaccuuuauuuaaaacaucuucaagcacuaacugcaaagggcauaauauauagacagcagaacagaauauaacacagaacuugguacaguauguauccuccauaaauauccccccucccuaacugaaaaacaaaacuuuggauaguuuaacucuuaaaauauaaaauugaggccuacagaaaucugaggucucaagaaaauaaaaauaaacaauuuaccauauucuugagacaggauaaaagagucagcaagggcagcugguuaaauucuuuucacguugagucaaauaggucaaacaucaguuguacaugguucacaacuaaauuaaaacauaugggucaauagaguguuuucuacaaaaaaaaaaauaaguuaaguucucucuuuggccaguguuaagaaacaagaugugacauuuacucaauugacugaacuacauguuacuuucugaugccuuugacuuguuaaguuauucagcaaaaaacaaaaauaugauguaaacuuuauauauguguauacauauauauguauaaauaaauaaauaaaacgaauauacuguagcuaucuucagacacaccagaagagggcaucagaccccauuacagaugguugugagccaccaugugguugcugggaauugaacucucaggaccucuggaagagcagucagugcucuuaaccacugagcuaucucuccagccccauaaauguuuacuucuuuaaaaacuacuucccucuaugcccucaacaauccuacaaaauugauaaaucuauuuucuaucuuaaccuugccuuuccauuucuacccaagcagcugcuaguaaaugaucauuuaaacuccaaagaucaagaguagaacaauggugcaugccuauuaucccagcaacuugggaaauuaagguuagaaaauugcuugaggggcuggugagauggcucaggggguaagagcacccgacugcucuuccaaagguccaaaguucaaaucccagcaaccacaugguggcucacaaccaccuguaacagagaucugaugcccuugaagacagcuacaauguacuuacauauaauaaauaaauaaaucuuuaaaaaaaaaaaagaaagaaaauugcuugaggcaggaguuccaagacaagcauaaaacaguuggaacaauuaacuucauugcuaaagugcuuugcuuggacuguaguuugauccuuagaacccauguuuuuaaaaaaaaaaguuauccacagugguacacauuuguaauucuagccugcauggacagacacagauagauuccaggucacuggucaggggaacaauaccagaaacuguucucuuaccucuacacauacauaccugcaugcacacucaugcauagacccacacccacccauacccaaaaaggaacagacugguuuuuugggugcuaaagcuguuaagauuccucucagaaacuuacccugguucacucccucauuuuuuucuccaauaugaugauccaacuucuuucgucuucuuagucuacaauuucuucaaagacugauuaggguggauaggccuguuuauauuuccucaaaaguagcaguucugaacugcuucacacaucuuuuuuuuuuccguugaaaccuacauugaccucaaaacgcaucaucuuccagcuucagccucccaaaugguagaaugcuaggauuacaaauauaauccuuccauguuugcaauuucacuuuuugcuuguuugagcccaacccagucuagaauucuagguacuccugcuuaagucucucaaugggauuacaaguacgugucaccaugcccagcuagaagcucauuaagaagcagcuaacucauuuuuucuauucuuaccacacucacugaccuuuauuuagugcucagcccauugcuuaucugaacccuaagcaacuuuaacuuucacugucuauaagaagcacauuacugaacaaugaaccugagcaugaccauaacaucuacuugcuuuugaaguccccauccugcacacauuuuauccuuaguugacauccuacuuuaacuagaaacauacuucccacuuacauuacuuacacauacacaaaaaauaauuuaucuucuguucuauuuuuuuuuaccugaaauacugucucaaaaacauaggcuuacuugaggagugcuaaacaacugcagagauuccaagauaacaggguucuaugaggugagauuuuuauuguuuucugggcugcucuguagacagaaauauuauuuagaauucaaaauacaaagugagggggaaacuuuaacugauucacuauucaagugcuaacaagaguuuuucaauguuguggaagaugccugaacacugacaaaaaucaaaugguuacagacauacaugaaaacuguuuggccuuauauguacaugcucuagacuaagaaauaucccauuuuaauguauuuuuauaaaauguauucucaugcauuuaaggcuauaccucuuuuacuuaaaaugaaaugagccaaguauaauaaauggauggcuuacaacugaccaagauauaaguguaauucauuaagaugagaacaaaauuaagagaauaugugucaaugacaagucaagaaacacaaguuacaauaaaggugauuuuacaaaaagauaaacccacagaagaaaaacacuacuggaaaucuuugauucaauaauuuugcaguaauguucuauacaaauguagauguauuagcuagguauuucuaacuuguacuaagaauagguacauuacuuucugaacugcauuuuccaagguuacuaccuaaaauacuuuuccuucaauuuuauguuaucacacacuacacaacuggguagcaguuaagauuaauauccuguauuaaaaacugaggaaguauccuauagcucauuaaaauuacuauucuaaauagcuaaaacuaucuaaaaauuuuuauguauguuuuuggggucuuguugauuuggcuuuugagauggugucucauguugccuaaaguagccucauuaacuauguagcugagugugggacacuccugauccucuugccucuacagccaaaugcuaggaucagaggaaagcccuauauacaacaauuaugaucuacuacuccaggaacauugacugacaucccugucaggguacagagccauuaaggagcuuuuugucacucaggaguuagaaggaaggguugugguacugaagauuguacaggucacugcacaugcuaagaaagcgcuccaccgcuuagauacauccccagcuguagguagcuugucugcucaaagcuacucaguaucauggauaccauacaauuuuauuucuacgaucuacacuuugggucuauaggucggcuucgaaggcacauuugaagauacacuaucacuccuauuuuauuuuaaccuuucagaaaugguuugugcucccauaaaaacaauuuuaagggcuggcaagauggcucagcggguaagagcacugacugcucugaagguccugaguucaaaucccagcaaccacauuguggcucacaaccaccuguaaugagaucugacacccccuucuggugcaucugaagacagcuacaguguacuuaaguaaaauaauaaauaaaucuuaaaaaaaaaaaagaaacaaacaaacaaaacaauuuaaaaagcauaguagccuuagaacaaccuucuaaacgucaaacuucaaauuuuaggauguaaucuagguccugguccuaggccuaaggguuuagugguucagagcucccuagcacacgaaaagccuggaguuugaucccuauuacuggggaggugguggugguguuccaguccaccucaauuuuguuuaauucacuuuaguuguaccuuccuaagucuuucuggaaucucagccagauauucauacccaaacuacgugcccacagaggauuuaugccaagggacauucuuacaauuaauccaaucuagucaaaauaaccacuauccaucugagggcacuacagugcuuucucucaacuaucacaaaaacaaauaaaauguuucuuaaaauuuccuguguuacuguuaccaucuggaauaugcucagggaaaacaaauuaauuaccucucucuuuucuaaggcaaaaaauuucuuaaauguaauuaauuuuaaaauacuaguaaugauaucuacuugcaacuuuuuuuccuaagaaaaacuaauuauauuuauuuaauauuuuuaguauaacauagaaaauuauuuggcuucccauauaacaaauuacagauuuaauuugaggcaaaaagguuaugugacuuacccaagcuucuaauuagaaaccaggucuccugagucucagcccaauguucuuuuccuaaacuuauaucuuauuagaaaauuccaaauauagacagaccccccaguuacauggguuugaguuacacugauucacauauacaaacuuuauauagugugaccaauguuucaacucacgcgguacccugcuuccauuuaugcaguaugccaggcaucggcacgauuuucaguggcacacaggcgguugccaccaccagggcccuaggcaaaauugcaaagaaggcaaaguuugucuuuggcccucccaucucccuuaugcauuucucucccaccuccugauuauccucccaaugcccaaccucccaaugccaccaagcugcccuucugacuguccaaagcaacccccacacacaucauggacuauccuuuccugaagugcccaguaauccaaguugucuauuuuacuaccaccacaaugccuauuccuaaggauucuagugagauuuaagucacuuaagugauuagcugauuuaaguaaucgaugauacacuuaaccaacagauuuaagucuccaaguaauuuaaaaaggaauuaaaagcucuuuucagaaaaguguggguggggaauauuaggaaagggggagcaacaucuucccagagucccagauuccuuuacuguuccagauuccuucacaaauaugauacuguuaaggggauaaaugccaucuaaagcaccacuauccaaaagucuuggcuguuuuauaguugucugcaaggauaaacaaaaaacaaagcuacuuuaaauacccacccuuaccuaccuuuuccaucucucccccacuuucuggguucccaauuccaccucuuaaagccaaacacacaguauuuuugguaagcugucccauguguauaacacgagguuuuccauuaugugguccaaaugacauggugcuucucagugauguaccuaugucccuuauccuugucuaauuuuguuuaugguacacaaaaaaagguaauucugauuuuauuucaagguccucaauuaaaauuucauuaaauaacaaggaaauguacuauguuaugucaaauauaugaaagaacuaauacgguaccuuaaaaaagcuuucuuuuuguuuucuugagcuaugggaucucacugcacuacaccugacuaacauucacuccuuuuuuucccacuuuuccauaaaaguaguucuuuucuaauguuuuugcuugaggcagggucuugccuuaacucaggcuagccuggaacuauguaaccuaggguagccuugaacucacugaaauucuccugccuuagcguucuacaaaggcaaaauugaugcuucuucugaaucaauacagcacugaaaaucaaaucacuucaaccaaauacuauuguuuacucauaaauauguguuuauuuuuaaguucaauaggucugaaggauuaaaaaauauucagggacagacacaggaauauaaauuuaaguaaaaaaauaauuaaacuuuaagaauccagcuucauucugggacuacaaagagaaauuuacagauauacuacauauuuaacaguucaguuuuguaauacuagaggggggcugcuaucagaaaauugucagccgggcaugccuuuaaucccagcacuugggaggcagaggcaagaggauuucugaguuccaggccagccuggucuacagagugaguuccaggucagccaggacuacacagggaaaaaaaaaagaaaaguaaauugucaggucauaguuaccuugauccaacuaaccucccaguaaaauacauaaggaaauccuaucuaugcagaaguuaccaauaauggcaucaauucauauuuaaagauuacauaagguaagccuuuaagauuucuaaaauguuauuacaaauauugaacuguuaaguuccuguaugaagccccuucuaaauauccucacuuaugauggagaaggaagaaaguuaagacaugcugcaauuauaaacauucuuacccaagcaugaaagguuagguuauuccagugguguuuuuaauuacuuaacuuucaagggauuacuuacuacucacaaauaaaucuuauuuucuuuccauuuuuucccuccucucuauacaauaaaucuguuauccaccuguaucuaucuuuaagaaaaauuuccaguggguuuuuauuaggacuuaaccuuacacugaaagcuguauuaaguauugcuaaaaaagauuugaaauagguucuaucuucucccauauuuuccgcaaagaacucaagaaaauucaacaggauuuacaauuaagcuaaauuuauguacgucuuuucuuguaagccaaacuuguccaaaaaaaaaaaaaaaaaaaaaaaaaaagcauuuaaaucgcuaaaaaacuugccuaaacgaguuuuuacaagucaggauuuggacuuguuuuuuuuuuuuuuuaagaaagugcugaacuuuaauuugaaaguacauuguuaauuaucccccaaaagcaacauuucaucauuuuuagaaacaaacacguaaauaacucuuucuaaggauucuaaucuaacuguauuuuuaaaagcccuuuccuucaauucuaauucagugggcaucaaauauccaaaaugauucuguuuucagcacagguaaaauuugccaauauuuacugaagucucuaauacguggucuaacaaaauggaggucucucggugggaaaaaaaaauaggccuaaacacuucuacaaaauggggccaaacacacccacuuuaagaaaccaugguuugggucagauuuuccacacacacgaaaaaaaaaaguugauucuguaagggcucgacgaagcgucccuggaacuggggguuaguagugguuucguuaagaccagggagggaggggauguuucucuccacacucuagaggacggcggcgaggggugauccgaaagcccagaggaaaggagcuggagcuggggguggagaccugagcgccccgccggucccugaucaauagucaaacugaccgccccacuacuccaagacagacuugggcucucccaaccccgccaagucaacagcaaaaggcacaaacuccccuuucugcucccaggccccgccucgccgcauuggcagcaguucccgccaauccgcacggucaccgcccccaagaccgccugccaagcccugauuggacuggaagagagacgggggggaccucgcgcuaccaaucugggaaccccuuacucggccgcacgcgcgcgcccaagugcucccucggaggccucccccuccccaggcacggccccucccccacccccagggcucuggcagcgacuuaccgucccgagaggugcccauuaacugguccagcauagcgcgcaucugggccugcgccgacauggcggcggcguagcgggcgggcggucgggcgggcaggcaggcggggguggggcaccggccgggcccuggcgggcgggggacgaggggaaggggugggggaggugcggcgcugucucgguggccgccgcggccucgaggcccgcgaguagggagucggaggggucguggagaguccgggcugcgcuccucacgacggcgugaacgcggaaaauggcagccccccuagagagugagcccuggugcccucacucuccguccgguuccugagacagacgcgacacaggcuaagccgacucucgccuccucccgacaccaacacccgccagaagccgucaacccccccccccagcaagcgagcucugacgcggcucgcagccgccgcgacgggagcgcgcacgcagcucgcgccuagucguuucccguggggguucggccaaucgccauccacgucgcugcgcuccgcccugccccuccuacgaagggucccacccuaacggcucccgagcgcguucacg

SEQ ID NO: 2920 - RNA, 6519 nt, Mus musculus
uuaugguuucucucauuuuuaagcaagcauuacauuuggaugcuaagugauuuaacaaauacaacagaggaagggacugaggguucaaaauacaagggcaagaugcucgugauuuuugcuuuagaaaauagugugccuaacagugguagguggaaagcuaugcauguuaaaccuguaguguguuuucugugguucgucuuugaaccacuuuguucugagaguuaccuacuuuuuuuuuuguuuuuuugagacaggguuucucuguauagcccuggcuguccuggaacucauuuuguagaccaggcuggccucgaacucagaaaucugccugcuucuagagugcugggauuaaaggcgugcgccaccacgcccggcugaguuaccuacuuuuauauuacuugcuguuuguacuuuaccuaaauuaucauuacacauuugagugucuuucauucuuccuuuuagaauuuuauaagaaaauacaaaaagauaaguuaaauauuuaaauuaacuaaaguauaaggaacuuggaucauagaugguguucccaucugcuuuuaccuuuuuaggacucuaggugccuccauucucuuuacuuuuauaauugaacuguuguauuuuuacuuuauuuuuauuuacuuaauuuagauuuguuauuacuuugugucuaagaguguuuuguaccacauguuugccugaugcccaaagaggugagcuuccauguguguacugggaaucaaaccugagcccuuugcaagaacaaauguucuuaaccaaugagcaaacucuuccagcuccugaguaguccaggcuagccuugaacuuaauuaugauuauccugucuuuuucagcaaauccuacuggcuugagcaaccacaacuauccauugauggugauugugguauuaauuguggguuguuaguaguaaugucuuuauauucccuucuacuuacuguucuccuuuuuucuucucaguccauccuacuggacugauguucaugguuuugaauauauaaaccacuuccaacaauucucuccuagaaagucauuugguucuaguuaugccacucuuuguucuccaaauaggguauaauuuuuuauucuuucaaaaugugcugaacauauugcuuauuagucuuuaguguguguaaaugacuuuacuuccuggaaaugcaccucauacauccugauacuugauagaaauaaccuuccaugaguuguuuugaaaauauaagcacuggaaaguuuugagucaagagaacauguucuuuguucuucaauacuugcuggaugauaaugcugcauggcaaggaaccgagcacaaggagugguggcuccugauagaggccugaggagugugacagugaucaaaacugucuccauugaauuuauuaacucaguuuagucaguuugcacaaguuaucuugaaaggguuuucauaaaccucuuauuugauucauauaacaaucgaaaaguacuugugaaaagaaagagaaaugaguuuuucagaaucaggagguugauaagagauaaauggagauuuuuauuuuuuggauuuggcuuaaugucuaguauauuuuuuauauaauauccaaauuuuuucuccauuuacaagugugugaauuuuuuacuuauuauuguuuuguuuuuuugcuuuuucaagacaggguuucuguguauccuugacuguccuggaacuuauucuguagaccaauuuggcuuugaacucaaagaccugccugcuuuugcuuccuaagugccgggauuaaaggcgugcguuaccaccaccuggcaccuaguauauguuuugagaaacagcauuguauugaauuguuuugauauuauugagagguuuucauauagcugccuuaaguuuauuaaaaccauguguaguauaauuuuuagcuaauuuauuuuuugacacaaggucccuucuauagucuugacugucuuggaacucacuauguagaccagacugccuuugaacucauugggauccucauggcucugccuucauaguggugggauuaaagaugugggccaccguaucccgcucauguaugauauuuuauaauaggauccuuuuauuuuauccaaugauuauuauuacugacauuaauaucaguaacucauuuuguuuucaaauuugguguauaguacaauacuaaacauuccuguacauauaguuauaauuagaucuauuacuguuucuaguuuuaguggugugugugugugaauguguguuuguacacauauauuaauauacucuugaguuugaggauauucagggcuacacagagaaaccuuaucucuaaaaccucaaaacccuuagucagcauaacagcuauugugcuaucuaaggcauaguaaaaauaugauggcugugugcauuuuuuauccaggaacauaaauggucaaaggccaugaagaaucugggauuuuuaauauuuauuacuacaacaaacaacaaaagcaaaauuacaaaacaaaugucucaucguagugcauuucccaccccaccuauuuccucauaguuucacccaggcagugcuugcauuaaaguuguguauccaggcuguuuuugaauuucaugagcaccaugcccaucauaccacuagcuuaguaauguauuucuaaaucacacacauauaaggaacauauuuuaugucuuuuugccaucucucucccacuugucaaggaugugugaaaaauuuaaauuuuguguugugugagcacucuuucuaaaccauuugcuaaaggagaguuucguugacacuacgccacccccaagacaguuguucuuuguagcccuggcucuucuggaacucuagagccaggcugaccaggaauucagagauccaccucucucugccucccaagugauacaauuaaguguauaugccaccacacacugaaagagagccuguguuagcccuggcugauguucaucuuccugauucagucuuucaaauacuaauuuuauaggcuuggacuacuaggcacauuagaagggacaugggucuugaucuuuuaaaauuuauuauuucaacaucauauauacauacauacauggguguuuugccacaugugugucuggugcccuucaaggcuagaggauggcauuggaauccccuagaauuagaguuacagacuguuguaagccaucauguagguccuaggaauugaccuuugguccuggaaaagcuacuagaucuuuuaaccccugaaccuuaccuuucuagcccaagaucaugguuuuuaaugguuauauguuccaucaaacucugguaaagaggcucuuaagauauuucuuuuuucuaagaaaaaaauuauuaaagcuuauauccauguaccuuuguacagauuauauugcucaaauucuucagaguugcuuauucaagccaaauguauuuaauaguaaugacuugggaaacauggacagugcaaaacaugguuuguagagagaaaaacagaaauagaccauuuuucuuaggaagcuuagaguccauuuggaaugauaacaucaacuuucagaaauuaaaaaauuaaaagcacuuaauagaaucuacuuuguuaaacaggaaaaaauguagauguugaggaauuuuaaagagcaauuauuaggaucagagauaauaauuggucaagacuucuuggagaaacauuugaaaugguuugaaaucagaguaaaccaagcauuuuauuuuguuuuauucacuuuauuucugaagagaaguaucaccggcagcagccaguauguuuucacuugguuuuggaagcauuagugcuucauuuauguggugucuggauggagcuuaagaggggcaaaggcucuugagaauuguuuugguccucgguguauuuuuguugugguuucuucuguaguggcuuuuaauugcuuaggguacuagggucauggaaauuguugaccaagguagguuuccccuugcauugacuuuuacaagggcaggaaguuguaaggaguuucuuuguggacuuuuuuuuuuuuuuuucuuuuaauacuaugccugauaccauaucaaagcagauacuuugucaugguggauacaaaagagaaagcaacggacuguuucuauaauucagaaaaacugucuugugauaccuguuguccuuggagaaauguuccuggagaaaugagguugacucugaagauacugggguacagauacaccucauuauagcuaguuuuagaaggacacaagugaagugaaaaaaaucucuuaaggcuaguuuuaguugccuuggguuuuugcuguuguuuugggguuuuguuuuugacugaggcccaaacucugugccuuguauuugcuaaguaagugcucuagcacugagcugaguucccagaucuagaaggcuugcuuuuaagaaugaacucuggucugguaaagauggcuucauggauaaaagcacuuaguaugcaagcuuggcaaccagaauuccauccuuaggacucauguaaaauaaauguagagguagggaacacacagacucuacaagguuguuuuuuucacuuucacaggcauccugugacacucacuuccccccaggcccccuuccauacacacacaaacaauaauaaugaauaaaaaaauauauuagagcaaauucugaccuaagaagcacauuuugaaagaugaauaguugagaccagguaucuuaauacuaaaaugugcauaaaagccagauaaggugaaaucauagaagagaaaaucaagauguaaaguuaauuaucaaaguauucauuaaaaaccaguaauagggcuggugagauggcucaguggguaagagcacccgacugcucuuccaaagguccagaguucaaaucccagcaaccacaugguggcucacaaccauccgcaacaagaucugacucccucuucuggagugucugaagacagcuacaguguacuuacauauauuaauaaauaaaucuuuaaaaaaaaaaaaaccaguaauagauuuguuaugagauuguagagcacaguuuuagaucacacagauuuaucuuaugccauacuguaaaauauucuuaguuuuuuuuuuguguguguguguguguguguguuuauauauuuuaggguguguaucuuuguguaugugugccagguauaugcaggugacuguauaggugucacguuccugagcuauauuuacaggucauuguuagcugccugacaugagugcugggaacuuaaguggaguacucuggaggaggaggagcgaguguugagccauuuuucuagccccuuagcuuaauuuuuugaggcaguguuuuguagucuaagaaacccacuggagaucauucugccucagguuccuaagugcuaggauuauagguacccuauguagauuugguucaaaugcacaaagugccuccucugccuucuaagcccuaggggucagaggcucauaccaccaacccaaaccuugacuaguuuuagaauuucuguaauucuuuguucauaccuaacuacuuguaaauuuuuguaaauauaagguaugauuaguuaaauuuugccugcuuuauaucaguucuuucaaaucuuuugaauuuuuucaaaaucuuuaucuagugaauguccuauuuuuuaggguacuauacaaaaugauuguucguauauuuuguuuuguacauauguagguuauuggcaaaaaagcaagguuggcugagucauuuuaguuucuagauauacaaguaagucucagauugcuguagaagaugcucuaauuucguuguuacauuaguugguuuuuguuuuucuuuggagguagaaggaagacacugacugauuacuggccccuaacuugcagucuucaugucucaguguuucaaaugcuaugauugcaggaacguuccacuaaauguguuuguaauacuacuacaauucugcuuccuccacaccugccucuuuccucccuccuuuccuuccccgauuugucguuugucugucugccaugagauccucuaaccugagacuuuuuaagauuaauuuuucuuuugugaguuuguuguuuuuguuguuuuucuugagacaggguuucucugaauagcucuggcuguccuggaacucucuuuguagaccaggcuggccuugaacucaggcagcugccucugucucccaagugcugggauuaaaggcgugcgccaccaccacacugcaucuguuguauuuuaucugcauguauaucuguguaccacaugcaugccuggugcuggaugagggugucauagcaaaaagagggugucacaccuccuguaacuauaguugcagaucauuguuagcugccaugucggugcugagaacagaaccaaguccugugaaagagcaaccacugagccaucucaucagcccagaaaaauguuucucaugaggaugcauuuaaaaugaaucuaaugagugguaaacaacgcagcuauggcagcaaauaucuauaacccuaacaucucaagaguaucaggcuggagcuggagagauggcucagugauagccugaguucaga

SEQ ID NO: 2921 - RNA, 2071 nt, Mus musculus
guaggggcacuccuguuuccaguuuaccaagugaacacauuuauaaaagacugucaggaaugccugggacaaagccaacaucuaugaaggauaacuguacgugguguugcccuauuuccaaagcaccauuguuacagucuuuuuuacuuuaacuuuuucuuuugaacugagaaaaacaugaaaaaaaaucaauuagcaaaauuggggugugaguuauauguguuuuagguuccugaauuuucccccaaagaaagugcaguauaaaugacuugagggcuggauugaagcacuuccauuuccuguuugaugucucaguuucaguuccuagcauuaugaaaauuauauugucaaaaguuuuugcugcugagcaaggcauggugagugcucuggucccacaauugaggguaguucggaagcuaagaguggauuuggaguucaacaccagccucagcagcuuguaagccuuauacaaagcacacuuguaaaagugugguuuuugaaaucacauaaaggacccauuucaaaaauaggccuauagugaaucgaaguccaaauuccaguuuauagaaaauaagguaaguucuaaauguauguuacuuuacaaaacaacuggcuaauuuuucuucaaaaagucaaagauuuagguuaaccaauaacuguguuuguagucuaauuagaucuaaaagagauuuuugacuagcuggccaugguguuucaugccuguuaucuagacacaugaaagucaggagaauuuccaugauucugaggccaacuugggcuacaauagaaaaacccugcccuuuggaggaaaaaaguaagaaaaaauagagaaacugagagauuauauagacuggaaaaaacuuguuaacuuauauaaugauaaacuugcacuacauuaaaaaaaaccuuauuuuuaguauuuaugugagagaugauauuugguacuuauuucaaaugaugcaguuaaauauccacauacauauaaaaauaguguguaauauguuaaauauuagaagagcuuuauguauauuuucaauuuuuucuuuuuuuuuuuuuuuuuuuuuugguuuuucaagacaagacaggguuugucuguguagcccugcuguccuggaacuuacuuuguagaccaggcuggccucgaacucagaaauccaccuaucucugccucugccucaugaaugcugggauuaaaggcgugcgccaccacugcccggcuauuucuuaagauuuuauauuugaaccuuaucagaaucacacuaauagauaacaccaauggacacauacacaaaaaguaccugagaccaucagcauugagacaccacugcauaccuacugaaauggcccacagaggggcaguauagcaauaucaagugcuaguguagguggugaacaacuggaacccccaaaaggacugaaaauggcacagcugcugcuuauaaauuaggcauguccauaacacaguucagucgucuugcugcccaagggggaaaaaaaaccaggagacuccacagauuuguauuugaaugcuuaaagcaguuguguuuauaguaaccccaaaccacaaauauuagaaagaucuaucaaccagaaaucagacugcggugcauccacacaauggaaauaauugcuaauguauauagcaaugaguaacuucauauacucaacugaaggagcuagacccaaaagaggacacuguacaguucucuucaugugaauuaaacaggcaaaaauaaccuguuagccuuauuagggcuugcugcugagcaguaagccuuuuaggguguuagacauuuuccguacauugaauggcaauguuuaugugcugccuacuccuuggccuuuuuaaaaauuuucuauuucuauaaaaauaaauauugguaccuuaaaauugugaauaugggggcuggagggaggacuuggguuaagaacacggcucaugaaguguggacgggccuggugcuguucuugugaaccaaucuagugaauaaaggaaccaaucacugggugaguacgagggacuuccggguuggauggaggaaggaggagagaguuagguccuuuuggaaug

SEQ ID NO: 2922 - RNA, 3017 nt, Mus musculus
uccuuccucguuggcucuguuuuugcuguuaacauauuggugcagucuucaagggacuggaaaagacacacacgggcagccauacugcaauccugacaugcccggggagccuaguucauucguucaguugaauuuuucugcuaaaaucuuuuaaaaaaucuuucucuuucucaccuucuccuccuuccugugccaacucuucacagucuuauguagcccaggcuggccuugaacucuuggugauccuccugccuuagcuuccugaguccuaggauuguaagucgcaccugccuucuuuuccugguagagucuuuuuuacucccacauuccuucacauuuugaauuuaauuuuccuuuacuuauuuucaaauagacuugugcccacugccccuccucucagaucuuacuauguagcccaggcuggccuugugcucagccucugcacaaggccaucucugcugagauuaaaggcauucaacaccauguccagcugauuccugguuaauuucaccuccuauaaagcuccacugagaagaaaaaauaaaaauaaaagaacaacaagacaacccccccccacacacacacacacacaacuuuguugcaaggcaacagugcuaacucccucucucccagcucccacuaucuuuuucuugucacuccucugggaacuuggagucauuuggcugaguuuuaguguuucaucuugguccaaguuuuauucaaaccucaccuggacagccuugaaaucaauuuauuuuucuguucaccugccaagucaaugccacacauuuuauuuuauauguuucaaaaacaugauugcauguuagcgcauguguguagagcgcaucugucuugcugggcuucuggaagucagaggacuguggggccugggaucaaacccagguuuucaggcuuggcagcaggugcccuuuagccacugaaccaucucagugacccuucuuuuagauuuuuuuuuuuaauuggagaaggaacucccuuccaggaacugauuucucaauagcaauuacaaaccaauacuuuaaguggcuugauacagugagaaggguuugggaugcugucugggcaaucugcacauauaccuuuacccccagguacuauguggaagcaccaggggccuggggacuucccagauuucauagggauaaagaacagguccugggguuggaccaagcacacagccugcuguccaugccuccucgguggcccguggcagcuuaaaccaagaggcugucuuucccccacgcagagaggcugcuuccaggcaucagcauaauccucugccucuggccuuccacccggggauccaucccauaaucagccaccaaaugcagacacuauugcacaugccagcaagauuuugcugaaaggacccugauauagcugucucuugugagacuaugccagugccuagcaaauacaaaaguggaugcucacagucagcaauuggauggaacacagggcccccaauggaggagcuagagaaauuacccaaggagcuaaagggaacuguaacccuauagguggaacaacaauaugaacuaaccaguacccccagagcccgugucucuagcugcauauguagcagaagauggccuagucggccaucauugggaagagaggccccuuggucuugcaaacuuuauaugccccaguacaggggaacgucagggccaagaagugggaguggguggguaggggagcaaggcauggggaggguauaggggacuuuugggauagcauuugaaauguaaaugaagaaaauaucuaauaaaaaauugaaaaaaaaaucaagcguuucccucacaagcaguccuaguaaagauucugagagagcugcugccacaagacccaacaccccacuggaucaauuuaaaagacacauagaggugucauguguccuacuuggaguccagcauuguuuuagaagugccaucagaugcauagaggagacccacauggggcuggagagauggcccagcggugaagagcacugacugcucuuccagaggucccgaguucaagucucagcaaccacaugguggcucacaaccaucuguaaugggaucugacacccucuucuggugugcaugaagacaacuacaguaugcuuacauacauagaauaauuaaauaaaucuuaaaaaaaaaagcagagacccauauggcaacucuuuaugaguuuaaguagggcaaguauuuaggaaauggugagccaagucuguagguauaugccugucauucuagcuacuuggggaagcugaggcaggaggaucacaacuucaaggccuaguugggcuccugaguuugaggccagauugaguaaauuagcaagacccugucucaacauucaaaaaaaaaaaaaaaagaguuaggagucuacuuagcaguagagugauuagcaugcugaagaccuguguucaaauccaaguacccccaaaucaaucaaucaauaaaugaaugcugggagugcaggggcgaggggagaguuuggcuguauugagcugcuacuacagguggaagcuggguugccgcugggcaguacagcugcugcagcuucaagcuaaguggccaggacauggaagaaaaugcagugcugaggccgacugccagggcuggagaggagcugggguugaggaaacuguggguggguuucuccgguuacccuggagagcaggaacccaaggagguaagucagugaaaagggggcauguuucuuucuuucuuuuuuuuuuuaagauuuauuuauuuauuuauuauauguaaguacacuguagcugucuucagacacaccagaagagggcgucagaucuuguuacagaugguugugagccaccaugugguugcugggacuugaacuucggaccuucggaagagcagucaggugcucuuacccacugagccaucucaccagccccgggggcauguuucuuaucagucccaggaguuuggaguacaggggaccagguuaaagccacaggccacuugucugcauagcug

SEQ ID NO: 2923 - RNA, 694 nt, Mus musculus
uuuaaaauaaaaagcauagauuuccccuccuuaccccuccuuuuacaauggucucuucuccgcucuaaguccucccacuuccuaguucaaguuucauuugugccccgacugccccccucccugccccauugcauuguuugugugcggcaccugcaguagaaaaucccagcucuccaggucggucugggagcuccuccacccuccucccuggcgggccuccuccaguguuuauauguaaggguauugguugaccuuggcaggacucaguggguauccaguguagacgguggaggcuggcgaggcgcugauauaggucuggugggcaaacugggcuggauacugacugggguggauggugggcgagggcaggacccggggccccaugcucacagggaccugguggacgaugcuggccggauaggcagugugcugcacgguguggcgugcugagccuugggaugccaccaggugggcuacagugccgguggagccuagggcugugggcgcuguauagguguagaggugaggcuggguggggaggugggcagccgcagccaggugggggugaacagugccauggcuggggcuguugugcgggaagguguacggagcuugcgccauggucggagugauguaggccugcugucgacggugacucccggugcgguccgcagccaugugcugcugggccuga

SEQ ID NO: 2924 - RNA, 694 nt, Mus musculus
ucaggcccagcagcacauggcugcggaccgcaccgggagucaccgucgacagcaggccuacaucacuccgaccauggcgcaagcuccguacaccuucccgcacaacagccccagccauggcacuguucacccccaccuggcugcggcugcccaccuccccacccagccucaccucuacaccuauacagcgcccacagcccuaggcuccaccggcacuguagcccaccugguggcaucccaaggcucagcacgccacaccgugcagcacacugccuauccggccagcaucguccaccaggucccugugagcauggggccccggguccugcccucgcccaccauccaccccagucaguauccagcccaguuugcccaccagaccuauaucagcgccucgccagccuccaccgucuacacuggauacccacugaguccugccaaggucaaccaauacccuuacauauaaacacuggaggaggcccgccagggaggaggguggaggagcucccagaccgaccuggagagcugggauuuucuacugcaggugccgcacacaaacaaugcaauggggcagggaggggggcagucggggcacaaaugaaacuugaacuaggaagugggaggacuuagagcggagaagagaccauuguaaaaggagggguaaggaggggaaaucuaugcuuuuuauuuuaaa

SEQ ID NO: 2925 - RNA, 61439 nt, Mus musculus
auuauuucaagcuaugguuuuaaaaaguuuuauuuuucaaguuguacuccaaacuaaaagauacuuagacucagccuuaacgacucuguucugaauaucaggaaugcagauguggcagccagaugcuccuugcugcagacaacagcaguggucaacaauugcaugauguuucuugugcuucaugaauagcugagcaggacauuuguguucuuaacuuggagugcagauuuggaggaacuucacaggucuacagcccucagcuagcaguguauagcauucauuguguggugaagcagccuucgaagccaaccucucaaaccaauagggagagagggaaaugucuagcuuuuguuguaucaguucucacuuugccaaaugucugaaagcaauuuaagagauguuucagccaaacccucuuguagaccuaggaaagaauacaguuagccuguucauugugcuccacuuggcugucuuggcaucucugcaaauaaaacauuaaaaauaggguggcccaggaaggagauaaagcuauugucuuuggauguagguguaggugcuucucccagcccacgaagcaggguuucucuguguagcccuagcuguccuggaaccaggcugaccucagcagccucugccuccugagugcugggauuaaagguguggaccacugcugccaccuggcagugugugcaccugugcuugaucgcaccuucauaugacuggcaucaguagcaaguccucuaacacacuaauguuuguagacuuuuauuucuauuagcauugugucauaggggugugugugugugugcgcgugcguguacgagcgcacauacauuugauuacacugggcuucaguacucuuauuccaucacuuuccgucuacugcaacaguauuauuguaaggaaacagugcagugagacaggaauuucccucugcauuuaugugcucauauggucagccaggugucguccaugugaaagccaugcacaacagauaauuuguguaaaauuuauuucacucucauuucccauccacauauggaucuuuaaaggcuaaauuuaaguuguuguuuuaugaucucugaguguaccaaagaagaauagucuuauuaaaaugucaccucugucuuuacucauguacagucacaauaugcuuaucucccuuccugguuuaucuccccugccagaucacuccucagagugagagaguggcuucuguuuaugucaaccuuugaaauggcuaagagcaggcuguauacacaucagcccccuggccaacagggcugagcuuggcuucuggaaggaaagaagguuccaugauccuucuggaaaggccacucuccacuggaaucauaagcccugaauucugagaagguaguugugggcuaaagagauuaacucagagaaagagcuuuguaagaccaugucauugguuuuuuuuuuuuuuugguuuugauaggaaaauugaacuggcccuuccuucaguaaauugacugcauuacauaaggcacagguugaagcagugcaguagcaugaauucuucugcgguuauuugauuauuuuuaaaauaccauugacauuugaaaggcccauagacaaaggccaacccuauaaguggcuguguuuagaaaaguaaaauaaaauccauucauuggccuuuuuaccuuaaccauguggauacaaagcaggguuuuauuucaacuaaauagaauagccaacauguaguuuuaagaaagauuucauuguauauauucauugugcauggugcaguauuaaaauauaugguucacaguuuuaauaauuaguaccauucaguucaagcagcucugacuaauauuuguguaacuuuucaucacaaaaugaguaauauuaaacucuaauaggauugauuuuauuuguuaauuucuucuaaucagucuuaaguuauuuaacagaacuugaaguaaagaaugucagacuagacacccaguuaaauaacuguuuaacuguuauucaugacuguuuccaauauugcacauuaaucaaacuucuuugguuugcauaucuauuauuguaugauacuguugauucuaauuaauauuugucacuuguuaauaaauggucucuucacucucaccuaaaagauaauuccaaguaaaauacaguauguccacuacuugcuaccuaugaaacuagguuguucuagugugaggaagcuaacuaauauguuuuggguguuauauacaugaauaaaggcuuuccuaggaaucuggcaauucguuuuuaaaacagcucauucuuugucuccuaauuacaaaagccauuaagucaaggcuguuucugaagcaucagccacuaucuaaacauccuaaagcagugacugagcacaguuuagugucacuuuucaguuugacuaguugucacaaggaguagaucaaaaauuguuaaauugauuuuaaaauaaugugauccuuguaaaagucagaucagcaaaucuuacuggcagcuguaaguaguuugugccauuuuaccugauaaucucauaacacuguaaauauuauaaauuucuuaaaccaugugaauaucuggguagugguggcauauaccuuuaauccuagcagaggcaggcaaaucuuuugaguucaaggccagcuuggucuacaaagugaguuccaggacagccagggcuacaaagaggaugaccccuaucuuaaagaaagaaagaaagaaagaaagaaagaaagaaagaaagaaagaaagaaagaaagaaaaagucaagaaauaaagaagaaaagaaagagaaaagaaaagaaaggaaaacagaaaaauguggguauauauaauuucuucuauuuuuaguaaaaauugaauguugaaggcaaacagcaauugacagauaaaguuagaaaauuaagauguuaacaauugauaggcucuggauugagaguguaaagacuagcaaaaauaagugcaggcuaucacauaaaaccgaaaacccguacaaaugcugugauuauagcuguauauuuaaagacuugagggaaacacaucugugugaugcuugcauuuuagcuuuuguauauauugguuuuccuaagcuuuagucuuaguuuuuauuaggaaguuguuugcuaccuuuucuaacauguuuuaugugagcacacacaugugcacuagaagggguuggucaauaauuacaugcaagaucaccaaaaauaaggucuauuaugguauuuuuguggcacuuuacaaguggcgguggccauguaugacguccuuaucuguguuccuuaccuaccccaggugaggaucuccucaggaggacaguugcuccaugcugcuuuaucugcucaguuaaaaccuuaaggaagaagaugguauuugccaacauguaaacuaacauuugcucccggccuuuggcucuugagaagaugauccuucaguggaucucaacacucgccauucuugcauuucuguuuuagaggacacacaccgugccaguccugccuuuucaagucucuugaagaccuaaaguugaaugguggcugggacuagagaacagccuggcauccuaccgacucuagacucucugucuuuguuuauuuuuguuuuguccuuuuuuucuauuguuguugguuuuuuuccucauuuugauuuuuuuuucccccuaaaggagggaagauuaaaaaacaaaaucacugcuuuucagggaugccaugacauuauuguaaaaauggcaaucuacaaaaauaugcuuaccauaacaucuuuucuaggauauaguuuuuaguguauguaauuacugauccuucuagaaacuggcuucuggcuaccaagaaacugcccauccccagagccuauugcaccaucuggacaggccugggauuuuauacacacacacauacacucaugcacagacacacacacacacacacacacacacacacacacaggguggggguggaaggcgagagagagagagagagagagagagagggaaagagagagagauccuuuuuacuaguuagaagagcuuauagcuggauacagaagacucaacaagugaagaccaucugcgaagcugcaggugaccaggucacauggcagauauucacagugcacaaacagcaugcugaauggauauucucaccagaaggucaucuggguaggguuuacuaagcaggugaccccacacaggaaaacauuaucucaguacucacuugaaaaugugaggagacuaaagaacacuugcaguucuaaguaagucaauacuggaaucagaugguuuaguagaaguaggugggugguguuggcacauaccacaucucucaucugaaagugaauaagagauagcuuauuuugggguccuuuugagugaccauggcccaggaacacaaccuuagauuuccccaaauuccauguuccaacauggaaacaguuucaugaaauuuuauaguuuuacagaacaaaaaaaagucauacauaaaugaaggcaaguugguggcuacaucaguuauggcaagauggaggagguuuuucuuuagaccucagaugcuaucugauggcauccuuagcuuucggguuggugaaagccaguggucugcuaaguuaauagauuccaaaugguuuuuguuagucacaagauguuaguucagacacagcgguaggcaaggaauggcuguucuggaaggcuaaaaguagcccaagauaaagucucuggaccugcagccuuucaguacuggaauucuaaucaaucaaucaaucaaucucugcaagugcagcuucucuucagguguguguguguguguguguguguguguguguguguguguguguguucacaggguaggcagguggauaaguggacugggaauugacaggagucugagugugagggcagccugcaguagcggguuagugcaugcauagcuaaggcggcaacuaagaaaugggggggggggggcacuguaaauuaagauauuuuacauaaaacaaaccugcugggcuuugauuuuaaaagauuuaagccagacaggugcauaccuggaaucucaguagcccuagcauuuaguggaugaaaaaguaaauucacaaggaaaggacauggcugcuccuagggauggugggaaagaaaguuuauuguggauaugugggagagugcagccacaggcagacaccagggagagucuagagccugacccugugagggggaggugaagggagaggggggagccagaccaaaggccucgaugguaaagggcagacagagggccagguaaccaaaaugguuggauuauacagggaagggcagcuggggguggggggaguggggagcccagcccaauuccugggcuguagaaguuuacauuaggagguggguguggcagccaggaggacccuguaauggaguagggacuguggggagaaccugguggcaaagguugggaagcaagcacugggugugagauaaggaagaagaccaacugcugggaaauagccagacgcauuuuuaagucuuugcaaaccauuguuacaauggugugugugugcgugugugugugugugugugugugugugugugugcgugcgugcgugcgugcgugcgugcgugcguguguguguguguguguguguguguguguguguugggguggggggagugucaacaggccaucuaugacaagaucagagggggauucugggcugcuuguguuguuacauugugaauguuuauuaggcuguccuugcauccuagaguuagggaggauuuaggaccagaaaguacauuucagucauuuaugcuuugagcaaaggaaacagugcucugaaaucaaaggacuacugguagagagagagcgaagacaacagaaaaacuuauuaggauggcaguauaaccugagauuacugaucagagaccagcagagguguagcucuuuguauccucuaaagagaaguacugaaaaaaaaaaaaaaagggggagccaugcugugcugugaagauaaagggaaauuauaguaaaacaaugcucuggaauaguuggaaagaaaggugaaggugccauuggagagggagaagaugaaggcagcaugagauuacuaacugcugagacugucuucauuuagacaagcuagaagggacggaacugaggggaggguccucauggaauccaaugaccuguaugagggaagggccucaugggaugaacauaccuuguagaaacagguaggcaaguguaagagcaggguccucacggaagcaaguuuacaggaagauccccuuggaaacagguggccugaugugaaaggaggauccucugggaacagucugcuuggagccagguagcuaagugaaaagaaaacauuaguuuacagaggcucugaguccacuucugggauuucugaaggacagcucuggggaaggacucaggguaagcuuuagaggaagugagagguagauuuaggaagcucuggacuaguuaguuccugagucuggcucuggacuucaaaggugggaaguguacagguagcaauguccuaagguuagauucuuacaccuuguguuuguuccugcugggcccacuuccccagccccagcuauuuaaaauguuuuguuuuauugguugguccucaguuauaaaugccauuguuuacaguggccuuuccuaaagucccucccagcuucacugcucagacagccuuuugccccuucuucacuucuaaagaacuuuuaguauaguuucaaacccaagccucaugucaguugagaaagcccauagguugcccagcugauaacggcagagcuguccuucauacucaggccuggugccuuuucugcccugccauuccucauccguggauguaaauuucuuuuuaggcagaaggagcagaauuggguaaucgucaauccaguuuacugaguuguaaaacccaugacuguaaacagugaagugaaugcuguaugaaguagauggggucuggaguggagaguaaacuuuauggagaggagacuuggaaugcacuuuggagugccagugggaaauuuaaauggcagaaagcaaaaggaguuucuggguggagggagguggauguagggauugguauaacugauaguagauagaguuggacucccgaaagcagagccaaauguuuaagguagccauaagugagcuagggccccaaaguaacaugaaagucagagucaagacuuaggguaucaggaauguugggaagaaaggguguguaaagaaaguggcauuucaggaacgucugacuagccuaaggagggaaaugaggggaaagcuucccauguagaaggaccuaggcaugccacugguucccaggaaucuucaguggggauuguuggcaggaaguuuauaagugacuauagaaauaucgcagcggcuugccugaccacacugaaauaggcaugcugcaugaaucccacuuauuucccucacaaucuucuugagggauaggccuggcaggaaaauacuaggcaaauccuugagguuauauguuacuucccagcugaaggcauauuguaaauuccagugaggcaccugccaggugcuugaaauccuaugagugagauggagacauggagacugaacauggguuggagaauuguuaggucuggagccuuguaguguaccacaggauccugccuuuaggaguugcuugaacaaggcaguaaaagguuguucuucagguuuguagguuuuaaaaccuucgggaagauaacuaagauccuugucgauagagucaaggcugaaaacguucucaguggcucaggagccaggcuaaccuuguaacauuuaaugagaacaguagagucuuugcauguuuuccuuuuaaucaguuaacgggagagaccugaugaauuaugaagcacauuauaagauucgggaagaggagcugaggaagucaguuauguaagaacaaaugauuacuaucaaaugguugucaagugacugugauaacgcaagcucaggaccaagugcgggaaacagucugugucacuuacugaugggaauacuuucugagaaacguguccuuaggugauuuugugaguaccauagggugugcuuuaguaaacgaagacagcaucacuagacaauauaaccccaagggauuucugucacauguuaucuguuuaucacuauugaaacauccuaauauggcccaugacugaauuuagagcaaguaauaaguauuguauguuacacauggagcaucuuauauucacuugaucuggcacagucauauuuuugaugugaaggguaguuaagaaagugggaagaggagauguuugucuagaaugcaguuaagaagauacaaguuuguggcaacuaucuuaaaauacauagaaagcugucaugugacagacaccagguagauuuagucuacaucccuccaauggacucagugaacuccucagggaaggaugaaacagguuugaaguguggugagccaggaugcuguagugaggacucuugugauggaucuaaagcgaguauccaggguuucuaggguauaaauacuuuacagacugaacuaggccugauauuuaccaguuugcaggagcuagguauaagauaaucagaaacuuugugagcuagcaauuaaauuauuggucccuugaaguugaccauagaggugguauuugugccuaagaagucagcaaacauuaauggugacuucaccucaccccuccaggaucagccucucagcauaccaccaguagccccaaccaaaggaugucuguuagagcaaggauccucuggaauguggaagggcaagcuaggggaggagacacuaguguuugugugcucuggucuuuuuagcuucuguuucccuucuaaacugggcggagcuuuccugauagagcacauaccauuucccaucuccugccaagaucugaggcccaugaguuucucugucacuggaucugccagagaaacucuguuucucaaaauaauucuuuccuuguuuuaugucguguuuggcuaacccucuguaggugcuuccuaccccauucuuaucucgagcugaaaggacugugaacagggaaugaacgcagccagagaaaggggauuuggaaacacuuggcugcugagaacaagugauugcaggguuggagucugacccacagauagaagaaggccuugcaguacuaacaucccaaagauggacucuuggguuaaccccagaugaacuagccugucucugcuaccugggcaggggguaaacuuguguuguuuaucucccucauuuccuuuugaaaagaggacuuaaagucuccgagauguacacgauguacauggaagacacaaaggccuugugcugaacacaguaggcaaacucuacccugcucauguaacucuuacuuauuuuuaggcucuaaacaaaaaaacaaaaacaaccagaaacugucuacguuuacuuuucuaggaugccugcagcauuugaaaccccaaaggccuugccauuuuucccagggccuccuccuucccaaccguccccuuuucaauuuccuaagagacagacaauccccaugaccauuugggcuacaaccagcuccaaguuucuaaaacuguggaaaccccuaauuaagaaaagagcaccaucccagccaguggacuuggucggcuuuuauagaaaagcagcccacccaaaagugaugaauuggagcaguucaguauucaagcuguaagugcggggaaguauaguucuuacuuuaaauauacagguauacauguaaagcugcauauggaucuguuauaagggagaucaauccuaaggaaagaugcguuauaccccucucaaaccuccgaagaguuuuccuucccauauuuaagguggucaguuugaagaaagccaggauuuguuuguuuguuuguuuuugguggcuuagaaauguuguguuacauguccuugaacucagugagccagcccaucaacagggccugcuagugggagacaaaagccuacaaggccuuuguuucaagcuaccaagcuuuugucucaagucaagaggguaaggaacaggcuggcuaccuuuacuacuagucauggccccucucccuaucugccugcuagggagucugucucacgccuagugucucauuaccacaagguacuagcaugcaugucagcauccagccuuccucagccagggaaacuuccaggagagagcaaaccccuaccucucgaaggcagccauggugaacuuccuaucaugcgcccaaagaccacaggucccuagcuuauuuugugugccuacaguguguacaguaagccuaggcugaggcaggcuguuagucuggcccaccaguguacaaucaacaaacaguucagcccuuccugagguucugccugaaggaagugguaggaaauggguguaacaaugacuacuugggauuagaaaugugcaaagaagaucuccccauccacuguuccaaccagaccugcuccauccacuggagcucugccaucucuucccaggaaugaagccuuucguaagccaaaguucuuggaaaacuuaacguuuggcugauaaaauuuuauauguauauguguguguguguguguguguguguguguacuguugucauuauauuaauuucuaugaaaaaauuuuaaguuugcuuucccauuucacauagaaauuauuccaugaacagaauucagugaaguugaaaauguuuggcuuaucaucacuuacuuucuagccuggcuauucgcauauuuuuuuugcaugagcaagugagcuagacuuggagcuagacugcuccaauucaucacuuuugggugggcugcuuuucuauaaaagccgaccaaguccacuggcugggauggugcucuuuucuuaauuagggguuuccacaguuuuagaaacuuggagcugguuguagcccaaauggucauggggauugucugucucuuaguuucucacacauacaauaugcauacacaucuuacaauauguaaggucagugguucugagcaccuugcacuagagaaaacucagaccuucagauagaggacaaaaguugccguugagaaugagaaaugccucucauaguccuggauagcugagcacuuggucaccaguuggcucuauuuggggggacucagaagcugcugccuuuugggaagaaguauguccgcuagaggccuugagaguuuaaagcugucucagcuuccugcuccagcaagagacugacacuugcugggugccaccccaccacauugauucaucuagaacccuaagccaaaauaaacuuccaugaguugcuuauuggcaugguguuucaucucaacagaauuguggaauacaagcacaaaguagguaaguuagagcuugcuuuggaagccagcucuuugaacacugauguagaccucuugaggaacaucuaggaaaaugguagccaauagagggauauaaggcaaguaaguggguuuuggugaggcccuaugauagugccauggauuuucauagagaagcuugcagcuuagcuggagagaccaacuccugcaccuagaaacaguggagugcccacgacaguguuagguuaauuggaaagugagcugaaggaaagagaggagacuugaaacagaaguuuggauagagaggggcaagacugcauagaucuacuggccaacaagccagaaggauccauucaagugagaauaucaccagggauguugaguggcaggcagaaugcauagagcucguccauacucagagaaaagccaccuucaccuguaggugcagucuggacuugaggaaccaguaaagugaaaaaucaugccagccaugucugaaaggccauuggagccaacauaagccauucccacagcaggaucacaacgcguggagcugaaacagucuuaacagacggcacuugggaauccuguggaguaucggcauuaaggcagcagaguucacugugaggcucucauugagggcacaagccuagaaugaggccaugcagugacugcuagaaggaaauguaaaauucugucauuagaggaagggagagagagagaacucacacaaagguggagugagaagguagcaccagaguauauaacaaucacagugaagaucagauucaaagacgacauuggaaauugaacccagagggaaacuugguaggcuaagagaacaguuguuugagggacuuucaaguaaauagaacuuggauuuccugugauaagcaaguugaugcuugaggaaggaaguagggcagugaaaacccuuuuaggaaaacaagucuagggacaggcaauaauugauuggaaauggggaaggcuggaaacagaaguccccagggguuaucucuaagaucugucgaggccaugagagcagauggggagccaguaucuuugagggauguuucaaaagcaaagggguacagaugaaguucaguugguagagugcuugccugguguacagaaagcccuggguuugguccccaguacuaccuuaguauuuuaaaaacaucuuagacaguguggugcaugcauauaaucccagugugucuauauauaaucucagcacuuuggagguggguaggaugaucagaaguucaaugucacuaaaaaaggaagaugaaaaaaggaagaaagcagagucucaugauacaggggagacaaaugugauagugcggaucacugucgaucuuacugacuucagauggggagaccaucaugguuccuuuaggagaaauguggugaggggagggggauguugaguucacuuuaagacuccaguagagacuggacccauggcacuugccagcugagggugacauguaccauggcggguggaacaggauccacaagaaggagccagagaaaaggagaguagcaggaggaggcaguagagagccagcuugcucaauuacaaaccuugaagguuuugagagaauguugaagacagcaggccaguuaaucaaagaagggggcauggcaaagcuauaggccagaaacagugugugguccuaaggggagggguggauagugacagccauguagcuucucaaguguguagucagcguggguguccuuacacuaccucuguagcacccagcuagccuccggaccugucuccccgcucuaccuucaauucucauccuucucuguaacugggacaauggagucucugccuuuaagauuauaauaacauuaaacagugguaagguccccaguaacacacuuccccucaugccuccaguuggauuugugggguuccuucaaagaugaaggaaggcuaaagcagugugucagaagagcagagcagaaacagcgcaagcagugcuaucucaacuggaagaaccagagaagggagagagaaaagugagcacguuuaagugauaagaugaagcccugcaauguaggguaaacugaugcuacuggcaaggacgacagacucacucugcaaauucgcaugcaccugccacccacagacaccuggaagaagaggcagugaaguccuuccccgggcuccugaccagcuuccuuugcccuggggcuaaugucuucaauccaaguggaagguggaccuggcucgaucuggcguguuacaaaguuuguucucgcagugcugacuucuccucuguucuccugguuugcauuuuaccguagaugucacuacuuaacugaacggugggugcuguuaacagcaucauagguccugagaccucaacgacuugcucaucagcaucuuagcuccagacuuaggacucugguuccuagagagacuuuguaauccaagugagugccucccaagcauaggugucucugugugaagagacuguugucacugcucucuguagccuguggauaggaagcugcaugggaucagagggaagcaucgccugaccccaagaacucugcuguuggcaaggacauuaaaaagcacccuguuuaacuuuccacucagagggaucucaacagcagcacuuauuaauagcuguucucuugauguaaacugccccccaaaacacugagugggugauccaaguagguuuggaguugauauugcuagggauaucaaaaugaacacagggguuuuugggggagagguguugucauugcuaauuagaauuucuuggacuuauaaauuugcacauggcaccccagcucucugcucuuucuggauuuucaguauuucuugaugauaucugccccaccuggaaguaagccuggaugacuucauaaauauggaaagcagagacaaugagaccaggugacaggcuccaaacacgcagggggucacaucaaagccauucuaagugcaugaacacacccagagauuugcuuguaaucauauuuaacuugaagagucacauuuguaucacagaaacuuucauguguagcuugugcaguuaggccuguaggagugugagccugucuggagugcaauuaaaaucauucuugguuucugugacuuugucaucuggccaacucagcuacauaggcacugcuccugcaaaaaaaaucccagaggugcagcagguguauucccuaccccuaccucccuaccccuaccacccuuagaaagagaaacaaacuucccuugucccauguguaaugugucauaaaacagaucucaucggacagagcaggcaaucucgggcugguucugaagcacugaagaucguguccuuggucacuugucaucugggcuuuucaguggccugucuuuacaaagaggccacucacugcuucuguagucugcuggucagacugcucugugugcugguacaggaggcuugcgcuugcucugccucaucaagucuccgugguacagcuuuaggaagccucagcucuguguuuuccagcagugcuuacuccuuccugcuuggagaagaugcccuggggccuuuuuuccuaaguguggaaacaaauagaagcuguuguccacccaggacuguggugcuaauaaccaagauaguuuccacccugguaucacuugccuuugcacugcccuggcccccacgcccuuccuuguccucuuaaacauucuuuuuguuuccccaccucuaccuuugcuuaggcuacuuucucaccagcagcucuguucucuuucagcacugaagucugccuaccuaauccugaccccuuaaguucuguguucucucuagucaguggcagcauucccugguggccucuggaguguaagcaccacaggaacaaagacuuucuuguggaugcccaaauacuaagugccuagugccuaguggauguuugguaauugcuuauugaguggaaaaagagaucacuccuucuggccuuccuccauguaucacuugcuaugugcacuccaauugcaaaaauccaugaaaacagaaaccauugcuuaguaccaccucuaacagagagucucaaauguacuggaagcucaguagauaugggcaguugagguuaccacaaugcucacugugcuuaggggaacaggguaacucauucuguccuugcucccacucuuauagaaaacuacccuugagugacuuguaagcaacccaaggucuucucuuuucuuuuccccguugagcucucggccacuuggacaugguuuucuuaagagcaugauauauauguuagccacauucuccuuccagaguuuuguaaaagcuacagaggauuguucacaucaguuauccaguggcuggcuaguuaauucccgaguaagcuacucuaagaacugauuauaauucuuuaucaaauacauaacugggagaaggccagaaaagaauuauucugucuuguaggagggaagaauccagcagauagucacagagcuguggcaccagagccuuucuuucuucuguuauuguaaauuauuguuguaguagaaagccagauugucgcaagauggaacaucauacuuccucucagcagaggccuuacauaagaaaaccuucaugaauaaacguugcuauuaaaaugcaugcuacuuaauguaaagugcaguaguuguuuuacauacuuucuaaauuuuaaauggccucuugccucugggcagcuuuuugucuagucaaagaaaaauaauuuugaaaguacagggcaugguggcacauaucuaaucccagaacucaugaggcuaaagcaagaagaucaagaauuuaaagacugccugaaguauauagcagaguucuaggucagccuagcuacagggguggaggggaggggagauagcagcuauggggugcaggugggggguagcaaagaaaacuaauuuuguaacucucuaaagugccaaucaaaaauaaaaacuuuuauuuuuagacauuuuacuugucucccuacaucuagucucucuccuauccaucugagaauucaagugccaguagagccagauggugccgcuguaagcugaugcagcuacagcaaguggcacacaggggucuaugaaagggcagcaccaccauccucagaucaucauugcugucaauaaauaugggcccuagaauugccugagcuuuuaauuuucaugagaagcuggaagucccuacccuuagguaguaccaccugaguucucaaugcuaaaaaguuuagauucuuuacucugagcacucaggaggcagaggcaggcagaucucugugaguucaagguagccugcucuacagguaaguucuagacaagccagggcuguacagagaaacacuaucuaaaaaaauaaaauaagucgaauuaaaucuugaauauggucaaaauauguacauguauggaaaugccacaaugaaacccauuauuauauguaacuaguauaugcuaauacuuuucucauuaaaaaauauaaauaguuuaaguuuuaugcaggucaauuuguuaauaucucuguuggcuccuuccuguaggauagcaaguugcagccuucuuccuacaaguuugguccugccagcuuuaaaguguuuggaaagccucuagcaucauuguucuccuuaggagaagauauuuaaguaaguccagucagaauagggacugaguggagcacagcacauguguccaggcuguuccauugaagcugaccagagaguaaucuagaguugcuuuuguacagggucugcucuccuaggagcauagcauuccuucacauggacaugagccauaacugugggacaaauugccuuaaaacuuaguggcuugugcacuaagugguuaucaucucaguuucugggggucaguaacuugagagcaacuuggcucagauaguccuggcccagucuugggagacuguacucacugagcccuuagcuagggcuauaaacacuugacacuugcgggagucuaaggaggcucacucuugugacuggcaagcuggcgcugccugcuagcaggcacucauuauccucucaauauggccacugcuugcuccaauagcaggugauucaaaacucaacaggcuagaagccagugccuuuuuacgacuaaucucacaagucacacaucauuauuucugugauaucuuaucgauuccacacauuuaccccacuugauauaauggaacaccagauaaggggauguagacuaucacaggccaucucagaggcugccugucaccacuguguucccagaagucccuccguaaaaccuuuauaaacacaauccaacacuaaaagggguuuuccaaagagaccuaagagaauaacacacacaucacagugauuuguguuucauuuacuaacguuucugggaccacccgcugauguuaaauccccugaauguauagcucauucccacaaaugccuucucuggaacauucuaaaguacuuuuuuuuuuuuaaauuaaaauccugcucauaccaucacuuagagcacugguucucaaccuuccuaaugcugugacccuuuaauauaguucuucauguuguaguaacccaaaccauaaaauuauuuuguugcuacuuucaaaacuguaauuuugcuacgguuaugaauuauaauauaaauauuugaugugcaaguccuguggaauggugauuuggccaucaaaaggucucgacccacagguugagaaccacugcuuuagcgugacagcuuggggucuacccucugcucccagauggagugcuaauuagcucaccccugucuguucuauggggguguuccucgacuauucuuuguuagcgugcagccagcagagcaagcggaacgaccaguuugggagcuguaauccaaagucuccuacacaaagcuucagugccaucuuaugugaguuagaugaaggaguaggguucccccagggucugccauggcauccauuucugguacucccuuucugauccacccaccaacucaaagaacauggcaaguggguguugcugaugcucucaaacaccuacaccucaggccccaugcugcuauagccucuuucaagaccaccuuuuguauccuuaaacaagguuuggcuugaacgaaacuguuaaggggaagaaaagguaucccaauaugguuucccccaggaaaacccacaacugauaccuaguucuuguuuguucaauaaacaaaaccaaaaguugaugauugaaggucaccauuagcaacauguauggauucuguaacauuuguauauguaacugagagggaacauuguaugggcccacccuggcaguggccaccaagucccaguguuaguaaauggaaaugaaauauauaauuaaggaggccaugguggcgagcauucuguagcggagauggggaugggguggggggugguauaauuauagaauugaaaucugagacugcaguguguaagggaccguucuaggggagaggcugugugauagauggucugcauuguucuccuucugaccuucuccugaacuucccuuuagaagaacagaggaaauacaauucugccauuucccacauuguuucugaguaauacuuuaagaugcccacccuuagcauuuuuuaucuuccacugggguuuacuuucucuccaaugcuuugcuguuucccauagaaaaaucuaaucacuaaugauucuguccuuguguuaaugcacaauacugaggcuacacaaauauuugcccauauugaacacaaugccuacagggaaaggaaaacucccagugucauccauucacucugccaagcagaacagucagggaauagcauacagugaugaugccaaacccaggaggagggggcagccccaaaccuggaaccaaacaauagggucuuuugaagcagaugagaaggagcgauggggacuuagaucagagacagugcuacaagccuggaggauagugaccagugugaggacugugcccaaaggaagagaucgaucguaagggcuccaaagcucaccacagaaacccuuucuaccuauaguacaaauggacuuaggaacaggaaacucuccaaggccaaaaauggguucucacaacgacuugaaacucuuaucuuuaaaaaaugagggauauuuaagaccccauuuuccucaaucuguacuugcauaaaauauucuuagaguaauauggaggccaucuggagccaaacccucuuuuccccuagagaggggcuuguuaacuucucucacagcuaaauuugcauauguucuaaccuuuggcuuauggcuuuguaaaaauuguaagauggcuacuggcauggugggaggacauugggcacacacacccauugagcaaacuguaaaucaacccauuuucuguuuccuacuuucuucagaguccagggaaacuuaaugugucugagugccuccuaacagcgcugguccugaguuggguuucuguugcuugacaugaugaucuccaguuccguccauuuuccuacagugacauaauuucauugcuuccgacugaguaaacauccauuguguaugugcaccagggcuucuucaugcguguguuugcugagagagcacuuagguuaaucaaccacgaacacuucugugggauuuuuauccaagccaaauuucuaacaaggcaagguuuuacuuagcuucagaaucaacucucagucgaauccuuggaggauuaggggguuguuauuuuucuuucucuuuuugucaguuguugaggcuaaaugaaaaagaacuacacaguccuggguuagagcuuuucaacugcagccucugaguuuggcuccuuuugucaguugguacuaaguaccugcugugcacagugcuaaucccagcagaacauugccaggacuuccuuaggaaaccaguguggguucugucucccucaggaauuucuggucucuugggaguccaaaacaggccugaauacaugcaugcagacacuuccuucuauucucaggagacaggugacaggccaccacuugcuggugcagaugcuauugcaaacucuuauucuuugguagcaagaaaacugaguuccucauacuaggauuuuggccauuccuucaaaucuaucaaauugccuggaaaaguaguuaggugauccuuuuuaaucuuccauuuagucuucucccucugucuuuguuacuguuucuucaucuuuagauguguauguguggugugcacacauguucacauauguucuuucuuccuaccaccccaucaguuuaugcauauguuuuuaacuguacaaauucccuuggucagauuuuugcuaaaagcaggauuuuuguuuguuuguuucuccugaaauuucccucauugaaaugcccauuaucacucccucucccuucuguccucaaaaauaaucagaaugugcauucucacuccauccucucauaaucacuuuagugugauagaacaauuucuagguuuuuaugguaggagagaggugcugaccugaaccaucaccaucacaaccaucacgugagcaaagucaagcgguucuguucacaccucccacuuccuguguguaaggcucugcggggugcugcaaggugcacugacaccaggauguggagccuguggccccaaggugcuuccagucuaggugcagagcugacuagcuaacccuaccagugaaaguggguacaguucuaaugugagugggaggacagaggaaagcacauccccuuggugaggggauuguccuggagggaacaaaaaaccauuuuccaaagacacaaaacugugcuggaggugaugaaggaagugacaggaaaugggaggcuuucguggagagcacagccuuucagcccuccauauugccuugccauacaaucccuuucucccuccucucuacuucuuauccccaaguguagcaacuccuuaguuccaguacccaccaguuagcucacucugcuagaggaauguuugguguucaugagaacaaaaugaacauucuaaucucuugccgaguguugcuccuuuccaaaggccugcagucccagcucuuagauuacaaaagaggcccaauuguuaaaauaaaaccugcaguuuauggggaaaaggggcaaugguauuuccaccugggggaauaguucagcaucuugccccaacagaaagaucugcuguguucugcuuaguuuucugugggugucucaggauucagcagcugucaccaggggacagcaaugccauccaucccuguaugaggugaugguucagaugacauucagauuaccugccugcgacacuucugcaugcccuaguggcagauuuaaagagacagcugagccuuucuuguggaacuaagauauaagcaagcaaauuuggguuuaguuuuauuucccuagcacaugaauauugaaaguuaucucuuaaauaaguugcccuuggcuugaguuuguacccaccuuauucagcagaauaccccuguuccuaacuucuguugaggcaaccagccuauagcugcaagagcucuucccuuguccuggcccugggcaaaucccaggagagcauacuuauaagacagugggccauagugaaaccuguucuauggguguuuacugcuguagucuugaaggacaugcucuugagaguccccuuugcagguuugguuuucuggcaaaaccaggaucauuugcacuuucccuagagagcuggccucaucuccaugucccaucuaggcccacacaugccugcuugcuuggagauagccacauccuacuuuuacugggucaauauauacccuaucagcuagcuccaaguuucugcugagaacucgcucugcagggugcuagcuagcuuuggcccuugguucugguaauccuccacucacuauacagugaucagaaggaaaucucugaugcucucccugccacugcaguggaaauucacccucuagagugcaugccaucaugcucaguggggucuuuuucauagcucagguuucuggcuucuguucucugaauuggucugguuccagucagugacaccaaauguaccuccuuuucaaagaauaaguuucuagugucagaacccucucuuuuaucccuaaucagcagcaauaaauaguggcuuugccauuuaaccuuacaaaucacaugaccagauaagggugggagaaaugagccuugucuauggugcagucccuugucuaugaauuggagugcagaggucucuccagcccaggcacagggcacugugggaagggaagcacugacacuccggcucauguucauuuacccaacaaacauuuacugaguacucagaaugaaucagucaaagcuaaaugucagagcagugugaauguugauguuuaaaucagcaaagcgacacauagguaauaucacugucuugguagagagugagccuugacuacuagguugacauggaaaaagcuagccccuccaugccaugacaucagauuuucacucuguugguagcuuugauaugucaccaggccaaauauagagaugcugcuguaugugcaguugauccucagaaauugaaauuucaaauucccuuucaggguagaggaaugagggauugcccucagaaagccauggcagaugacagagauguuugaguuggcccuuuccagaaucagcagguguccccuuagaaucuauaacugcacaaauuuagcccucagcuucagucaacauaguuaacaaagcagaaggaaaccauugagcagaagaaacuguaagacgcaugucacccaugugcauguucuguccacuugcuuugucucuuaguucugcccuuuccaguucugucagaccuaccuuaucuugacuuucaugcgacgggggacagcugaggccggagguccauuucaccaaugugacucacacccauuuuuugugugccuuuggcauacaggcacagguuucaaggcccuuugaggagaaaggacaguauguagaagacaagagggguuugacauucuggggugcucuuugcuguaguugucuuugcuuucuaauauuuuuuguuucucucucucucucucucucucucucucuguguguguguguguguguguguguguguguguguguguguguauguguguaugcaguugugugggauagguagguguacaaugggaugaacauacccacauuuaugcauucucucuuccucucuugccucccucccucucuuucuuuuugugugugcauguggaggccagaaaucaacuucaaauaucaugccugccuuuuuuuuuugagacagagccuggaaaucccugguuaauuagaaaaccccaggauccuccucucuccucccacaugcacugggcacugggauugcaaaugaggauuaccacuucuggguuuuuaucuggguaguagggaucaaacaugaagggggguauagaacccugcauguuuugagacaucuuccuaggcauuguuguauacuucuuugugucugucuuucucaaugaaauaaguauucuuuacuuguugaaagcaccugaaguuauaaguguaaaacaaagcacuauguggauacuagcagaccucagaauucaauuccuugggcugacuaguaacuaucuacuaacugacuaguagcuaucuacuaacugacuaguaacuaucuacuaacauuuccuugggcuggcuaguaacuaucuacuaacauuuguugagcguauacuuuggcaaaaggcaccaacauaaagcccauccagguggcucuguagcccugcaugggcucucuccugcaaccuuugacaacaccagagacaggauuggaaaacguaggccacccaggccagaaacaggcaaugaaagcuuagcccagccagggaggugaggauucuaggaauuccaggggugcugagugcuucugagaugagccuugguggcucuuccuagaaaagaucuaagcuaguucuuccuaggaacauucucagugagauacacacagaguggggaguuugucuuuauuuuuacuucuuucucuguuuaucaaaugucaagccaauuuagcuuuauuuaagugacuuuaugucucuguuuguguauucuuuuuuguuuguuuguuugguugguugguuugguuuguuuguuuguuaguuuugagacagaguuuuucuguguaucccuggcuuuccuagaacuagauuuguaaaccagacuaagccuucaacucagagauccaccugccuuugccucccaaguguugucauuaaaggaaugugccaccaccaccaagcuguauucuuugcuuuguuuuaccuacccuaguacauacaaacaaacugcaaggcuaaugucagaaucuaccuuagaaaucugagagcuggcuucaguccaccaauacuacugccuuuguguuauauucaguuugugucccagagucaacuuuuucuuccauauguaagcaacagaacuagaguuugauuuugaugguguccuuggcagaaguguaguagcccuaggaaucaaggauuagcauagaaaauacauguguauuagugcacacuuggaaaaaaucucauucagagcuaagaggcucacugccaauacaaauaaaaauagcuaccccucugguccuaacauugugcuggaaauggccagugagaucaagaaagccagcguccuuuggagacugucccaguguggcaugagacagaugucaacauguagaccaaacugugauuaagucaccuucccauauggacacaaggcuguuucaaugucuugagcauuuuuauuggugauagccaaaaccaguuuucagcgagggucucgaaggucuuaauccucaucaucacaguuuuaugagcauugagcaguggccccagauccuacauggagaucucugcuuuguguuuucucugucugcuguaucaagcuguuaccuaaaggcuaaguaggguuuccucagcuucccuucuggacucaaaaccuacuaucaaucucugcugugaugguucuucagcucauuagagcuggagagugaggccaaaguucaagguuuccagcaguugaguugguuccaggcauggcuccuuauaaacucacauaacgggagguccagguggauaucugccaguguuuagaucuuagacccucacccauggguuccucuuaccuucuacucauccccuuaaucaaagacaaaucaguuccuccccuaccugguuugcugaagaaguuguaucuuuuucaaaacuaaaucccugguuggccugagacuacccaggccugcaucacuguuuaaauccccaguugggccgcccugugacuuccuggacacaguuugaacucauuucuacggaugcuggacaguucuccuggcagccuuaccugugauccaagaauauucauccugagugguacccuaagguguucucuagucuuuacccugaaggcuguuuucuacaugagcucucguuccucucagauuugccuucuccuucagauuucuguugcuauuuuuugggcccuauguggcuuugauggagucccaugccuccauuccaggccaccagucucagcaguggcucagaacucauggcagcauugccaagucuccuuaguauugcaauagaaacauaagauuuaacaacccaucugaaauacaauuuuacauuuugauugcuucugccccagccauaucgagguuacuuucaaucugcauauauuugugggaacagacuucuucacugcaguucaauuugaguacaccuuauaauaucagugauuauaaaauaccagggacuaauagaguuucuugcuuccaaggaguucaaacugcuuuauaauucuacuggccauaauuuaucuucauaaguuacuauacagacaagaggaaaaagugagauuaauaaucacauuuuauagaggguaaaauaaaacuuggagaaauugaguagcauuuucccagacgugcucagcucuccccaggcucucugaauggucugcaggcugaacacuuacaucagaaaugcaugugaaccuugcccuugcucugucauagacugugggcaagagcaagauacuugacucugggccagugguuagccaaggacacuggaaugagcagggugugugcccagcuccugcagcacagaccucugcuacaaugaauguugugaguacacacagggucagcuccucgauuagauccucagaccucuucccuggguuuuguucccaggguaucacucuggcaucucaacuaccauauugauaggaagacuacccgaagggcagagcagggcagggcagggcagggcaagugcugccuucagucccugccuuguagcucugugaaugcuauugccaucugcauuagaccaaauaaguagaagacggguuauaggagggagcucugcuucuacagugagaugagaggucuguggcugugacuucuaaugugaagaaaaaagggugucuuucacaugaggagaaggaacgauggguuggauccagagcaccaaaaaagaacaccagaaaaaggguauucuuuuuguuugauuacugccauauagauuaagucagauaauagguaaguuauuuagaauugcuugauuguccuagaacuuuugugagguacuuccugccaugcucuauuuaaccuucuuucuggccccuccuucuagaaugagguauauggccaguacuuaaaaaauacuaggauuggacccaugugcacugggcuccuggcugcagucuucacaccucucuuggaagccagccucugcagggucacguggucuagacugaucgaagaauaacuuauuccuuaugugcacugucaagagagcaguggagcuaauaacaaagcuucagucacugauguguugaaagugacaguuguuuuucuaaccuccccuagaaaauggaauguaugguaucuuaugagggucacauuggaaaggaauaaucacucucuuucuuaggugcaauuuugucugacacuucauguauguguuuaaaguauuuuugaugccccaaaauaguagugagagucuuuaaaaugguugcaugagguggcaccauggcaguguaaguauagagcagcugucagcugagugaucugcagaacagagauccguguacccaggguccuucuuguacuggcacaacucugaggacagaaacaaccuccauggaaugugcccucaagccuccuaaaucuggaagagccaaagcagagugucucuugucacaguguugccaaggugaugucgccagccuccagagggagcugcugggugcugcuguuggcacaguugucccuucuagaaagguauaugggaccguccacagccuaagcacuggugcuacagcagugacaugggggaggaguacucacugccuugugcguggaggcuaccccugccuugccagguacaagguuagcucagaccucucagcucuugucuuuccucgcccagcuugcccuucuucauguaauauguacacguuccauguaguauaccugcgcugucugcaugaagcugccucuaacuagauagugaccuccaagggcccccaggcuuugcuuuauuguuugcuccugagccccagcauagugccuggcacauagugacacugaauggcuaaacauuugaauaagagaccaagugcagcugaagccaaagcccaguguggagugaccuggucaaauaugccucaggaaagagugggcacuucugcagcuacugacagggaagcuaaacacacacacacacacacacacacacacacacacacacaaaagaacuuuagaauugaguuuugagugagccuucaugaacucagagccugggagucuagcaucauaggaacaagguauguacaaaaucacagcagaguacacauauuuccccagauugcaggcauccaaagagagaaguggguucuuuucaaauaaaguuuaucuauuauuauuagugcugcgugugcacauauauacaccauaccaugcacauggagucagaggacaacuuaguguaaauucccuccucucaccuuuaccuagauucuagggaucaaacucagguugcuauaaauacagauaccuucacugcugagccuccucacuagccugacaaguaucuuucuuuccuggggccucaaacagcuacugaaagagcagcgccaguguaccuagcuuggaaucuaagauaaaugagacccagaccauauucuuagagauuuaaaaagagacagauaggcaaauguguuguugaugggucaaaaaugacagagguguuguuguuguuguuauuguuauuguuauuauuauuauuauuauuauuauuauuauuauuauuauuauuauuauaaacuacaacuuaaccaggcauguggugcacacuuuuaauccuagcacucaagagguacaggcaggcagaugucugugaguuucagagacagaguacacagccagccagagcuguauagugagcuagccaaugagacgucucucccugccaugaauaaaaggaaggaaaacaagaagaacuuuuagugccauguuaggauauaagaagguauuuucucugucuuggguguaauuauuugacacuucaugaauguucaaaggguuuuuaguguccuaaauaaucuaaucagagagauuuuuuaagauaguccuuugggggcagcagaugcuuagugaauaucucuugcaccagucuuucguucauguuuacaucuugaucuacugguguagauaguagaugcaaagggagcagcauauauuugaguaaggaagacuggaagggauaggaagggaaaaaaauaguucaaaaauagguuucauaugcacagagaaaaggaacuuauccuuugagacaugaaagggaaggcugagaccaaaagcaagagcugaguuaguaacuauaauagaagcaugaauugaggacuacuucauuuaccuaguaccagugaaagccgagcuugguacaacuucaugguauauuuuagcgaucuacuuuagagguacagugacaccccaccccaccccaaaauaaaaaagaggggugaaaucguaacugugagagaccuuggcaccaauuucagguuuccacacuucaccuuucuugcugucagucuuuggugaaccaucugcagauaaacacacaggcucuccucccaucucccuugcucaggugucugugcaacugagcaugggcuggcacacacaugccccuuugggccucagugccugcuaucuguagcugaguccuccuguaccagggcccagacuuaguuccuugugaagacuuaccccuucccucuccuuugucugcacugcacagaacucccacccuaacucguguuucacacuucuuauauuuaauaugguguauucgaucaacauguauguauugaccaaguggcaacuaaaugccaggcacugggcugcccucacgggcuucguagaggaagagagacaguaaggauguuauuggggagagugcuauaaggugacauuuauggugcuggagauggcaacuaacuggugucagaggagaugucuaugguggggacaauuaagccgagcugugaaagaugaggaggaagcuguuugagagccauggggcgagcacagagguggaagcaacuacaucaccugaagccuacugguccaggaggugcucaagguauucuggaaguugaaaagacacugcuggcaccagagccuguugcaguagaaaagugacuugaaaugacaguggaaaggcaaacugggucccuaacuggggaaacguugaugccugagccaugggagagauucauagauucugaguacagcgagagccacugagggcuuugaaacacaagcugauuggaagguuauugagggaagggaaaacaggaagcaccgggugaagaguugcugaggccaaaguuauaccaggggagagggagaagagggacucauuugagguagacuuuggaccggggcacguggauggucggguggcagggggauugaagggauuggaccuggaucucuugcaaagagaucuagggagccuagaacugaaaagacaguuuuaagaugagacugagguuuagaugucaaaucuaaaccugugaggguuggcaugauugcugugcaaaguuuccuagagcugcaaacaaggaccacaaaauguacugcuugaaacagcagcuacucuguugauguucaggagcccagaggaccaaagucaagauguuagcugggccuuaaggauggaggagaggauauuucccugccuucucuagcuuuuuguggauguagguacuccuugguuuguggcacauaaaugcagucuccaccucugucaucauauggcuaucuugucagugucugaggccaaauuucccuguccuaauaaagacaccugucauauuguacuaggacccaccuucuaugauacagcuucaucuuaacuaauuaaaccuacaacaacccuauuucuaaguaagaguccaacauaccugcuuuauaauacuggagauugagcucaggacugugugcauacuaggcaaguacacuaccccugagcuauaucccccaacccaguguuucauucaggauaaacacaaaaccaugauagucauguaggggaagaauagaaagaaaagaagaugguacauagagcauuuggacaaagaaggaggaugcucuaguaaaggguauggacaggaaaggauauggagaggcaagaaauuuggguaugggaaaguggcaccuaggaagccaggccuaacaaagcaggagcagugggcaguuguauagaagagaggcagcucucaagacacagagcugagaugcugaccaagacuacgacagugcacaggccauccugaucccucuaguguggcacaugaguguaggagcaucucagacaagguuaagaggcgggaacauuuaggaggccauugcucugagaaaugagguauggaggaagcagauagucuugguaacacuuggagaggauuaaggaaagaugugugcuugaggcuugcuucuguuuauuagcuuuguccuugcauacuguuuuguuuuuccaaagugguagcugcugaaguauggugugugcugugguacaugccuucucaugguuguguuuauaucacacauguuuguaaucuuuugucccuugauuuaguguugccuuaacuccaguuccaagggacuuagugcccucuugccccacauuugugacauuccuucacacagaugcacaugaauaaaacuuaaaagaaagacuuuguggucugaucuugguuaccaaauacauguguacuuucucuuuaaaaugccuuugaaauuucuauguggccuugucugucaauuacagagacauuagcuccuacaaccaggaguggacuguuuauaauagaauucugguugacucucaggaugaucuaucuauucaugaaugggguucuauaguuguaacauuaaagaacuuuuauagagaucaaccuuuuagacacagaugggaaaaguaauagcaguguuuccuugaagaaauguaauacaaaugccuaggacaaagaucauugggaugaguggauuuuggacuuaauugccuuauuuuaagugagagcagcuauuuuuacauauuccugaaaguagaguuuaggaauuccuuccuaaauauuaggcaaucuuuauaacgaauuccagauguucagcuacaaaagcuaacuuccuaccauuuguggugugguuaucaggucaugagcucauguggucagaaugugaugguggugaugcccacagacaugcuucacuguaggucuguuguacugccacccaccgacccuuacucgaucggcacuugcaagcuaacuacauccucuucuaacuagauaacaaagccaaagaauggagagucucugcaaugcagaccucucucaagaccaaagaccccacacagguaccccagaauucauucuuccauucuuucucuccagggccccugagaucauccuugguuugccauucugugaggcaauugacauguggucccuugguugugucauugcugaacuguuccugggcuggccauuauacccaggugcuucugaguaugaucagguaggucugggugacacaggaauucucuaugugacuucacucuccauccagaaaaccuuagauuaccauuuacuuagaaccugccuuauucacuuauuaaacuuauccugacuuccucucucucucucucucucucucucucucucucucuguguguguguguguguguguguguguguguguguguuucuucuuucuuuuuacuucuuguuucucuaaaauuaauuccauuuuucucaaagccaucaguauaccauauguaccaugacaggaaaagcccugaccucuuucucaucuuuucuugcagauucgguauauuucacaaacacaggguuuaccagcugaauauuuauuaagugcagggacaaagacaacuagguuuuucaaccgugacacagacucaccguauccuuuguggaggcuaaagguaggaaaaacacucccucacuucuacugauggccuaauagugaaagaaggaaagacaaaaaugagcuuuugguauuuacaaauugaugacuuuaaucuagccagcaaaauggggauguaggauagaguugugaauacaagguguugcaggaucugaaugauugaaaacaccugcuuccuugccucacugcugugugagagacugugucccaugggaagaccgcugaauuucugggauuuaaucucaugauccuucaugucugcuucgugcuaaacagaugaagcagccacacucugcucuuaaggaacccacuguccauggagaaacaggaccagugccccaagcucuaggcuaccauauggacuauccucuuccuaaaaggaaagaacaugggaaauagcgugaccuaagugagccaagaaaaagccaggccagggccaagggcagggagcaauauuugugcugggcccuguaggguacagagggauuuuuccaaggcagggaaaguagccugcaaugcaaaugucacaaaccccugggaagacagcagaucuucauccaggacaauggauaccauaaacucuuggugacuucaccuuaauugaaacauauuuugcuuuuacuuuaacugugucuuguaauuaaaauugacauacuuuuccugggaaggagauaguaauaaagacuuaagucuguaguaaauucauuuuugcaguuuugcaauuggguuuuacuaaguuugguuugguuugguuugguuugguuugguuugguuugguuugacaggaccccaaucaaauccuaauacagcuuaaauauaauauguacuaucaaagcacugggauuuggaagcuaagcaggcucuuaggcuagaaauagagcaccugacauucaguaaguaugagaguugccaagguccaguaacaagucuucagguagaagacagacaacccaaguugauagugggggguagcuacuucgguguuuuaccaggacccucaucaccuguuccuugggguugaacugcuuaaagugugcuggccuuuauccagaauuaauugccuuagauccauugaugaguccaaaccaccuagcaaguagaaaaaguaguuuccuagccaauagcugauaaaugucuuugaaagagcagcauagaauacaagcucuggaaacagcugccacuuguaagcugggaauguuggucgucccccagaacuuuauauuuuuguguuuccauguaguaaaagaggagagcagucauccuaaugccugugguuauggaaaacauuuagugaguuagugugccuugaaacagcauaggagcuguagguguaagggauugcuaaguaaaauaaaauguuaaggugucacaaagggcucuggucuucccagguggaaucuuaccuucagcuuauggaaagcugcagaguaggaaggguguggucucauguucucuuuagagucuuugguaacuguaccagagugggcaugagugggagccuggggcggaaggaaggugagcuaguguggauggacagagaaaggagcucuuguguaggacacuuuccgagaaaccaaagucuccuccucugcaaagugagaaaggaccauggguggaagcagcagcccaggagcuugagauucagugaccugagcggugcugucugacugaccagguuucgcuuucuccgauagacaccagaugaccaugaagcagagacgggaauuaagucaaaggaagcaagaaaguacauuuucaacuguuuggaugauauggcccagguaagcucugugagugaauaugcagcacaggcccuuuaaaaaacaaagcaaaacaaaaaacagcugcagggcagggcaugccuucagacccaccacucugggacgcaaagcaaguggaaucucugagguugaggcuugccuagucuacauagugaguuucaggacugcuagagauauguagagaaacccuguuuuuuguuuaaagccaauaaaugaaaauaaaaaauaaaacccaccagcagugauauacuuaacuaugcucauugccuuugcuuaugaacaaucauaugacaggcuuaguaagaaaccauuuggucucagaaaccaacucuuuagaaaaaauagcuccauuguauugcuucuuguuuguaagguaguggccaaccuuacuggugcuaaaagggccugaauccuauacaguuuaaauauaauauguacuaucaaagcauugggauuuggaagcuaagcaggcucuuaggcuagaaauagagcacaugacauucaauaacuaugagaguugccaagguccaguaacaagucuucagguagaagacagacaacccaaguugguggugggggguagcuacuucgguguuuuaccaggaaccucacguucaccuguuccuagggccuugugugugcuaggcaggcacuggcuccagagcugagaccuacagcccauuggcauauuggaguugaugcucauggcucaguguguccauuuccuagggccuacauaacaagauagggugaacuggaggguauaagacaacacaauguauucucucauaguucuggaggcuaaaaccgucuggugucaguguccucaaggccacaguccuuuugaaggcccuaggggacagcauccauguguugggcuccccguggcucuggcagccucagaauuccuuacuugcagcugcaucacucuaauccggcuuuacccuccacauggcuguuaucccugugucaucccugcucccacugucagaucucugcuauaaaagcacugauuauuguguucaggaccauccuaauccaauauggccucauccuaacgugauuauaucugcaaagacccuauuucuaaacaaggucacauucauagcuuccacagauuaggacuuggauucagccuuuagggaagcccaauucagaccauuacacucagucacugucagcucacuagcagcgacuacagaccuuccuuaccuuuccaucacagauaauucgagaucuucagguacuuuuaguuagagacuaauccaaacucugagcaauccagaaugacuguuccuuuuaaacacugagaaacaaagcuguagcccaauaaacacuuagcacaccucuuagcacagaugaguguagccugguucugaguaaaguacacuugucagcugauuaguagcuuagauggucuguggaaacugaaauugcuuuccagagccccucuugaaaaaaaacaagaaagaaagaaagaaagagggggggggagaaggaaagagagagagagagagagagagagagagagagagagagagagagagagagagagagaaagaaagaaagaaagaaagaaagaaagaaagaaagaaaagaaaagaaaagaaagaaaagaaagaaagggaaggaagaaagcaagcaaacauugaaagcaaagccuuucagaggccaugcuaguagagaccugccuuugggagaaaaguccuguguucagcugcacucucuucccuggccagaggcaacugcagggaacacagggaccgaaaucauucuagucacagucagggaccaagggaagggugaugucauaaagaugaaggaagagggaacccaggcucuuuucuucuccagagguuguauacacuuuuccccaucuuuucuuuuucuacugcuuuaucuuagagcuuucuguguguguguguguguguguguguguguguguguguguguguguguauuguuguugugugcuugugacaaaacacauauagcauaaaaugucucaucuuagucuuuuuuuaaaguaaggcugaggagaauuaagugcaugcgcacuguuaugcaaucggccuccagaacccuucaucccgugguuauuuuuaauaaggugugaugaaagcugcacuucaccguggccaguuaaaacaggagcagcuuugugccuugacacugggauguaugugcaggugucaaccaugguggccucuuucugccccaaccccuaccugguaccugacucccgcagccauucuguuccuagcguauaagaggccaucacccguggacaguagcagcacacaggaccauggcgggcagucuacccucuggcaccugagauggggagcuugagaucagacgauauccuauggcucuuacucaccuguccccgcuuacuuccaggugaacaugacaacagauuuggaagggagugacauguuaguagagaaggcagaccgacgggaguucauugaccuguuaaagaagaugcugaccaucgaugcugauaagagagucacucccauugaaacucugaaccaccccuuugucaccaugacacaccugcuugacuucccccauagugcccaguaagugccuacuaugcuuguaccaagggcaacacuuaaaggcccagacaggaaauauuugaggcuuuguggcccucugguuccuacgcugcaucuccguucucaguuauagcugaaagcagcuauagauacagcacauaagcaaaaucaggaucuccuugucaucaaagcacuuagagcacuuguggggcgagguugggcugaagacuacaguuuguaccaaaaagaagggaaugguggaacauggggacuuuggggccagaugaacuuggauaucaacgcacaaagggaagugggcaaaacagcagugcucuaaagcaaucuagcaucagugccaaagguuagucccaaaacugucccagagugaacugucuaguuugcuucauuucuuuggcauacugugggcuguaccaggcacuggaguacaaugaggaacaaaguagacuguguacuuucgagcuaagccauggucuucagggaagaagauagaagacaauggcuguuaccaagaaaggaaugcgguaugaugaguccauccaacaaggagcuugcucaauaggccagaagacccaagaauauaaccugugaagggugagggaaaagaugggugugagaagucagggcacugccugugugaacucugcagcaugacugaacaccagaccuaggaaugggggcaacaugcugaggcugcagaagucagcgcucgagcaagccgugcucagggaggguuuugccuuuuaucagaagcucgaugcagcaguuaaaggacugagaagcaggugaauggcugguuggacucguguugaaugcagaucuaaccugcugcuguaucaguaaucuagaaaaaagugucugagaucuugcaguucucuuacuuagugacagccauuuccaagcagaaacuuguugggcagguugaaagauaaagugagagcagagaaauagacuacaggaagugagacugugaaaaggaaggaagaaaugagggcuguggagagaucagagcuugagaauggcugcucugauccauucuuagccugacugggaacccuuuuggggcucaaaugauccuuucccaggggucacuuaagaccaucuugcauaucagauaucaucaugauucauaacuauagcaaaguuacaguuaugaaguagcaaugaaaauaauuuuaugguugggggucacuacaacaugaggaacuguauuaaagggucauagcauuaggaagguugagaaccauuggacuaaaggaaauuuuugaagaaugaggaaauuuaagcaaauacuaaugggaagaaucugguagcaaaugagagauucaaggcaaaagguacuuacuugugaguaguuucuguugaguugguguuuauugcugaguggagagauggacccugucacuaaaagaugauauggugggagagacgugggugucagcaggugcacaggauagcagaggaaaguugagggaguuccugucagacagcuucugucucagaaguagaugaugacaucaucuguugagaacaagguggcuuuacaaugcagaacaugauaacugugguuggagagguggcucaguggauaaagcauuugucauacagcugugaggacugcuguuggauccccaucggucuguaaaugucagguggucuaccuguaaacagagcucaagagguaaagauagaggaucccaguggcaaacacgcuagcuagacuacgugaaggguaaucaggcaaggcacucagggaagccacagaaauggcuccaugguagcucugcuuucccagaagaucuggguucuagucccuacaccuacauggcaguuguccauaacuaccauaacuuuugucucggaauccagugcccucuucuggccugucugaacaccaggcaaauaugcaguacacagacaaacacauagcaaaacacacauacacauaauagacuuuuaaaaauuaaguuaaagcaaggaaagauuugggggcuagagagaugacucaacaauucagagcacuugcugcucuugcagaggaccuggguucagcucccaguauccaccucaugcagcucacagccaucugcagcucuagcuccagaggcuucaguggccuguggccuucucagacaccugcacacacaugaugcacauaaauucaugcaggcagaaacacauacauaauaaaccuuuuuaggaauaaaaaaaaaucaugucaaccuuugacuucuacaugcacgcccacguauccacaaacacgaauaugcucccacacauauacacaugcaaaaaggaauguuaagaaagaaacagagagaaauaagaaaagcgauaugugagggagggagagaggaaggcagagagagggagaggggaagagagaguguguugguccugguaacuggagcagagcaugauagcaaacuaaccagagaaauauaggagaaaggugggugugcgggaauacacaagugcuguaauccuaggagagggaaggaagcggguagagcuuugaacauuuggguccgagcauaaauugaugguguaagugaaggcauagagaaaacaguugaguuuguccagguugaauugcugccaaguugcucagagagaaugacaaauggaugaggaaguugaagaugcuggugauauaguaauuauaaucccaaauggaagcuacugaagguucaccuaagagaaaggaaacucaauagaucccaaugaguguccucugcucaacucuagagagaguuaugauaauaguuauagucaaaugcaccagaaggguagggaaugaggccagggaaacagggugcuugagcuugucuuaagaaacagguccagggcugacagcccaaggaaggaaugauaagggugagagcaaggucaugagguaggaaauguagguuuugacagguuaucaggauggcuacugaaguagucaugguacucagaaaauagcuuggagagaaagaccaaccugguggaaaggccucugggaaugagagaaagagaauggguuuucugugaacgggaagugggugauaucaccuuaaccuuagcugugaugcacugggacaugagagaauagaucacauccucacauuucugcagggacagcagcaugcucaggaaaggcucuuucaggaccugggguaaggacugcugugaggccacagucagcaacguuaugaccaaaauuagauuugacugaguuuccaggcuggacccaaccucucccagcuuaacaagugggccacaaccaccauaaaguguaucuuuuaagucaguucuuuuccauagcaguuagugaaguaagucaacuugcacggcaagaccagacaguaucucuuuaauucagggaacauuugaaacagucaaguccuagugcaaagagggacugugcacacaguccuuccaaacucaaaguauaacaccuaugcuguuucucagcaggaggcaguuaagaaggugucagucugucccccgggaagaaaggcaaauccccacaaagccagccuuucuaacuuuaggaauaaagaaagaugauagggaaacagugaggugggggauuagggaggcagaugcuucagagagcuccuauuggccuucugcccugucagucacccaaaaccugggcacuuagauaagcagggcucuguucuuuguuuaguaaggaagcuuccguaguguguuucacuaggagcaauggcaauuuagaacuuagaaggucagcccucgggaaaggcagguuaccccuaggccuaccuaagagugggcugaauauuuguagguucccagaagaccuugaagcgcucuagagugggaccgagccuucaggccuacccagccugcuuugggccccacccgcgggccugggcuuaagcugcucuagcauaagguuuugcagguaaaagcaaaaccacucauuucucuacaccaauauuuugguguacauauuuguaaaagccaauuguuuuauaaacuaacccaaaguaaaaauguuugucuuaucccaacagucaaauuuuagcccaguguagggaggaaaaaaaaaaaaaagcucuauagccugaaaacuauacauugaaccaucauaaaaucacugaaugcuuuaaaugcaucccaaaaaaaaaaugcauccacaucauuuuaucaucuucagcucaauguaaaagcaugcagcaugcacuugguacucaccaggaccuucaggcaugcuguuguuuaccaaugagcauguuuucucuucucucuaggacuaccaguuuacucaccaugcguuguguaucgagcggccaguguaaauagucauuaacuuagaaagaaguaggacucucugggucaugaccagauucaauuucugaaauuuggaauguaucuuucaugaaaauaauauucugggauagccuacaaacauccauuuuguccaaaauagagcauaccuguaguauacagugauagauaaguguuaccuuguuuuauccaguuauugcaacagacauuuuaaaucauagauuaaaugaggcuuugucuuaaauauuagcacuugagcaaaaguggccauagaaacagaagaggcagaagcgcaugaggagcagcauaugaagugaguagaacacaguggaugcuuaggagcuggaauggcagaugccacuaaaggccuucaagaggccacuaaaggccuucaugccgggaccuguacuccuuuaaugccuguguaauuagggguuaguuuugauucaggaagaaaauggaggagagaauucuacuucauggaacuagacaagaauuaggacaagaaaggaauaaggaaguuaggaauguguaaaagagaaggaggggugugaauugccaauuagugauuauuugucuggcacauuaucugucuuagaccuuuggcuucacuuguaaaaauggaacaaugauuuuaauucugucuuguggaugguacaagacugaauaggagacugcaaacacauaucacugcucucaguaaaaauuaguaaccacuuucauuguuuucauuucgugacagguuccagugagacaagucagccuaaguucaugacccugggugggagaauuauuuggcugacccauagauggugcuaguagcacaugggaugcuagaauggugagaggcuagacauguugucccuaaggaagacagaaguagguuguagcagcuccuaauguccuugguuggagaguuaaucucguuggucaagcacuacacuuagaaugagcagugagaaaagguaaugggggggugggagggggguagaugcagugaagcaugugugugauaagggagucuguccauccagggcagauaaaggacaagaagacaaugggaaauuugcucacacagugcugacaguucagcagcacacuuggggaaagcugggcuauuugacgcuaauguggauauuuacugauuguuuugcuuacuggauuaaccauucugucuuuuucuuucucuuuucucuccuuccuccaccucacccucuuucuuguccaugugucucugccuccaccuuuugcauauauagugucaaaucuuguuuccaaaacauggagauuugcaagcgccgggugaauauguaugacacagugaaccagagcaaaacaccuuucaucacucacguggcccccagcacauccaccaacuugaccaugaccuuuaacaaccagcugaccacuguccacaaccaggugaguggcaggcaccagggaaagguggguggggcuaaccaucaggacucagauaucccagauaucccccuccaaaccccagcagucuucccauguuguccuuuugggccuggaagcuaaagugccugcuuccucagccuuuuuuuuuuuuuuuaaagaagccaaggggagacguuucuguuuugacucugggacugagauggugccucuucccguuuuccucugagcaaauguggggaaaaaagccugcuaagaaauuguagaaccagagcuagaggagucccuccuugcacccuguguccaugcugucuguauucaggagaggaaaaaccuguucauucucuaugucauagaaaagccagcucauaggucugucaccggaguccuagcagcucuucccaagggauacaggaagcugagcuucccuucacguggauuuucaaccuucugcagauuggcaggcucagcaacauaggacgaugucugaaauacagacagaaaauacacucagaaaagagcuacugaaugaagacucuccacaaccugauucacccaccucuagacucagaggcuugaaccguuacucccaucuuccagucuuauaaguccccaaagaagcauucccagacucuccagcccuaauaccaaucuguaaugacaacaguguccuuuguguuguucauaccucugcauaaggacauacaccuucagagcagaggaauaaguauggaaaccuacugugugaaugcagcagcuggcuguccacuuuuguuggcugguccucucccaucacugaggagucacuggccccugccuucagcacugcucuuauucgccgggcuuuauuggccuguucccucuuagcuugaauucuaguugcuaacucucucugcuaacucucucugcuuagacugagugccaucuggaaucugcugcccccuggaggccaucaguguuccugacgcuaucuguccagugaaaagcucacacuuagugcuuagggucaaagacuuuucuuaccagcccuucaacuagcccucaaguuaaggccuuuccaucuagagcuucucaaagcaaccacuggcgcuuucuucauuaccuugaggcuuguuuucccaucaguccuuaggagacucuuaauccuaacgcucuaaccucaaauucuucguucccaucugccaucugucccuuccaauaccaaucuauguaagacagcacacaggaacgggcacuccucagaucauguaugaggucagcugacucccccuaccccaccagcccuucuauagaucucuuuauagccaucagacugaggucuacaucagagcagcccaccuccauguuuccugugauaugauagccucacauccgucccaaagaguaucaccaaaacugaaaaucacaauggcaggucccaaguaagggcaccucccuucuccaugacacugagacugcaagguugcuagguaggaccagagugaaaaaaaacggcugugaacuuagugugauguaggccuaagcauugagaagaugaagugcuguccuacaaaacuaagauccagagagcaaaacucuccaucaucugaacuuggaaguguuaggcccuaauuagauauaucagaaaaacaaauuauuuggauuauaaccuagacuuaagcacuaaggcaugcuuccccuccucugauacuauuacaaaguggccacacuucuggcaggaagcauugggucagacuuuucucggcauggcaccauucaguccucccggcauccauguggaaugcauauugucacuguccuuuagaggaagacacugagauaaagugguuaauccucuuaacaaaggcuauguuaguacauaugagguaguuuggguuuggacugcagcagccuggugucagggucuguacccuugaagcacacacacugacucacagaugaauccuguggagauccucagccaguaccuccuagacagccucugcucucuaagugcaacaaaacucccuuuguacacuaguaacccagugcuguguuuacuccacgggacccuggaguuuugcucauccugaacacugaauguuuaaaacaacaaaauucaccuacagauugauguuaguggaaggauacagaaugaguucuuuguugcucuuaacauauauccaguagacuagcacuuuucaaagugcucacuaaucuguaauuguuuaugucucaagaaagcugggccaauacaucauaauuucuauguacuuucaaaaaauauuaguaacauugaguagggaguccuuccugcguguucuugguuuaauucuuaaggucagccucguuauuaacauuuccaaggugucuucuuuuagggauauauccuucuaccaagaauuuuaacugaacuuauagguuaggcuuacauccuguucuuagagaugucaacaauugaaaugucuauuacaacuguauccaagaaccacuugggccuaucuuugcaacauaaguuaccagugaacuuauuuuuuucuucuuauuucucuuuguuauccaaaacagcucuuagaaccacagaggacaggguaaaagucacccacaccaucauacauacuuucaucagcugaucccuaagcaggaucagaaacugagggaaacggucaucaugccuacuggucacucuggggacuggcacucauaucaugacaugaguuccacuccuagagaagcaguacaugagcugaaaacagauccagauccagguuacacacauaaagucagucaggcagacaagcagaggaccacaaguccuccccuacgaguccuucucccaaggaggcaucaguuagggugcugaccacacugcccagcacacuguggcaggcguugagccacacagucacagauuacuguacaagaacacacaggaauagcucaacucuacugucugggaaaguucugcuuuggagcccuggugccaaggcugaccccaaagcacagaggcucagagauaacucugugggccacaggauuccuaugagaugaauagccuauauucacaguaggcuaggaaaacaacuagacuaggaagguaccuaagggucuauagaaaacaaacgguaccaggucaagaugcauacacugcacucaugaggcuguuacuggaauuuuuacccccauuuuuuauuagauauuuucuuuauauacauuucaaauuucaaaugcuaucccgaaaguucccuauacccccccccccugcugccgcccugcuccccuacccacccacucccgcuucuuggcccuggcauuccccuguacugaggcauauaaaguuugcaauaccaaggggccucucuucccaguucuggucacuaggccaucuucugcuacauaugcagcuagagacaugagcuccagggguacugguuaguucauauuguuguuccaccuauaggguuguagaccccuucagcuccuugguuacuuucucuagcucccccauugggggcccaguguuccauccaauagcugacugugagcaaccacuucuguauuugccaggcacuggcauagccucauacaagacagcuauaccagggucccuucaucaaaaacagaugcuuauguacaaagcagggugcuaaugcguaaaguggucuuuaagagagaaugauucaaggcuggagagauggcuuagugguuaagaacacuggcugcucuuccaaaggaccuggguucaauucccagacccauguuguggcucauacauaaccuguuguaguaacccacaaguacuauauuuacuggcuaaaaaaaaugugucccuguguucucacuugucaguugcugggucagcacaggcuagaaggauauguaaaugucugucucuuccucaccugccuaaaacagaaaggcaggcugcuguggggauagucacacagaccucagugcugagaggcaacccagaaagugggcuggguaucguccugcugcugacugauuccaacuggaggaguaaagaguguggccuucugcagaaugaagagcugguagagcuggggcagacugaccaggcagaaggacagacacaggagacagaaggaagagcaggagcaggcagggagguagagcagagagagccacacggagacagacacaaugcagagaaguuggcuuaagugagaggcuaacccaacugccccaacaaacaggccaguuaaaccucaagcgggacccccgaguuccccucaguaauaaccaucaguaauuccaguuccaggaaaugcaauguccuuuccuagcuucugugagcacuaggcacauacaugguacacagacaaacaugcaggcaaaacacccauacauguuuuuuaaaaauuaaaagagagaaaaugauccugugcccaacuacugaaagagaaguagagagcagggacucacuggccaggggcuuacagguccugggcgccagagaacaagaagaaacagcccauuguucuagggauguuggaaggcagaggcauggggaacagugacugaucagaggaugggaaagcccagucagaugggaagagauuggugccauggccuccagcgggagacccucggggccugagcucauagugucugagaugacaguggaaaugugguaagggagcugccaggaagaauaaugguggggaaaacuggagcuggguguugucaucaguauagacaccggcuccuacgugugcaugcauguccccaccauacuuccaggaggcacuacagggacugcugaaaaugcacacacaguuaaauaugcagcucaaaaucuaaaaaaguaugccauaggaauugguaauaauuuucaaauaaauguguugucuuaaaccaaaauccagcacaaaaucuaaguauaaaaagcaaaguaggacuagagacauagcucaguaguggaagugccuaguguacgaaaggcucuggguuuguuugauuucugcagcaccacaaaaaaauaaaaagaaaaagagggcuugacauuuuuaugaaauuugauguuaacuccacuugaaauucucuuuacauuuguguucuuuuacaugggacacuuuccuuuuaguuucuaacaaguuaaaaguaguucccuacucccacaagcacccccccccaaauauuaaaguguauguggccaaacauaugugaacauuuacucagagcccaccugcuccuuuaacccuuaguccuuacaaccucuaaagguacaacuccuucuagacagcuucagucugaagccauugcuaacuucugccucucuuugcgugaagaaggcuaaggagaaaaacaaaugaauucccaacaaagaguuugcuuuccuucuacagcuuuguuuucauuagaaguucaguuucaaaagauagauccugauauuugccaucuacugcuuuuacaguggcagcuccuaccgugggcuuagggugucugcacacagcacugcccuuagucugagcaagaggcuccuugcagacugccugggcuucccuucugcuacauaggcuuccaugcuaagaucuguuuacauaggacccaggccugaggaccaucuucaaugauuuguccuaccaagcauagacuacuuuacccaagggagaggagacugagcaggguuugugggcuggcugcauaguauaagugcaucugaaaccccucaaguuggaggagccaagcuaagacauggagaaggaggaggggcuuagcuuuuccugcccuccccagcaucacauuccacugucaaaucaaaggaauauaaaggcucucaaaccaaaccuacccagcugggaugaaaagagacguucauuaaacaauuuuguucuguuguuguuguuguuguuguuguuguuguuguuuguagcccugguaagccucaacucaguauauagccaaagaaaaccuuaaacuucugaaucuuccagccucagccucuugagugcugagguuacaggaauuugccaccauggcuguuuuuaugcauugaacccaggguaccaugcaugcuaggcaaacacucuacugagcuacauucgagcccccaaccagaugguuuccuagacuaagcuaacuucucagaagugaggggugugggucccacagacaugaggguucagcuggauuccugccccucuuuuugcuuuuuuugcucuuugguuuguuuaacucuccuuuaaauucauuuguuugcuuuagauucgugucucccaacauaccgccucccucauuuuuuauuuuuguuuauuuuuguuuaauccccaucauuccuuuaggcucccaccaccuccagugccacucuuuccuuagccaaucccgaagucuccauacuaaacuaccaaucugcacucuaccagcccucagcggcauccauggccgcgguggccccgcggagcaugccccugcagacgggaacagcccaaauuugugcccgaccugaucccuuccagcaagcucucaucgugugucccccuggcuuccaagguaaggcuaaacugcuucuugcaggaccaccuuuagggcucuaacuccugcuucuuccuggagugcuccugucagggaagaaagcccuuccuaagaaugcugcuauugcugacuuuggaggcuggacucguauugccaccaaccuagaaacaaugcggcuuaugcuccaguaccaaguccauuuguuguuguucucagcaccugccagcacuguggcucuagccagcugccuguaaagaggcgcauugucuaguccauuguuaugcugaugucagcuccagcuuuccucacaugaaaugcucucuguacgguaucuguagaaaauugccagucucugacagccagcauaggcucacuucauguagagaauauaaauuugucugaauggugccucccaaggccaugaucacagagcuccuuuccuguggaccugaagcagcuagagaugacuguguaccuugucacacuuuacacagaaagcucaaggucacauaugcucagauaccagccauacaaccuagagggagcccuccaagggacacgauguccccagcacccuuugcugugacacucaguuaucuccauugggcagcaaccauuguuuuccucuuguaauuugucauuuuaacuguccugguuuuggccccacaugcuuugcuuuuggggaggggggagggguccuggguaguaggggacuccuuuuaacuuguuagaaacuaaaaggcaaacgccccaagacuaaguuguaaagcuagcuagcugccuggaagggucucaguguuucugucauucaccucccuccuguuccucgcgguguacugaacaggccugcaggccucucccuccaagcacgcuggcuacucagugcggauggaaaaugcuguccccaucgucacccaggcgccaggagcucagccucuucagauccaaccaggccugcuugcucagguaauucucuucuguguugcucauuuuccaucauccguguuaaugcuuucccaaaagacauauaucuuuacugacucccuggugaggagcagguggaauuugucaggacauuggaauaugucaguaauguucuaaaugauccccaagugaauuaccucccuaagugucuagugacaauuccaagaagaaauuuagauagucucagagucuagggaaauuauuauuguacguuuguaaagcaaauucaucuaggaaaccuagguuuuaauccuaaaucugcuagcaauucucaaugaccuaaggcaagucaguuaacaucucuuugccucaaauuucuuccuuguaaaauagaaguggcucuuagagucaaagagcccuggagacuaugcccucauuuguagagcugggaaaaccagacaugcagaagcugugggcugggaccuuccucuuuuauccauauagauggucugacuguagaauaagaucacaaagauaaaaaaugaaaauguagccaggcagugguggcgcaugccuuuaaucccagcacuugggaggcagaugcaggcggauuucugaguuugaggccagccuggucuacagagugaguuacaggacagccaggguuacacagagaaacccugucucaaaaaaaaaaaaagaaaaggaaaggaaaggaaaggaaaggaaaggaaaggaaaggaaaggaaaggaaaggaaaggaaaggaaaggaaaggaaaggggaaggaaggaagaaaaagaaagaaagaaagaaaggaaggaaggaaggaaggaagaaagaaagaaagaaagaaagaaagaaagaaagaaagaaaaagaaagaaaauguauaaaguauuacaauuuauacuaacaguacuggugcaauaccagaagucaguccuuaaagacacuugauccaauggcaaguguauuuucuuuaugccaggcacuuuacaguuaauuuguuuaauccucacaacauuuuugccauauauuugucacuacuugaccaacauagggacuugcugagagccauauagcagccaggugugguggcacauacuugucauaccauacacagcuuggcugaggcaggaggauugugaguucuagaccaggcuaggcuauauagugagucuaggccauccuacaccaaacaguaagaccugucuuaaaacaaaaccaauaacuagaugucagaaccaucagaaccaagacauauucuaaacauaugacacagauguccauauuuucccaccaucuuagaccacuucugugucaucuuucugcucucgggcaucaagauggcuugcccuguuagugucggcuuuauguuuaagugagggaguuucccaaaagacuuccccaaauuguucucagaauaguuuguuuauagaaguguuuuuccucguuuuaaguuauaggacgucaaauugcauaggucuguccuuggcucucuuguaguucauuggccucucuaauauccagucuucacuaacugugucaugguaucugguagggaauguucuuuuaaguucuucaauuuuuccuuagguauucuggucucuuuuaauuucuauaugcauuuuauuuuauuccauaauuuauccauaaaaagaaaaagagaaaaagagagaaagaaaagaaagaaaaggaaaggaggcaggcaggcaggugggcaagcgaacuuguggggcuagaaagauggugcaguaauuaagagcacugucucuuccagaggccccaggcucaauucccagcacccacaggguuguucacaacuccuacucuaggggauccaaugacugccucuucugguuucugugggcacagccacacacauauugcacagaaauauaugcaggcaaaauacccauauacauaaaaauaaauaauaaaugcuuuacauuuuguuauauugauuuuauuaauuguacucauuuuuugcuuuuagucuauaggaauauagcuaauuugggucuauuaggauuguuauguaguuagccuucuguuuuugugaauccuuuugaauuugccuuguagacaagucuuuguaguuccaaauaauaguuuuauuucuuaaucuuggauccuuguacuuuuuucuauuguuuauauauccugggccaaguagggcagucuaaaugauguuuaauaacagagaaaaucagggaucuuuuacuucugucuaguuugcuuucuaaaugaaguuguuaaagcuauuuccuacuacacauuuuauuuccucuaaguaguuaauagagacaguuugucauauuuuaauuuuaaguaaauauucuauauaucaaauguacuuucucaucuauuugaauaaccaugugguuucauucccuaaucuguugauagauuuuguaguguuaaauuauccuuauacuugugagacacauuauuugaucaugugcuucauaugauggcaugccuuucugagcucaguuugcuacuacugugauuaguaguuuuucaucuguguucauaaaugcaaaauagcaugauuugccuuucuuagggagcccuuaucugauuugagaacacuuugggacaaccuuuugggaaacuaccuuaacaguuaaguugacacuuauaggucaagccauccuugacaccugacaggagagagaugauauggaaguugucuaagauggagggauucuagacaugugucucuuuauucuuauaucuaaacugccucugcuuaaguggcagcaacacuagcaacugguggcacacaaaguugugugugccuuguugaaaggguaucaacagagaaccugucuuuaaaacaggcuugucuuuuuaaaguccauuguuauuguuguuauugcugcugcugcugcuguauaguucuguggugaggaguucagaaaagaccacuauaaaucaaagaagagaccugcauacagaucaguugagggucaagacauuugcucacccuuuaucugagugucagaaguccagaccagccucccagugagccuggaaucuguagauuucccuguauauuuucaaagauuauuagagaacuacacacacacacacacacacacacuuuuuuuuuuuuguauuuacacacuggauccaaguaagccaggagcagcucuguuagaaauacuaagcauggcuugcuagcuaacagagacaucccccauuguucaguugaguggaaccaacaggcucagcauuuccaaauuugucucaguccuuuaaucauaguguggagagcccuaccuccgacuuacaggaaaagaaucucuaguguuagaaaccuucaaguugauuuaaccuaaaucuguaauuggaaaagugaacaacugaaaaauuauguguauaggauuuuaauuggcauaguguuuauaaaaaggaacccuuagaagcaaguugaauauucuccacuagggaauuuguugaaucaacauagaguggagcagaacaaagaacacacccauaaauggacacaguagaccugugugucuucaacugcuaagacauguuucuuauuuuugaaaaaugaacgaauccuauccuguauugcacuggcuaaugguuggcuaccuuuuucuuucugucauuucaucugccccagcgugcuagccugugaaaauggaaucauugucuuuauguacuccuuguaaaggacaaaauuacaguaacucaucaaacuaaguggugguuauuuuuagaauaauaauuaaauauugaaauuuaggccuucauuuuucugugaguagauuucuaggcucucagacaugaaauuucugaauacuguuaugugcuuuaaauguuguccccaaauuugacauuguuuucuucuucugagcauuuaaagcacuuugaggacugugugaagguuuagagguggcccuuuaaauguaucccacccguuacuuucagucucuuccccccuuucucucagcagcagguuguguccucuacagagaaacaagccucugacacacccuaagaaugugcauauggcagagggcacaguuagggacauaugagcgaccuuuuacagaaacccuuacaaaggaaacccuugauacuuccagaaaagucugugaccuccacauuuccaagucccaaaccccaguuagcacgcaaaaguggggagauggguggaacaguucuugacucauuuuuuuucaaggagcaggauccaaaacucccucucacugucagaaucaagucagaaacuuucuuaauguuugauuggagaaggucaagguccauuguggaugcugucagcacuggccuggagguucaggauucuguuauauauugaggcgagaucugucucucuugugaaucuagaccugucuuguuauuguagucuagcuagguauuugcuacaaaaauccuaucuucaucucccaaaugcugaugccugccugacauuuacauggguauuagguauccaaacucuggucguuacacuuucaugguaaacacuuuacccacuaauccaucucccuagccuggauguuaauacuucuaaauuacucuuuaaauguaucucuuccccccccugcccccagcccucuguguguguguguguguguguguguucugucuacacugcuuccugagaaauuucauuuuacuuuuuuuuaaacuguaguuuugaauucuccauuuaugggagcuccuuaucuuguuccauauguacauaucuauaugaaguaaaaugcauauuuuuuaacucuauggaucuuaauuauagaccauuauagaucuugcuuuuguuucaugugaguuucauuuuauuuuugcuuuaaucucuuccacguuagauggaagcuccuguaaagcuccuuuaacugcuuguguauaguuaagacugaaacacuaaggcuggagagauagcucagugguuaagagcccugacuauucuuccagagguccuaaguucaauucccagcaaccacaugguggcucacaaccaucuguaaugggauuugaugcccucuucuggugugacugaagacagcuacaguguacucaugugcaugaaagaaagaaagaaagaaagaaagaaagaaagaaagaaagaaagaaagaaagaaaagaaagaaagaaagaaagaaagaaagaaagaaagaaagaaagaaagaaagaaaagaaaagaaagaaaggggggagagaaagagagagagaaaggaaggaaggaaggaaggaaggaaggagggagggagggagggagggaaggaaggaaggaaggaaggaaggaaggaaggaaggaaggaaggaagaaaggacugaaacacuaaaguacucaguacacugagaaagcugaggcugggaugagcuacugaccguggggcuccuuguggagugacuagaggcaagcccagcgucuuuacuggcagaguccuuauccucaaaugucauuucuguagcuccuuucucuugaacuucuccauuucccuggagaaucgccuagcuucuggaucuggggacaguagacaccugcauaccagggaucuggccugguuucauauguggauuuaucuuggaguaauucaaucugcuaacuuucuugguaauuguucauauguuguuacaccucuagaauauuuuuaacugucuguuccucauucuucuugcuuuuacaaagugauacguuuuauuucuuuacugacauguuagguucagagaaaacaauaauuugccauauuuucuagaccucucugucucaguuuacucacuuaagaaaugggaagaaauaguaguccuuacccuaccugcccaauauuaaguccaaaaauccauuccugacuuaauacugcuugacacacagcaugcuccagccagcauaguggcgcauacccaugguccuggcacuugguaggcugaggcuaggaggaucuuaaguucaagugcagucugcauacauagcaagauucugucucaaacaaggaggggcgggaagcaauauggcuuagcggcuaaaagugcuugccucaaaagccugaugaccugaauucgguucuugaacuguaaaauaggaggcgagaaccagaaucugacucucaaaaguugucuccggaaucugcaugcuuguaugcauucacacaucagacagacauccacaauaguaguauuuguaaaagaaauacuaguuucauuccuaguaguaguaauaaauuauagaugugugguguaauaucaacugaaugagcugauuguauuuguaagcaccacuuucacaguaaguaaaagagguuuuuuuaaaaaaaaaaaaaaaaaaaguuuuucucucauagccuugagguaaaaugcuaauagucaggaauauaggggagaaaaaagaugaccuugucuuaguaucaacauacauuuuuuaaugacauuagccaagacacaugcuuuuuauagaauugcaaaugaguuccagaucacuaagcaguaacaaucuuaacugaaacuguuaaauauaggcuuccaccaugaacccugacuagccuagaacuuacuguguagaccaaguuggccuugaacucauagaaaaccaccuguuucugccaccugaguguugggacuaaagguuugcaccauucauuguaccuagcucauuuaauauuuugaauuuauagugguuuacuaguuagauuauauuucccuucagugagcucaguaaacuuuuuuuuuucuuuugguuuuucgagacacgguuucucuguguagcccuggcuguccuggaacucacucuguagaccaagcuagccucgaacucagaaauuugccugucucugccucccaagugcugggauuaaaggcauggaccaccacgcccagcaugagcucaguaaacuugaaaugcaauuugcuauuauuaauaaacguauagacuuaaugcuuucauuuugucagaugacauuaaauauuaugguaugaucagcagucucuggcuuucugccuauaucacaacagaucaguaagcaaacaagcaauaucaaaauguguaugagauuucacaggccacacugauauccugagaaugaugaacugggaaauggggcagaucugaaauaugcauuuuuauaagcauuaugcuugguaagucuugacuggaaauguagucuuuuauagaacuguuuauuuauacagaaguuaaaacaugcauauuaaacacaugcccagucauuggaacccugaguuagaaaauguuaguuaugucuggcuucauggacagagagaaguauaacuaagaguucaaaccuauugacccauccaagaagcauuucaugauggcccucuguauguccaccauuggucagauguguucaaugagaaucaauuaaugaccaaaacaagcagagaagagagggaggcacagagaauuuaaagcauucugcacauaugcaugcccaccaauuggucuauuaaaggaaaaaggcauaaagguucuucauauugagagguggcagcaguggguuccuccuagucucuuucuugucucugccuugaggaauugaaguuauuuguuauuuaagcugaaugucacaacuaaguuugguacucuuaccacuuucucucacauguaagccaguacuacauagucucuggguuguaaaaagugagaaucaaauccagaagauaaaacucuacaugauaauugauaaacagaagaacugaaucucugaguucaaggccauccuggucuacagagugagugccaggacauccagggcuacacagagaaacccugucuaaaaaagaaagaaagaaagaaagaaagaaagaaagaaagaaagagagagagagagagggagggagggagggagggaaaggaaaggaaaggaaaggaaaggaaaggaaaggaaaggaaaggaaaggaaaggaaaggaaaggaaaggaaaggaaaagaaaagaaaagaaaagaaaagaaaagaaaagaaaagaaaagaaaagaaaagaaaagaaaagaaaagaaaaaccaacaaaugagucaagugugaaaucuaggacacuugauagaaggcuuuccucaucugacccaguuagcucagucuuuugcacauaguuuauaggacaagucaaugaauggauuuuuagacagcuucaagaauaauagaacagauucauaaggaaaccauuuguaagaugaccuaauuccuuccagauuguucuguagcccuaugccuuuuguugccucccuuggguuuuuugaagccaacaagcaguccacacuuuuacacccaucauaagauccagcacagccccccauggauuaaguucuggacucauguaaaccaauuaaguaauuaauaaagugugaugguauggauauccucugucuuacagcaggccuggccagguggggcccaacagauccuacuuccuccagcauggcagcagcugacuggcguggccacccacacaucuguacagcaugcagcugugauuccugagaccauggcaggcacucagcaacuggcugacuggagguaaacagucaaucuuucugggucagcagaguuucugggaugagaguuguguucaccacugacagagaacaucaugugggcuauggcuacuguguaaugggaggugguuuaaacacuauaccaagacagccaaaauucaguuugauuaauuuucuacccaaaacucaguuacaucuuuuaaacaccaguguaauucacaaaacccugcuagguuuuucucagaauuaagucccuuucagaaagcaaacauuugucaccagugaaggaauacagaagagaguccccaaagcccuaagcaauucuagaaaguguucucaugaaguuuugagacauaggugccugucugucugagcuccccagggaaagcuuaacagauaagauagauuuggaaggaugagcucuggcgugcuuauuaagugugccuuuucaguuaacagccugucuuauagaugagagaguucaccuccacagaccccagggacuccagccaccaccugccagcacucggcaucugucuccaacacugcccaugcaccucagcggcuuccucauggacaccugcucugcuguuuucauaggcacuugucauuuucccucuggcccucaucccaacacugucacaaugcccuccuugaccaguacagagccauaugacagcccuccaguuguccccagcucuguggccccugugggauguaccuccugcagaaaguacucccugcuaccuucugauagucugcuuaccccucugagagccucccuaguuccuuuuuggaauauagagcucuuggguucgguguggcaauauauauauaucugaaaucuuaacacuuuggcugagguagaaggaucacaaguuugaggccagucugagguauauagugaaacuaucuuaaauaacuaacucacucucaggaaaagguaggcaaguggcuaguuaguucucugagucaggugucuaguacagcuuucuccuccauguaaaucuacuuucugacaggaggaaaaucccugguuguccucacagcugcgcucugcauccaguggaagcaguuucaaaccagaccaaacugguuuccagucuggcuguguaagaccuggggcagguuauuuaacuuucauggccucaguuuguuuuucaauaaaguggggccaugaugcuuaccucacaggauugugggguaggggauagaggguugucaauuaaaaggcacagaaaagguuuggccugucugucacaugcaguguagcagugccuggauguggcagaaugagcucggcauccucccuucacccagucaugacagcccacaccccacccagacuuuccagggagaccccaccacagcaucuuuuccuuugucuucggcaguuagagcucacuucauuucugcaguauaugugcccuguucaugcaucuuuucuguucugccuucuuucaccucucuuccaucuccacauccucccgaucucuguaucucauugugggucaaagagcauccauaaccgugacuaggaaacaaacaagagaggagcgccagcgccgcccucauuuccaaggaaaaggguccaucuguagggaaauaaagaacagaaagucagcgccacguuccuuuccaaaggccaaccacgucucaaagaccaucaaaaguacuaugaaaugcuugucuuuuuuuccuauuuauccuuucaaguuacaaagauggaaucuaaugauuuuuuuaaaguucaaauaaauaauucuuuagcuuuuaauuuuauuacauguuaagugggcuuuuacagacagaucuuugaauuaaucaccacuuuaaacauuucuguuggaaaacaaggcuuuuucuuaagauucauccaacccauauaguaagacuuuaaaauguaacccaacuccaggaugcaagcugccugcauaucucugugagcauauguaugacuguuaguaauuuugauuuaauacaaacucuauacgagucuagucacccuucaguuaaucuaauuguucauucagcaagcguguaauuaacugaucagcugcuacaugccugagcauuguguuagcuacugagggaauucaaaagaacgcuaaugauuccuaacgccagaaacauauggcucccagucgccaaaguuuguuuuucacauuaacuacaauuuccucauuaauaaaaugguguaucuacgacauccugccuaccucacaaaguggaauaaaagaacccauugaaguugcuuuguaaauucuaaaacaaaagguauguauuacuguucagcauaagcaccugcucagggauuuuacaggucagaggcuacucaucccaucucucuagagcuuacagacucugacucuacacacuugacauucuuuccccuugaaagucuugguucuaacucaucagccaguacuccuacuucaacacaggccuuccagucgacaggucugccggagaagcgucgucuuauuaaagaguugaguucuauaaaaccacugaggugccuuuuguucucguuucucguucaggaacacgcaugcucauggaagucauuacaaucccaucaugcagcagccugcacucuugacuggucaugugacccuuccagcugcccagcccuuaaaugug

SEQ ID NO: 2926 - RNA, 1219 nt, Mus musculus
ugagaacccaagcuccauucccagccuauagcugccuguaacuaacugcauguagcacaaaacacacacacacacgcacacaccccaaauuuaaaaauaguaguaauaaaaacaaaucuaauuaauggcucauaguagcagcuuuccuagucugcuuucuauaagacauugagaguagaggagacugaauucuagaacuauauccuuuguuuuugaucugcuacaguuuaaguuuucuguuuauugaguuauaauccacuccauuaaacaaaagcucuuuaagacaaaucuuuauuuugaccuuuaugucaaaaugucuucagauucuauaccaccagcuacuugauuucaaaugugaggucacauuuacaaacagacccuauauugauuagcuaaggccugagggaggcaguacagagauaaagucccccaccugcucuugcucuccuuaccugcaaauggguaaagcugcauagaggaagggcagcucucuaaagaguuuugauucaggccguggcagcaaagcucacagacuaucacaaagacaguguuaaaaggacccaagugguagucauaacaagaaguaucuuauuuuaugccuuguggaacauuauugacaauggagaaaauuguaguaggggaguguaagucuugagcugcugaccagggcuucaugccagucauaagagcaaauuauugccuugacacagcuuuaguacuacuguagcaaaacacauuuuguauuuccuuagcucugccagaagagaaccuaccuuguuccuguuacccacccagagccucccuagcacaguacccaauauucaguaaauauuugaggaaggaauaaaggcaauauaucacuuauaaucuuaccacccagaaaaagcucggagauuuucccugaaaauguaugagcuagaaucucuuucaaauuucaaauaaggggaaauggucauccuaagaauuauagacaggccaauggaccugugaagagccccaucuuucaguauucacuacuauggucagaagaauugacacugauaauguacugguaagaaaaaaauauuucauauggauuuauaaaaauacuaagaauugucugagggguauguguguaagguuguguuguguauagguuuucuuauaugaagacauuuagacuagacacagacaugaacagaagaaagaugauguggaaauacacagagaucuguaaaca

SEQ ID NO: 2927 - RNA, 630 nt, Mus musculus
gcaucagggaaaaaaaaaaagaaaaagaaagaaagagagagagaaagaaagaaagaaagccugcuucaacaagacgaaaagaacaaacucccgaaaaauuguucugacuuucacacacauaccacagggcaugcacaccguguacaugcacacaagcacaucuacacacaaaauuaauuaauuaaaugcuuguugcuuuuuuaagacaaaggacccaggagugguguuacacgcucuuaaucccagcacuugugaggcagagggagugggaggcagagggaguugugaguucaaagccagucuguuuacaaagugaguuccaggccagccaaagcuacacagugaaaguaugccucaaugaaauaaaacaaaaguuuaaaacuaauguuucaccaaggagaacauagacuuuagcccugaaguccuucuacauuguguagacagaaggaauaguuggugagaaauagcgauguccgaggagggaacccuucacuuaaaaauacgcucacugugcauagcagcaagccuggaugguggaggagagagggucgaccaggaacucuccuuuccuguucaucucaaucccggcuguguggugguugaaaggagagggauacaccugaugucaga

SEQ ID NO: 2928 - RNA, 42952 nt, Mus musculus
cggaagcucuggccacaucccgcugggugagguggcggcgggggcggcgggagcggagucuagcggagcggguucuucggcgggucucaggugcgagccugcgugcgcucgggugcuugggguccuggccggguugggcgcgcggugggcuucgggcgugggaagcgcggacagcugguggguguggcggcucgggcgccgcuggcagcuggcccccaccagacccccaccgggaccccaccggagcuccuggugcugccgcugugcagucccgaggcugugugcaccgcagagggaggaggacaccagacaccagagagggaagguggcccagcccagcccacgcagaccucccggguaggggguacuuguuccccucggcccaccgaucuuggcucaugggacguuugaacggaagaaaaugaaacccaaggaaaggguucaugguuuagcaagaggagggccacguuucagguagggugggaggcguuuggauaggaugcacggaggucagagggagaauugacuucguggaaaaacuagggguuuguuuucgaguaacugccacgaccucagggaauucggcucugcuucuuauucgaaugucagacuuugguuguucuuauuuguagaguguggccuguucuuaauuuugauaagacaauggggauguguccacuuuuaacauuuucugcaauauguuaagcgaugccgugauauuuuacugaaauguuuagaggauaccuaguugccagggcgagccucuuuagccauugcuugaugucuucacucacauuucuguuuacgaaacaaucacugaugaagagaacaccucgacuacugugguaguugaauuauucuuuugccacuugccagauguuccuuguaaguaaaacagagucugcccuaaacacacaguaaauccuuucauuuaauccuuaagugaggaaagaagugaaguaaauggacuugaccuuuagugucagaguucucuguuuuucaggagcaguucagugcucauuguuuaagguuuuggaugagugccugguccucaagugaggaugacaugcuguuguugcagugauaacuggcacgauuagggcuuugucugaagggcagaggagaaaguaguugucuuugaaagaaaauagggagaaguuggccuuaggaacccugguauaaauggaugugguuuuaggaacccugaaacagcuagcuaaguccuuaacaucugugguaaugcggcaguuuuaagaaaaagugugugugugugugugugugugugugugugagagagagagagagagagagagagagagagagcgagcaagugcacggacaagugucgaauaguccagguaaucaccaucucccuguguaacugaagauguccuugaccuucuaaucuuccugucucuggagugcuaggguugguagucaggugccaugggugcuggucaagcacucuaccacugaacuagaccaugcguuuuuuguuguuuuguuuuguuuuugagacaggguuucucuauauagcucuggcuguccugaaacucuguagaccaggcuggucucgaauucagaaauccaccugccucugcuucccaagugcugggcuuaaaggcaugcacuaccacugcccggcuagaccaugcuuuuaaagcaggcucucaaaugaaugugugcuuugcagcucuguaaucuaggcuggccucauauucucucacauuuggaaucucccugcugggauuauaggaguauacaccugggaagacucgagucuuggaaagagaaaagauguaucugguaucagugaauagcuucuaguuagaugaugagagaucagaaagauacuguguaugugugagcguugguuggcacacaagugauagccagcguaugcagaacugugaaagggccagacucacccagcggucaagugcuugccuacagaccagcacucugaguacagguuauccuuuuacuucguacauguaaaaaucagacccuugggagccagaugauugccagcucuguacauuugaggauguuagggagccacauuuguuuauaaguuggacuuuucccaucccaaacuacauaccagagagauuaagcuguaauucaagagguaauucuaauuaucagguuuuacaaagccugagguguuuucucuuuuccauuuacacaucugaaaaauaugcagagagcugacuaugacuauauuugcaaaguaccuaucaguuuccuggugccuuauaggcauucaacuaaauaaaucauugacaaagguuuuuuuuucccucuguccaagagcucuggggacacuguggacuuagaacagagaaagccacugguuuuuaaaaugggguuuauagaugaacaauaaacaugcaaaucguuaaagaaacagaaauggggaauagaauuuauuuauuuguacugggacuugaacccagggcuuuuacauuuguaugcaggcaagugcucucucuauuugggugcucaaacagucgucgucaucuucuucuucuuauguaaguacacuguaguugucuucagacacaccagaagagggcaucagaucucauuucgagugguugugagccaccaugugguugcugggauuugaacucaggaccuucugaagagcagucggugcucuuacccgcugagccaucucgccagcccucaaacagucuucuuacuuccaggugggucagugugacacaguauccuguuaauggaacauucugucugucugucuaucuaagaaagggucucacugugaagccuugacaggccuauaacuugcuuuguagagcaggcugaccuugucaaauacacucaguucugcucacucuugugggauuaaaauguucaucaccacauaccuggccccaaggggaacuauauuugaugaguugucugggcagcuacuuagggaggugacaucugagaaaugagccaagaaagggaggagcaagcuauugcaaagaaccaagaggagaugcacacaggccuagaggagaaggcuuggcaggcucagggauuagagaugggugcagguagagggacggaguggagggaaggggacaaagaguagauuauggccugacagaggacugggaacucagcugcccaggaugggacuggugacguaauguucacauaauggcaacugcacaugccuagaagcagcagguggcaggugccgagaaagugccucugaagaagcagaggugggugaaucagcacacugccgcagagaagaagaaaaaguaccacauuguguguucugugcucggaggcaugaaggggcucugccugugguggauggggagaugcagaagaauccccaagacaggaaaggaacugcucagacaagguaccuggagacagagggaggcuucguccucacugucugcuguucuauaccuucugaucuucugcuguguaguuuggaugggaggcgucauccugcaaagcucauuuugcuguugugugugauuggaucacuagaaugcuaacuucaucagugggcgaagcuacugaugaguucauacuacacaggcuguuaggaggugaugggccugcccuugccugcccuuuguugcuccguuuguuuccucggcugccgugaagugagcaucuuuacccaccuuucauccagaacaccggccggucauaggcccagaguccguacaaccaaguacggacugaugucucugaagcugugagccaauauauauucuucucuuaguucauuugcaucaggcauuugucacaugaugggacagcuaacacagcugccuggcuuguuuauuaccaacccucagccuuuccagcucaggcagacuccuaccauccccagcuguucccuaucccggaaucagacucauuuccuucaagggacaaagacagacaggcugagaaggcucugcacagaguuugguuuuuuaaugucucuuggaaagccaucacagguuuuaaacagagguugauuuaccacccaucuuuuuuagggaggagggggugcuagagauaaauggggugugugucacuaggucagcauacuaccauuauguuggauucuagcccuugauuuauguguuuuggggauaagaguccuuuuguguagcucaggcugaccuuaaaaaucaauaaucuugccucaggcuccuaagugcuguguuuacauguguuccacccugccugaugguacgaucgguguuguaaaauguacuuuugcuaaugugugaggaauuauuugugagugaggucauauagggagaagaauccuguuacagcagacaggugguagaucagggcaggucuucuuagggcggagacagggggauuaaguucagagguaaaaagguauuuaguaaugggcuggguguggaagcucagagaaagggggacauaaagaaaauaaagaauccuauucacuuuguccacagaagaauggaggugcuguuucugagguggggagucccaggggagauagauuuggaggaaauggaucuguggagggcuaaucaugcagucaguugguuaguggcauaaaccuggaaggcuuugguguaaagccacaggccugggugacagcagggaaagauacuggaguuuagaagggaagagagaaagcucugcuucacaggcugagaaggcagagccguuagggaagugugggaggcuugccgggcaguggugcuugcccuuugagguuugugguuugaaucugaagucagcccgguugugugauuuuucucugacagaauucagcugugaggauacagggaaggaagcgggccaggccugggagaagaaaagacucuggggagauggcauguaaucugguaaggaaguguggcuaagggaggagccuggcugggggaaaugagugucggagugugaaguaucuaacgcaagcacucuggaaggcaaggguguuuagaaugcugguaggagcgauuccaggccugaguuucacccauggagugagugaggcuucuuggggauacagggaaaaggcaagugaagaagacaggacugaagaagggucuuaagaggggacucuugcuggguggugguagcacacgccuuuaaucccagcacuugggaggcagaggcagguggauuucugaguucaaggcuagccuggucuacaaagugaguuccaggacagccagggcuacacaaagaaacccugucucaacccuccccuauccccccccccccaaaaaaaaaagagaggacucuuuccucuucugguugguugcucaaaagcucugaaagcaaagaggaagggccuguggaacagcagcuuccaguguggagggccaguucugguaguggguagcaagaguuucagagggaaaugggugagagcugcccuggguacaaggugggcaggaaauaggugagagcugcccuggguacaaggugggcaggacccauugauuuuugaagcagguaggcugugacaggagugguggcuucuugagaggcagggagacagccaagugucuguaaggauguggauuaguuagcucucucuuucucuagguucccagaaagccuggugggagaguggacuggauaguggugcagaccaugcaggagugguggguacuguuuuauguuuucucuccuaccagccucuuuuuuuuuuuuuuuucuugucuguggacuuugauucaagcauuacuaguacagaacauuuuuauuuaaaacauauuuaucuacuuauucacucauguguguaugauguguguguguauguauauauucagguaggcagcugcccuacucucccaaguaaggacauuacagcacugccucaccaucuucagcacaagaaaccuuuaaaggcuugcuauauuuggguuggaacaaguuguaaaucucucuauagaaaugaaauaguggaugacccauauaaccccagcacugaggggaaugcugcugaggcagaguuccuucaaguuccagaccagccugggcaacagagugagacaauguuuaaagauaaaguagaaguuuagaaguaacaauguaacaauuuagggcucucccucuucaguuauguggcaggguaaagccaucuuguaucagcauucguaguguacuucuguucuuuuuugcagaguauacacacacacaccccaccccaccccaccccuguuugugugugugugugugugugugugugugugugucccaguacuggcucuguagaccaggcuggccuggaacucagagauccaccugucucugccucccaaguacuaggaauaaaggcccgugugccuccacuuggcccaaaaccuuauuuuuaacauuuuauuuuauuaguauucuuuuuacuuuuaagguaacagcguggaaaguugaggguauuguucaaaggauacaaaauuuccuucagaaaggccuaaguucaagauccuauuguauauggaaacuggaguaauaacaaugaauccccuagauucuaagugaguaauaacaaugugucuucuagauuuuaagugugucccuucacagaaaaugacaccuggugaagcaaugcauuuguuaauucccuuuggagccauuccacaaguauacuauacauacuccaaaacauacuggauaugacaaguguauacugcauuuugugauuuaaaaaauaagaaaagccagacuggcuacuggguaguagugauuguuuuguaagucucauguccuggguuaggacccauaaucaguagugagaggacauuggugggacaacucccaaaagugaccccuaugauguaucuuagcauacacacucagauucucacacucacacacaauaaguaaauauauacacaaauaauaagaaaagccaauucuuagcacugucaacuauuacaugauaguuauauguucaguauucacacugagaaaauacuaaaguuacugugacuucagaaacagaaauuugacuuuaauaaguggggugugaugguaccuacuuauaauccuaguauuuaagaggcuaaggcaggaggauugcugcagguuggagaauagcuugaacuucauagugaauuggaggcuagccuggacuacauagugagacauguccuuauaaauauuuuuuucaguuuuuguuuuauguguaugaauguuuugccugcauguacagcuaccuaguaggugagaagagggcaucagauucccuggaaauagaguacagagggcugcgagcuaaccuguggaugcccguguucuuagcugcuaaaccaucucucaagcccugaggauguaucuuuaggggaaaaucagcaagcuggacauggugguggauaguuuuaauuacaacacuugggagacagaggcaaauguaucucuuaggaguucaagaguagccugguccacacacauacugaguuccaggucagccaagguuauauagcaagacuccauuuuugucuuccuuuuuuuuuuuuuuuuuuuaaacauagcucauuugguagaguguuugccuagcguguaggaagcccaggguuugauuuccaacugguuauggugguacacaccuguaguccuagcacucucgggugaugggcgaugggugauggaaggaaggaggaagaucaggucauccuuaacuacaccagacccugcuugauuaggaaaaaaaggaaggaaaugcagaaguaaaauaaagaaauaaauuggguuuuauuaauuguacagagcuggcugaauuugaaaaccacuagacaagaacaguguguguucagaguguuggauguggugaaagcagaauauacugacauccagccuuggcagacacuccugugcucaagggccccucgcucacaucugguuggaagcugucucugggcuguguaggauauaugugcacaguguacguuuuaauuauucuaauuauauaggaccaaaugcuauaauaguauucauuucaaauggcagucugccaacagcaggugacuauuuaaaacuguuuucuccauguguuuauuaaagcuuuuaucuuucaucuccguggcuuaggauaaggugguuuauuuagaaacuaaauccacauggucucauauguacauacauacaugcauucauguggcucugauuauacaacuauuacuguuaaagcaauagucaucucaauuccuugaauuuuaauauaguuauucauuauuuuauuacaugucucccugugugggggauggugcacguuuggagguaagaggacaacuugagggagggaguugguucucuacacccuguguggguccuagagauccaacucaggucaucagcuugguggccuaugucuuaauggacugagccaucuugcuggcccaagcucuuuuucuucuuuuuuaaagauuuuuuuauuuguuuuauguauaugaguacacuguagcuguacagaugguugugaaccaucaugugguugcugggaauugaauucaggaccucgguuugcucuggcccugcucacucuguggcccaaagauuuauuuguuauuauauguaaguacacuguagcugucuuuagacacaccagaagagggcgucagaucucauuauggaugguugugagccaccaugugguugcugggauuugaacucaggaccuucggaagaacagucaguguucuuaacugcugagccaucucuccagcccugccuuagcucuucuuauacuacauuuugaauuuuacaucuuauguucucucaguguuuugagguggaaugcauucagguaaaagaacugauuucuuuuuuuuuuuuuuuaaagauuuauuuauugauuauauguaaguacacuguagcugucuucagacacuccagaagagggcgucagaucuuguuacggaagguugugagccaccaugugguugcugggauuugaacuccggaccuuuggaagagcagucgggugcucuuacccacugagccaucucaccagccccaagaacugauuucuuguuugcuuuuucuuugguuuuguuucaugcacagccagcuggccuaggacucacuguauaccaaggauggccuugaauuucugauccuccugccucccccucuccagugaugguauuacaggcgugcaugaucuugccucguuuauauggugcuggggaucaaacucaggacuucccggaugccaggcaagcaaucugccaagaccaagaacuguaauuuuaguagcaacacaugauagcucuuguuuuuguaacuucuggaauuauaaacaguuuuuauuuuugucagaauuuuuagagucuuacugugcucauaaauuuguuagcauuuuucagaaggaaugauuuaaaaguggaauuagcuacauucuauugauuugacgcuaaaacaacuacguuugggggaugauuagugacuuucccuguaucuugagcuagucuugaauuuuuucauucuuccuccaucucuugaauaucaagauuacagaugugugcuacaaugaccaguuaaacuaaaauauauaccuuaauacauuaaaacauuuaaaauguuauuuuauauguauuuuuuagcauguaugucuguaccauaugugugccugagaagcccaaagaagguuucguauucccuagaacuagcgugaacgagccuccaugugggugcugggagucacaucuguccucugagcuccugagugcagguucccacggacgccagaugcagcagauccccuuugcucuuacacugagccaccuccucagcucugugcagauaccuccuuauuuuaaucaguauuucuaguauuaccuggaacuuuuggguuagauuuaguucaguucuucugcgcuguuccuucccuuccugugagugccuuucuucucaguuugcacgacucuuccuucccuugggguuacucauuuguugagguuccuucucccaccacaggacaagccaaugacuacaaaacaugauugucaauccagcuuccuguagccuaagagaugaggagucaauuauuuguugccuggucauaaacuacuaauucagacuucacaaaauuuauuucagguacuuuggauuaucauucucuaaucucuuugucugccuuccugucuguguguguguuugagacaggucuucuguagcccagguuagccucaaacuuucuuuguagcugaggaugcccuugagcuaacucuuuuuucuuuuuuugguuuuucgagacaggguuucucuguguagcccuggcuguccuggaacucacucuguagaccaggcugaccucgaacucagaaauccgccugccucugccuccuaagugcugggauuaaaggcgugggccaccaccgcccccacucuugagcuaacucuugauccuucugccucagcuucccaagugcuggaauuacaggugucaauaggucugcuuuauguuugaaaaaaugucaauaggggcuggugagauggcucaguggguaggagcacccgacugcucuuccgaagguccggaguucaaaucccagcaaccacaugguggcucacaaccauccaugaggagaucugacucccucuucuggagugucugaagacagcuacaguguacuuacauauaauaaauaaauaaauaauuuaaaaaaugucaauaauguaucuuugucucucuagaaagaagaaacaauguaacucagucacugggaggaccgaggucaaggugaagagggaggugggaagagcauggccuggccacgauuuuugcagagaggagcucuccucaccagcuucagccaucaccaccuugcuguguuccugcucacguucuucagguaauggcuggcugacacucuugucuucugccuguggggacgauacuguaucaguauguugguugacacaggcuuccagugaaauagauggcuuucuugauguuguuuugagacaagguuucugugugauagcuuucuuuuguauuuuguuuuguuuuguuuuggugcuuggcauagaacucaggguugcaagcauguggaacguaugcucugucucugagcuacauaucauuccccuaaauauuuaaugacacccuuguaagucaacuuuuuuugagauagcaucucagcguguaacccuggcugguuugucacuugcuauguagaccacucuggucuuguauucacagagauccaccuaccucugccucuggagucacggugggcuuaaaggugugcaccaccaccccagccacaguccaaccuuuuuguuuuuuaaauaugugcacgagugauuuuuuuuuuaagauuuauuuauuuauuauauguaaguacauuauaggugucuuuagacaccccagaagagggcaucagaucucauuauagaugguugugagccaccauaugguugcuaggauuugaacucagaaccuucagaagaacaguuggugcucuuaccacugagccaucucuccagcucguguaugaguguuuugaaugcacugugugcucgagcauucacacauuaauucaggcuagccuugaaaucauaauccuguaucagcccuuauauuauaaauaugcauccagguauccccauuauacuuacuuuauugaugacuuuaggaugauaguucucuaggucauuuugcauuuugcuuucuagggguuauuugacaauuugaugcauuucgauugucuuuuuuuuuuuuuuuuuuuuuaaagauuuauuuauuuauuauauguaaguacauuguagcugucuucagacacaccagaagagggagucagaucucauuacggaugguugugagccaccaugugguugcugggauuugaacucuggaccuucggaagagcagucgggugcucuaacccacugagccaucucaccagcccccgcauuucgauugucuugucggagacuuggggguacugcuaaaugucucaccuugaaucaagaacuguuaacauaaaauguugcagagguugagaggcugagucugauauuagguguucuuuauggaaaccaggggcuuguaacaaaagaugugugcacucaggagacgugcagagaaugcccagagccuccuagagcagcaaagaugagagagauguguaaggaauuuugguaacuucugaggguuaguagccccugacuagauaggcaugacuggaggaauugucugaguuucugauucuauagcccuaagugaccuucguaggaacauaaucugaacuaguacauuuagagguagggacauauacguaggccucauacucaacuggucugauauauuauauggauuuuauuauuaauuuuguuuguuuccucauuugcugugggugagcucucugcuguggucugaguggaggucauuagacagguucuuggagcugguucuguccuuuuacuauguaugcccuggggauugaacucagggcaauagguguggaauuagauucccuuagccaccaccgagccaucaccagccccauuaaucuuuaucaaaggcacucaaaguguugacuucccccuccaguaauaaauuaggaaagugcuucuguagucuuauaagaguugcuagguaauuuugacaguuuggcuuagagcucuccauuugucagauuggggcaggcaucugugugagggagaaacagaaaucugaaggcaaggguacugaauggcugugcuuuccugaagaggcaccaugccuuaaauuaggugcagcccaucacguuuaguuucaggguaaguuaugcacaaacaacagacaguggguucacgaaacagugcccccuacccuuugguuuuuugagacaggguuuuccuguguaguccuuguugcccuggaacuuucucuguaaaccaggcuggccucaaacucagaggugugccugccucugccuccugagugcugggauuaaaggugagugcuaucaucaucuggcuagcagagucugucuuaauuaguaguuuuuacaaagcagcaaauaguuuucuuuuuuuguaaagcuuccaaacucaaauaaagcaaaugugcacggguuuguauuuuguugagugcuguuuucuuggcuucucauucaguugucuuuucucucuguguuuugcagcuauucauugcuccaugcgucaagaaaaacauuuagcaaugugaaagucaguaucucuaagcaguggaccccaaaugcuuuuaacacaucacuugaccugccugcagagguaugcagaaugcuagggcggagcuaaggagggcucuccucugugccugcccauaagcucuucuuaaguucuuuuuccugucaucugcucagacuuuuuaaaaaaaauuuuuuuaauaauuuauuuauuauauguaaauacacgauaacugucuucagacacuccagaagggcaucagaucccaucacagaugguuauaagccaccaugugguugcugggaauugaauucaggaccucuggaagaacaaagccagugcucuuaaccccugccaucucuccagcccccuugguuuauuuuugacuuuuaguuauuacuuaaucuuguacccuuuccuuuuucucccuccaucucucucucucucucucucucucucacucuuuugagacaaggucuuacugugaagccugguauuugcuuguggacaaggcuggcuugacuccacagagcucugccugcuccugcuccugcuccugcuccuacaugcuugguuaaaggugugagucauuacgcccagacacuuacuuacuucuuucuuuuuuuuguuuuccuuuuccccuucuuucuuuccuccccucgcucucccuccuucccucacaccccccuuuccuuucuugacaggaucucucuauguagcccuggcugcucuggaacuugucaccagccugguccugaacucacagagaucuuccucugcuuccugaauuuuggaauuaauggcacaugccaccccgcaugguugcuguuuccuuccuuccuuccuuccuuccuuccuuccuuccuuccuuccuuccuuccuuccuuccuuccuucccucccucccucccucccucccucccucccucccucccucccucccucccucuuucuuucuuucuuucuuucuuucuuucuuucuuucuuucuuucuuucuuucaagauuuauuuauuauuauauguaaguacacuguagcugucuucagacacaccaucagaucccauuacuuuucucuuuuuuuaaaaguaacuuucuuuuuaaaaaugucuguuuuauguguguguauguaagcauacaugcaggugcccagagagaccaagagaacauugcguuuucuggaguuggaggguaugcgcugccccaugugggugcugggaagugaauguuagucaucuggagaacagcaaguacucaaaacugacgagccaucuuuucagccccauuuucuggagaaauuuugcuuuucuuuuugggaugagauauaauacgucuauuuucuuuuuucuuuuuuuucuuuaaacagaguuuuauuuauuuaugugcauauucggaguguucaggagucgguucuuugccuuccgccuuguggguccuggagauuuaaaugccuucuugcuggccccucauuucuuguuucugcacaacagcuuuggcuccuucagcuguaguuuggugacauucgaucgcucaguaugggauucagguguagucugccuagaacccagaaaaguagauugguguuuugggauucuggguuugcaguccccaaggccacuccagguuuaauaguuaguggucacagcacucagcaugugugguuuauuacagaaaaaggacaggaagugaaauuagccaacagaaaccaggcacacaguugcagguucccucccaggguaggcuucuguuuuacagcaagaggcuguaacaaaguaugugaauugcugacuaccugagaagcccauuggagacucauaccagggauuuuauuuggggcuguguggcacauauuaaaauuccugggucucaggaaagcaggguucaggauugcuggguauagagagugcccuuaguccuaaggagagugcccuccuuaguuuccguuagaaagaucugaugcugaggggccagccuugucagcaggcuuugcuacggagggccaucuuuggccuguggguugacucuuuucggugauaaccauucacauuauuaguccucauggaauagcauuggcuuuugcuugcucgaugguuaauccaucuggguacuggggaucgauccaggauuucaucuaggcgagugcuucacaaguguacuauucugggccucacccccagcucuuuagguauucauuuauuuugcucuauaaaauagauguuaguaugcugauuuuucaguuuggauugauuggcugccagaacucacuguguagcccaggccggccucaccuuccgagugcugugauuaaaggcaugugccacauugccuagccuaguuuuguguuugcaggcccauccuguugaugccuguguucugaaccacagcagaaauugggaaaauucauuuaaauccagcguuucuccuucucugacuuauaccaccagccccaggauuuuacuuucuguacaguauuuggggcuggaaaggugcccagcaguuaagagcacuuguccuugcagaguucucucuuccuccucuuucuuccuuccuuccuuucucucucucucuuucucucucucucuuucucuuucgcuuucucuuucucuuucucucucuuucucucuuucuucuuuuaauuaauuuauuuauuuuauguauaugaauacacacuguagcuguacagauaguugugagccuucaucuggcuguugggaauugaauuuaggaccuuugcucacuccagucaacucugcuugcuuuggucaaccccacucgcuuagucccugcuuucucuggcccaaagauuuguuuauuauuauauauauauaagcacacuguaguguacagacacaucaaaagaggaugucagaucucauuaccagugguuaugagccacccugugguugauagccaccauguaguugugagcuacaaugugguugugagccaccaugugguugcugggauuugaacucaggaccuucagaagagcagucaaugcucuuacucgcugagccaucucuccagcccccgaguucaguucuuaucgcccacaucaggagcucacgguuucagucucaggggauccagugucucuggccucuaugguauccacacuuccaugcacacaugugcaagacccccaagggaggguagaaauaaaaauaaaucuuaaaauguuuacauugcgggcuggagggauggcuuagagguuaagagcauugacugcucuuccagggguccugaguuuaauucccagcaaccacaugguggcucacaaucaucuguaaugggguuggugcccucuucugguguguaggcauacauguaagcagaacacaguauacauaaaauaaauaaauaaauaaauaaauaaauaaaucuuaaaauuauuuuuaaaauuucauuuguuuauuuuguguguauuagugagggcaugugcaugccacggcacguauguagauaugucagaggacaacuucuggggucuauuuucuccuuccaccauugggucuuggggauugaacucagguggucuggauuauaucugcugagcuuccuugcagacucuaaaaauaaaucuuagaaaaauaauacugugguaguaaaauuucucuuuaauauucugaaguaggugaucuaacccaugcuguaagccacaagcagauaaugugcauauccccaaacucugcuguguucaucuguagucaagucuuccugcaacuccagauccaggcagcgucugcucugggaggcugguuuuaucauauaaauauauaugaauuuuauuaauuaaaaauauucauguauguauguaccauaugcaugccugcuuucaauggaggccagaagagggcaucagaucuucugauugugagucacauuauggaugcugggaacugaaccuggguccucugaaagagcagcugggguuuuuaaucacugaccuaucucuccagcucagggaagguugguuuguuuguuuguuuuugagacaggguuucucuguguagcccuggcuguccuagaacucacucuguagaccaggcuggccuugaacucagcaaucugccugccucugccucccaagugcugggauuaaaggugugcgucaccaccgccuggcuucagaguuauuuuuaaaguacauaaaacauggcuuuccuagauggagguggacaguuucucauucauaggguauuuaauucagucagaauuuauuucuuccaaaugccugcaugugcacacacugccgaguguccuuacugaagucugggccaccagcagcucaggauuuuggcuuaagagauagauaggguagacuauaagguagcagcaggcccuugucagagcuggcguuucacacaggaacccuggucugggaucaccccuuuccuugugugccuguuuccuuaccagagcucacugccuugcccuucacaccggggucaggcaaucguggugggaggugcaggguauugggaggugguugacuggugugaaggacuaaggucacagcagagugacuuguccugucguucugcagaucuggagcagcaaccaucuauuucccagcacagaggaagccacucuuuuucuuggaacacuagauacuguuuuucuguucuccuaugcugugguaaguguucauaugauggacuuuauuugauuuuguuuuuuaaauaauugcuuaauuuuuauauguuaaaauuauauuaguuuauauaugauuuuaauguauaaucuauaaauuuauguauaaaacuauuguuuuguuuuaaaaauaacuauuauguaaaauauuuuuaacuaaaaauuuaaauaaaauauuuauuauauuaauuuaauauguauuaaaauuauuauuuuauauauaguuuauauguaauuauauaaaaauuuaaauaccuacuaaauuuuauagcuuauauauauaauuauauuguuuuaauuuuuaaguaacuaauuuauuuuuaagauuuauuuauuuauuuuauguaugugaguacacuguagcugucuucagacacaccagaagagggcauuggaucccauuacagagccaucuugaaccaccgugugguugcugggaauugaacucagggccucugaaagaauagucagggcucuuaaccacugagccaucucuccagaccacaacuuucuuuucuuuucuuuucuuuucguuucguuucguuccguuccguuccguuccguuccguuccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuuuucuuucuuucuuucuuucuuucuuucuuucuuucuuucuuucuuucuuucuuucuuucuuucuuucuuucuauauugugguggugagaaucaaacucagggcuuguaccuggacauauguuuuuccacgacugaccuccccuacuccucaucaggucuuuuuuuaaaaaagauuuauuuauuuauuuauuuaaugcauaugaguacacacuguagcuguacaggugguugugagcuuucaugugguuguugggaauugaauuuuuaggacuucugcucgcuccgguuggcccugcucucucaguuccugcucacucuggcccaaagauuuauuguuauaaauaaguacacuguagcugucgucagacacaccaaaagagggugucagaucucauuacuggugguugugagccaccaugugguugcugggauuugaacucagaaccuucagaagagcagucagugcucuuaccugcugagccaucucuccagccccucaucagauccuuuuuaaaaaauuaauuuuuucuuuuucuuuuucaguaaggucuguguugccccuggcugucuuagagcuugcuauauaaguaaaccaggcuugccucaaacucacagaaaauuuccugcuucugccucccaaguccugggauuaaaggcgugcuccaccaugucugguagauuuuuauuuuguguauauaggugcuuugcccacauuuaugucuguacaccacuuaugugccugguaucuguaucagaucccuggaaucugaccugcagauaguuuugagccaccaugagaguucugagagucagacccugaaagagcagccauugcugcuaacugcugagccauuuuuccagccccaaauugguuguuucuguggaucugccuuucuucauguggcuuccaggcauucugcuuucuggagcaacacauaaccaguugauuucaucaucugaaagagguuuucauggccccuuauucacaaguggcacaaggccucucauggcauuuauagaccagugagccuacuuuaaugcuugugugcuugcaguguggagggacaaaacacuugugauauuugucaucuaaggguucugugucauuaagacaguuaguguauuagaaauagcugguccuaugucaaccgaaguuugaagucaagacagucacucauuguauacauuuguggcagaaguguaagguguguugcucuuaaggucuagacugaucucaguguucaguuccugcucugcacugggaagacagagaagauaggccacuuaugccucucauggguuauucccucccagccuucccauccucugcuuuaugaugcccugaaaccuaaggggccuaaggggcacagacccggagugcuggccugugccuuacaagucaccacagacugcucacaugugcagcacuucuuaacuccaaaugcagaugcuucagagaguccugcagcaacgcugaggaccacugcucaauccagcucaccuagaaaauggaacguacuugggggcuugguguuuguuuuuuauuuuucccuguggaauguuuguaguguaauguuauuugcugaagcacugacauucauagacaguuaaugugcaugugauuaaggguuggcuuuuuuuuuuucagucaccucucuaguuuaccucaugugucaugugcacucccagcguagacuguuacuguuuuuagagccaccaacugaaaugcuuuauuuuagggccucuucaucagcggcaucauaggcgaucggcugaauuugcgauggguucugucuuuuggcaugugcucuucugcauucgugguaaguuggaagauuuuauaguuauuguaguuauuacugggcuggccagauggcuuaguuaaaggagccgaucucagcugaugaccugaguucaauccucugaucacacuguggagagagacacaguaggccugaaaguugccccuucaccuccgcgagugcacccugcaugugucuacacccacucacacuuguauaucacaaacauaacaauacacgcuaacaauaaauaaaauuaaaaaauaaacaguuaaugcucuuuugaccagauguucuagcauuuuagguaacccuucucugccuccgucuggaguggaggagagaggcuagacuucuucacgucaucuuccugugugucuucggcuuaggcagaucacuuuuuuuuuuuuuugagacagggucucuguaaagcccuggcugucuuggaacucacucuguagaacagguuggcuuugaacucaaagauccuccugccucugccuccugagcacugggauuaaaggcguacgccaccacugcccagcuucagguggcucuuguccuuccuugauucacauagucuucguaaacagcagaaugcuggggucucagcggccugguuucaggcugccugccagucacacuugcuugccuaccuuugcuguagacugacuaacuacuuucuggugcccuaaccuggccacucuuuucuacccagugcuuuuauucuccuuaccuccuauggcccucaugccauggccaguugacaccccuagcucugcacuucucggagucaaugagagaguccugacuuccuccccugcucuagcaggaacccuccguggccucuucaguacccuugcugucuucucccucagccugugcuuaugcgucagucuggcuuuccagaguagcaccacagacccuagccugggacagccuggaacagucugggacagccugggcuugccucuugcuccuguuuucugacccagauucugcaguguuucuccuuccucguuuacaaagggaugugcagaucccucauccugcuguugcagugaacaucgugugugugugugcgugugugucugucugucugucugucugagggucauuuggaacggcugaggaucgaacccagggucuugcgcuugcuaggcaagugcucuaccacugagcuaaauccccaaccccuaguaagggguucuuauugguugaaucaacuucuagacuuuaguuagauucugauuuauuauaguguuucagugucugacauuuacauuacagggaaagaaaaaaaccuuuuuucuuaaaguuuuagaaauuaaagcaguuuauucauaagcugauaaccuguacuuauuuauauacaugcuuuuuaaauauuuacacauaaacccuuuauguagugauguuuccgcaaacaagcauggcugacugacugccucucccucuucucccagcugcuggcaaccacugaccauuuuucuguucuugcaguuuugcuuauuuaagaauuuacaacugagaccugacaguauuuuacuccccuacaccaagaccucucaaacaaaguaggcuucaacugugaaucagaagucccuuugagcaaaaugccuggaaaaaagcaggcccaugguagaaacagcugaauaauucagcagaugacagacaggacucacuuaugcgagugaacuuaguagcugcuguagcaacagcuggguucaccugggacugcccugaugcccagugccuggaucuguccugagcagacauguggguucaugugcugcuucagagggaaugagggaacagauggaagaagauggaaaaugggaacuccgcuucuagauuggaagaugcaaguugaagggugggaagcagaauguguguguguaugugugugugugugugugugcacaugugcacaugugcaugcacugcuugugugccugcgggugugcacauagagaagccaauggaggauauugugcguucugaccuaucuuucuccagccuuuucucucgaggcaggaucucucccugaacuggcaucucucaagccucagcagucuuucuguuugcaucccacacagcucugggguuacaaggguacacaugaccacauucagguuuuuacauggcugcagcgauuugcacuugggucuucauacuuacccacugagccuucucccuauuccaugaaugcacuuuuuguguauccuggaaagcaguuggguguauugaaacgucuguggaugucacaugucccuuuucucuuuccuucucucgaagguguuugucuuugguacucuuacggaauggcugcacuucuacaacaagugguucuacugcggucuguggauugugaacggccugcugcaguccacugguuggcccugugugguugcugugaugggcaacugguuugggaaagcuggguaugcuguuuccuuccucugacugcauuaaugucacugggucuggucacauucugcuaacuuggugcuucagagugugccucaucaucucucugagcaguuccaggauagaaggcagugucuuguggacuucagugauggucuguaaauauccagagaggcacguucuuaaggcuguaugucccaguuccuccuccuucagcucuucuuuaagaacugucaaagucccacccaugugccugccauccaguauggguguucuuuugaguguagucuucuuugccauaguuugagacucugugguuaucuuaucguuacauuaacaauaaggaagcuuaguccaaaaguuuuucaugaaaguuaggggcauagcccagugguugagcacuuguguagaagauacuguuaguacacaggaaguaagugaccuguguuccuaaggacaugccuaaggucacaugcaaggauucucauucagacguugccaccuuuggggcuuaggccgagcuuugcccuaccucucacccuccagguuagacuguguuggccuugccaugaguggugugggcugcaggguaaaggaaggugccugcugauggauuuucccagccagccuggaagaaggaugcugagcccgaguccuaggauggagaauaagucgagugaacuagaguugcucuguggaugauggcuguuggugaugcuucucuuucagaagcaguguugacguggcguuuagucauuucaccugggucagaguguauaugucuuuaggggcaugcuuaccucccaucuggcuucuuugcauguuugcucuuauacauggcagcagacauuccccuuccacugugguguucagcgugcacuuggcaggugcuucacagccuccaucuuccccaguuucauaacuggagcucccucagucaugaacagucaguaaugcugcgaccguucaccuguaaacugucuuguggagggaugaguaacauucaagagcacucugauuauauugcagcaggccuugugcuccguucugccaauauauuauuacaauugcguuguaaaggcauuuccuuuuuuugguuuuguuuuuuaaaugguggaauuggagauugcacaggucuucauucauacugggcaagugcuguaccacgggauuucaucccccagaccgcucuuucuuuuucuccuuuucuuuuccuuuuccuuuuucuuuuucugacagcaucucacuauguugcccugacuaguguagaccaagcaggcuucacacucaaagagauccaccuguucugccuccaaguguguguucccaacccagcuuaaaaugucuggucucucuauguacccugguugcccuagaacauguacaacagguggucucacagagagccacuugucucugcccccugagugcuaggauugcagggauguaccaccauccaccaugccuggcaugaaagcuuugugcuuugggagccacagugugcaauguuacugauagaaggaagcuagcuuggugugcaggggccuugggcugugggaugaucauuaacgcucaaguuguaacccauguuggaggucuuuaaagaaugucaggcuagaggaaaugaugauaaaacugcaagugagagggguugugugccuuggcauuguggguaugucuguugugggcguggaagagccucugugggaccuuccuucuccaggguacacuauucacauucuucucaguggacagauaagcccuggcuugcugacccaccuccuccgugaguccuugguggguuuuaguauuuuuauauuauuggagcuuuucuucuuucguuuuuguuuuuguugagguggggucuugcaguguaguguuggguaccuugaacuugcaguaauccugcccuagccuuuuaaguguggggauuagcagaguaagccaccauaccuggcuucuuuucuucagguuuuuuucccuuugguuugcccuacaaggaacccaggccuucacuacuguagugcaauguccaaccucuaaaugaaaauuuaauaucaccacaucucagaagaaucugguuuuaccauugugguauauuuuucaaaaauuuaaauagaauguugauuuuuuuuuuuuuuguaaugcacaucuuuccuguuacagccauuuuuuucauuuugaccugcauauagacucccucugacacauugucuuugguuuuccauuguucuccuuagccgaggaguugucuuuggucucuggagugccugugcuucggugggcaauauuuugggagcauuccuggccucaucgguucuccaguaugguuaugagguggguauuucuuucacagcuuauguguacacucguucuugcucguucucuaaccaauaacuccucauccuccccucuccuccucucaagcacuaggauugcaggaaugugccaccaggccuggcacaaaggcuuuguguuuuggggaccacaguguuacugauagaaggaagcuagcuuggugugcaggggcuuggguuaugugaugaacagcaguacucaaggacuugauucauagcccagcaugcaagaaggaaaagggcauagagccauggguucugagcaagagugggugugugggcaggccagcugccagugucuguuguggaucucuagguacacugucaacugaagucugugccuuugggauggggcuugaucauagugaugugcauuugacagaggcugaaugggauggggcagcggauucccggcuggcucaaguuuaaguaagcccaugcuuguacaaagagggauaaagacagauuauucucuuuggggaauauugccaugagauguugccaguuguuuggauuguuuuaacugcuuagaauuccugcggccucaaauggcuaagaaagcccaggcauccaucccaaguaucccuaggaguuggacuggugcuggaagugcagcucucccaggaaauggucccuagagcugcugacagagugagaagcuggguguaccugcuggauguagugcugagugucugcagagccgggcaguccuuguucugccuuccaguguuucugugugugaaugaaguaaaggaagucugccaauuauccgaaauucauggaagguacauuuugaaucuaguuuuuuuuuuaacugguaaauuauuuuuuuuauagaaaaauaaauaacuaagggagccacagagagcuucuacugaguauuuacuagcuugguaagauucagguugguaaccugacguguccuugagguugugaggcaaugacauguaguuaucggcagugucucguuauaguugcccugaccaagcuguucaccuccaggaagcauugguacccguggaugugcuuacacaggcacaaacaaauguuaucuacaguuaccucagcauaguuuguaauagccaaagauugaugcuaagcgucagcugauggggaaguauuuaaacucuguugcacccuuuggaaggugccauguagcugugacguagaaucagaaggcuggaacugaaagagaccaagacccggggaagaucucacagacggcaagcaggccaagcacugugccuugagacaccauuaguuuguaagguuccuaaccacgguccguggagaacaauaaaauacagcagaauuuacaugugggcaguugagagcuggguggauugggggaaggacuuacuccaccucuuaaugcuuauuuucuuaaguaggaugcucauucaaaagccuaaauaauuaggucaguugcucuuucagagagcagguauuauggucuaggcagagaccugucaccuaucacagucaccuuuccugucccaggccuucucacaccugucacagcuggauuguacuaauuggugcacgugugaaguucacccaccccagugcugcuccucaggcuggagcagugcuugaauguugucauucacuugguuaaaaaugcugccucguuguccauaucaaucagcuggcuguccagccuggccaucgaguccuuccuccugacaucugucauccuccguggcaguuugcuucccuguaucccugggcagaagccucaccugaggcuuguagagaaugcuccaucucaugcccagccugcagcacccgugcugcugcugugccuugaaagaugauuuuucucacuguucccuuaacaccaucuugcagugucagccuccucuagcuggugcuuccuucuggauccugugugcugcuuucuuuucuuuuuaauguuuauuuauuuauuuuguggauguggauguacugucgcugucuucagacacaccagaagagggcaucagaucccaucacagaugguuguuagccaccaugugguugcugggauuugaccucaggacaugcucuuaaccacugagucaucuuuccagccccgauccugcauguuucuuacuagguucuuguuuauuuagcugcaugccaccuuuucacacuguuuuggguauuguuugauuccccuugacuggauuuaaugucuucaaaggcagauacuuuuuguaggaguguggauaaugaaaagaaugagauuuggggggcuguccugauuuucuaauccuaacagugcugcuuaguauccaggugacucccguggucaucugugagucuuaccauguccuuaggaaaaugcaaugagaagucacaugcaggaugcuugacacagugcccagccuggaagcccaaaguacugggguucuuccagucucccugucucuucuguccccaccccuccccuugcgugucuguaacaauauagcugugaugaccaccucuguaaaagccacuucuccucuccuccaguacgccuuucuggugaccgcaucugugcaguuugcuggugggaucaucaucuucuuuggacuucuagugucaccagaagaaauuggugaggagaagccaucucuucuauucgaaauauguuacugguaggagcugggagguccaaggacaggaaaugaaauuacacuccucuuuggaaguuaaaggagcaguuuggcccuguccauacugaccguuacagccccaucuuauaccacuacagggaguugagaggagugcagcucaccuucucacaacaggaagaaccagacauuugcagaugguuuguaugucugagacacuggcuaagagaguaacgucuugagacuggauucuuuuccuuuaugaaaacgauucagucugcucuuuucuuacggcuaacugugggguguacaagcgaagccucaggagcugagaagcgugcagcucguccugacugaaugggcuugguagccucagucggcuauaguuggccuuggucuccuacaagaugaaaauaaggacaguaucaacauugugaguggugaugugugcagagccucggaaggccaggcacacaggcugugucuguacagggccgcuguuaauacucuccuaggucucccgaguaucggggcagaggagagcucggaagaagauucacagaggccacucaucgauggugcugaaaaugaagaugacuaugagccuaacuauucgauccaggaggacagggcugucguccaagugaaggccauaagcuuucaucaggcuugcugccuuccuggggucaucccgguaaggacucccuggucuccuuccacagcuggccgggugugguaccuucagugcugugcuggguggggagcacgcugccuucuacugucuacugaugcaguccuaggugguuguguagcaucugucagcuucccugguagccauggaaacccugucacauauagaagcuucagacaacagggguugggcgggcauguccagacgugacucgugaacaugcugaugcugauccaucaugcaacugccaaggcacaguuaacaaguuuuuaaauauuuugaucucucagauuuaccuggaccaagagggguuuugaaugguucaucaucugccuauuugugaauucugaucauucuggggaguagggaguugcccaguccuaggacagaguacacaaggauuucuugguaauuuaucccagcauuuccacaaccuuugcaguccaggucaacucugucugagcggagccccuccugcugcugcagucugucugucuucauguuuuggggguccuaucacuggaguggaaguuaagaggccuagguuguguuugcagcuugcccaguaacuuucugugagacuuggauaagucucccaacccauccuugugucucagugccagggaauggagauggcacccaucuugccuggcucauuguauaguucacaaagcaucugauuucaugaugcaagucugcagccauccuacucugucccucccagcucucuucugcccucugccucucugcuaaaaaacuaacccuacgaacaggcagucagucaaguguaacacucucuaauucuuagagcuagggaauagggaaauagagauagagauagggaaacucugguuccuuuaggcccuuguaguccuguucuuaugaacauagugccuuucgguuauaaaaauauuauaccagcaguuguuuugguagagacagaacuucaguuuguuguggcuaaacaagaaacuuacuugcuggcuccuuuguacuccuaagccauuguucucuggcacuggcaggguggagaggaagucuagcuaagccuuugucuuuguagcaggcuucugggcugagagcugugguggucaggauuuggcucucuacggggugucugcuacccugccugccagggaagcacuuuuaaaacaaguggcaccugggaaaucacuggcacugggguggggguggggguggggugcaggaguucuagccagacacucuuugaaguccgcccucuuccucugccuucccuuugaugcuaauagucaggguuuccugguaauaauguauguguugaguacaggagucucagccaucacccacuuaaggcagcucuuucagaagagagccagaggccaguggaaaccauagcucuuucuuuuuggcccuccagaaaggcucuuuucugugggaugugguccacagguagaugucuuucugucugugacugagucauuaacucuccguaguuugcagaauuaaauuugcggggagagaaccaagaaagccuggcugccagcaagaugagcugagguuugcuaggccaauuugccuguggcugauggugguuggaagcaugaacaccagggaccuuuugucuaaauaaagaaacguggguacaguguguacugcuuucuggguuucaaacacugccuugcuuuuaccagagaaaugauagaagaagaaacuggggguaguuaagaaaaagcugugcauaauuccuuccuuccuuccuuccuuccuuccuuccuuccuuccuuccuuccuuccuuccuuccuuccuuccuuccuccuuucuuuuuuuggaaaccaguagaaguaaagaaagagggcuucuggguaaggucagggaggaccccaugcugugcuguaugcugcuuguugacaguugugguuucuccugcaguacucacuggccuacgccugccugaagcuagugaacuacuccuucuucuucuggcugcccuuuuaucugaguaacaacuucggguggaaggaagccgaagcugacaagcuguccauuugguacgacgucggagguaucauagguacgcaugugugccucuccuuccgcgugguuagucgccugccaucuuucagaguuaggaaaucucauuugaaguuuuauugcuugcuccacagccgucuuucccaacccguccuaccaguaaacacgcagcuucugugagaacaaaaaguccaaaggaagagggccagcuugagacugacaggcugugguuuauaggggcugucuucucuuagucugcgggugauggaucagcucuuuuguccugggaacacuuggaaaucucuuuaaaugcagcgccuuugugugcuuucagggauggcuuggcuuugaagcugauuuugugagagauucaagauggaguaggaauguguucauuuuggcuuccucccacugucccgcuaucuccagccaaggaagcaaacauagcaccuuaguguguagauugucagguaccagaggaagggcaaacagaaggauuucccuuuccuuucuugucuguguuugcuggauacaacagauuuauuuuauuuuccaggcuagggauugaacccuggguuaggaaauguacuauaacccuaguucuauaacagauuuuagcaguggcuuugcgauguagccagaaauacaaaugaggaaauaauaaacccuuaggcaagaccaacagauuauacacuguggccucaccuuaacaucucugucugugguauuuacacauuaagccaagcuacccugaacacaggaauagcacagaaggcucuuaggugucacgcugauauuauauuugaacuuggcuauugguagucuuaggucuagagccaaagguaauguagacgcccugggaccugaucauacuucuguaucuuccacaguuaaaggcaucuuggugcagagcgaaagaaguggguuuggagcggcagcucaagggcucuuccuuaaacuagcugucgagguugagccuuacuagaucacacuaggcauccgggcugcuuucaagcuugugaucuuucuguuccagacuucagggggacggcaagugcaggcucacuugauucaguucuucaugcuuuaaguucaaaugaggaaauccaggggaaucaguuuguuuuuuauuugauagggaaagugguaaguaugauauugaugguuuugguaguuuucuuuuuucuuacuuugugguguccuguccauaggcagccacugugguggggacacuugggagaaccagcuguaucugucccccgaggggcuugucucagacagcugagcccagccacagcugcuuuccacugaccgugugcuuugugcuugaaggugggacucugcuaggcuucaucucugacguacugcagaagagagcaccugugcuggcccucagccucuuccuggccgucgggucccuuguuggguauagccgugaguauuccuuuguaauugccuugauuccugaucucuugaagguaggcacuugcccagagucgguggccagccauggagagaucugugauuagcucugagugccugggaacugucaucacaugguuuuauuuguguggggaggaaaccgucaucucgucaucucccuugcuuuguggaccuguuuaaaagcuugcuugggaguguauugcuuuguuugaggggcggcuccagagggacagcauuagagccaauaaaaccauaaaaggaggcaagguuucuaaagcgggaggaugguaauuaguaggucuugggguauguguguguguucuaaagccguagaguuguucucuggcuuuuagacaucucauuagcuugagcaguagccagagacaggacaaaagcuggaagggccccgucugucuuuguugucucuggagggauugugcuguggcggguuagggauggggaugcagucgcuugcugugcacuguugauggaggcacaugcaacugcuuuucaagucacuguggugugucucuucucucacaggcucuccaaacaauaaguccaucaaugcgcuucugaugaccauuacagguauggucgacccuucuguccacugcgcugucccucugggagcucagagaaagcugucucccacagguggacugacacuaaaccuuuguuauguagaccucaagugauaggaagauaaaugucuuugccaacuucucucugcccauggguaacuucuucaaccuucugagacagaagcugucccuguggacaaacccaaaaauuugguuuguuguuccaugucuggcuuugacuucagaaggugacuuaguaaggccucacauuggaaucccauccacuagcuuguggaagugcagaauagcuagauuuuuuuucucucaugccaaaacugggaaauauguuuauauauauguguguguguguguguguguguguguaauuuuuuaauucagcaagauguguggcuaugauuccaguaacaugacugaguuuaccagagccaggccacauccaccagagggcugugccuuacaagaacaagagcugugguuucaaaggggacaauccuguuuaaucccuuugaaacagcacugucucaucccucucuuuccagcguguugguugacucggguggauugguguuugggggacauaauuguguuguaauggacccugacaagcugcuacuguuuguugaugaguccaugccuacugcauugaaauggccgacuguuccacugggacauagacacuagagugucauaucacuggagaauggauuucagaagagcagauacaguuagucugaaaguacuaucuagaagcacuuccuuuaguuucuguuucucaccaacacguugguuaagacauuggaauauuuuaucuaucuggucaauggcuagaaauguggaucauauuuuaacaugaaccuguucucuuuauggcuucaggguuuuuuaucggcggaccauccaauaugguuagcucugcuauuucugcagacuugggucgccaagagcugauccaagggaacagcgaggcucuggcgacugucacggggaucgucgauggaacagggaguauuggugcugcugugggccaggugagaagagcaugugcuugcugacucccacggcagguggcgcucuugugcuguggacaggacgcccuagguuuucagccucugagaggugggaccugagauggaaggcaucccgaauggccaaagauuguguagcuaacucugaguacagucuguuuucuccauguccagacauuuaugacuggucccagagguugucuguagguguccuguagcaaacucauccuggaugcaggcugcuggaggucuauagacgcugacuuggaaccugugggccuguauauucccacgcagaugcuggagagccucuagguuagaccugccuuacugaagcagucaggaugucuuaaguuuacugguuugcuugaugacuggggugaaucacugcugugccugugcuuagugaggggcagcagcgcacccagguguucuccagccauguaguggguguuuaucagugucugcucauuacagaaaugcaggcucuaugaaggcagcaucguggcccgguugucugugccaccccccacacugccccccacccccaccuuguagcccucccucaucgauccuggcacaugggagacguucugguuccaaagcacuguacaauaaaugguugacaugcuuaggauauuugacuguauaauuaaagaacaaguguguguguguguguguguguguguguguguguguguguguagguauagguauacaaaauuuaacaaggguaggaggauuugcucugcaugcucugggguggaaaucaagcagggcuacugucacccauucagaaggcuucaugucugaggggaggugaacagucgucuugcuuuaugcauuuaugugucuaugugugugugcaugccacguggcaaauguguggaagucaggacaaccugucagaaucuguuuucuuuccacuguguggguccuggggcuugaacuugagacaucaggcuugaugacaagggucguuacccucggccaucuuuccagacccauuauacugaguguuuuaaauacauuuaacuaguacacuugagaacaguuucuccuguaguccaggaugcccuugaguuccugauccaccuugcacgugcugggauuauaggccuguguuaccacgcuggcuacacaugucaguguucagaccccaacuguaagccugguggcaaguguccuuguccccugggccagcuuggcaggacuauuagugcguuuggacacauauuccuggaugagauugcauuaucuacuaaggagaaacgaguccaagcgucaaaugucuacacugaaacuuaaacauuuacccacuuacuguagaaauagcacaaguguccauccagcagcugcugaaugcauaagcaggauguggccgauccauacaguggaggauuauuuaucaguuagaaggugacaaaggcuuggaagauaccacagcauagaggaaccucagaaauaugcuauugaaagaagccagucaugggagacacagugugccuucuucauucauaggaaaugucuaaaauugguaaauuuauaagaaaagaaaagacuggaucuguggugccucaggagugacugccagugggcuggcugcuuauggagcuggccauaacauugcuaaauggcauuaaugaugggcugcaucaauucagauccacuaaaaacuauugugcucugcccuuguaguggaugugucuuuauguuauccaaacuguacguugacaggauguuuuuaaaggacuggugagauagcucagugggaaaagguauuugccaucacauuguagaaugagaaaacugaauucugaagguuguccuuugaccuucucauauacagugugugugugugugugugugugugugugcgcgcgcgcgcgcgugaacacccagguauacacauagugaguaagaaaacaguguuagguggugguggcuuaggccuuuaaucccaccacuggggcugaucccuugaguuccaggacaguuccaggacagcuaggcuacacagaggaacccugucuugaaaaacaaacaaaaaguauccgugugguuguuugaaugauaaauauuuuuuaaagguagaguuacaguuacuguuuagaaggcuacuauguucccgaagcugugauggguggugagaguuuuguggguagggagcuugcucugcuguucauccaggcugaccuugaucuuccugccuguucucacuggugcugccaucccaggcgcacugcugcacccagauggacuugaacucuguuuaucugauaggaccuaggccaggucacuaaguguuuuugcuuucauuuuuccccagcacacauuucaguaaugguguggucaaaggauguggcuuaucucaucuguguucaggugguuuucaggaccaaugucaagacuguuuagcaggggaaagucaucucuucagcaguggaauggagggacuagauauccccaugaaaaagaaguaauuaaauccuuauuucauacaucaaugaccuccaaguggauuaaagaucuaacuugaagagcuaaaauuaugaaauucuuagaagaaaacauaggucaaauuuugauuagaaaauagauauaaauggcuaauauaaaugcauguaaagauucucaguggccuuaguagagaauagccacacugauaucugacuucauuccuagugaggaucaacuuaauaaaaagcagaacauagggcuuggagagauacucagugcccuuuucugaccuccaugggaccaggcacucaugugccucacaucuguguguuuaggcaaaaucagagcugugcauggugaugugaacauaaacaaaauggugcagaaaauauggguauuuccccccccaaaauuaacugugcaauuauuaugugaccuaguuuacuuccccuucuccccgacugaaaacaaggacuagcauuuguaugcuggugcuuauuacaguauuacucauaguagauaaaaaggagaaacagguacucaacagaaaaauggauuaaaaauaccgugauauugcuaaacgcaugaaacucaagaagaaugaagaccaaaguguggacacuuugucacuucuuagaauuggaaacaaaacacccauggaaggaguuacagacacaaaguuuggagcugagacaaaaagauggaccaucuagagacugccauauccggggauccaucccauaaucagcuuccaaacgcugacaccauugcauacacuagcaagauuuugcugaaaggacccaaauauagcugucucuugugagacuaggcaggggccuagcaaacacagaaguggaugcucauagucagcuauuggauggaucacagggcccccaauggaggaucuagagaaaguacccaaggagcuaaauggaucugcaacccuauaggugaaacaacaauaugaacuaaccaguaccccggaacucuugacucuagcugcauauguaucagaagauggccuagucggccaucacuggaaagagaggcccauuggucaugcaaacuuaauaugccucaguagaggggaacaccagggccaagaagugggaguggguggguaggggagugggugggggagcaugugggggacuuuugggauagcauuggaaauguaaaugaaauaaauacccaauuaaauaaaagaaaaauagaaacaaacaaacaaaaaauaccgugauauauguguucaguggaauccuauucagccaugaaaaggagugagaugcuaaugcaugcucacugugugguugaaucuugaagauuuuucuacaugaaagauuaguaagccagccagaaaaaaaaccaaaaaauauuuacaugaaguaucuacaauaggcaaauuuacagcuucagaaaguaaauuagaaguugguaagucagguguaaucucagcauuuggaagacuagagcaggaggauugcuacaaauucaaggcuguccuagacuacauaaugaguucaagaccagccuaagcuacagagugagacccugacuuuggggaaaagaaaacaacaagauagaacuugccuuuggguaggcuuguggguacugugauuuacagggcuuguguuauggguaaaaagguuugggaaauaaacagcuuuuguggguauguaucauugugaauguaauugggguugcuggccugugagguuaaaaaggguuaaaaggguggcagagcacucgcugggcaaucaagaggacugaauuaggauccucgagucucagacuuaauguaaccccagcucugaggcaggcauagacaagaggauugcugggaccugguggguuccagccuagcugagaaaacauggguccuauguccucaaaggggaccucaggaauaggcagcaagguggaggaggacuccuaaugcccucuuccagcuuuagcacuugggcacccucuccuacaucugugcaugugcaugcacgugagcacacaugcgugcauuaaaaaaaaaagcauaaagugaccaacuuuacguuggagaguccuguaaaaaagaggagauaaagcugggccaagugcucuuagcuucuuuucuguaacugaaaguaaagggaaagaguuagguuguggaauguugguaacauaguaacccugugaacagauagugugguugagagugagcagggcauuugaggccaccaccguuuauauaucaacuuucaggcugaucaggccuagguaguaagacuguaccucagaaagacuuaaaaaggaaagaaaagugagcaucaggaggacacagcuuguucugaaagcaucagcucuaggaugaagagugagcaggagggcagaagauacagaaagcagaccucagagcacacagcuugugugcucacucacugauugugaguucaaggccagccugggcaugcugcgacccuguguagaacuuuaaaugacaagcuguuauucaaaccccaacuccugauuuuccaaaguaguccugucuaaucuccuuucagacuaccuuaucugguuuauuuauauuuuaugugccugagugcuuugccuucaugaaugugugugcaccgagugaugucugguaccuucagagaucagaagaggguguggguuccucugaccuggacugacaagugguuaugaguaagaacagcucuugcuuuaacuacaagccccguucguuugcuugcuugcuuauuuuuguuuguuucguuguuuugacucagagucucauuuagccuaggcuggccucaaagugccugugcaguagggaauaaccuugaauccaagugcuaggucucaggcauggcgggggacaugcgccgccaugcucagucuauguaguguuggggauguuaacaaagcacucuaucggcagccacguccccagcccucgucugguuaauguauaaagaauguauuaugauuucccuuucuccuuuuaguaucuggugucuuugauccaggacaacuuaggauggauguggguuuucuacuuuuuuauucucaugguaagugcauuuuuuuuccccuuuaaccauuuuucuuauuuaauuuagaacauuugauuucauuacuacuugaaaccaacacaauugcugauugcuuuaaaagacuagugugaaaaguaacauuugauuaugcugacgagacgcauuaaucagugugcugcucugcgcugcugauuggcugcugaauaggacuugagcauucugaagcaaagaagggaggcucuaaucaccagggucccgugcgcguccaaaacgaggacacucugcagggcaagcugcucagcuagagauucuuggaugagauuuugugcuuuguaagaaagagugaguuaggcccuaucuuuaaaaugcugcuuccuguugagacacgugacaaacucuuuuauauuguuggugggacaauguucaagauaggucaaccaagcucaccuggggauggccuugcucuugaaacuaggcauccuaauuggcuaccaucuaagucugggcaguuguccucuagccucuuccauaggccaacaggaacaaguuugggggauuucucuucuccagcuucuaaugacucagauuuggugacacauaccugugaugccagcacuuaggaggcagaggcaggaggauuaugaguucagggccaaccuaaaagaccuugucuuuaacaaaaaguccaguuauuuccaggguccauuugugggcuagggaugcagcauauuugaggccccagaguucaguccccaguuccacagaacaaagaggagacagcucaguaaaaguccgagcugcacacaccugauaacccgagcuugcuauccagaaccucuauaaagagcaagaugugaugauggcacacaucuguaaucccaaagcuacugcaagaaggcaaaaacaggaaagucacccagaagccugcagaucagcuaagcuguaggaauagcagcagaaaugagagaucuuguuucagcaugguggaaggcaagcucuaccugcuucauguguaccuguacaugugugcgcacucacgcucucccugcuucauguguaccuguacaugugugcgcacucacgcucucccucguccucccuccucacacauacauauaugcuugcaugcacaugcacacacacaggguaaauaauaagaauaaauauaaaagcucauaaaggccugcuaaauagaacaaagggacuauugcagcaaaaaccagaucugguguaagaaccuugacguucaugacuugcuuugccuguggaaguggcacacgaguuauauuuucacagcugugugacauuauguuuguuguucuaacuauaauuuucagaagucauuuucuaauucaccgaagacagaaaguuuuauuucugugaagucaaaaugucuucgcucaaauccauuugcuaaugcucaaaucaugacgcucuaagagaaguaaguuguucauuuuaaaaacuuuuuucucuucacagacaaguuguacaauucuguuuaucuugccguuaauagugagggaaguauuuucucuugugcaaaggagacaagcucacucacuuaaugaaugacggggucccacaggagaggacggacugggaagcuuaggagggcccauaggccuucaguucacucguguggaguucucuaaacacuaauggagccuuggcuugucaggcauccuacaacacugccagcuaccccagacacaggcaaggaaggggcgaauuauuuuuuuacacuacagcaguuccuggagaauuuuauaacauuugugaauguacugaaaggaaaaugaaccugccagcaucuuuguugggcuugucagcuuaucccucuaacgcuagauaccgguuuugguccuggacccuuguucuucagccuuaaucaagagcuaagugaucaggaggcagaaucauguuguauugaugagaagacuaugguacggagcucugauaccacauuugcagagaguggaucaccauuaaggcaucagagcagagcugaguccagaugaugcuacaggccugcgguggacgaaacacaccuuuaccaagguggaaagaucacacugugcgauggcugggucacucuguggcuucuggaaguucucguccucucuagaauggcuguuggcuuguucuccuccgacuucauucacauuugacugacuccuaggagcagucuucuguuuguggacuauuauauuucagacauuccaguauggagcuuucaaacccacguucacagucugggaacgacaagacccucugagaagcuguucuauguagccuuauuguuggaagauuggucucugucacagccgcagccagguuccugaaguucccucagcagaagauggaaagacaaaggcucuuuguucuggggguaugaaguguauguauugaaucauguuaguggauuguuagggccugaggccugcccuuuagaagauuguaguguguaugucuucaagacuaugaauucuauaagaaucaauacuuuaaggucauucuguacauacauuuuaaauuauguaaacuaggaggaaaauguacaauuuugagggauaccuaauucacguuggguuaggaaauauucuuccaccucuugcuuuaugcuccaagguauguauugaugaacuugcaggaauacuacagauuucugaccauuuuccuguucagucacugacauaaagggaaaacacaaaacauaggaagguaggggaaacaaacccccgcuuuuguaauaaacguccagcgguuguuugguuacuuagucccugcuuaagcuugacauugccucucacuuucccuuucuguguggugcugggguggacucuggguccugcacaugcccagugugucucccaaugcccugcacucccagcccagccccacaguuaaguacagcggugccuugaguuccccagcacuugucacuggaagcagacagcccacagccuugccagguggagcugcuccccugcccuagguccuggggggccucauucccauuagagggagcacccccucucucccucugaggcagacugcucaguggugccugcagaugaagccucugucgcauguggcucagagguucguccuccucaguggguucaucuucauguucucauaucagcccgugccgccuuuuccagguuagucuugagcaccuacccccuucuccguggcucuccaggcucugccugaaauggagcuguaaacacucagaacaggaugaaacgauguuuuucucucugaaucugaguacguucuccaucuacuucugcccaccugggaaggaaguggcuuuaacaaacgccuaggcauuugccucauuuucuuauuaaauguuugccuggaaggaagggucagagcuggcgagcuggcugggugggugaagugcuugcuuugaaagcaugaauaccugaguuuggacucucaguccccguguacacaucugggugcagcggcacacaguuccagugcucaggagacauuggaaacaggucuggcugagcuagagugcugagguucaggaagagagccugucucagaagacagugacgggcuggagagguggcucuguggcuuuagaguacuagcugcucucccagaggacccagauucaguucccagaacccacaugacagucacaaccaucugcauaccuccagagucaagagauacagcacccacuucugaccuucacagguacuacaugcacacgguacacuuaggcaaaacacaaacacacauggauacuacuuaaaagggggagggggugugauagaggaagauagccaguguugaccccuggucuucaugugaucauguacccacacaccuaugcacacgugcuaacauauaucaaaaauagcagaaaaggccacaguaaaggcugguuugaaaauggauuaaaaauuaauuugggggaaaaucguaggaggcuuucacacacugaaauaaagaaugacuggaugggaaacauuuugcccuua

SEQ ID NO: 2929 - RNA, 9187 nt, Mus musculus
guuuuuucccuuuauagcauuuauuauuauuguaauacaacacaauuauaacuauguuaaauauauauguauuuauauuagccucuucuacaaagccuaaaguuccaugagcuaaaaacuguuuuuccuuuuuaaccacucuauuacuaaacuccaauaccuuguauacacaaggcauucaauacucccugucccagaaaaccuuuaaucccaguuaagcaccuucuaaagagcaagcuuaauggugaauacaaaggcucacuggucagagagaggcaagguuaggguugggucgggaugcaauggaggaauaaagaaagcacaggacauucauuuagggagguucuccagcuccaauccuaacagccauuccaaucuuaaacacaucagucaacaauaguuuauucacuccauuauagaauuagguaugcuucagauuacaaaaccaaggucauuauaauuuugaaggauuagaauauuaucuucaagaaaccagucacagcuuaacugaaguaaaacgugaacacaggguuggcgucuacugagggaagucauguuccucuaauacucgggaagauaaugagaugcacuuucuuagucacugaggaaggcauuugcuuucuugaugagcugaugcuauuucuuuuuuguagcucucuucccuucuccuuuccucgguuuccccuucccacggagcuucuuuagacgucguugcucauccuuaaaguccugaugcucaucucuggaugaagaagggaaaacaaagucaaagagcuauguuuaccacacuagagaaaugacaaucuagaacuggucucuuaggcugucgacuguggcuuuucagggcacaugcuuaguuuggugaacagaaagcagagaggacccaaccuauagacuggcuagguuauaagaauucaggugucaguuuuccuccccagacgcaauacuacaaagaggagcaaacuuccaggugagccuagcuaaaccuauguaucuauaagauacaccacccaucauuucccuauguuaaggcuaaacaccuuggguuagaaucucaguacugaaaaaaacaaaaaaagacuaaacauugagaggaguacaucgugaguguaagucuccaguugcacacagagauccugacugccgaggaauuagcaucuccuaaaccaggcaguuguccggaagagcaugaaugggaaaagggucaagcacauggaaagcaguucacgacaggcauuaaaggagucauggcaggcaggacuaacuagacauguggacagugugaagacuucuacaacugcuuaaagugucuacauucuaagaccaaauacccaaagaaagugcuuaccauguaagccauggaacucacgcagaccuggcuguaaaacacaguuccacagauagagcucugugacuuugaauacaagacccggcucucuuuugcaccuuaguuuccucaucuuuaacagguuacauuaauagcuuaugguuuaaauauacauuauuaaugggcuuaauaaaauggacuaaauaauauaaaaagaugcuuugcuggguucaacuaagcuguuuuuuaaaagguugguuuuaaagaauuugauacuuuauuccaugaauaaacauugaauaaacacauuaucuacauugggauuagcuaggaaggacaaauaauucuuaauauagcuauaauaauucaucuaaaacagaugucagaucaucuuguuuaaacucuguugcccagagcaaaagccccuuucuuuaccacagcgcucacagacccccgugaccugccuccugucucccugucacugccuuggcccaaacuauuccugggucauugcaggcacacuccagccucaggaagugcgggcuuuguucacucgugccucugucccacagaccuucccaggucucaccggguucacuccggacccaugagccucagccuaaaccuccauguccucugugacugcccugcucaccacaggccugucagcacucuggauccugcuuagcuaguucugucccacccccugcaaacuccccccccccccaccaaacauugucacaaaacauauaugauggauuacaucauuccccagucuuuguucuccaucagacagaaaacucuacagaggcugcuagcacgucacgacagcuuguuaacugagugaauccacugucuggggagcgucuacuuuccgcccucuuuugcaggccuuuacaucaggcguucuuugugaaguggugcugcaucaaccugucugacacuacagauggacaugcacugaagacaccauccccacagcuacugacuaaacacauacaaauaacuuuguuuuucaaugaacaacuaagugguuaguauuuuucccaucuucaaagauaugucuuuguuuuccaaguaaacaagaagaacaguaucaagaagcauauuaaaauaguugaaugugauuuuguuauaauuuuccuugggauuuggcuuccgauauuuuauucugggucauaauaaaauuaguauuuuuccugaggcaagacgaaaagcacaggaaagagucccaagcaacugcagacacucagaagcagguuguauguuauaaucucuaguaauguauuauuuuagacucuccauugguuuuguucauugcugcuccuuuaauguccauccuagguaccagcacaugggaagugcuuagaaauacguuggauaaaugaauauaccaacauuuagcucucuggaaugaguauguaucaugcuguacuauuaauuuuauauuacaacaaauggucccaaauuaauaguuaggccuaauuaaagcauguuauauuuuaaagaugguauacaauuaaauuuuaugaaauauacuguuuuaauucuuuguaaggaguauguacuaguuuggaaaugaaaaagagaaaaaugacuaccuagauaguuuauccuuuuuuugccccccaacaaaggucuuaagcacucacuucuuagaccuaccaaacauauaaagcacaguauuaaaaauuauauaauuuauaaauuacucuucaaagugaaauacagcuuauuuaagccaaauuaauauaucaaaaaggcacaaaauaaaaugccagaagcgagugggaggaauaagaaaugucaacgaaacugccaccagcagagaacggaggcuccuacacacccaguaagaggcaaagcagggagggggagggggcaggaccaagaaccagcagcucuggcaaccaccgugcuuuggggggggggggguccuuuauaccucgucacuuuggcccacucagcugucuccauccuuuuuagagcaguuuuaaacuaaagaacaauuagacaucucucuauagcucaauacaauuugauaaugguuaagcuuuagacauaagcguauguuucuguuuguuuauggauuaaggcaauuuugaguccccucauccccuuacccuuugauucaccuggacucccauaagaaucacaaaacuguagugagucccaagcuaauuguuuuccuuggccaaccuuccaaaaccacccgucacaagacccacccccccuuaucaccuguaaaggccaaggaaacggagguugcccaugagcgcaaaauacguguugugauuuggauaccagucauaagucucuuucuucuuggccaagggcugcucgcuaaacaggcucaccacuuucauggacuuugagucaguagaccuggccacuucaccaaagauccgggcacucagacgagacaugcgcagugcauacuccgaaagcggagacauuucuucaccaguagggaacaggauuccuacagaagaugagauuaauaggugagcgugaaaaaucccauauuuuccuagguaacauuuuagaaaaugaaaauauagcaagccacccaugaauuauuauggcccuugggcaggcucugcccugaggggagacaugcccacuugacagcugcuucucuccucuggccugcaguuucuacaauuuuguguucacggacugucucuucgguguauugccuuucuuacaauuuguaauuugguagguuauuugcuugucagguuuacuucuuugcaagcuggaugaaggggucagggaaacaaguuauucugcuauggcaucguuauuauaccuuuagaaaacaaccacccaagcagucugcaaguaaauaugcugacugcuugccaucuaaagguguaaucauggcagagaaguaauuacgcuguugucuuuauuaucaguccuuugaacacuguucuccuccagggcaccagauggcucugagaacugcuaaugaguuaugaggucauuuagccucuagguuacucgauugaauucugccuagcaacugcaagccauguggaaaaaacagacagugguucuauagaaacaaaauucaacagcucaaauaaggaucaucagcucaauagaguuguuauuccugaacaaaagucacuuaggaaguaugauacucagccuuaacacaaacuagcucaacaguaacuuucuucagagguacagaacgauggaacagaugugagaacgauaacuaggacauuaagaauuauauuauagcuaacagauauauaaaaaaacacaugauggacaugcaaaaaucaagaaugcuucugggggcuagagagagaacucagcgugaagaaugcuugcugcccuuccagaggacagcccaguucacagcacccgugcuggaccauucccaacugccuguauauccagcuccgugggaucugaugccuucuucuggccucugugggcacugcacacacaaacggcaugcauucacacaggcauagagacacagacacacacaauaaaaaguaaaaaaaaaaaaaugucugguggugauggcacacggcuuuaaucccaacacuugggaggcagagacaggaggaucugaguucgaggccagccuggucuacagagugaguucuagggcagccagggcuacacagagaaacccugucucagaaaaaaaaaaaaaaaaaaaaaacaaaaaaauaguaaaacaaaacaaaacaaaacaaaaaaccuuuacgaccacuaccacccaaaacaaugcuucugguagaauaacuguaccaucucauucuaggucagucguaugcgcuauuguuggcagcacauaccaguuuaugugaaauuuucaugccgagauaagaauccuugcuggcuaaaaggcuaucugggggguaguuugguugagauguggaggagcuagcuuuuaaauguaaaaaaggcauaaaucuaucuugaaaaagcgaaugggagaacuaacccaaaaccuaaugagaaggcgcuaacguagaacagcucuuucuucagaguucugcacucuacccuugcaaagcaaaguaugcuuccaucaaacuaauacuucaaaaauagaaaugccgggagagcgugggaggaaacaagaaugccaauaaaaugccaccugcagagaagagguucccacacaucugcuaaaagacaagacuagguagagggcaccugaugcauugcaaaacagugcuuggaugagcagaguuuuaaugcuauuucaacauccagagacagaacagagguugaccuuagagcaacuaauaaugucaaaccauuauuacucugaaugccaacuagaugaucuugggccagcagugccacccaaaggcuagccaggggagaagacucacggucucguucaaaccaaucugggcuaccauagcuuucuuugcucuuccccuuuuacauccugcaauccaggguggacuguguggaugcagauggguuugggcugauaucaucagaauggagguuucauuuuuuuuuuuuuuuuuuuaaagauuuauuuauuuauuauauguaaguacacuguagcugcccucagacacuccaggagagggagucagaucucguuauggaugguugugagccaccaugugguugcugggauuugaacuccugaccuucggaagagcagucgggugcucuuacccacugagccaucucaucagcccgagguuucauuuuuuaucaguuuacaucuaaggagaauauaacagugucauaacccuuccagggccauuagauguccacacgucuucagaagcagccauguuucuauguauguuuuaaacaccaccaccaccaccaccaccaccaccaccaccaccacaaauaacaacgaaaaaaccucucuugaaaccuugacuuuuuccaaacacaaguuuaaacaaacuuuuuccuccauucauuuuguccucuuuuuacuuaguuacuaguauagcaucggaauagauuuuucacuguaauugccuagcauuuccagagauacguuaaagcaggcugggaacuaucauuugcuacaacaucuaaaggaaaauacaucuugaauucccaaucacuuucuucuuaaauagagccuacaggaugagaccuggcuuuguauccuggcucugucauuugaucuauucugaacucugccugucuaaauucuaauuuccaucuuucugaaauucaagacugcagggauacugugagacgucaggagagcaguggcacccaguaaaugguaacccacagaaggaacaacccuaaaccccucugauagcuuggugcucguggguucagugaauaguguucauuuguugacuccuuugagugcacaauuacacaguuacuccugcgccucccugaaaugauacccucauuuacaaagccugacgaggggaacgggggcagccagaaccuugguaaccugacaggcaggaaggagaggaagccuguagacagcagcuaugcuaagguaacuccauagccacuuugcaguguagcacacaggugggauauauaaucagccguaagaucugauuagacuccauggcaacacagaccacaaaagccaagucuuaaaaugacagccuucucucucuuaugacaaagagagagaauaauccucuuuagacccgagucccugacucagcccuacucccagcaugguggcuuuagcuuaacuaacacacacacacacacacacacacacacacacacacacacacacacacacgauguacuuuuuaaaaaagcuucaaaaauugcauucguuuauuuugugcugguauguauguauguauauauggacacacaugugcuacaauacacagguggagguaugaggacauuuaaucgucccuagucauuaggguugacugcagugucuuuguccauugagccaucucacuggucuguuaaacuuuaaguauaaacaacacauaaauaaaccaacagaggucaguuguggccuucaaaccuggcacuucaaagcacaggcuagugguucucugugcguucaagaccagucuuguucuaagugaaauuuuaggcaagccagggcuacauggugagacccugucucaccacaaaaacacaggcuaaaaugccugcuuucuguaacugguccuagggcggaugcauugcuaccucccuucucccuucuuuaacuuaaaaaaaaaaaaaaaagaagaggcuggaaagauggcuuagcaguuuaggugcuugucaccaggccugccaucugacugugaucucugggacuccccuaaggugaccucugcaugccugagcacacacacauacauguaaagggcuauuuaaaaauuuaggacguuuugagauuucaguaugcuuuccuaaaggauuucaauuuuaugaaagaauauaaccuuuuaaauuauauaacauuaagucaaaugauuuacaugccaauuagauuucaauucacauaaaauuauccuaggaguuacacaauaggguaaaaauuaaaaacaaacaaacaaaaguuauuugugggugggucugugugacuauguucccagggaggcaagauggagaggguuccccuagaccaguaguucucaaucuuccuaaugcggcguuccuuuaauacaguuccuuaugucgugcugaccccucuaccauaaaauuauuucauuucuacuucauaacugcaguucugcuauuguuaugaauuuaugaauuguaauguaaauaucugauaugcaggauaucugauaugugacucacagguugagaaccucugcccuauaaugguguuauacgugguugugaguuaucugacuagaaacucaaccuggauccugcaagagcaauaugcucuauuaacuacugagccaucucuucagccucacaaauuaguuccuuugaaauaucauguuucuuuaaaugugaaugaaagaaaaauacaggugaaaauaaccguugaaaaugagaagcaaaaccaaauuacuuaaauaugucaagcaaaacacauaaagcccacaucugaaaauucagaacucuuuuuuccccuuuuggcauaaaaagauaaguuuaucuuucucauggaucuauuuauuuaaaaugcuugcagguacacuuguguggguauaaguguaggucaauuaucaacaucaggaguacaauuuaccuuauuauuugaguuucgacugacaaggaaagcugaaggcauagugccugccuaaucacgacccaaggaaugcauacgaguuguuacugagaagcaacgugcucagagcauuuaaaaacugguaccaauuauuuuacugggucacagggcaugaaccccuccgaacagauaacuuuauuuuuuuuuuuuuguucagcaugcacaacucauacucuccgcugucugauucgcgcacuccuccggcgcuggaagcuguaguagagucauucauuuucccaagcaucaucuaaacugcauuuuaaauaacaaucaacaaauaucgccggcgcaucccacacaaaacugagugcgagggcgggcucacuaggagaaaggaagugcguuuuugguuuguucaguuccccacaggauaaggggaaagccucggguguuugugggguacacguggaagcuccaggaaggccccuaacugacucgacuggaucuggcaauuccaccagguuagggacccggguccgcccgcaccgccgccgcccucugcugugaccccagcgcuccgcuugccuuaccugcuccugaccucgcgcacgcgcguccccggaaggcccgccccccuuuacuugcuucccagcuccagagagcaggagagaggcggaagcuugauggcuagagcggagucggcggacaacccggaa

SEQ ID NO: 2930 - RNA, 1717 nt, Mus musculus
aaguuuaaaggacaaggaggggagcaguuggcuucuuaggcaaaguaucaucagcuaaccuuuaagcugacugggccucagucagguaacggguggugguggauggguggugaacaggggaauuucagaacauugagauaacagagcacgaguauuacaaucauaauguuucaacuuauuaguaacauuuuucagggucagccacaaaaaccacagugaacucauacauagguacagaaagggcugccugguggucagcugugacccaagauaauuuagacauaacagcucauaauaaccuuugauuugauggguccuacaugaagccuuguggaauuucuuaagauuaacaaacuucauacagaacauucagaauacacagaacaaaacaggguauguggucagcauguccuugagccaagucacuucucugugccagugacuggcaggcauguuacagcaacaauaugaaauagcuggcaggcauggaacaaaaugacuacagauauucuagagauuggucagaccauaacaauagauaaaacacugauacacauaaaauaaucuaaaaauaauuaagagcuuauacaaauuaaaagccaaaacaaaacaaaacaaaaaccuggaaagaaccuuaauaacaaacaagauagagaaagguugacuucccggcuaugguaagagggcgaugugguuaauucuuuugucaaguugacuggauuuggacucauggaggagucacacuuuagaugugugucuuugggagaaauucaaaagagguuuaauggagaagggaaggcccacccugaguagggggagcaucauccaucacccugagucucagggugacuaaaauggaagacaccagcugacaggcaguuuucaucucucugcucccugacugggacguugaugugacuggccuucucaugcuuccgccaugcuucuccagccaugauggacggugucacugacccguaaaccaauguaagcucucuuuuccuuacgguauuaucagguauccuauuacagcaaugagaaaauugauuaauauagcaugcaaguacaccuaaggccugaggaauaaaugccuaaaggacgggagcagguugcaaaggagaaauugauguuuccaacagacaugaaaauuguucuuauuuaccaagagacuugaugcacaaauugauacauauauuaagaacagaucuuuuccccucuaacaaaauuucacuacuuaugggauauuggcauaacuuuauuugaaaucaauuuggccacauuaguuaugucuuagaauguucauacccuuucaguaaguaauuucauuuaaggguccauaugcuagagagagaaucugaagcacauagaaaguuuuauguucaaaaauuucaccauaaaaguugacagugauuuuaaugcugaaaaauuaaaacaaugguuuuauuuuaugaugcuuuuauaacuaucaugcaaccauuaaauaugauacuugugcagaggauagacaggaagugccuauaugcugaauauuuguugaaaauaggagaacauacauaaauuauccuccucacuaggacauuaugaguaacuauguacacaaaaacauggcacagggcuguaacagggcugcagagaugaccccauguguaaagcccuggccucauaggacuauugacauagguuaagauucccaaagcuugccuaaaacccaacacaa

SEQ ID NO: 2931 - RNA, 1717 nt, Mus musculus
uuguguuggguuuuaggcaagcuuugggaaucuuaaccuaugucaauaguccuaugaggccagggcuuuacacauggggucaucucugcagcccuguuacagcccugugccauguuuuuguguacauaguuacucauaauguccuagugaggaggauaauuuauguauguucuccuauuuucaacaaauauucagcauauaggcacuuccugucuauccucugcacaaguaucauauuuaaugguugcaugauaguuauaaaagcaucauaaaauaaaaccauuguuuuaauuuuucagcauuaaaaucacugucaacuuuuauggugaaauuuuugaacauaaaacuuucuaugugcuucagauucucucucuagcauauggacccuuaaaugaaauuacuuacugaaaggguaugaacauucuaagacauaacuaauguggccaaauugauuucaaauaaaguuaugccaauaucccauaaguagugaaauuuuguuagaggggaaaagaucuguucuuaauauauguaucaauuugugcaucaagucucuugguaaauaagaacaauuuucaugucuguuggaaacaucaauuucuccuuugcaaccugcucccguccuuuaggcauuuauuccucaggccuuagguguacuugcaugcuauauuaaucaauuuucucauugcuguaauaggauaccugauaauaccguaaggaaaagagagcuuacauugguuuacgggucagugacaccguccaucauggcuggagaagcauggcggaagcaugagaaggccagucacaucaacgucccagucagggagcagagagaugaaaacugccugucagcuggugucuuccauuuuagucacccugagacucagggugauggaugaugcucccccuacucagggugggccuucccuucuccauuaaaccucuuuugaauuucucccaaagacacacaucuaaagugugacuccuccaugaguccaaauccagucaacuugacaaaagaauuaaccacaucgcccucuuaccauagccgggaagucaaccuuucucuaucuuguuuguuauuaagguucuuuccagguuuuuguuuuguuuuguuuuggcuuuuaauuuguauaagcucuuaauuauuuuuagauuauuuuauguguaucaguguuuuaucuauuguuauggucugaccaaucucuagaauaucuguagucauuuuguuccaugccugccagcuauuucauauuguugcuguaacaugccugccagucacuggcacagagaagugacuuggcucaaggacaugcugaccacauacccuguuuuguucuguguauucugaauguucuguaugaaguuuguuaaucuuaagaaauuccacaaggcuucauguaggacccaucaaaucaaagguuauuaugagcuguuaugucuaaauuaucuugggucacagcugaccaccaggcagcccuuucuguaccuauguaugaguucacugugguuuuuguggcugacccugaaaaauguuacuaauaaguugaaacauuaugauuguaauacucgugcucuguuaucucaauguucugaaauuccccuguucaccacccauccaccaccacccguuaccugacugaggcccagucagcuuaaagguuagcugaugauacuuugccuaagaagccaacugcuccccuccuuguccuuuaaacuu

SEQ ID NO: 2932 - RNA, 2453 nt, Mus musculus
aucucaaucugccuggaucagggccuacaacuaagguagaguagccuggugaggauucggggugccacucacuggugaaacacuugcacaugacaugugacacuuucuccucagugugcaaaaaucaaucaucaaucagucccucagccauugaggguguggagugugugucaggugguaagaagaugaggcuguugugugugaagacaucccuugccccuauucuccauagaacauugccccccacccccucacagcacuuuucggucugagcuaagaaaauuugaauaguagauuagucuucuggcuuuuccccuuuuucuggugucgaguuuuaaaaauucucacuuguauuuugccauaucuuucccagccccaccccuuguugagggaggagguaagucuucauuuggaauucugaagagcaagcugccaaauagcuucuggaagguugaagugcagcgggucugaaugcugcuuuuuaugggguguuaaguuuagucaggcucucugcggguagcuaaccacugguaaauguuaaagagagagcccuccaagaaccgcuguuuaaaagucacuugugguaggcaauacuaaugcagcaggaauaaaggacacuagcaucuuugaaaaguccugcuaccaagacugaacgaucugucuucucaucucucuccucacagccucagaccauucacaagauaugacuagcaacaggaaguucuguggguaacauaggagaugcauccauagaagcaugcaacauuucauauugagauaacgccacacauauagcuuuuucaaccuucuuguuugaauuaugaucauccuuucacaaaaucaaguaaauuauacauuauuuuaaggcugcauaguuuuuauuuaugcaguuuuauuuguucaagcaguuuacauuuuucccaacuauuuuugguauuuccugguaauuaauagcuggaguacuggucuuuuguuuguuuguuuuacauguguguguauauaggccagaggagagccuguauauuaucuucagaaaugucuuuugagauaggauuuuucaauugaccugacuggccaacugucgcgucugcucucgaccagcaagaacgacacgaccaccaguccuucuaacaacaguuuauucaguccugauucuucuuguuuauaucucccccgaacccugggccucucauuccuuuuauacucucauccacgcacagcaggccacgccgccucaccaggcacgcagcuucaguuaagcagggcagcaggggcauaucuccaucaaacuggauucaccgguauccuggugcaccugcgcagcucucaagauguuuguggcuuauaugaggaagucaggugcaagucauacgacuuagcuacagucccuggcgccuuugggacugccgccacacccgcuccuaacagccaacaagauccaggauccuccugccucuguugccccuguucugggacaaugagugcauacucccauggguuugagggaucaaaauuagucuucacacuugugaggcaagcucucuccugagucuucuuccugcuccccauagcacguuuuuaauggcugcauuauuaauuauucaaauaauuuuuagcacuuuucauuuuucccagcuauuuuugcuauuuccugguaauuaauagcuggaguauuggucacuguacucucaguggucacauagucaacaaauguucuuugaguguuguauacugggcuagaugugauaguaguuacucauuccggcaaauccaaauucuauuaugacagaagauccacaaagcaacuauauaaauaaaggaacaagcauuguuggguuuugauaagugugcuaaguaggaaagaugacaagguaaaaaguuaaaacaugaacuauagggauagguaggaauaacauuuguaagaagagauguucaggaucaugcucagugaagagggcaggagagagccauccaggggagagucagaagacaagaauuccaacugggagaaccggcaaaggcaaaggcgugcguguguguguguguaugugugugugugugugagagagagagagagagagagagagagagagagagagagagaugccuagggucaguugaagcagacaggaugagggacguuacugggcgaugacagaaggaauaagauaauuugugugcuugguuccugggagcagaaaagcuauggaagauauuauccagaagaacagcauguuuaaauagaacccuggccugggaaggcaaggcaaacuuggacggagggacaguagauuuuacuuuuaauugaagguuuuaaaauauauuugauaauauuuuucuucucuuccaauuccucccagauucccucaaauucccuacccaccuaacuucauacucucucuuuaacaaaaggccaaugccuccaagaaaauuaaaacagaaacccaauaagu

SEQ ID NO: 2933 - RNA, 5965 nt, Mus musculus
cuagcuuuauuuaaugguucuccuuguguuucuuccuccacccuucuucgcagcccucgucccucugccggccucuucccaucacgcuggacuaaauucaagaguuuaggaugcaccuuccuaaucucaaacacuggagcauugaaugugagggucaggaaacgcagauaccggacucaaacccaacaugguccaugagauucuucacuuccaugauuguccgcagaaccaaacuuuuucauccaaggcucuucucugugugacaguagagacuguugucacagauuucacaucauagccaaccaaaaguuuucuaaagcugccaggaaaggugacuuagagcuuccuaaaguggagacacuuuucacuuucuuuucuucuuuucuuuuuccuuuuucuuaauucauuaaaugacagagaaauacaaacuguuuaauuucccaauuaaaggauguuucuguggguucaaggaaacugugggaauugagugguaguuucuuauuccuaaagagaaagauggcaggcagguagaagagcuguggcaccaugugcauaugaccacagagugacagauggcacuaacucaaaugcaaauagaaagccagaaagacuguuaaacaacagacacauuacacucuaaugccucuacauucaaacauucccaagugcuccauggaccagauuuuguauguaaauuaaagcuagacauugucuucuuucauccauccauuuuuuuauacccuuuuucuuuuucuuacuucuucucucucggcucccuccccauccucucuugaguuggaacggaagacuucaugugggcuaggcaguagggauucucugacacugccuuuggauucagcccagucacuuccaccccccagcagugucaaggcccccacccuucuuguugucuuugguccuuugauccccaucucuuagcuacaguucuggcuugauuuuagaagaaggaaugccaagcgcauuugcucacaucaauuuuaauucuuuuauuuauccuguuuccucacacaauucaaugaugcagcuguuaacucuauuugcaguccgcuggcuuugagaccauagauaacuuauuuauuugucuuuggguuuugccuucuucucaucuguaaaauuggaauacuucuuguucugccugccuucugaccuauuauaguagcuugccugagcuaccacacagauaacuugguuaacucucuaaggagaaaagaacugguuguucacacggauaaaaccagacucaagggugaugugaaaaucuuucccgggucaauggcaacacagucaggaccucuguuuuucauccuauuuccacaucaacaacuagagcaacccuuuaccuaagucaacaauacccugcgggagacacagaaguuuaccugagcugagacagagagaagguaacugcccucccccucaacacauacacacaacacccgagacucagaugauuggaaucugccaggaacuuucagaauagcaauuauuuucuccauuugucugcuuuucugcuccugcccauuuucuuauaaguagaacacuuugcucucauccuucaauaaaugucaccuccuauuuuuuuugguuggcauccucuuuagacguccugccucaccaacccacagguccaucucuggccaguguggacucacgugaugagaccauccucucauccccuuaggcaauagcuuugcucccaagggucuauagucuggggccaguguaggacuucugggcacuaaagccaagugaucauuugaccuccaggaaagguaaguuuacuggggauaaaagggcaggacccagaagccuucacuggaugaaaaaggaaaaacccaggagagggugcugaacuuaguaccuucuguuuaagauacuaaacuucccaguaguagagcugggcucuuucuuuuuccauuaagcaagcagugguuaaaguauuaaucacauauuaucuguuccuaagaaucaaucgacauggccucacaugucuccgcugacaagucugaucaggcccuuaugguaaggcaagaaggaaucccaugguggccacgagugugacuguagagaugggaaugaaaggagaagcaauaucaguccauaggagcugacccacagggacuggggcagcccaugggcagggauauuccauccuuagcuauggcuauggauuccagccauagcuauggcuggcuaugcaggaggcugagcuugcucaugaacauugccaucaaauggcucuuucagcaaagcuuccccugacucauuuggcaguaugagcgaucugcacacugcugugugauaaugaggcauccuuagcaacucacagaagugaauacagagugucuuuucuaccuggcuggggcaggccugcuaggugcucagaaaaacaaaagagaaucaggcagggaagguaucuucucuguuaccccuucagggaucucugcgucugggacuagggaacugucuguccaguuucugcuggcuucaccuucccagaugggagggacaggauuguuuucccuuuauguuugugccucucucucuagucagcuucucuugacugggauaacagugucugauuuuccgugcagaacaaagagacuagaccccgaaagagagggaucuugacucaaacugugcucugcuggaggcagaggucccuuuuacauguuucaugacucaggguaggaguggauagaauguaagagucagaaaggauggagggguggccuccuuaugacagacacagauccccgugcccacagggacacuguugcguuuguuccucugggacaagaagagagauggggcagcagcagaugugagguaccugacuccaugagagaggaaaaauguccuugagacccucuaggaugcucugugaugccgcagaggauucagaguuuggggcagaggccaggaaaaaugguuugguuuuuuuguuguugucuugggguuuuuguucuuuuguuugguuucucuugcuuagagcccuguuagcaggcuggggcugguggacugccuuaaagguaggggaggcaggcagauucaagaaggagugaccagcaugaugggugaagugcuccccaggaaguaaagagucaguucuacgggaagggggugagagaagaaaaccauucuggaaacaaguccaggccagagccacgcauggagagggagcacgugacaguaguucuggugacaucuguccacacaggggaaggagucagcaaagaagcugaguugggcaagaugcuaaguagccagcagagauacggaacaguccuuccgucucccuugugcugcaaacagcauuuuuccagcuaccuccuuccucaccaagucauuccuggcuuugucagauaggucagagauguauggagcagggacaguccucgcugugacgcuggggcagacccuugagucagaggauagggguaacugcgaggaaggggccugccugcuccaggggcucagacgacgggagggggaugcagcucuucucugcuuccaagguugcgggcaaaacuaagcuccaagagccugcuugggauggagcagagaaccaguccagcagaacccuggguuaaagcagggagggcagcccaucuacagaagcccugcucucuccagcagcccaccucacugcucucucgucucuaaaagccuaaugcuguuagccacagcuaucuggguucgaguccucucuaccacuuaccgugcugcuuuuagcaaguggcucuauugucuacacuagagacagcacccgucucuucaggaugggacagacucacaggaagagcagcacaugccuagcacagaugccuagcuggagcgagccguuagacacaggcgaugaugugcuugcccugugcuuaggaacccagcuaucacaacacacuugaacagaagacacucaccagcagugguucucuccuguguaggggucucaauagauagucuuccugcccuugaagugccucuacccucuucucccuaccccaagcuuaggguaccugugacccuacuguaucacguguucucgugcuaacuguuuuccuccugcuuccucacagaucuucguagaaugacagcuggcuucaugggcauggcaguggccaucauccucuuuggcuggaucaucggcguccugggcuguugcugggaccgaggccuuaugcaguacguggcagggcuucucuuccucaugggagguaaggcugcauguggcugcuggggauagggagguccuguuaacuggaaccaugggcaagugguaagagcuuacagcagaggggcauggucaauaugguucuuugugcucccucaucuguuggcucaucaacagucucugccccugucaccuauuggccacuauaccagcuuuucaggauguaaacagaaaugagauacaguguucagugccuagagucuuggggaccucagugcccagauggaagggagauaccguagcuaggagacucacaugggagcagguggagaccucagacuuggacgcaugaaacgacguuucaugcuccugugcucuguauuuuaguguugacgaaggaaggaggcguuucuucuccuaagagccaugcucauccuugacuuacgguuuaaaacaaaacaguggugggucuagacuagauccuucuauuucuguuuccuuucuuacuacuguauggccauugagucggcucaguggucuuuagcagacuguacauagaacuggggcuggguucuggugugagcagaacugucuacuugggaauuucucuuuugagucucugagucuguggcucagcucaaguguuggacugccuggaagagguggaugggugaauuguggggcgccuggagggagagagugaguguggacagacagaauuagaaaugauugugggaggaagagaaaaugagucccacauucgggagcagagcucaggcuuugggcagugugcaggugcuugaugcuggucucuuuuaugccucuuucugagcuaaggagagaaagaugaggucagcugugggacucuuuagcugcaggggaagcuggggaagggagaagcuugucccucacugugcccagagagacaucuggggcauaaaaaaaucugguuuaggagaggaggaagaagagaggcuuuguaggaagggcuugggcccugaaguuucccucuguuccuuuaagcacagcuacucugugucaagcacaaaugcaggcuucccauggagcugguacuuccaggggacugaccuguuaccagagucaggaaguccccacgucagagcugccaccccucggaccuacaccugucguuaaggcacaggcucagagagugagagggaagugguggcucaaugauagauucuacacagacagccaccaacucccaagccacacuucuauccugugggcuucucucucucugguaggacaacaacauaaaugagcugaugguucucacgcuauauuuuaugaguauuuucccugguaaauuuauuucccuuccaccuuucaugaggcccuccaaauuauaagaaaagauaaaaagauagaagaagaagaagaagaagaagaagaagaagaagaagaagaagaagaagaagaagaagaagaagaagaagaagaagaagaagaagaagaagaagcagcagcagcagcagcagcagcagcagcuguauucuguuuguagucuguauccuaucucuuuggagacauagaacaggcuuugguaucccagagaagcugagcaaaccagccccaggcugagcaggaacccagagccccaagggcaggacuggcagucugucauuucuccuucuuaccuggcauuugcuguauccucuugccuucucugcuugccuuuuuuuuagacaggaacaagcucacaaccugggaccucuccacuuggagaacuucccaagaacuucaguu

SEQ ID NO: 2934 - RNA, 83050 nt, Mus musculus
aucucagccucaggcuggcuuccuuuaaggugaguaaugauggcagcaguuauuaaguagauauuuacaauuguauuguguugaucuuauaaagcaaaaaaugggaccaucucuuuguaaauuuauuuuuuaaauuuuauguauuuaaguguuugucugcuugcacauauguguaccauacauguaccuagugaugauggaggcuagaagagagugccagauacucuggaauaggagguacagaugguuaugagccaccauauuggugcuagaaaccaaaaccaggauguaagaguucucugguagaauuuggggguucauuuaugucuauuaucauauuaucuuuuaauauugaaacuuugacuucuuccuuuccaauuuguaucccccugaucuccucuaguugucuuauugcucuggcuagaaauucaaguacuaugauuaagagauggagaaaguggacagccuugucuuguggaauuuuaguggaauuguuuuucucccuuaauuugacauuggaucuuggcuugcuguauauuguauuuauuguguuuagguauaagccuuguaucccuguucucuccaagacuuuucuaaugaauggguguugaauuugucuaaggcuuuugauguuuucuuagauucaguuuacaaguauuuuauugaguauuuuugcauuaauguucagaagguaaauuggucugaaauucucuuuguucaguuuuugugugguuuagguaucaggguaacuguggcuucauagaaugaguuuggcaauguuccuucuguuucuauuuuguggaauaguuugaguauuuguauuaguucuucuuuggauaucugguagaauuacaugcuaaaacuaucugguccugggcuauuuuuuugguugggagacuuugaugauugacucuacuuccuuaggaauuacaggacucuguacauuguuuaccugaccuugauuuaacuuugguaaguagaaucuaucaagaauucuauaauacauuuuguuuagauuuucaaguuuugugggguacagucuuuugaaguaagaccuaauuauucuuuggauggcaucugucucccuuuuuauuucugauuuuguuaauuuggacacugucucucugccuuuuaguuuauuuagguaaggauuugucuaucuuguugauuuucucaaagaaccagcucuuaguuucauugauucuuuguauuguucucuuuguuucuaauuuauugauuucagcccugucuacccuucuuggguguguuugcuuuuuguuuguucuagggauuuuaggccugauuuuaaauuguuagcaugagaucucucaaauuucuuuauaaaaacacuuagugcuaugaacuuuccucuuagcacagcuuuuauuuugucccauaaguuuggacauugucuuaguuaggguuucauugcuguaaauagacaccaugaccaaagcaacucuuauaaaggcaaacauuuaauuggggcuggcuuacaguuacagagguuuaguccauuauuaucaugguaggaagcauggcaguguuuaggcagacaugaugcugaguagcugagauuucuacaucuuuaucugagggcaauagaaaguagacucucuucuacagacagccacgagaaggaggaucucucccucacggagagcaauaggagacaucaaaucugccuacagugacacaguuccucuaucaaggccacaccuccuaauagugccacuuuccauaguccaagcauauuuaaaccaccacaaauauguugugccuucauuuucauugaauucuaggaacucuuuaacaucuuuauuucuuuucuaacccaguggucauugaguagagaauuguucaauuuccaugaguuugucggcuuucuguuguuuccuuuguuguugaaguccagcuuuaauccacggugaucuaggaaaauaugagggguuauuuucaaauucuuguaucuguugaggcuuguuuugugacuauauggucaauuuuggagaaaguucuaugaggugcugagaggaaggcauauucuuuuguguuugugugaaauauucugcaaauauguuagguuccucugaguuauaaugucuguuaguuucauuauuucucuguuuaauuucugucuugaugaccuguucauugcuaaguguggggucaacaccuacuauauuacuuaauuuccuacuauuaauggaugggguucaaugugguauuuaagcuuuaguaauguuucuuuuaugaauguggauguccuuacauuuggggcauagauguucaaaaccaacuuccauggugcuguucaucaccaagggaagucaggacuguaacucaagcaggucaggaagcaggagcugauacagaggccauggagggauguucuuuauuggcuugcuuccucuggcuuccucagucugcucucuuauagaacccaagacuaccagcccagggauggucccacccacaaggggcuuuucccccuugaucacuaauugagaaaaugccuuacagcuggaucucauggaggcauuuuuucaacugaagcuccguucucugugauaacucuagcuuguucaaguugacacaaaacuagccaguacaauaaucuugguggauuuuuccuuuuaugaguauuaauuaccccuccccaucucuuuugauuaauuuugauugaaagucuauuucauuaguuauugaauggcugcuucaucuugcuucuuggaucgguuugcuuggaaaaccuuuuaccagcccuuuacucugaggcaaugucuauguuuuguugcugagguuauguuucuuguaugcagcgcaaugaugaauccuguuuuugcauccauucuauuagcuuauaucuaauuuuauuggugaauugagccuguugauauuuagguauauuaauuaccaauguuaacucuugguauuuugauguugguaaugguaaaguguguguguguguguguguuucccuucuuuugguuuuauuggugugggguuauuuguuuucuaugcuuuccuguguguaguuagccuccuuggguuggaauuuuucuucuaguaucuucuauagagcuggauauguggauauuguuuaaauuuguuuuugcuguuaacugucuuguuuucuccauuuauggugaucaaaaguuuugcugguuauaguggucugggcugacaucugugguauaugagagucugcaagauaucugcccaggcccuucuugcuuuuagagucucuguugagaaucaaauguagucuuauagcucugcuucuauauguuccuuggccuuuuucccucucagauuuuaauauuuuuucuuuauucuguacauuuaguguuuugauuauuauguggugggaggauuuucuuuucugguccaauguauuugguguucugaaagcgucuuguauguuuauaagcaucuccuucucuaguuuggggaaauuuuauuuuaugauuuuguuaaaaauauuuucugggccuugaaucugggagucuucuccuucuauucuuauuauucuuggguggucuuuucauaauguccaaauuuaucauuuuuuugauugguguaugaauuucuucuauuagauuuucucugcuugagagucucucuucaucucuuauauucuguuggugaugcuugcaugucuaguuccuguucuauucccuagguuuuccauauccaggauucccucaguuaguguuuucuuuauugcuucuauuucuauuuucaggucuugaacaguuuuauucauuuccuucaucuguuugaucguauuuuccuguauuucuuuaagggauuuauucauuuccucuuuaaaugccccuaucaucuuuauaaaauuggauauaaaaucaucuuguguuuuggcuguguuaggauacccagggcuugguguuguggaauuguuaggcucugguggugccauauuaccucagcucuuguugauuguguuucuacaccggccuuuaaccaugugguuguuccugguguuggcuggguguuccugguguugacaggacuccucauaaaggcagagccuugggucucauuggaguucaggggacagcaugcugcucaguucugcuggcugugccccagguggacuuggccggcaaggugacugugccacucuuauuucuucccauccuacuuagacaaagguaacuucuguccacuaucuucuaaaccgagauaauguucucucaggguugguccugguagagcuuccaguaacuggaaccuacuggauuucaagauggucugugaucaugguccugcuaaaauacuguuccccagcuucccuugucggcuacagauuggccacaucccgucuuccagagauacccccucaccaugaguaaacauggucuugccuaaggucagauugaacuuaucuuucuuuccaccuuccaucucucuacagcugcuuuuaauaauauaacaaugugggaucauuuggggggugggcggggaaaucccacaaauauugagacagauggaagacuauugauucugggauugacuggauguugucaguauccaaugucauagcgcuucagugucuucaagagaacauuaguugauuuuacacuuuccauguguagcuuauuuccacucuguaaaaaguaccuaugugguagugugcuagauaugaaaagagauucuaguccccaucuuugacaaugcaaaauguuucuccccaaagauuccaggcaagugcuaaagguaggggcaaauuccaguagccuccagggacuacuuuccuggucuucagugauuaucaugcugaccaaagaccaugggaaaggaagggcacaggccaagcccuucuuucuggcugugcacaucuccauggcagauacaagucucuacugucacaggugcucauuuuguccuacaggaagcucuauccaguuugucucauuuuggauauuguaacaugacauugucauuuacaaagcucauagacaggaacuacacaacuaaguuacaaaaaugucagaaaaaaucauauguuaauuaaguuuuugaauuaaugugacuucacagucauggcuauccagggcacauguaauccacaggugcagguuggacaugcugacaagaauuuccaaaauugugaaagggagcuagucucaauccuugagugacagaaugucuugggcuaacucaguuucuggugggcugcaggagacaaugaaaggcuagcuaguaguuaagacugaugauucuauaaacugaauccuagugaaacugaacuuagaauggaguagaauugacauacaucuccaaaacccaacugucauaucuaccugcaggugaguauucauauaagaucauacauguucaugguuuuacaaucauagacuucagguauauauuuagaaacuuuacuauuaucuuugauguuuucauucuuacagaaaaaaaucacacuugguaucuaaagugagagauucugacuagaaacauuacuauuguuugagaagggucaagucaaaugccauuuagauauguagaaagacugcauagaggcuaugggcaugaugguaucugugauggcuauucccaguugucaacuugacuauaucuggaauggaauacaauccagaauuguaggacacacuugugguccagaucuugaggcauagugaccauaaaaagcuuaggcccaggcaaagugguacacaccuuuaaucccaggagacagaggcaagcagaucucugaguucaaggccagccugggacagaacacauuacaaguaaaaaacagcuuagguucaggcauggugguacauacuuuaauuugggccguaccuucugcuggaggccuacauaaggacaaugaaagaaggaaguuuuucuucuucucugccugcuugcacuuacgugccagcacaucugcuggaaccuacuuuuucaggauuccagcuuauacagaagaccaguugaaacaccuagccucaugggacugagcaacuacucgauucuuggacuuuccauucacagcugcccauugauguaagucauuccaauaguuuccuuuacuacauagagacauuccauaaguucugugacuguacagaaccauggcaauaucuuagguuuauuuucuguggcuugacagacuaccacaucuauaaauaauaagcaaaaaauauuuauucaggaaaugguucugggacccgggauguccagcuggugaaaaucuucacguaguaggauaagcagacacucaggagaaguaaaaucaggcauaaaucacaccugaccagcaggaaccugccauacaauaaugccaugaggugaggacagaguucucagccuaggcaccccauuaaagguaucaucucuucucaccauuccaaccuggcagugacauggcaauugaacuugagcaugaguucgcagaggacacucaaucuguaggagguagguggagaagaggcacggagacacuacaguuacacaguggaaauggaugcaggagcccacaaauggccuuacaagaacauaauacaaacaugaagaauuaacuugagacagugaauuaacuggagacagugcaauugguaucugcccagcauagcuuggauucucuaggaagcauaaccuaagacagugcaugcuaauugugacugcuuaccaaauugcuguguacucaguaguuuaacauacaauguauuaucuuacaguuuuggaaaccagaaaucuaaaaugggucugcaggauuaaaaccuucuguuucuuggagagaaccacaggcaaacuucagaguauuaaagcagucuauguggccaaguucacacucaccugcgaugcccauguggcaguaauauaugauucuaaucuugagagguacuaagcccagaaaggaguguaguccucccuucacauauaagauagaaaacaagacauaagccauaagaaaggcacacacaugugcucgagcgcgcucaccccccagaugcauauguaauuauuuuuaaggcuuuuuaaaacuaucauuuucugaucaaaguucacuguccccauuuucaggacucccccucgcccccaauccuaaagcauguucuuugccuucuccuuggaucaucccacaggucucggggguuucaagccuccagucaagcaguugcacagacucauuuccacaaaugaacagguuagauaguuggaaaagaaauuccgaaaguaauucaccgacucccucagcaguaaacuauuuuagaacacuaagggauuguuuuaaagcaugauguucucccaucuucuaauggacaaauggagagagugguuggaaguucacacuauucccagggagaguggugggaaagucacacugucccagugaaaaguaggacagaguaugguuuacugcacuuaaccucaucagauguuuuuguuguucuucaagcauucaucuggagucuaaguuauaaacaaaugaaaugggacuugugaagguagauugcaagcccugugggggugggcaccauggagggcacuaaacuugaagccagccucagaccuuuccaugcggcccaucacacgccucucagcagaugcugagugacagaaugauggaagaaagaagagagaaaguuguguugcuuggcuugaucccccuccaucaugaggguugcugaauuuaaacuaucuggaggucugcaucagcacaguguucguguagcucucuuguuacuacgaguccacugacugcacuagagauaucuguaaaauguaaaccagacccaacaauucugcugacagaauccuauucuacugagugguguguccaaaaaagcuuucccaugcaggaaaggggcuuaauuucucuguccuugaggaagaguugaggaagaccucuccacucccaaaaaggaaagaaggaaagaaagaaagaaagagauuaacaugagaaaacaagcauaauuauuaauaugugaccaucaggaggaagcucaaauuggugacuuagaacucugucuuagauggcacuccaaacaaagaacaauaacauuuaagcaggugacagaagugaggggugaaggauuuugauuuuauauugacagcaauguagguggaguuaaauacauuggcagauaaagaccguuuugauaaauaaaucaugcaaaugcugaugugggcccacagcuguccucagugguuagccuuuguugucuguggacuagaguuguauggaaaaaagguacacugcuauucaagagucugcagaccaguagacugauuagaacuucaugacaguggggagauggaaugucacagauggauagccaaauuucuucucucuugccuguaguagcuauuuaccaccaaacucucuaccuaacccaucuuugugacuacuaguuaaaacuuuaggaaugauauaacuguaaacuuccaccaacccaaaucuaagaaggucauccaucacauggcaucugaaaccuauggaagagauuucucuguggugcuguuuccugccuacuugacaucuuaaaugguguacuggcuaguuuucugucaauuugacacagcuggaguuaucacagagaaaggagcuucgguugaggaaaugccuccaugagaucuaacuguaaggcauuuuucucaauuagugaucaagggggaaaggccccuugugggugggaccaucccugggcugguagucuuggguucuauaagagagcaggcugagcaagccaauaaagaacauuccuccauggccucugcaucagcuccugcuuccuaaccugcuugaguuccaguccugacuuccuuuggugaugaacagcaguauggaaguguaagcugaauaaacccuugccucuccaacuugcuucuuggucaugauguuugugcaggaauagaaacccugacuaagacaaauugguaaccagcagaguggaauauuccugugacaaccuaaccauguuuuggggaggacuguggaaggacuuuggaacuuugggccagaagauccauuugcuguuaaaaacucugugagauauuguguaggagcuuggaagauaauguugagagcagugcagaaaauggaggccuggcuugugaaauuucagagggaaaauuaaagacucuuuucagggccauugcuguuuugauugugaagauucuguaguucugguuagcuggggcugaagaaucagcugugauuaacaauauaccagaacaacuaaagcaaaaacuuugcauuucugggacuauugaugcugguuagcuggagcuaagaaauuagcagugauuaagaagagaccagcaucauugaggugacaucuucugggaaguguuuuugagagcacagaggcuguauuccagagauggccaagguuguaccuugugcuguggcuggacuugguaauguguaagauucacccaggugguacugguuuugaaggcaugaagaggucaugcagagcagcugaggcucagcacagugagaggccauggaaggccauuggugaaggugcagccucagcugcaauugauuuuccaggacagaaggggucauguaaaggaguugaggcuuggcaccaugaagagagccuaugagaggcuguuggugaagcauaguuacagcgaaagacuacaguguuuggagaugccaguaccaugagaugaccaccaagaacagcagcaacaguggaguacaggcagcuggagccuagaagacaaaaugagugcuacaaaggacagggcuggagaagugacccaagcccuuggaggagcccagaagauugugaguuugaucccagacauuggacaguuggaguuuaauuuuugcuuuugauugugacugugcccugauguuuuucccucuugaaguaagaaacuauuuuuaguggagcccacaguuaagagacuuuuaauuguaaaaaggcuuuggguuuuaaaagagauggauauuuuaagaauauguagagacugugggacuuuuaaaguuauuuagaucuuggggaugaauaagaauguaaggguugaggcuuacuagugauguguuugugugucaaguugacaaggggucaauuguacuggcuaguuuugugucaacuugacacaguuggaauuaucacagagaaaggagcuucaguuggggaaaugccuccaugagauuuuucucaacuagugaucaagggggaaaggccccuugugggugggaccaucacugggcugguagucuuggguucuauaagagagcaggcugagcaagccaggggaagcaaaccaguaaggaacaucucuccauggcuucugcaucagcaccugcuuucuaaccugucugaguuccaguccugacuuccuuugaugaugaacagcaauauggaaguguaagcugaauaaacccuuuccuccccaacugcuucuuggucauguuuguucgggaauagaaacccugacuaagacaaaugggcucauggcuuuauuuuauuuucugauucauaaguguccaacuaaccuauucuacgguggaacgugucauucagggcaacuugaaucuguguuccaaaaccauugccauucauacuuggcucagaauacauuuauuuccuguuuccuagggagacagcagugaagaaaugucuauuuucuccagauagugacaggaacagaccccgaagaaaugauuccacuaaagucuagauuuguggauccaugaauuugauugggguagugaggaauuaccuauaggaacaugagcaacuuagaggaggcaauaccagugaagaaguucccucaacacuccucagccccucuggcccaguaaccuuuaauugcuuguacaucuuguggaagaugggagucccuagagaucaaauauuaguggauccagucuugggacaucucaggcgaguucccauuugaagauguuccuacugaaaaacuguucccauuuaagacagcaauguugugcccucagggcagacuucuaagaguccucuuugcagcaaaaucuguuuuauuuuguugacaucuuccucgcagugaaagguggcaagauaaaaaguuuuuguaacugccuugguguaaggcagcuaacaggaagcuucucugcaccugcccuucaucuucagcccagcgaucuuuauauuuuaacaagacacauuuuucuguuguccaacaccccugugggcucuccugcugcauggcucccuuuucucauagcucuuucugccuccagcacacaggccuaaggguucugugauuuugugccugauuuccccagccucagccccacucccaccccacccugcucuuccgugcauccagaccugaucaucaucuuccugcucucuggagcucaaacuuccgcucguuaauuuaacacagugccuccucaucucccgcccugucgcuggguuuuguuuuauuuuguuucauuuaccacuaugccuuagccauuuaauuacuuucugauuuaguuccaaaucguaaaacuguucuuauuauguauugugaacuuuccagaaacgacuggcuggcgacagauggauagaugaaagauugaaugaacaaguaaugugagagaaagggaagggagggcgguggcugcugcgagcccaucccuaggucacgggagggcucgcccccgccuggcucgcgcugcuccgcgucggaacccgagagcagagggagcgguuucccugaaaagagagggagaguuuugugagagcacacaggaaaggccgggcgcugagcggcgggcagcggugaguucggggagcaagcuagggccgcgggauguguguugucaggguguggagcgcagccgcugguggcugcguugagcagagcguccggggaacccgccuggcguccggggaucggccacgcgguugcugacugcgguggggcgggaggaggggagauugggccgggccagcauggcgugcacgcccguugucccugcgagucaggugugccgguucgagucccagagccgucccuaaccugugaaccccucagcuacuucccaccuugggcugugggguacuccggaacaaaaaaacggggccaguaauauuugaacccuaaagggugggucgguucauucguucuauuuauuagguucugcagauguggaugacuagaaucuguucuaaaaagcucuuuagugagaaaaccccuacuuuucuugucagaagagggucagaauuugagaguuuuuggguuuggggaaagccuguuuggaaggcaaagauauguuaauuuaggcauaaaauuugagauuuuuaacugacauuagugagaaugaaaauuuuggcuacugagaagggaauauacacugaauguauuacagauugugaagacaaauacagauuuuauucacaacugcuucacugcaaaaauuaaugguguuucccuuuuucucuagggaaaauguuaauugacuuauccagggucucaccaucuguaaacgacaaagcuaggauuucguuaagcaccuuggccaguccucuuugcacacuaggcugccugcauauuucccucaucuuuuaauaauauagaaagcauuuaagacagggugggcguggcuuuuuaaaaagacaguccacucagaguguugucgacuguccgauauucguuccaugccccucucuacuugggugauguuccagccuuccagcagguggaacagucuagagucuccuuaacugcacacuguuuccccacaaaccuacaauguaaauccaaagccuugaaaucacuuaacaauccguugcccaagcacaaaaccuggcuccguuuccucguccuucaccucuugcaaucaguugaucaucaagcccugcccauuucuauuucauaaagaccuccaaaucauuuguugacucuugucuagaauuuguggcagucaccccucgaauggcuccuuuuagauuuacuuucagguucuggcagucuguuuuauauucugcaccucaaaugugauuguuauucaucugcuaaaaaaaaaaaaucucaaguuuuaaacauaauauuguuuuaaacauaauauccaaagaccuuagugcggauucaaagccuuuucaaaucuucccccuccccaugaccccaucguucaucuuaaaacauugauuuuuaaugucugguguguuugcaaccuccauugcaauuauguuaguaacugcuaacuaaaaaucauaugacuacucaguucaggaacaaaguaggcuuuuggggaaggaagaugaugaccaagaauauauauuuacaacaaauuuugugcauuuuaaauaagguuuaauaaagacaguaagggcugggagucacuguuguagaugcuauccuguauguauaauaucgaugguguuuagggcauggucauccccaagucguacauuggcaguuggggaaacaguagaagcaggaaguuguugcuaaccugaagcagacuuccuguauaaggcucuuguguuagagcuaccugucagaugcuuguaggaaaagaaauaguacuuuuauuucuuaagaugaagggacacagaagaacccaaacaaacagaccuugcuggucuuuuaagucauagcaccuuguucagucauguuucuguagaacuuacugcuuuucaucaaauugaccacacacacagggauuuauuucugaagguucugugucaugaaagcucacauugaauagauguauaugcuuuuuccuuguuaauaugucuuuuguuauaagauucuuaguuuuaguaaugguugagaagagaaauuacuucagucuacuacuuaccuguguuuuucaaaucacacacacacacacacacacacacacacugccuuuguauacuuauuaguucaggucguuauaacugggauagcuuaaauaacaaagauuacuuuuuacaaugugcaaacuggaaguaugaacccacaaugguuguuggcacugggcaugguacccucuuccuaguuugcaaauggcugucucauugcuguguuuucagaugguuuggagguggaagggaugugaggcugucuucuuagagggguacuaguccauucaugaggacagcauccuuaggaccccauuauuucuacauccuaauaccauuucagugggaauagguauucaggccauagcauauaccuaacuccuuuacucugacuucugaccugcaggacucuggcuccuucagcuccaucccaguuaggccuguuuuucugaacucaggguagauccuguucucauuccccaacauguaucuuaugguguugcagcuuugccuguaugguuguauugcaguuagggauuuaagauuucugagcauuugagagugggacuuacucuucucugcccuagcccuuaacauagaguagguauucauuaaaggccucuugaaugaauaagugauuaggaucagaugagagaggucaauuauguggaccuuugggaauuuucuuuuucuuuuucuuuuguaucagccuagauggcuucauugauguuugcaguguggcuuuuucuuccuaggagagggauuuuaaccaagggaaguuacagagagaaauaauuuuuaucuguuuagauaauaauauauauauauauauauauauauauauauauauauauauauauagugagagggagagagagugcgcacaauuguaagaugucauuuagcacccuacaacuuagaggauauuauguaaaaguucugcuuuuauuuauugguauuuugguugguugucuucuuugaauguaauugggauaacacuaguuuuaaaugccuuuuacucugcuaauuuuauuuaacauuguauuugguuguuuuuuucuauaucuaugaaaauucucaauuaaaaaaugaauugcuacaugucucacucacuuaauauauguuuuugggauagcuauuaugugccagaucuuacuugauguauggguucuaguagugaccacaguucugcauucaguggaccuuacucuagucagagaagcuaaguaacauauuaauauaaauaucaucaaauggugucauacaaaaacagaauaaacauauuacacuauuuuauuuuuucaugaagaacuaauuuaucuuccuuacaggaguagguaugaguaucugucuuguauuuuguuauuagugaauacgauaauuuaaaaauuaauuuuauaugugaauaauaauagcucuuuguaauuugcacgccuuugauuaguaaauugaguauguuuuuucuuaacugagccacaugcauugcuuuuuuuaaagcauguccuccacugguuuucauacuaaagaccugguguuuucuucugucuuaauaagcuguugcuggucuuuuggguuccuuauauguacuagacaaauacucaacaaugguauagugggacagucagaagacacacaucagggaagccuggcuauuuacuuccuccuuucugcccuccuuccuucucauauggagagggaaagguggguggauacagaaggaggagagccaagguagaaguacaugaaaaagaaggaagcagagauuggugaguggaucagaagaugcugauggugacuagacaggaaaggaugagaagaaccagagcagaaguagcaaagggaaaacaaaaaaggaaaagggaggggcggggagaccuuagaggaggacuguaggaugcucugugauuaucuuggauaacuuuguuuucuuuuucugccuauuaaaucuauaggagaagaugacugcauucuuuaaaacgcuucgaaaucauuggaagaaaacuacagcugggcucuguuugcugacauggggaggucacuggcucuacgggaagcacugguaaauacugacagcccgacaccauccgcaucccacuauagaaggaucuguagggccaggguugaaaucuugcccagcugcacuucucuauaaaaugcgguggucaaacaaagccauucaaauaaaaacaaaggcaaaagcuucuuguaaccugcucuauguaguugacuacauauugcacuuuauaugcacuuuauugcucacagaacauauuucacacuguagugugcagucugauugauuguagcugugugguucuguccuugcuaaguaucuucagagcuaaguaccacauccuuauaaccuaugugcacucagcuuagcauaugcaagguaagaaagaauauuaaccuucccuuccuucuacccuggaccccccggggagccuaugcuguguuugcagggccucgaaggcacacuggugccaauguggagacucuagccccugcugggugaagauccaaagagcuuacguguuccuuuuucaguauguuuccagaggucuucugauacucccuaaagucuuaagacuuuuuaaaaggcccuuuaguucuccagccugaaauguccucacucugaacaggguuugaagcagccuuuauguuuguuucuguaugugguauaacacaaagguauagccucacuguuuugcauguggguaugugggcugcacuguuuauagaaaggguuucuuucucugcuguauggucucugggcuuuguugaagguauuuugaccauauaugauggagcuuuaugucuaggcugucuguccugucccuguggccuguguauaucuauaggccagaaccacauuauuuugaaaacuauagcgguauaagaaguuguaaaauuaggaagugagacucuuccaacuuuguucuuuuucuagauuauuuuggccauccaggguauuugagauuucuuaucaauucugagauggcuuuuuccuauuuuugcaaaaagugccauugagauuuugacaggaauuacauggaauuguuaguuugcuuuguuuuguggccauuuuuaacaguauugucuuccaguccaugaacacaagaugucuucuuguuugguggcucuuaaugaacacaucucuuaucuuaccuaaauuuauuucuaaauauuuauucuuuuugaucuucuuguauaguugauuucuuaauuucuuuuauguguuguucaaucagugcauggaaaugcagcuuacuuuauuaaucuuuuuggguuuuuuuggucuggcuuugaugagguuguuuuaugguccuaacauuuuuuucuauguguuugggugaaaccguucugauguucuauauaaaaagcucaugacaucuguaaagacagauaacuuucuucuuuuccauucauuuuagaugcauuuucuuucuuucuccucuucuuuuucccuuccuuucuuucucccucaaccuuuaacuugaucgugucuugcuaugcugcccaggcuggcuaugaaacuaggaucuuccuacuucggccucccaagugcugguauuauagguaugugccaucacuugcuuggcacuuguaucuuauuuuucuuccauacguucucugacucaauuacccuucuuguacugccuggccuuguagucucuugaguccuccccuuagcacaauuggaaacauuuccucugaucccugccuuccaaacuuacacuuuugcccucugucucucuuugccucucuccuucuuguccucugugaccccuuccuucccuuucuucaagcaugaggaaagaguucucugcccgaugcccucgucucauaugucaugcucuccccugaaugaucucaguuguacauacugucuucuguccagucccagguuuuggucaucucuauaaaaaccucuucugagcuauagaccuagguguauagcuugacggagauagucucagugccauagucuuguggcauuugaacacuugauccccaguuggugguacuguuugggagguguggccuugcuggaggaaaucugccauuaaggguggguuuugagguuuaagagacucagcauuuauuguuugcucucucugcuuccuucuugugggucaggguaugagccccagcuuccuucuucugcuaccgugccuuuguuaugccauuguggacgcucaaccucuggaagcaucagcccauauuaacucuuccuucuauaagaugcgucagucgugauguuuuaucacagcaauagaaagguagccaauacaaguacuuaucuuagggugcuucacagguaucucugacucagcauccuaaaaacaaaaauccuccugcucaaccugcuccucaguuaguggacaugcucacugucuauuucguuucccuagauauuuggacagccucucuuccuccuuacccacguuucuuaugcccugugcauggauuugaaugguuuuagucuccuccuguguucuguuucuuuugucuguccccacugucugucuucauccacacugcccucccuuccuguguggauuauuacgagcuucccagcuuuuugacuguucuguuuuguacaccauugccaugcugcuguuuugcaagugaagguugcuguugcuuuuuagacugaaaucccaaauucuuagcagcaugcuugaauuuggccucaucugcauauaucgguaaccuucccguaucuuacauuuuugcauauggccuucaagucuacuuuuuuuuuuuuuuuuuuuuuuugguuuuuugagacaggguuucucuguguagcucuggcuguccuggagcucacuuuguagaccaggcuggccucgaacucaagucuacuuaagugaugaaauuauuauguuucagaaucccuagaagggcuuugcauauggcauccuuuucugagcaacugaaguuucuccaagucucaaguacugucuuuucaaagacaucuucccucucuaauuagauuaggcagucuuccugcauuuucuccauaaugcuaugaacucuuccucuauagaauacucuguuguuguggggccagugagguggcucaguggcuaaagugcuugcugugcaaacgugaggaacugauuugggaaccugagcagccacauacaaguuagauauggcagugugcaccuuuggaguuguggagacaggacaaucccugggcuuacugguauccaaccuagucaaaacugugaguuccagguucucugagagacccugucuccagaaaagguauagacugauagaggaagacauccaacaucauccucugcccuuugugaguaccuaaacaggugaguacacugacacacgcacgcucaugcacacgugugcacguauacacacaaaaccccacucauugcuauugugaugguuugcucugcuugugucuucuccuaucauaauacuauauagccucuguauugcauggcauuauccugaagccccugcacauagaaggacucaugcacauguguuuauugaggaggaugaaaguauggcacuaagcagcagaguagccacugcgcuggccccuucugaccucacauccaggcugucaaauucuaaacaaguagugcacuccaucuauaggcagcuuccucuuccauggcucacaaauguauccugaaauauuccugaauuucugguaaauccucugccuucucuauacucagacaaccuuagcucucauuuuaaagagaaaauuaaaaacuacagaccgguuauucacacacagacacuuuuguguucuuuccuucaguggaugaggcagccuuccugcugcccagugaugucuccuuuguacccagcccucaccaucugcgccuucauuugaguccuuaaucaucagcuuuuuccuuguugaucaaaaccacuccaaacuuaaacaugucuucucugaagugacaauucuguuugucuacugcccucccugucuuuucauuuguaccagcuuuuaauguuuuccucuugaccuuuucugccauuuuagacucagguuaguggaguuugguuauaggccaucauuugauugagcaggccuuugacaaagucaugccuagccucuuaaccaagugaguacuuuucaaccuuuaccugcugcauuccgcuggcugucuuugaucuuuuguuguuaccuuaggcuguccuuuuguuuucuuugucuuucaugcuggugucuuacagacugcagacuuacuugauauguuuuguaaaugacgcccaacuacaaggcuauuuagagguaagagagagagauucuggguguguuucuuuagacauuuaucuucucuugacacuccauguaaauagaagaggugagagggcacucacagcaggucugcuuuaauuuuuauuuaucugucccauuuuuauugccuccuuuuauuaaucuuuugacaucaccuauuuguaggcuuuuuuuuauuguuuguaguaauuuauggauuucuucucuuuugagaguuccauauauuuucucccuucucccaaguuucaaagaagaaauucauuuuuauuuuuuuaagauuucuccuauauaauuuuccugccgaaggcugcuguaguuggcaggagcagcaggaauggcucucagcgcagcucugggagagcaauugaagaggaggaaaugaccccgugugcugagaguaaagagaguuuaaguauugcucguuccucuccagccgcucuuaccgagccuucugggauccccagggaagauuauguuccaggcugccuguucaucaugucagcgguuuaccugcaauagccuuucuacuuuucuagccuuuuaguagcaaagaaccugcugauuaaaaaguagcagaagaaaggaagcagcguggugugaaaguugucacuggagucaaauagcagugagacauccuaguggugugaccuugggcucuugaagcuuuaccuucuucaacuguggaacgggcauaguucuauuucauugagucauugaaagauugcuaagaucacugcagaggucuagcuuagugcguucuagacaugcauucaguaaaugcucugaguaauuucauguaguaacuacuuaguccauggagaguuaaaacaaagugcuugcugguaucuggacaaugaaugacaugggauagccacuagggcaggaagacaaagaccugccaaaugauugaagaagaugugagcccuauucuauuucuccuuccauauauaaugagacaauuugaaaaagucuaagguaggggcugaagagauggcucugugguucugaguacuggcugcucuugcagaggaccugagauuguuuuccagcaccuacauagucucuccaggaggagcugauacuuccuucuggccucuggguacuaugaauauacguggcauagguacuuacacagauacauaagauaaacauaaaauaaacuuuaaguuacauucaguguuaacuucagaacaauaaggcccaaaccauuaagaacaucaagucguaccugaacccuugaggaccugacuggaagucauugucuguaaucacuggaggccuuguccuagcuucuucugccuuuggucugucuuacuguuuuggucauggagccuugacaccacuuuucaacuaaccccuuuggcucaguacugacggcucuaaucuugcuucuuuuuggccccacgucucaguuuaugccucuggcucuaggcuucuucugauagcaguucuacuacugucccuugccugugacccaaaucucucuucucaagagacugucuaccaucucaaguuggcuagaauuccuacuaucuuuuccugaagauuuaaaaaaucucauucacauuaagucccuuguuaagcuugcagagcaaaugauacuguagcuaugguccugggcucugugcucauugguuuguauuaaucuugaagauuucuuuuccucuaugucauguaacaccaaacaugacuagauguacacuuggccuuucuaaacaaugguuaugaaguugucuacaggguuuuuuucagugccauucaauugauucgagaccuuaaugauaauagcuauuaauguugcugggucugauucucagcucuugguauuuaugacauuguuuauuuuaccuaauaauuugaugauacacuuauuagucucauaguagcaugauagcaugagauucauagcuacaugcaggugaagaaauagggacagugagagcauaucacacuguuguugugugagugaccagaggauuugggugcaauugccacgcuauugagaaagaagggacaguucucagaggcccccuacaguaacauaguuaagauagagccuggcaauaugaaacugagcuucauauuuaucagcaaugucuagaaguugcugauuugugcugugaagagacaccaugaccauggcagcguaggcacacauagcacuggagaaguaguugggagcuuauauauauuugaaagaggagagaaagacagguggaggggguaguggggagaggcuggcaaugacagagauuuuuugaaacuucaaaguccacccucagugacauauauccuauaugucacaccuccuauagggccacaccuccaaauccuuccuagacaguccaaaaacggggcaccaaccauucaaauauaugagccuuuaggggccauucucuuuuaaaccaccacaaguaguggagccuuggguaccuucuccuguccauauuagauucucugccuauaaacuggagguaguagacaguaauagugcccuucucuaugagcuaccauacagauuuuucuuagacuagaacuugguacaaagaacaguaacaaacaacacaucuucuuuuguuuuuucccucacgagggaaaucuuaaaaagaugucauuugaguugaagacuuaguggagauugguaaagaaugugacuagaguugcauguuuucaauggacuauggaaaagccagguuguagugggguuuacauauaagauaccugugucugagcagcaguaaagaucuuaaggggagaagaauauugugaacaagguagcauuuuagagguuuagccuagccuccugugcagggugcauuuuagaaguugaucgcagagcuauuaaaggccugaaauaauggcagcauaaggaaaggagagcaaugggcagauauggagcuggguacuaggaguggcacagcacuacagucacgaggcuuccaggauucagguuugcuaccugucggcuucauggccuugucagucacuuaaaccacuuaacucugagccuuggcuccucgucccacaugagggauaauuauauguguuuggcaggugaguugcaaggacugaaugaggaggugugggucagcugucuuauacugugcuuaaauuuagcucucugcagaugcuagcuguuguuauugcaaggugauugacuggguauuuggcugaggcagaggagaaaucauuuuguggcuucaagacugguauaauuggugaugcagaaagaagaaagucaccaaggagaauugguuugaggaagagguauuauauucuauuuuaggcacacugaguuugagacccugacaggauaggcaaagggaauguguuagcugccagguauaaauuaugcaugagccacacuugacuagacugguauuuuuuccuuugguggagauuaugguuucaggagugucucuggaugucugaaagugcaugcuuuacccugauaucagcucagaugagccucugacucuguaggccauuguccaggcgcuggcuugcuccccuguacaguugcguugccagugcugaagcuaggaaguuuauuccccuuuguagcuucucuuuguuucagauuuuguugaaauuuugauaaagccguuuguuuuguuuuuuagucauuucaaaguucauuuugcaucaccccaucccccaccccaugcacaggcugaugcugaaauugggguuuuaauggguucuauuuaaagaagcucauuugugggcaauuaaauaacaugcuugucaacccagaugugauagggaauaagggaaccuuuuuuuuuuuuuuaacuuuuaaauacaaugaaguuuaauuauauuccauuucuuuucaacuccuuuuguuagauuauguggaaaacagauuucuuccuuaaaaaaaaucuguaucuguacuucgcuguaucuaagugggagagccaagauggaagacaggggguauauuuaaguuauauuuugucuuuuuggcuucacaucauugaggaaauuuuuauguuagugguuuuuacuuguuccaaggccugaacagaaaauaauuguagcugaugaugaaaguagcucuuccuuaguaguaaucaacacuucaaauguaucauguuucaaaacacugauguuaguagcuaugaacuuaguauuuucaggucagagguuguccagaucugucaaggagcuuugaaccuguaguguguaccaucucaugugggauuuuuuuuagagagaauugucagguugcaagaaaagggagauuuucucucagcauauauguucuugaauaccuucauaauccauaaucucugaguagcacuuugucauuucuuuucuagauuugguuaccuugcuuauaccugagacucaguauauaugugcuuuuaugacauuugccaauauauaaggauggucacugggaccuagaaaacuaguguuuuguugccuaauagaguggcagaaugacauuuguauggaaaaagaaaucucgaauaagguguuuaaauggauaaaaaugaauggauagaaaaauguagacaugagagaacugacucccaaaaguuguccucugaccuccacauauaugcuauggcaaaugcaccacacaaacauacguacacaaauaaauauuaaaaauuaauuagauaggaguagaaauauuacacacacacacacacacacacaagcuagaggacaauggaugcucucuaaugguaggugaagcauccccuaaugguaguauaacaacacauagaucgaagcagaaauguagccaccagccagagauggaccccuauacagaguauagagaauucugucuuugugcuuccaggacuaucagaauggugugguaggaagaaacauugguuacuuguguggacuugggucuagaaaaaaaaaaggaaagaauaauuucauauucuaaggaaagaaaaggcuugugauagaccuuuucauuucucuuagucaauguauggauguguguguguguguguagugggggacaguacagaagcaucgucuggcuaaugaaaaguucuauagagcaggcucacaggacaggcuagucaugagagagaccccucaaggaugccgucuuuaguuaaaucauuuccuauucugagcuggacggggaacagacauaaggaggaaaccugagaaaccaagaguuccucgaagcauuuccgaguaauagcuuauucuauaacguguagaaaaguaacugaucugagaauauuggggaaaggugguuuggggauuccuuauuucagagugugaaagaaugggcaccaaucaagcugcuuggaagagccuuuggagugguagaguugaggccucugucuugggaagaggucguuuguugcugauaaauacuacugaauuaauuauucagagguugggaaagauuuaugggcuugucccuaagcccaccugcagaagaaagacuguaauagcacuucaguaccagugcagggagaaaguaaagugggugacucaugagcaguggacagggcucuguuacugcugaaaauaucuagaaggaggcagggguaucagcaggccgagaagcaggguguuugaguucuagugcuaagccuccagucacuuacuuucuuuauuuuuauuuuauguaugugaguauaccgucacuguccucagacacaugagaagagggcaucagaucccauuacagaugguugugagccaccauguaguugcugggaauugaacucaggaccucuggaagagcagucagugcucuuuaacugcagaaccaucuuuccagccccuguagucacuuucuaagagugugcauggccacaggccagagguuaccucaaauuaggucaacuagacauuuucuaggagcucaaagggguugagcuaagugaacauucugcagucuuuuggggauggagacugagguuggacuccuauauguucucuuuauacgucauuacaagaugggaaucaccuccacugugcccuuuguuacuagaagggcgcuguuacgccauuugacugaugggguuggguguauggaagcauuguaaaggaugggcuauauuguuuuuaagaacauuucuaccuuggcauuucagaugucuaggaaaugggacuugaguuuggacaccauugacaaaaguauuuguucuggcugcuguuugccuuuccugcuuuggcaaagaaacaaagaguaaaaucagggauugcagaccuaaauauuacuaucaauauucaggaguccauguuuuggcagugagcaaacccaaaaacucuuagaaucacaaaucucauucaguaaguggguucacacauuuugccaaaggcuuguuggaaguguuuuuaguuuauuguugaauacccuccugcaggcuucuuucucauucccuguguagcucuuguauuaaauuuauugaguucuauacacuuauuguuguuguuaauuauaccacuuugucucuccucucuuccuucuguuuuagcaaauaauaauucuugagagaacuguuuucgcuuuccuuuauauuauuuuaaaaugugucuuccacuguuaaauuaagccaccaacuaaaaagcugcugaccaccuuugugcacuuuuaguccaggaggcugccuacacauuugcaggucguuuguuaacuuucuuguucuuuacccauuuucacucagcaacacaacuguagugccuuugaugccagccaucaccuauauggcuccuaguucucucuuaguucuauggcauugaagugaagacauuuggcacaguauauaucaacaauauuguccuccuuuguacaacaccaggacuacagagauuucuguaucauuuugggcuugagaaaguugagaagauauaaauuuccuugguguccaucauagggagucccaggaacagggaaagaugcuauccauaaaaacagagauacuggaguggaggaccucauauccuuucaggcauugaauuguccccuugggguucuaaguugucacacugacuuuuuuccccaaaagaacugaacauuuuuuaggaaggaaagauugaacauucuuccaaguaggcugcacuucccucugcuggaucaaagcuucaucucauaggcacaagugauguggucacugucuucucauguguaacagggcccgugcaguagccuucaccuccuugggagggagucuaggucaugaggaagggguugaaccauguaacugggaaacacuuucccucuagccacuggcugagaugcacuguuuguacugcugugauuuuuuuuuuuuucucuaucccuccuucuccaucaacaagaagugagugcagccccuggcaaugugaugacuaauuauuuuaggaaaccugagugaguuacugugguugcuguaaacaucuaaacuugaaaucuguuuugugcaaagcaaagacaguguuugcaugcaccaagggaaaacuggugguagaaauugcugaacaauuugcuucuaacuguagugggaaauauccuuuuugagaaauacgauggaucaauguaauuuuucucuucauguaaagcuguuauugaaguaacaacuuaucuuauuuugcaguccuaaaguaauaaauaaaacauuuauggcuuggaauaaauugagagcaucccauuaccuguaguagcaggcaaguucacauucuuuuaaagccucaggcaguaacaucagcagauuuuuuuuuuucuuccuuauuuucuaauccagaagcuucuaauuucuuugugucaaagagcuuccauucugguucugaguaggugucgagggacccuuucugauaugacuacauuuuggagaaccucuuguaaauuguauuuaucauuagugcccaguagggaccgugcuguauagaaagaacaugggcuaccaguugauguacagucaauuuucuauguuugguagcuaggucucugacucacauucagacucuugauccauuagguaucuagaauuuucugacacuggaacaguucucgggcuuagugguuuacagaaagaaccucaucauugcuuuggucuuuuaagaguaccaguugcauccuguucuucauguguaugcucacacacagccugagggccuucugaccuggcagaauucccaugaccaugugggguuuuucuuccuuguccuuggcuacacgggagaauugucucagaugaucugcugguucaggauugccagguacucagacaagaauaaccuucaguuuuccuucaaggacgaagugugccuucugaacacagugagucaauuuuccuguucaaacauuugccacuuauuuauuaacaaguauucauugaguucccacugucugcaagagucugggcuguggguuguauaggagaaaguacuggcaaauuauccuuuauuuaaauaaguuauuuaaaggaagacaagaugaguaguuucaugugugguugguugaaagcagggguggguuuuuuuuuguuuuuaaauuuuucuccaaauuuguauuaguugauuuucauaacuaugauugaaauaguaaacagaaacaauuuacaacaauggauagaaaucuuauuugaacucacuguuucauauggguuacagugucucccugcaugggaaggcauggaggaaggaacauguggauggauuagaaggcaagagaguucagacuggaaccaaggacagaauuaccuucaaaggcugaccccauaguggcccuucagucagcuaggcacuaccuccuaaugugcuauagcuuucaaaacagcaccacaagcuggggauggagugucugaaacacagacuugcuagagauauuucagauuaaaacauaacauuuggggagagacaaaaugaccaaauacuuggaugucugaauucuacuaccuuuuaggagaagcaaaacaugaaguauaaaaguaguaucaaagggaaugaugggaaauaaauaaggaaaguuuaacccuuccauugguuauccaccagagcuuucacuuugucucccuucauuccuuccuuccuucuuuacuucguuuuuuuuuuuuuauugaaaauagauaucuuucucauacaauauauccugauuauaguuuucccucccucuucccuuucuauuuccuccccaccuccucuccucucuggaucuacucuguuucuuucuaucauuagaaaagaacagacuucuaaguuaacaaccaaacauaacaaaacaaaauaaaauauaauaagauaaaacaaaaacuaucauauugaaguuggacauggcaacccaacaggaagaagagaguccuaugaguaggcaaaaaauuaaagaccaacuuguugucacagucaggagucccauaaaaauacuaagcuaauagcuaaaauauauaugcaguggaugggcccaugcuugcugcuucagucucugagcucagaagcacuuaguugauucagaugaccaugcuuuccugggguccuccauucacucuuucugucuccuccucuucagaauucccugagcucugaggggaggguuuggagaguccgauuuggacacucugcauacugucuggaugugugucucugcaucuguucccaucugcugcuggaggaagccucucugaugaugacuggauaagguucugaucuaggaguauaacagaauauuacuaggaauaauuuuauuguuuguuuguuuuuuaagaucagucagguuuguguuuaccuuaggucucggucuaguuucugguucuugguuauccaagcaguguugggguguagguuccuucuuguugagugggucauaggucaaaccauacauugguugguuauuccuacaaggucugugccaccauuguccuagcauauuauucaaagaugggucacagguuuuguggcuggguuggcguucauguuucuuuuucuguagccuauagaguacccuucucuacuaaagagacuagacuguaagggcuccauguaggcaccagaucaacuucucuauguucagugaggugugugggugacaguggcaauaccccaucccaugauaauuugcagagagcagccuuuugucuuaacaacugccuggguuguuuggggauuucugucggagccucuuggccaacaacucaauugaauguucuuuaaucccaccacuggaagucucaccuggcuacaagagauagccaauugagauuccauauuccccauuacuaggaguuuccauuaggauccccuucauagagacuggaaaguuuccacuguacuagguuuccauaccacccuucaagugccccucaagucuagucaucuuuccccaaacucucucccugcaucccauuucuccccucaccugauucccuguugaaucccuaugaacucccaguucacccagaaaguugguucuaauuacuccucucagggagauucccguauuccccucaaucucuccucuuuaccuaaccucuccgagucugucauuuacucaaugauaagugaauauauaccauauuuaucuuacuaggucuggguuaccacucaagaugaguuucucuaguucuauccauuugccuucaaauucaugaugucauuuuuuaaacagcugagucaugcuucauuauguaaaugcacuacaaguucuuuauccguucuucuguugagggacaucuagguucuuucuaguuucuggcuacuaugaauaaagccacagggaacacgauugaacagauauccuuguguuaggauggaguguccuuugaguauaucaagagugguauagcugggucuugauugauugauucccaacuuucugaggaaccacuauauugauuucaguaguagcugucugaguuugcacucccaccagcaauggaggaguguuccuguugcuuuacauucuugucugugugagcuguuacugaucuuagccauuuugucagguguaagauggaauuucaaaguaguuuugauuuccauuuuuuuuuugauaaauaggauguuuaacauuccuuuaaguguuuuucagucauuucugauuccucuauugagaauucuguuuagauguguagcacauuuuuaaauuggauuauuuggguuuuuugauaccuaauuuauuaaggucuuuauguauuuugaauauuagcacuuuauuggauauaggguugaugaaaaauguuuucucuauucuauaggcugccucuugguccgauugacaguguccuuugccuuacagacacuuuucaguuucaugaggucccauuuauuaccuguugauauuaaugccugagcuaucgguguccuguucaggaaguugucuccugugccaauguguucaaggcuaauccucacuuucucuucugucagguucagugugucugaucuaauguugagguuuuugacccacauagauuugaguuuugugcagggagauagauauggucuauuuucuauuugcauuuuucuacaugugguuuuucagggggugccugcuggaguugggggaugggauucagccucaagucaggggagggagauuagaaggcauggccuguggaauccacagaccucucugcagcuuuuacuguucaugccgcaauaucugccuccugauaguuacuuuguuuuuucugcauuuuugucacauggucauauucucugaagcucuagcaaaaccauauuucugaaacauuuuuagaauuucuugaaguaguuguuagagcgugauauauagaucaucaaaauauaguugacuauaacuaucuguaggcuuagccucuguggacugaacccacugcagauuaaaaaguauucauaaguauucaaucuauacugaagauguauauauauuuuuucuugucuguguuugagcaauacagugcaaguguuuauuuaaguagcuuuuaucuuguauuaaauguucugaguagugauuuggguaucuguaguggaggagcggugucuuagauccauuuucuguagaacacuggaggacuguccaucuuaguucaaggacuuuuuuuuuuuuuuuuugagaaugcauuuguguuuuuacaaauauccugauucagagaauaagacaguuuaugugauuuagauauuagaguuaacugugaucauauugagauuuucuuuguaugggcuaaaucagugcauauucuggcuuuucuauaggcugcauauuccauuuugcacauuagauuaauauucuuuugauuuugaagaauauucugaaagaugaggcaguauuaauaaugaugaagggugggggaggggagaagguuacacaacuccucugccaccugugugcagaguuaguuacacagcagguggggccugacccugacugucagagcuacauauagaccagcccucauaacagaucagugccuuucaacuuuauuaaugugugcuuuuaagguacuggagccauuauacuuuucagggaacauuguuucuagcuuucaggucauucacuauuuugggguauuuuguugcuugccuguggaaaacagguuaacagguagcaacuguggcaaaaucuauuguuuuauucucauuccuuccuaauuaucagucuugaaauuacuguccauugccaauuuucaggucuccaguguuauaauggugaucaaggaauauauguaaaguaaucuuuuuuuccuuuaaaauauuuucuuugguuauuuucuagcaauaccaaguguguaagugcagacuguggccuuggccucugcaaacaaucagagcccauuuagucucaugacacacuuuagacagcuuuuaugcuaaauacauguuugcauucugaaagaauguuuucauauuuggaagccaaacuuuuaccuccuauuuacauuugugauauaauagaguaucugauagugcuauaaaaaaaagaggggucucauaaaacaguaacagaagaagcgaaauaucaaauucagcuuugucaaaugacccaaguaauauccacuggguagaaaaacccaagacguauauuaguuucuuguuguugacuaauaacuuaguuuggcacaccgucaauauuuauuauacuauuuuguaggccaaagugcaaggguuuacaaggccugccauuccuucaaaugcuauaaggggaaaggcuacuuccuggcuuuuccaguuggcaaggcugucaacauuccugggcucaucguuccuucugucuuuaaagccaggaggugaccacccucccagaguuaccuguguucugaucacagccauaaaagccucucugccuggaagacuuaucggauaguuucggaugcucccgguccugaagcucuaaguuaaucugcucuuuccuguugccauauggagcuccagcucuucaggcucuggacacuaggcucuagaugugucaggagucugggucauuuuucuacacaccagaauguagaaauagguaauacaagcuuucacucagagaauguauuucuugaaugugcuccugguuugagaucaggucuuuaagaaaucuuuacuuaagguacuuuuuuuuuuuuuuuuaagcccauccauucuauuugggucuuaaucucuaggaaugcuaaugcuggguuucuuuuguuugcuuugauagugauaaccugcuaagaagagcagccugucaagaagcucagguaaugccauuuccugugauaaaauuaaaucgcccuuaucuccgcugugcagaagacacagccacuccagggacugacuuacuuggggucuugcaucagugcagugugacuauuuucccuccaccuccagauggaucaggccaucagccaacucugaguggaauggguggaaguuagccaucuggugaagaacagugcugacgcccacccuguuaggcuuguuuacuccuggaucccucccaagaacacauaacuggacggcugaagagcuaagaauuggcgugcguuugcaguuauccuugaauaucuggcuaaacccugaaucuggaauagcccccagggaucuugguucagaacagauuuuaccucugaaagucaagucuuguuaaaauuguuuucuucugcuuuuaaagcccaugucacuaacauagcugauuccuagcacugcacugccauccaguuccacgagaugcugcuuaagcauucauuuaucuggcugugguggugauaguugaguuguaaauccuuucagauuuaacacccuggcuuuccucucuucccuauuuguaguuuauacccugcagauggauuucugugacucaguaccuuuuuguuauaugucauuuaagcuuaugaugucagaaaugccugaagagauguaugaaaguuaaaauggcaaagaaaacgaacacauuuaguagaagugggugucaaaccucauguuuguuucugaauuauuuucauagaugauaaugacaauagauacuauuaauaaauccuucuuuggcuccaaauauguuuuaagaauuugauuuuauuucugcacagauauaccaucuaguauagcuuuaaguuauuuuaaaaauuaauuuaaauaagcuuuaaauuuuauuuuuaagaucagcaagaugcuucacuuucaggaagcugaggcaggaggauugccauguguuuaccuccuggguuacauaaugaguuucaggccagccugagauaggcuaugagucccucaaaaaauaagcuguuggauuauuuuugagucucaguaugauacucuagaacauauauguaauucuuaaugaucaaaucaagguaauuaucaaauaaaccuuaauauugaguuccagggaguucugcugauacacucuccucuuacuuaaggugaauccucugcuuauguucuuucugaauuucagccccacuuacuuucccaggaacaaggucuuguuaggaacuuuuccacauacugaccccuuacuguucuaauccuccaguccucugcacauguuuagcaucuuccaugugacuaaaggugcauugauccucucagcuuucucuacuuuuccuauggucuuuuuauaaucuaaauuauugagugauuuaaaaaaaucauguaaacucaacucuaguuuuuacaaacuucuuaauccauuauggaccugacaccugacuuuacaagucuggcuaggaauucuugggacuaggaaaugaggauaaggaggggcagucuagugcuguagaucuggaaucuggcuacagaguacugggguacugggaagagauaccaccaugaccauaacucuuauaaaggaaaacauuuacuuggggcuggcuuauagguucagugguuucgaccauugucaucacggcuggaagcuuggcagcaugcaggcagacaagguagcugagagagaaagccacacuggaccuggcuugagaaucugaaaccucaaagcccacuuccuaguuacacacuuucuccaacaaagccagcccuccacuaaugcuauucccuauaacugugggggccauuuucacuuagacuaccacauucugcucccugcuccccaugggccuguagccacaucauaaugcaaaaugcaguuagucuaacuucaaaaguccucagucuaucacaguuucaaccauauuuaaaaguccacaguugaaagucuaugauaaucaaggcagucucuuaacuauagccuccuguaaaaucaaaaugaaaaaaaaaaaaacaaagaaaaaagcaaaucacauacuucuaacauacagugacacagggcauacauuacuauuccaaaauggaggaaagagaaggauaaugaggaaguacuggacuaaagcaagacugaaagucagcugggcauaccccaaacuuugcaucuccaugacugcugucaaaucacacuucagcucucaaacuccuuucacuguuuuugacugaaacauaauucuuucucuuggacugguuccauucccugauagcagcuuuccuuggcagguaucccaaggcucuggcaucuucaacauccuggggucuucaaggcaguccaggccucaccuuuacagcuucaugcaauggucuuucuaggucuccaagaagggacaucugcauaugccuggccucagaggcuuuccuuaguuauggagggagacucuauaacucuuuucuuguguccuugacucuauaaacuuagguaccauguggcugaagcugcaaaguucugcugcuugcgugaaccccuuauucaaauacauuuucuccaguuuucugguuuuuuaauuuuuuuuucuuguuuuuuuuuuuuuuuuuuacuuuuuuacuuuucagcuuucugguuuugauaguuuccuucacugccuaaguuuggcuauccuggagcuuccuuuguagacccaggcuguccuugaacucuaaaaucuacuugccuuuuccucccaggugcuuggauuacagguuuguggacuuggccuuaugcuuuuauuuaauuccuuuuucauuuaauuccuuagcugggugggggucuuguucugaggucaccacucccuuuacuccacuuagcaucuggcuuuucuuuaaucuguuuacauucccuggggcuccuuuucuuccucuacuguacuuuuuguauuuuuucuugcuuaucuuaagucuuuuguuguagaucugcauaagacuggcuucuauuaaccacagaagacagucaaugcuagguuguuuggaaaaguccuuugccaaaacauuuaaucaauaauuccuuaauuuagccucaggcagauuuuuuuggacaaaggcagaaaacagccacauucuuuaccaaaauauugcaagaacaaucucuaggccacauauaauauuuuucucugaaacuucuuaagcugggcucucauaguucaaaucacccucaguaccacuaucuuccaugauccuacuaguauggcucauuaagcccgguuuaaaauguccaaugacauuucuagcucaaaagucccaaaguauuccauauucuuccaggcaaaaacagugucaggccuaucuuagcaauaccccauuccaggaaccagccucgaucuuaguuagaguuucuauugcugugaagagacaucaugaccacaucucuuagaaaggcauuuaaucaggccagcuuaaaguuuagagguuuacuccauugucauaauggcaggaagcauggcaguaugcagguagaugugguguuagacagguagcugagugaucucuacccaaaucagcaaaaagcaggaagagagugccacacugggccuuucuugagcaucugaaaccucagagcccaccccucagugacacacuuccuccuacaaggccauuccuacuccaacaaaggcagacuuccaauaaugccacucccuaugagucuauggaggccauuuccauucagaccuccacagcugaguuaguuacuucauuccugauggaauccuagaaugaaauggaucagaacaaaccaaauugaugauauauuuggagacuuagccagaaaaugucaagauacaagaguaaaaagagaacaagauacaagaguaaaaagagaacaagauacaagaguaaaaagagaacagaagugguaaugggcagguaaugugugugugugcacuugucuauguagguguguauggagguuagcauuggcauguuauucucucuagcucucccuagcuuuacugaauugaagcuugccauuuccacuagacuaucugaccagggagcccccccggauccgccugguuucucuucccagcacugggguuauaaacauacacugacacuggagaucugaacucugucuuaggcuuguguaguacuuuacuauuuaguuacccacguagccaucuccccagcacagagcuuguuuauuuagaagguguagaaaggaucucuaguggacagucagaggggaggcagauuuagacugaguuguucaauacaacaucuugcuauagccauuuccccucuaaucuuugcuuuauacuuguuuucuagaauucugcugccauaacccagacuuguuuuucaaccccaagaccugaaguuuuuggccuuuuuaguguuguguuaucaugauucuuuucaucagcucucuucccuaguuuagaugucucaguaguagcuccccuucuguugcuguuuugaauccucacauugauccuuugcuucuugaucugcucagccuuagagccauagaauagaaaacaguuugaguaccggguuucuucuguguauacagauggugaaaauuaacugguaacaaagacucccgaggaauaaauuuaguauagacuaaaggaaaaaggauuguagcaugaaaacugaaugucccuucucauagccuguggcccugcaggauguaugcuuauaauaaaaggaacuaacuacuaccacugguaaggaaagccagguuuuuguccuaauguaaaaucgucauugaguaacugcauacuuugguugugaugcuuguagugacucuguuauggagaucauggaugagcuugugcucuuuggcuggaugacaaaaaaaaaaaaaguaugcgaucaacagcugaauaaagaauuuaauugaaaaugucucuuucuuuuucagguguuuggcaaccagcucauuccucccaaugcacaagugaagaaagccaccgucuuucucaaucccgcagcuugcaaaggguauuucaguuugugacuuacuguauuuaguuuuucuaaaggcaaaggacaaaaucuccacaaaggcaggugguggacugugugcuacagugacugggacugguuacugugcagccacagcguuagucuccgaguggaagucaccgugccgcaaauugauguucaucaaacaccaaggauuuauaucagcuugagagcaguccuacugggaaugauugcucuccugcuuugcauaaccguguuaggcugccaucacaaaggaguuugagagaucaagagcacagugggcucaggaggacaguguagucuuuacaaaggagggaaccuucuacuggccuuagagaaaguucacucuccccaaacaaggcuguggccugguagggcagucaccuaaggacggggaagauuguuccucaguaagugcugcgcggggcuuuugcuagaaguggcauauuuguugcuuaguugaugguacccguuguaucacccugaaaugcaggguacugugaagacaaggaaagguuguggaggaacucagaauugcccugucugggggaaaaagccacaagcaggaaaaaaaaaaaaguuuacaguguuaguuagguuguggagaauauaaaugcaaaggcaucaucgaccacuuuaaagaaacaguuuaaaaauuaccuuuaaaaaauagaaugaaaaaguugaagagggaaaaaauacuuauuguuuucagugucccgaucaauugugcuuugaguaauuugugaauauauauaccaggcuggacacuauaagacugaagucgcacacaucgauaaugaguacuugaggcuggauuuuaaguguucaggcacuguugucugaagcaaaacgaagcagaagcucccaaagucaguucuggaggaucuuuuggggaaauuugagcaugacuuuguguauuggccuccucuguaagucguaccuauagauuaugcagaguaaacuugcuuaauagaauauugccagacuuggcuaaggccacuucccuccuccguaaacacaccaauuuuuaucucaguaauaaaugauacaaguucuuaaauagcgcaaccugaacacccaguacaccaguacaucagucacuaugaccuggugagggcaguagagagcucugugucuguguguguguguguguguguguguguguguguguguguguacgugccugugugcgugcucgcacacacauuugcuucugcuucuagaauauucugaguuacuuagccuccuaagucuucaguuuacucagcuagaaaacuaaacaacauaauagacacaaagccagaacacauacguuaagcaccacgugauguguuuguguuaaaugccgcaguacuuaugaguguuaauuguuuauuaaggccugcugcugcugaugugaugaugauaaugauguuuguaucuagcuggguucauaauauucuucacuuuguacucuuauuuuuccuaagaauuuuuauaagcccccuuucacccuucuuuaaagauagcuguuugaugugccgugccugcccuuuagaaaucuuuaauuucuggugaaaauguuugggcaguuuccuuaagauacagucaacuauuauaaguucuggcuuccaauaaguacuugguuguuguuugguuuuggcugauguuuuugcuuuuuucccuagcccauauuguuuuaauauucacaauuuaauuuuuuaaagauuuagguccuuacauuuuauacaaacugcauguccuggaagaauuaguuuucccuuuuucuaccaguguguguaugggaggugugugugcuugugcacauagaggcugagguuggucuuggucuucaguugcucuuccacuuuacucuuugaaguaaagucucacaguaccgcucagaccuugccauaucauggcugcugucccggaccagcuugcuuuggagauccuugucccugucuucagaggccgagcuggccaucaccgccacugggugcuuauguggguuuuggggaucugaacuccaggucuucacaccugagcuuguucagccagccuuagccaucacugagacaucacuccagccccugcuuacauuuuuaaaacuaaagcgggcucuuguuuguaaguccaauacuuuaucuaaagguaggcaaagguguagccacagauggccuccuauagcaagguggaucccugcaugcaccugggacacagagcucuaaaacucccuagcacuuuuguuuuaaagcuuucacuauuuaauggccccauuuuugucacuguggcuauuaugcacuaacacauauguauaauuuauuguacagcuaucucauuauguaggacugguuuaaaacuucaggagaacuuuaagaaacaagguaacuauguguuuacuguuaauaaauaauacauuaaagaaguaauuaucuuguguggugccugagucuagaaauugccguaaguacauaaaguuuuuauucaggccugaugcuauugcacccuuaauuauguaauaaauaauguauuucuuacuggcaacacuugcuuuucaaucugaagaaaagucuuuuugcuuuuauuuuagagguuuccugaacuaguggcaucauacaaagaugcgaaagaacagcucgugcucagauugcuuuccuuaagcucacagagguacaacucuguuaugauugauaggacagagucagacuucaucagagguuugcuuuuaggaaauagaucugcuaugcucccagcugcucuguucuuaccauuccagcaguaaaagcaucccuuauaaugucccuaccuucccuauuuuucugggcuaggugcaaacauggugaggaggacagaggcaauucauuuccaugucgauuucuuguucauucugauggguggcaaauauucuugauuaugaccaaugguucugugagcuaacgucucaguuucuauccuaguucacgauaaggacuguuuguuauauugccauuuuguucuuuucaguaaagauggugaauaucuucugugcucaacuccuaaguauucuuccuuagcugccuuugaauuucucauauaaauaucauuaagaaagggccuggagagauggcucagugguuaagaguacuggcugcucuucuagaguuccugaguucaauucccagugaccacuugguggcucacaaccaucuaaugggguccuaugcccucuuuuggcacacagguguauauacugauagagcacuuauucauuaaauuaaucaaucaaucuuuaaaaauauauauaucauuaagaaaggcaaagcaugcaucauuguauuuuaaggaaauuguauuucaguaagacagcuaagugaaaauguacauagaaguuagauguuuuaauacuguuuuuggugugugugugugugugugagagagagagagagagagagagagagagagagagagagagagagagagagagagagaaacagagacagagacagagacagacagagagucagagacagagagaaauuuauuugauuuucaacucugccauuuguguggagcgacuuugccacuucuaccuuugauuccuggacugucuugaguuuugaccugcauuggacuggagugcaguaauggaauaauguucaugagacgugcacaaggcauccaaaaaagugucacagccauguuguuugccuugccucagaauuuaccuuuaugauuggaagagauuuauucccucauucauuuguauacuaauccaucauuuacuuagugagugcauuugaaauaucccaucuguaauccuugaaguuggcugauucaagaauuaauaaggacugauagcuauuuuuguaaguuucuugaguuguccuaaugaccauuuugaaagcuguccuccucguguguugaaaacauugcugaugaacugguguguaucaagugcuagcggaauaaagaugggcuucugugcuugggagauguagacuggcuuuacauuauccuuguuagucaucuauccuaauagauauccuuugcuuuuccuuuccuaguaaaaauucagcucucauagaaauacuuuugaucugucucuacaaguuuaaagauuuggaaugagcccuaguguuuaaacuuaaaaaaaaaaaauugugucuuuuuccagaagagcaugugauuaguaagggauuagguaaaucuaucuguucccgugggccauauauauaauguuacaguaacuaccucugcccugcuccuuauaguagacuauaaggaaguuccaguagcagacaggcagcugugggagugggcgcugugugcacugugugcgcugcucagacaagcccugcuuggugucgugguuuaucugcucugucguugucucuggcguugggaauucugcgaggaucaagcuuuguuauuuugaguggagccauaucugcugcucauuguugcucuagagaauguagcuucccaaauguauacacgcugacuguaugagacaggggacaaacuuacuuuucucucuauggaaaaucaccguugaguuucuagggcaugugguuacaguuuuuauucucagcuugagaaugcgucuuaaaauacugugcuuuuuuucccccuuugucuacagcaaagccagaacucuauuugaaaaaaaugcugcuccaauuuuacaccugucuggcauggaugugacuguugucaaggugagacuuccucuagagucuuuaaguacacagaucaccauuuuuaauguauucauguguucucugcucuugccuucuaagcagaacccaguuuucacugaagauaagaggaaaaucaauguuugucucauucuauuaauuacucaaagcaguuuuguuuucuccugacauggucagcuuuuuauuucaacacagacucagauggguguucggaggucuugauacuuugcagcagguaaaacuaacucucucaauugucagaguccauccccaaaauacaaagcucucuacuuugagugguuuaauuucuugguaguucuacuagcagguaaacauuuucuuccuguuaaaaaaaauuuauugugauaaauaauuuuuuaaaguaaaaucauuagaauuuuuugauguuuuagguaagaagaaaaagggacaaaauaaauuagaaggaauuguaaauuuuagacaucucagguuuccauuuugauaacuuuaagcagcauaugugugaguguaugugguguucauuuagucaaaaucagccuuaugcuguauuuacuuuuaauuaauugaagaaaauuguguguauguaugugcacugcauguaugccuaguguucccagaagcgaacuaucagguccccuggaauuaucaggaacuggagcuauauauaauugugagccgccaugugugugcuaggauucaaaacaagauccacuggaagagcaacaaguacuuuuaacuguugagccaucuccacagccccugcccccuccaggguuuuaaaacugaguuuauuuuuaaaauuuuuuuguuuuuuguuuuuugaaguuauuaugguuuaauggcacuauuucucccuuccauuuccucccuccagacacaaccauauaccccuccuugugaaaaugauguuucuaauaauauuuuauugauucuuugagacuuucauacaauauauuuugauacuuuccauuccccacuacucccacuaacucaucccagaucuaccuccccaucugcacccccuaauucccuaaccccuucuaacuucauguccuuuaaaaaagcaauccauugacucaauuuugugcuagcauccacuggagugggaccuaccagaaccagcucuuaagaaaacuaucucuuccuucccuaaaagucaugaauugucacuagcuccuuaauuagugguggcagcuuguaagccccuuucauuauccuagaauguugacuggacugcuguuaaucuauuucuaaauuacacuuugaguaugucacagagauuagaaggucaugcaguaaaguuuccaugcaauuuuggauucacuuuuuuaacagacucgaucuugcaguguuugcucagggguuaggagaaaggggaaggaaaccuuuacaugagcaucuacagugugccacagucuaggugugagagaccauaggguggucacuuagggcugcuaucauuaguuccuuacuauuugaugaaacguuuggauaaaacucugggccuggagauuugcugaagggagacagugcauguuaggcuucaguagugcuacuacaaguauguaaguucuguuucucuuuggcaagauaaauucuucaaggaauuuguuucucuucuucgguuuucacauuagcuggcaucaaguuguuuaugauguccucguguucacuuuugacuuuuuguagcuuuuguaauguuccauuuuacccuucaccucagcugggccugcucuccccuccugccgcccacccccaccccauagucuucaagacuuuuuuucaauuugaugaguuccugcugaggacccaguuugccuauugaucuuuucacugacaagguuguuucauuucucauuuucuuuaaaauacauauuuccuucauuugcuuccuuuauuugcuguucugcugaccugagauuuucauugguuuaccccugccccccccccauauacagugugcauauuuacagccauaaacuguugcuucaucugcauacuaucaauuuagacacaguucuuucaugaucauugcucacgauuuucucauuucuaucaugacuugcuugaccucugaguuacuuaauguguuuucauuuucagaucuaaagguuuucuggguaucauuuugcuuaugauuucuaaauuaacugaucaaagaaguauucuauauaauuucaggaucaaaguuuauugggauuugucuuuagaucuagauugaauguaguuuuguuuauuauguguucuauguaugcauaaaaaauaauugauaucuggaagaaauaaagaaagaaauuaaagacuuccuggaauuuaaugaaaauguugacacagcauacccaaacugaugggacacaaugaaagcugugcuaagagaaaaguucguagcacuaagugcccugguaaagaaacuggagagaucuuacacuaacaacuuaacagcacaccugagagcuauagaacaaaaagaagcaaacucacccaagaggaguagaaggcaggaaauagucaaauucagggcugaaacuaacuaaauagaaacaaaacaauacuaagaaucagcaaaaccaaaagcugguucuuucaaagaaucaacaagauagauaaacuccuagccaaacuaacuaaagggccaagaggcaguauccaaauuaauaaaaucagaaaugaaaagggagagauaacaacaggaaggggggaaauucaaaaaaaucaucagauccuacuauaaaagccuauacucaaaaaaaaaaaaaaaaaaaccuggaaaaaucuagaugaaauggauguuuuucuagacagaugcuacacaggcccaaaucucacaaggaaguagaagaagucauuaaaaaccucccaaccaaaacaaaaacaaaaacaaaaacaaaacaaaacaaaaaacagcccagggccagauggauuuagugcagaauucuaccagaccuucaaagaagaccugauaccaauuuuccauaaacuauuccauaaaauagaaacagaagggauacuaccuaacucauucuaugaagccacaauuucucugauaccuaaaccacacaaggccccaaccaaaaaagagcuucagaccaaucucgcuuaugaauaucaauacaaaaauacucaacaaaauucuugcaaaccaaauccaagaacauaucaaaaccaucauucaccgcuaucaaguaggcuuugucccagagaugcaagguugcuuuaauauaugaauuaaauggagacauacuugaagcaaucccacugaaaucugguacaagacaaggaugcccacucuccccauaucuaguuaguaauaguacucaguguuagaacuauaagacaacaaaaacuggccaaggggauacaaauugguaaagaagaaauaaagguaucacuauuugcagaugaucuuauaguauaccccaaaaauucuaccagagaacuucuccagcugaaaaacaacuucagcaaaguggccagauauaaaauuaacucaaaucaguagcuuuucuuuauacacaaaggaaaaacaggcugagaaagaaauuagggaaacaaucucuucacaauagccacaaauagcauaaaauaucuugggguaacucuaaccaaacaagugaaagacuugcaugacaauaacuucaaguuucucaagaaagaaauugaggaagaucucggaaaauggagagcucucucaugcucauggauuggcagaauuaacaguaaaaauggccauccuaacaaaggcagucuauuagauucaaugcaacccccaucaaaaucccaacacaauucuucaaagacauggaaaaagcaauucucaauuucaucuggaagggcaaaaacccagaauagugaaaacaaaguuuaacaauaagagaacagcugggagaaucaccaucccugaccucaagguuuacuacagagcaaaagugauaaaaacugcaugguauugguacaaagacagacauguugaucaaugaaauaggggaggucccaaggccugacacuauuacuaaggcuauggagcacucacaaaaagggaucuaucaugacuggccuccaaaugacccaacaagcagcuuaaagagucagaugcagauauuugcauccaaccaaugaacagaagcagcugaccccuguuguugaauuagggaaggcugaaagaauuugaggagaagggcaauccuauaggaggacaagcagucuuaaucuggaccccugagaucuuucaaacacuauaccaccaaacagacagcauucaccagcucauaugaggcccccaacacacauccaauagaggacuuccaggucuaugucauucacagaugaugcaucuaacccucaagagauuggaggccccagggaguuuagaggucagauggggucggggcauccauguggggaggaggugugggauguggagcaguuggagcuugggaugggaggggcggggaauggaauauggaguguaaaagaugaauuacaaauaaaauuaaaaaauugauaucaauuauugaauguuauauuuuguuuaugaccuauuaaaccaaaucuacucguuguguagugcaaaucuucuauuucucucuuggguuuuuuuuuuuuaauuuugcuuuuauuggugauaacuauuuuaaacuauccugucaggggaguuacaaauaucccaguaugauugugaauuugcccauuucuguagauaaucuucucuguuuuuuuuuuuuauuauuauuauauguuaagaugauuaacucucgagaacuggacugaacacaagaaauuuguucuaaagacaaucugauccaauaaauguuuguuguaaaugcugauauauuuuggaugugaacuuuagccuuuggugauugagccucuccagcccaacuguugauauauuuaaacccauuucucugcuaguuguguauuggugugcaagaucuugguucaacuauugcuuuucugaauaggaucuuauuggucgguaaucuguuuagaacugucuuuuguguuuguccaggcaggaauccuuaaugucauggguggagaagaauauuuuugauggccuuacucagguuagguugauaugacgguuguguggcccaggugguaaccacuaagcauccuuacaugguaacugagcuuucugaaauaaaacacauccuauuuuauuucuaaauacuugaagauauguguuuuaauaaggaaguauauuuuucuguguaacuauauugacaucuacauacccaacaaacguaacaauucuuuaauuauuuaauuggauauuuucuuuauuuacauuucagauguuguccccuuucccgguuucccuacccguaaacccccuauccgauucccccuuucccuguuucuaugagggugcucccccacucacccacccacuucugccuccccacccuagcauucuccuacacuggggcauugagccuuccaggaccaagggccucuccucccacugauauucgacaaaggccauccucugcuacauauguggccugagccaugggucccuccauguguuuucuugguuggugguuuagucccugggggggaggggguccugguugguugauauguaacaauuuuuaauacuaaagcccuaugacuuuugguuuuguauuuuguaauuuuuccaauuuaagauacuaaacaauuauauacacauauacacacacuaauuuauugauguuacauauucagaaaauaggcauuaaagggagauuuaaucauuaguagaaauguuaauguuuucuucuuacaguucaguugaaacuauuggucuuugaaagguugauuuucugucuuuccuguuaaauuuuaucuggaaauaauuuaaaauuuucaaaauaguuacaaaacuacauauacauauuuagcuacuucacccugacuuaacguuuuuacuguguuuucacauaauuucuuuuuacauaaaugugcauguauguauauaauauauacaggaauuccuauauauauuauggaugaaaucauuaaaccaugguauaugaacucaccuuuaggcuccuuuuccuagaaguuaggguuuggaucucaagguucuauccuguaagguaucuguuggugucucuggugacccguuccuauccaggguccucccaaaguuaacucuauagcacauacauacucuguuauguuugaggaguuuccugagaguaauaaaauaacuucuguagauuuuuagaguucuaugcucggaacagggcacaaagaacagguauuucaaauuauacuacagguguuagcccaucugauauuuaaguauuuaguuuuugccugcucuugugucuaguguauuuugaauuggagguaguauuucuauuucauuuaccuuaugcccuuuuuuaacauuugucuuaagggguauauauauaucaauguacacccugaugguggcugaaauguauaucaaauguucaauaaaaaugggaggaucggagugcucuucuguggguucuuucaaacauaccugcauuuuuuuuuuaugugccaucguaguaaaacaauaauaaucgucauuuacuuaacacaguaccaguugcaaacacuuuucuagcuguuuuaaauucugcuguguagcaauaguucaggaaagccaugauuaaacccucucuugauacauggaaauucauugauaagaaaauuaaaauccagugaguuuaaagcuaaucaguuaagaagucacagagcugagauuuacuguaggucucuugggcucugaaaucugugcuccuuuucauuauaucuacuucccuauuugcauaugcacugucuuccugccuucauaugaaaaacagaggguaaacaauguaauagaagccacaguggacuggaaaagaguccugugacuggcuagcuguaugacuaaggcaaauuacuggacuugaauuuuauuuuuagaauaaggaggugaguagguaguuucugaagccaguucuguccuaguaaguauaaaacuauaaaaauccacacuauugcugucauagaauuuuuaugucuuccaaccauguaaaauuaagggagucaauauacaacuuuaaagaacauggcucaccuuuucacccucuaacguguggucuuacagugacaaguuuaccaaugacgcuuugauauugcagacggauuaugagggacaagccaagaagcucuuggaguugauggaaagcacugaugugaucauuguugcuggaggagacggcacacugcaggagguaagauccucucuccccauguagggccaucuuuaaggugagaagaauggacaauggcaacaauaauuaaggaaacugcuguaguucauuauuuuagggcuauugcucucaaacuuaugcagcauuaagcuuuucuccugcacuuuucuuuccuuguuuuugguaaaucuuccucccagcucaaagaaggguuuauauguaagcaagucugccugagaaaauuaaauaaaacaagcaaggcuauaaucaagcacuuaagaugaagugggaagaucuugaguuccaguuagucuugggcuacauagcaagauuagaucucaaauauugaauaaaaugggaggaaaaauggguguggaucggcuaagcuuguuauguugugcauucuguaaugcaaguagcucugugauggcaccaagguuucacuacaaggacaaguucucaucaaaugaaaguuucucucaagaaaacacuuuuauggccacucacauaauuucuguuguauuagaaagucaacucuuaagauugcauuuguagaaagagaugauauuuguucagauauaugcauuuaucuucuuuucuguuguucuaagguuggauguuuggcaauuagugcuccagaacaaaccucacauaugcugggcaagugcucuacugcugagcuacauuccuagcccugucuuguucuaacaguaauacacuuauccucagugaggugcuacaccuauuagaaugcccaagacauagaacacuggcagagucaaaugcugaugaguguagaacaguaggagcaccauucauugauggugggaaugcagaaugguuuagucacuuuauaucuaucagaauaacccaagucuaggucaaacaaaauggaaaaugggugguuucacugaaaacuggacauacuucuugccaugugauccagcaguugugcucauuggaaguuauacagaggaguucacaacucucgugcauacaaaaauaucugcacauggucguuuauagcauuuuuaucuacagccgaccaaauguggaagaaauaaagguguccuuuaauagguuaauuguagaguagcauacccaaguaauggauuauuuagugugaaaaaaauaagaacuauccacuuaugacaagauuuggagcauauuacuaagugaaagaaccacaaaaagacucuuugacuuguaggucacgcaacaguagagagaauaaaaggaugagagguugccugagguugagagaaaagaaggauuagcaggcagcgcacgggacuuagagggcaaggaaagugcuuuggagaugauagugauggauaggagugaguacaugguuuuuaaaaucugugaagugcacagcacugagcaaacaccaaucuaaacaauaaaguuuagaugguaauguagguucaucaaaauguucauuuuacccacauacuacauuacuguuggcuuuggccucucuuugguggcuucaucagugugagggaccagaaaugaacagcagaaaagcuguccuuaguuugacuuggcauuuauaugagccuuaguaagcuucuuuuuaaaaaggcugugcuaaugaucuuguaauugucuuuauagcuuguuaaugaaaugugaagaguucugauuguauaccuacaaagaaugaagcagaucccugacagccuuuuaauacugaaacgcaaugaggcaggacaagauaaagggaagagauaugucaacuuuugucuuuacaaaauguuuuaaaggaaagacagugaauuguauauuuaguguauauacagucauuaaaagacauugggcaagagaaaugauuggcuuuuuauaacagcucauaccugcaaucccaaggaagcugaaagcagggggaaugcugugaguuccggccuggacuaccugaugauaaugaauaacuaaaguaaaugauaauguuaguugucuaaccuuuguuuucauagcccucaggaagaagcacuugaguacagauuucugagcauacuaagccgccuguccucugugcacugcaaaaggcuaacauagucuuuucuguauaguugaaaagaauucauauucucuagaaccugugauacauuaauguuaguaaacuucuguuuuguagaccuugaaauauaauuuuacuaauguaaugugggauuuuuauaauuuaucuuagucuguauuauucuugguuaagaauaaaaucuaauuuagcacugauccuauuugacaauaugauguguuuuuaagaucuaauauaucacuuaauauagcuucuagaagaaaauaaauaaguuuaugguccaugaaauuuuauucuaauuuuguuuugauaaugaaaauacauguuguuuauaauauuuuuuacauucauagguuguuacuggaguacugagaagaacagaugaggugagcuuguaaaaaaugugcuaagcuuuuauuuguucucauccuuugucuuucccucuuacaaugcauacauucauauuuauauuuguauguauguauauguguguauacauacauacauacauacauacauacaugcaguacuaaggauugaacccagggcuuugagugucuagguaagcaugcaccacugucuuacaucuccagcacuuuguucauuuaguuuuuauuuugagacagaguccugauaaguugccuaggcuagccuugaacuuguuagucucuugccucagucacuggaaucugugggauucuagacauaaaccuucauacucuacuccuguguuauauuuucaauccagugcaauugugauaggauuggaguuuugaucagauggugcaaugcuucuucaucugucauagguuacucucaugaacccaugguggacuuccuguguugguaauccaggguaccauguaccuuuuaacaccagcuauugugcuauauaaaaauuuccuauagaaucuuuucuucaaggaauucuuuuauaaauuaauagugauauguucauauaauaugaccuggguagcaguuaaauggaugaacuaggcuuauuuaguuaagagcgagcaugaggaccugaguuugcuccccaggauccauguaaagucaucugaguacagucaguggugcugcucguaagcccagugcugccuggccaggaaggacagccaugugggagaccuuaucuaaaagaaauauggacaguacauagggaauacgacaagaagcugcccuguggccucuuuguguacccuaaacacacacacacacacauacacacacacacacacacagacacuuugauucucccucacacauacacagagacaaauauguaauguguaucaaacacaagaaugaaguagauauauaaauaucuacaucuuuagaucuuagaaauguuaaauauaaguaaguuuuuaaagagggugaaaucugguuugagaauucagaaaacaguacugucacuguauguuauuugguauguaaguauuuaguaugaaaaaaauaauggaaaagaguugugccaaccuagugguuuccuguagaaggggucaggaaagcagaauuucaaaggacuucaucugucucugccuauuuauuuuaaauuugagacucaauucauuuccuaagauaucagaagcaaaauggcaaauguucuuaaaucuggguuguggacuuaugagguuuuguaagaucucauuuuccugccacaguuuauaauacuuuaguaaaaacaauaagagauuguguucaaaauaaacuuuuaagaaucuucaaguaauggcuguauaugugacauugaguuaaaucacauguuaugucauuaacuggccaugauuugacuuacucuaucugaaguagauagcuuaugaaacacugucaccugccauuggucacuauagaauucguagguauuuuuaguugaauuuugucucuguauuucucagccagugugauagcuuaguacaguuguuguaagauugucauuaucuuaacccaguuucauauaaguaauuguaguuacugaguacccgaauauguuuacugugucauuguguuuucuuuguuuuuuaaacugcucacguugggguauuugcuuacugaccuagagauggggaauggagaugagacggaagacacagccagcuacuuuguucuggaggaugcucauaggccucccuuuaaaccuaaucuucugacuguaacaauaccacuuugucuucuuuuuuguucuaccaggcuaccuucaguaagauucccauuggauuuaucccgcugggacagaccaguaguuugagucacacucucuuugcugaaaguggaaacaaaguccaguagguugucaauguggaaugcuaaccuaugugugugguagagccugggccugaaaauuaacauacgugauaacaucgacuuuucaaauauugauagguugaacugucaaguuauugagagggaacacccagccucucagaaaauugacgugcucccaguugacuugugguaccuuccuaaucuaauaauuaauacauccugauguugggaauggagaugggugcuuucugucauugcucuuuuucugccuuugcguuguaagacccuuucacgaggugagggcagauuugcucugaucauuuccuuuuaguacacauggugacaaauagcaagucucucaggaaacggaacugcuggcagccauagcuucauuaucuuggugauagaagcagauaaaacaacuaaauacagucacauccuugugacugccugaaguggcugggaguauggauauaguagcugggggaggggugagguccugacauuuaaguuacauugcugugagucuaacacuguccucuggacucagaaagauugaaagcuuuagagaacaaagaccaacucuuucaaaaagguagugagugaccuugaauuugagaccuggcuuuugcagcaauuaauuaacauaaucuugagcaaaugguugucaaaagacggaaguaaauggucaguguuggagaaauuguuacauaguguguaauguaaggcuugugauagaagaagucaaaguaaacauugguugaaugaguuaauuaaaaauuucucaguuuuucuucuuauaacugucuaagucaauaauaauagucaagguacuuuuuaauuuggauuaaauuuuuuugucuugcauuaguguguuuucuuagacuaggucuucuagacugacuuucccuguugucauuuugagggccaucaaugguaucuuuaacaauuuuaugcuguucauaaaagcaugggugcauauaggaaagcccaggccugcauauauauguuuaucagacccucauccuacugucucucaugugucagacccuuacaggauucuccaaccauccugaggccuagcaaacaggagaagccuuaaugggccauacuuuuagucgcagguuagaauuuaugaggggcaguagauaaugauggauguaugaucccagcaucuuugcugaucugguguaaguucucuccuguguagggcuugacuguguuaggagcuuuucuuucccuuguaucaguagagguuauugaacugcuuuagccagcguuuccaaauggcuuaucagugaucagaaguagauuauuuuccuuccagaaacccuucccuauccaaaagccuccacucacauguggccacccccaagaucccagacaguggucugcuuuuuaggaacuggguuuuuuuuuuuuuucuguguuuuuaaacuauuguuauuagcugcuucuauuuauaauuuaaagauuuauaaaaaccuaaucucuaagcaaaccccagggcccuuggguaaucagaaacucugccuuuggcucgggauuucaaaaacuuuuuacauggccauugccuagggcuauguaaaaagaacaaagcuuugccuuugccccacugucaagauuucuuguaaaauaauuauugaagaaugaaaaagucuuuuuuccugaaauguggaguguagcaggcaaauaauccuaaaugccaggcugcagugcuuccugccguacuagaacccugagucauuguaagggaaugauaaaucugaggugcauuuuagcuggcuucuccuaagcaguuuauagaaguaauuuaaugcaaaaagccuuuuugaauugcaauagauugaguuguuuuuuaggucucucaaagccacuuuccaagucucuucccgugugccaggugcuguuccgauuaauaaguacaguguacaccucaccuguggugcuucccacauagcccauacacacucacaacaauagaggcuagacccgugcgccugcuccucgcugccuccaaguagaaucucauuuuugaaaaauuuccuggccacucccagccaaaucaauauugaaaugaaaaaggggagggugauucauaaauaaauauggguguuugggaguuuugccuguauguggaauucccagugcucaaggaggccaguagagggcauuggauccccuggaaccggaggugcagguggcaguauaccucaugugggugcuagcaauugaaccaggguccucugcaaacacagcaaguacucuaaccacugagccaucucuccaacucacaaaugcucacauuaaguaccagagaaaagcaguccagauagcacaagcacuguuaaguauauucagcuacugaaacucauguauugacagcaugaugaaugccaagcaguacagcaacuauaggagcuaauguggcugcuucuuaucaaauuaaacauaagcuuuucauacuguuauauauuuaccuaagagaaaugcagauauccagaucuguacaacaacccaaaccuuauuuguagaaccugcugcuaguuaucaagaaucaggacggugccaguaucaaccggcucaugaguggcugaacaaacuaugguacauguauacaccagagugcuacuuaacccuaaaaagaaacugucugcccguguuguugacgcagucaguagugggaauagucucaagcucaugcuuuuucauuguauuauaugauaugaucguuccacaaaagaguaaacuggcucuggugccugcaggaaccgaugacugugguaggaguggguuggcaacaaagacgaugagggacuuaaggggauguuagaaauguuaucuauuuugauaaugguguuaguuacauaaauacauuugucaaaauguauggaaaggcaugccuaaaaggacagauuguacugcauauggauugcaacucagugagucugauuuuaaaaaagaagauggugcuucaguuuccagguuuacguuugaggagcuuggcuggaggaccaaauggaaagcugacaggagugauugcccaggaugcacaaggccaggcccaauccccaacaccacaguugaaaaauaaaacaaaccaaacuacaaacucuucuuggaucugaacaggaggggaggauaccagucagacagcugccccaugauugaagagacaggcgggaacacaguccuggcuuaccaaggcagacucaugaacguuagcagcugugggaaccaguaccggugcaggaaaaccugagguucaauguggucagcucugagaguucugaccuucuuggaacccagacuuauggguuuccuauaauauugugagauuucccucauaguguuugcugaagagcccaugcuaaguaccgggaaaggaggaaaggaaguacucugaagcagucuuuuucccucauaaggucuguaucaggagaaacucgcuaugcagagcccaaccuucuagaggagucuuggagcucaauaaggauugcuagacucuagcuggcucuggccuuccacaugggagaagggaaauacccaacccaaacugcucuucaggccugcccuaacuuaggggguauauaaaagugcaauguugaaaggaaaaugcuauaaugaaaacuggacaguuuucaaauccaugcagacuauacaacaugcuucuaaauaaauaagacaugcaucagggaaaguccagagaaguuguaacauauuuuaaacuaaauaaaaacacucccaaaaaauaugugguaggcaguguuaguggacauuaggggaaguuugaagauuugguauacauagcagaacagaagacagagcaagauuaagggugaaggcauauacgugggaaggugaggcaggaggauugugaguuugaaaccagccugguuacacaggcagacacugccuccaaagucaagaggaggaaagcaaguuaaacucagaguuaacagaggaaagaagaguuuaaaucuagaguaaacaaagggaauuaauaagaauuagagcaaaacucaaugaaauugaaaauagaagucaauagaaagcugguucucagaaauaauaaauuucagcgagucucuagccaggcuaaauaaaaacuagaaaggacacaaaugacucauuuuagugaugaaaaagaggacaucacugcagagccugugaacaugaaagguuauaaaggaagguuauagcccuaggcccauaaguuugauaaccucagaacaggcugacuccuucaaagacaguugggcauagcuuaugcaagaaaaaaauaauuggcaagugggauuaguaaacuaguacauucaaacaguagaaucucauucagugaugaaagaaaugagcuaugaagccccagaaagacaggaacgugaaugcauauuaccaagucaaggaaaacauuccgaagaagaaggcuacacucuauggcuuuaacuguuaagagucccgaagaggucaaguugugacaguagaagggggaguggcuauuaggguuuagaaaagguacaaacagacuuguguagcaguaaaauugcaaaguauguacuauugagugguagaugucauuaauguuugucuaaacccauuuagauugcagcuaugaucaaaacuggaucaugaauggcaauaacaagucaguguaaguucuucaauugugauaaaugagccaaccagucuuggggguggggguggagagaugugacaguggaacagcugugucuguaggaggaaaggggguuauauagggacauuucuguacuggccuucaaauguuucuaugagccugaccuaagauggcucuaaaaaggaguuuuauguaaaaucauugauccauagcaaaacacauacacacagagguugggggagggagagagggauuaaaauuaacauaguccuuucaaacuucaauaaauuuacuugauuaaacaagcacuagagauguguucuaguuucuccuguguuuuguuaaacaucagcauaucagcauauacuucuauggcuacuaccucucaccauuaauuuugauuauauggugaucccguaccuguucauuaaguucauauaacaaugucaguaaguugacuaccguauauugaaacagagcagauugguuucauagugauaaucagaaaauaaaagugaaaaccugaacgcauuuggaugcuauggggaaacaggucauuuagaaaacugguuuuuagaguuuguuuauuuuuuaagcgcugagugggaagguugggggcgcugauauggugguguauaccuuuaaccauagcagucagaagaugggucucugaauucaaggcuauccuagucuguguagccaguuugaggucuccugggagacaaagugggacccuaucuaaauaaauaggagugagggaggagggauguaguucaguaggcaaaaugcuagcauuugugaaguccuggguuccguuugcagcauggaauaaaucagucauggcggugcacaucugcaaucccaacacugggcagauggagagggaagagcacaguugacagucauucuuggcuacaaagucagcucagugccagcguaggaacaugaggcccugucucaaaguuuuaaacaagaguuaauccuuucucuuggcuuucuuauugcaucucagugcaguucaggggaagguucuucuguacaauagaggauaaaugagaaggauagacgugagcuggacaaaccgcucagugacuaugacugcauguuacucuugcaaaggacccaggcuugguucccucuccugacauccacagacaccgcaggcaaaacgcucauauguauaaaauaaauuaaauguuuuaaugauagauuuuuaaaaaaugauuaguuuggagcccaguaaaucuaggugaugauuuucauugguggccaucaucaccaaagacagcagguguucuuugucuucugauggagauguguacuaccacagggguuauuuaaugcugcaaaaucuuaaggauggaucaauacaaacuuucuguuuuagccauccucagaaaauacaugaacuagauauauacacuaguggcauacacauauaaucacuaagguacaaguccacagaaauucaguagacagauggccuauuucuuaaacaggaaaaugaaaaggaacaaauaauagauuuaaaacauauaaaccaaucacaauuuaugugucuuguuugaaggaaguaacuuauguauuuauauauuauuaaaauuugagcacugccuaaaaauguugauucacauguaucaaaguuauaaauguaauaaugauauuucauaaaagucucuuuugcugauacauaaugaacuacuaagauaucagguuuacccucauacuuagugacuuacauggugaugugaagaaguaagcuugcucaugaggggauaaugguuuugagucugaaugaggaauauacagaauugucugcaguuucugugcuugaaacucuggaaaauaaaauaaugcccagaaaauaccgauugccuguaauuuggcaugcauugugcugcugucaguuuuuuauuugucaguccaugaauaugaagugucacuggccuuguggaguuucugcuccccaggaggaggcaggugauaacucaguacauagucaggcuguagccaugggaggacagcaacaguguagugaugagggagagccacagugaaggaccgucugcgaggcuggaugguguggccucucugagguggagcugucugcaagaucucaaggaugagagugaagggcuugccguagcugcacuuagagcauggaggguugaccagcauuaguaaaggcccuugauggaggucuacuccuucucuccugagaacacaugucuuacugucuagccacuuggcuuacucuuucucuuguugaccaucuuuuguguauuuaugugugucugacuuuuaaaguacaaacucuaggucaugugcagaucuggcauaauuuuauauguccuggauaauccagaguguuuacuuuuugaugaguuuuguuuuuuuuuuuuuuuuuuuuuacauagagguuuuugcaaaaauugucagaauguagguaagaacagucuuauaucuuugagggaaagaaucagcagcgagaacagaacacgaggcgcacccuugugaugcuggaaaaugaggaaaugugucuugggucguggacuaucauuugcuaugauagcuacaagaccuggccuucaguuaccuccuggcuguuugagaagaaagacuuuuuuuuuuuuuuuuuugaaauggcagaauuucauauagcgauuaaaagaugcuauguuauuaccauauuuuaaguagcaaguuuucagauacuuggugcaguggagugauguaauaaauguguaugcauugauaauuggucacacgcuuuccuaaggugauuuugaaagacuagcuuuuacugacccccuacaaggcuucccagugugugcgugugggcugucugcacagaugugugcaugcugugcacugggggagguggcauuuacuuuuuauaacaggucccuuuccauuuuuccccuguucagacauauuacagacgccacacuugccauugugaaaggagagacuguuccacuugaugucuugcagaucaagguaaacucuuuccuucagauuuugaaaaagauauuaaaaguagcauuuaaaagguaucagagcaauaagcacauguuaaagaaaacggacuguagcaguguacaugggcucugauggacacugcauuuccuuucucuucccacccuagcacuaguccccauaaugaagcguuguucacuaaugaagguguuuaugaucccacguguaauaagaauuaugugacauaaaauuuacaucuguagucacuuuaaaucugcacuugaguaguguugagugugugaugucaccuuuugauguauuagcuuugaaccuaacucuugaccucugaaacauacagggaucccuuuguaucacuuccucguggaauuauaucuaauuuuaauuucuccaacuacuaccuuuaugucauaagaaaucuagcuaugcaugacugaguauuaaaagagccccaaggccagacaaaauuaugcuguaugccuauaauccuaacccucuauaaguaucagaaguaugaaagguucaaaguuggucucagcaacacagcaaguugaggugaacagguaccacaugaaaccuggccuuuaaaaaggaaaagaaagacccauaacauacuucggcaauaauugauuuccguagcuguuuagaugcuggcugcaucucucuuccauggucuacaacacacgagcuucuucucgcguccugcuggagcagcuguugucuuuaaccuuagcucucagacacguuuaugguuaggauuugguagauuaucuuuccacucuuucucacauugagaacaacguuuucuguagcuuccugaauuuuguaacucuccauuuuucuguugaguuguguaacauuuucuuauuuguagaggauaauuuguuuuagaaauaggcuugcuggcugugccaauuaaagggcauggaagcaaauaccucacaguacgcauacuuggcacgcagauuuuggucuuuaauuacugcuaucuuaaaacaaaacaaaacgugaccaccaacaacaaccugaaauaaagggagaguaaguuugagguaagcaagcacucggaaauuaauggggacaucacaaaagacauugaagagccaggcugucaguguuugcaugucaaaauuauuaguugacaagaaagauagauauauagauagucacugaagucuuggugguaauauagaagaauugucauguuguaauuauagaaagaauaauagaauauuaacauuauuaagucaccauuuugauaauugaguuuacgaugagaucaucaguagaaacugaacacaaugcacgauaucuauagggaaacaaaucuacaagcauucuccagauuaucuacuuagccgcuaaagggguagguauggauuugagguagagaaaucuagaauaugcuacuuucaugaaaagaaaugacaguaucugcuuucugggaagaaaauggugccaugccacuauauaguucugagaguggugccaugccacuauauaguucugagaguugugccaugucgccauauagucuccugccccaaaugucagcuaauuucaaucuaaucacuugauaguaaucagaaaaagccaaacugugugucauuuuagacauuuuagucugucuugcuuuaaaauguuaauauuaaaaaaaauccacaaaaguaaguagucuguucaagaugaaaaaguaagacucuuguaaaggauacugcauuugaagaaugaaaaccaaucguaaucauggauguuguucggacaaguaaagauacuuguacacagccugaauuuuacacucugccuuuuaccuuugauuccuugagagugacucccaugcaaguuuuugcucgggggagauaauugcuuccaaaaguucugaucucuacagcagcaaaucuagcaacacuacaaaacauacacggggcugcagaagagcacuggcuguucuuuuagaggaaccagguuugguucucaguacuuacaugcaacagcucaaaacuugcugaaaacuacaguuccagggaaucugaugcccucuucuggagaugugggcacugcauggacauggcacagagcacacaaauaaacacacauagauaaaaagacaaacaugagaucagacuacaaggagaagacuggcaauggugacuuuaggugagaggcauaaguaguauacauuguacuauuuagaguuuugccuuacauuauuuuucaaaauaaaaaaacaggaugaaagagaaaugguucauuagcaauuucuaaguuuuugucaacauuuguuuaaaauacuagaaaaaagauauauuuuuuuuugacaggaguuaaacaaguauucuuuuuuucaucuaauuaaaaagaaaaaauaaagcaaaugucucaauggcagaguuguagaguugaaucacacugcaauggugaacccuguguuugcccacauccgacccuaagaugcgccugcuccauccuggaugaacauguaguguucacucaguuuuugauuuuguaaaaauuguagggaucuauacugugccaugaucccaaguuuaacccugaaaguugcuguuacacugguugagcaucccuagucugaacaucuaaaugccaaguguucccaaauuggaagcuuuagagaauuccagauuuugcaguguugauguggguaggaaugcucaaucaguaguuuuugcaaauauuccaaaauucaagaaacccaaaaauugggaauauuucuggccucaugccuuucaggcaagggacacuuaaccuauaugcaguuuacuaguaugucuuuauaauuggugaacuugcaaguuuacaaccaaguuuccuuuuauuuuucuucaugcagugaugucuagacuuuccaucaugaucucauuaaucauagucuaaauugcaauugaucuuuuagcauguaaucagcuaaguuguuuucacaaaacauaaagacgaugauuaaguagagauuuuuauauauaaagacauuguuguaaaauaugauuauuaccaaaggaggugagugaggagguacuucgaauaacccagugauuuaguauuuguuauauauauguuagagguaauugcagaauaaauugaauguaacuggaaauucuuacuaugcuuguuaaauaucucuagucuuaauccccucucucauguucugaucuuguaaauugaugucagauuuuucacaaucucuguauauuaaugacacagcccaggaagcacaaacauuuuaaucaauucuuagaaaauguggaacaguagcuucuacccuaguuucugaggaaccaguuugguuuaauugauuuuuuuuucuuucuccuuauuucugaaaauugcuuucagaauguggagaaaaucucugucaacaaagccugacaucauagacagugcuuaaugucagucuuuccuuccauaagcuccacguuacauaagccggagacuguucaaaaguacaauaaaucaugaacuagaauuuagcuugcacuguucacuguguguucacaucuuauuuuaaauguucaauuugauaaggaaauccagauguguuuccuuaugugaccuauuuuaaaaaaaaauaaaagaacacagauagucaagaaaacauguugccuccaucuucaaagcauauucagagaccagcaucuugccuucacucucuuggucccaccauggucaccuucaccuuacuucagagcccucuaugaccuugccuuacacccuugcuuccuugugguuuguuuucagcagccagagugugagcaaaaguuagagcacaucacaagagaucaccugugcauugcauggacgcugcaccugucaauuaaaaagcccauagcuuaggcaggaaguagagguggcucaacugguaguguuauaucucccuguugguuguugaugccuuacucuuaggucuuuuaugguuucauaugugaauuucuuuuuguauacauuuuuguacgugcuuuuugagguuggaaaucuauuuuagcuccauuucuuugaauuuguacuuuaguucucaggcuaagcacucuccauagccucuucauacuugagugcccuagcccacaacucucaaaugaagaacguucuucuacuuggcacuuagagacaaacauguccuugugauaccagucagcugguuucucagcagcaccucuuugcuugcuuugcauucccagucccugucccucucccucucccuuucucucccccuuucccucccucccucccccuaguucauucucgccauugcuuauaugaauuuggggagcagaaaagccaauccacugcaugaacagguacacagcaaaggagugagagguccaugucuccuuccuaggaauguguguguuucucacagaucucuugcuugccucuggcacagugaaaugggagugauacuaaugcugggauuacaggagcccuugaucccaugagcacaagauacagugugcugucucuaagaccucuccucuacccccaggucuuaauuuuggcuuauguuagcugugguggaaaagugaugguaugggagaauccagguugguccuucuguucuucagcaaaccaaggagcuguguguaguauugugccucuucuuagaaugggguugggggugccuuguaucuaucaguuuugagcuguuggaagcuugcggcuccgauugcagcuaauauguucccuuaauuugugagaacugauacauaagauugcaucggcuuuaaaguguggaucauucaagcauuccuaccauguauccauagggcuaauugcuuuaacauuugaacuuacauauaaaauguuuggugugaugagauuuucacauaccagugauuucaacauuuucuagguacuuauaaauuacugugugcacaaaucuaaaucaauuguauuuaacuuccagggugaaaaagaacaaccuguguaugcaaugacuggccuccgguggggaucuuucagagaugcuggcgucaaaguuagcaaguaaaggauuacuguguuucuaugugaugaguccuuaaaaguuuuauuccauccuugcuguugagguuuuuaaauacacuggucugggaguaaaucuucuaggccuggaaguugaauuagguauugauaaugcaauaggaacagccagguaaaguuugaauucuauagucagaaaggauagggaaagguccauuaagaaaagaguacauaucuauuugcagacacauuugccauagguucaaacaacagaagggaaacuggcauugcuuaucacacagcagcaacauucuuagcuaaaucccaagguguugccuggaccucagccucagggagcccguagaguccuaguuggucagaaggcugcgugcaagguaugugagaacacucacagguagagagacuaagggcugcucucucuuacaggagaugguugucaggcuuugcugacaggaagaacgggcucaggaagagugauuagugggccaccacuggcuuucauaagcauaggcuuaguuuuagaaacuuucguagguugaaacuucuggcucugaaagagguguggagggguagugucguugggcuucugaggcaggacugaagcagacaccaggcaaaguucaucucuuuucugguggaggcauccucuuuugccuacagcucaggguuuacaguuuuaguagaguuuauuugugugaugguugcucucauguacugcucuuucauccggaaccucucuugcaguucaagggccagacugcuaaacuuuccagaaaucucucccacauuucauucuguuauccccgguaaugaaauuccugacaguggaaugccaguaggggaggacugcuggaucucuuuacaggacacagccauuugcaaaugggccgugguuguauugauuccacagauaaccuugugcuugaucgcucaucucagauucccacagcucacagagaguaacugcuuagcuuccucugagaaagucugcucugaacaaacugcuuucccaaguguucugaucaacaguucagcacuagugcuggucagcugucuuaggaauagcucaucugcuuguuccaacucuggucgaugaguuucaaagucuguggguggugauauuauaccuuggcuaggacugaccacugagucacuuuuggagugaaauaagaaacauucccuugcuagccauaggaagacugcaagcauugugucaacauuuacuacuggaaaaagugcaaggaacugcuuaaacuuuagaaauagaccacccgagucaggguguuucuacuuggcuaacucacaaaaagagaaaccaaaaagcuuuaaaaacaccauaaaauaucaaauauccaaggcccugguaaauacuaccacaguaucaacgugagugauaauuuagcguggcuccacauuggcuauaaauuuuuauucuaggaaauuaggucauuaucccuaaugaacaguucuucuguguuuuuauuuuuaaaccuugcccuuucuuuggcuguucugccucuucuagccuaacguucuuuuuucugaucuuugaugugucuagauucaguccguuucccaguuccuucugccccaccugugcuuuagccuuuguacauuucucaguauggccacacucuaaugcuguuguaguccuuccugacuuuucuuaucaauagugaucaguuuauagcaaaacauaugcagucacuuauaauuuacuauuauuuggagucuguuaucuucucaacucauaagcccaaaaguaggaaguuuauccuguguucuucuauauguuuauucuuucuacaacuuucuccaucuguguaacaagagcuaacuaaaggcauccuaccugaaucagucaggaucaguaaaguagcauggguguugucagagaugagucuaaagagugacagccacaucacuuucuaguugcaacuaggcaucuuccucuuuaguaguuuucaugcacuuagcaauaugcaauagguuuucacucugagacuugcacuugccauauuaaagcuauauaacaugaauaauauaaauauauacugguuuaugcaugugugugcauuuugugugagaggggccacgagauacaggauacagucuugauuugauaauacacucucucuguguggcuuuauugcucucuccuugugacucuuugauuguauacucacccuauucuguggguaaaagucuauauuauaacgacuuauaaacuuaggggucaaagagacguaagcucuauaucucuuauuaacuacaggaauuguucugccaucuaaguguauauucuuagaugugccauuaacauuuaggcucaaaguguauuacuuuuguguuaugccacaauccuuaagcccccagagcagccgauuacaggagagguccauuccugaugauuugauugucuuggaugcuaucuagcacuugagcagcucuuuucauuuuuauucuugguuuuucuuagguacugguaucuugguccacuaaaaaccaaagcagcccacuuuuucagcacucuucagguaaaugcaauuuauaauauagaacacgaccuuuguuaauuugauguuucucugucaugucuauauuugagauauuaauucuuuacuacagacccauaucacguuuuccaauacuaaaaugggcgacauuugacuuauauaauuacagaaaacauucuuguuuugauagacaaguaccccucguaucuaucuguuuaucuaucaauuaccccgaugucuguuucuuucucucuacuuauccauccaucuauccauccauaauucaucauucugucuauggccaaaccuguguuugcuuuaucuugaauacuugccuuuguuuuucauucacccaccuuuaccagauaaaccuugaacagagugagcaaaugccuacauuauuaauauguguaucuauagaaguaccuggcagugagcugaagauuuguaaugaauuauagauaaauuaauuauauaggcuuguauauauuaucaguagguuucaaacuguuuugguuaaauaaguguaguacuuauuauauucgccaguacuguauagaacacuucccucgucacaacgcucugccaggcugugcucucuuuauaauaauacguuaaaagguaaguaauaaggccugagguuguaguauagcacagugauaaagcaccuugcucagcauauuuaaagcccuggguuugauuacuaaugagagaguaaggaggcauagaaaaaaaguucaacaauuucauauuaaugaaaaaccuaaaagaaaaaucacucaauaggugagcuauauacucuguuuaucuuucaugcagaucaaagcaguauaguuauaauuuauguuggcuaaucugaaaauugauugugaaaaacuagaauccaauguuaacauuuggaguuaucugauuucuucuaauuauaaaauaauauauccuuugaaaaauguagcucuaagaaauuccaguuggauugaaaaaaauuaaaagaaaaaacuaaaaguuaguaaaauacuuggaguaaauacaacauaauuaaaaaaaauugaaaaggcaagauuguucuacuccuaaguucaaacugauuaguaaaaaguguuauuguuauagagaauaauuucacugguuaaguagcaauacccugggaagcaggagcuguauguuuaaaugguggccuucuagauccuauaaacacuuuccauccauugcuuaucaauugcuuauuuguagcagaauuuuuccugcccaacuaauuuaaauauuaauacaacaagaagccugugauuggacggggaaaagagaggcagagcuaagaguuucagagacagggacagggacagggacagagagagaaggaaggaagaugaaggaagaagaagauccagauuccauguggcuuuaaauagccacauguagcuaugaauaucauaaaaguauagaauaagugggauaauuugucuaaucuagguggucagcuuguaucuuuaucaauuggcucugauaucauuguguggccaucuugugaacugagaauuuauugauauauaaaucugacugauuaauuauaagcuucuagaguuuugauuuacuggguuaaggggauuugugacaacuagccacaggggguagauggcugaaaagauacaagcagcucugaggcaggcagaugggagcugggaagaccacagacuggggcuaaccuagaguuaauaggaaguggugguggggcauaccuuuaauccagcauucaagaagcaggagcaggugaauuucugaguuugaggacaacguggucuacagugugaguuccaggacagccagagcuacacagagaaacccugucucaaaaaacaaaacagaacagaacaaaacaaaacaaaaagaaaaacaagaagaagaaaagaagaaagaaagaaaugcagacagucaggguagaagguuuccucuucaggaaucccgacuuuaaagagaagacagaaaaggcuacccugagagaaacaggaagacaauagagcaguggcuuuuaagugagcagauagauggcuguguuuucauauacccagagcaggggagggaggagcaggaagugaagagaaaggagacagagaagaugacugaguuggcuaagcacauacacagacaggauaggauccaggguuccugcacgggggaagggcuuccuuugucacugagacaguagagaagcagcaguuaggaccaaaugaaagugacauuggagagaacuaggacguucucccugauaugcuuugaaaacuguuugaagcuaugcuucugaaaaugaagcaggaggacaggugauaaaggcggcacagaauauuuaaccauaagagucuagagacucugccagagccugagggucugugaugucgcugauaggcuccucuaacugguuucugucuauaccugcaguaugauucccccacucuccaauaaauguuaagcccugauuuagggaucccuccuuccuuuacacacacacacacacacacacacacacacacaaauaauaauaauaacaauagauaaaaauguaucauaaaauaucuugugugagaaugaugggcuuugaagcaugaagaggccucaggcuggauuugaauucuguccucuauauggagucugauaccagcacugaaguagguguuugaugcaacugauuucauuacuuguuugugugccaucgauaaauugaggguaaguuuagcauaggaccacucugcucauucauauugauuucuguucuuuggauaaguaaguguaaacaguaguugucaauucaguuuguuuuucucucuguuguauguuagggaacauacacaaucacuauguucaugguuuuuaagguaagguuugaagucgucauauucccaagugaggagaauucugcucauugaagagacaauuaaauuauuagaauucugaccuuugcagagcaaagcccccuguguuaggaauuauguguacaugaugaaagcuguuuucuucuucauuaacaggaauggccucagacucaucaagccuccaucucuuacacgggaccuagagagagaccucccauugagccugaagagacuccucccaggccgucucuguauaggagaauauuacgcaggcuugccucauucugggcacagccacaggauggugagcaauguggugacuagauuccaagcccuguucagcuuagaaguggccuggagcagacucccagaaucaguacuagauaaguuccuggugaauucagacuccugggugcugucaggacaggcuucagugucuugugacuaagcaccaccguuccucguccucuuugucacugacaucugugcuagugagcugcuuucacuugaggacgcuuuaggcauagagagagaaccugguauuuaucccugcuuuacagaaaaaugaaauaaagaauagaguuggacaaagggcuggggaagcugacuaccagcagcucaguagucucccucccucucucuaccccccccccccccccccgugugugugugugugugugugugugugugugugugugugugugagagagagagagagggagcgggcagggacagagagagaagugucaguagaaacacugacccaugucugauggauucccacagccuccucccgagagguaagcccugaggucuggaaagauguacaacuguccaccauugaacuguccaucacaacccgaaacacccaacuugaccugaugguaagugcacucaguuuuuaaaaaaaugaauuuggugucuggggaaaaagugacaggugcuuuucuugcacugauucaguauuuuucuguuuacucugugggcauagagaugaaaggcucaaguagagggagggguggugugccuuugaggaacaauugcacugggaagugguagcugagugcauuggggcacaggagcucacggaucucugaacacacauuuuguucaugcgugcccgugcauagaggcucagaccagaagacgauuuguuuucuauuuauacaaguaauuuucgucuccugggaaauauuugcagacacaaccagcccccuuuaccuuuggaaauaauuccaguugaauuaaugaacuaaacuaaaaaauaauaaaacuaccuaaguauuaaguaacauuuaagugauuauuaguagaaacuugaaaaguacaaagaauuuuuucuaaacaugacaccuaaggcaaauuuuauauugauacauucaucuacuuauuuaaaaagauaaacuugggaaugacagcuggggagaauauuaggauauggcagaccagcaauuauuagcuuuccuuaucacagucuccuagaguaaaucaauaaggaaugaacagggacaauauuaaacaaugggccaaaggcuaaaaauagaaaaugcacaaagggaaacauuuuaggaaaaauagcucauguuuauuacaugggagucacugucuaagaaucuuacaugaauuagcuauauuauucucagauuuacaccguguguguguaugagcaagaccguuuaacugcauuucauacuaaggguaaagaaaaaguguuaaggagcagcagcugagauaguaacuacugggugccgaguguuacccagcccggcagcacucagugguggugugcauggggagcugggcccucucuuagccuucaugaggcuguaagcuguaacuguuuguuuucagcugucguggcaggggugcggugguuuaguuugugggcaccagcacuuacuguccaccgucuucccuuacuugacacagaauuaugaaaccaccaugaagggaugagguugaacaguccucuguugggagagauuuuugagaagaagauaacauuucuauuacacacucucuuuauucucagucugugguaacgcuguauuugcaguguuugcuccuguucuuuugccauuguucuuuucuccgaggacugaaucucugaaugcauugcgugcagugagccugugguugcagcucucucuagaugagccacauucaggccgcugaaugcucuuaucuuugugcuaauuacaaagcucugugacacugcuucuuaucucuagucaguucucuuuccuucaccacucugccagagcagauacaguaaaauagucacauacuguagcugucauguaauaguuaaauauuuacuuaucauuaaaauaauaucuccauaauaagaaaacagcuuuaggauuguggaauuucagaaauuuaaugucucuuaaauaagcauguuuauucuuuaguagcacaguauauuaaauagauugaguaaauaacuauuaaugcuuuaguuuaaaguaauauauaaucuuuauauuuacuaauguggcaagaugcucaucauauauugcugagugauuuuaaaugauuuucaugagauaguuacuuccauuguuauuuuuaaaaaacuugccaccuauaauugaguuuugugaauagcacagguaaaggcuccaauuuuauuuacuuauucgaguagccaauuaaucagaucaguuuauugacucuuuccccuagagauggacagaucauugugugcuagaaacugaacucagcuccucgagagcagcaacaaacacuccugagccgucccaucagccccaugcuuucuauaaauacuugaggguguuuauuagguuccucauagaaguuuuauacgguugcacuguacacauacaacuugaggaaaaauggcauuucuauaguauugacccuguggcauaucaacgugauguaucccuuccuuuacugagggcuucaauaucucucaagguguuuuaugauuuucucucuaguauuugucuauugcuagguauacucaugguuaucuuacuuuugauacuauuaucaguauaaucucuuaaaacuucauuucucugacugaagagacagacauguaauuguguguguuuguguguguguguguguauguguguguguugaugcugaauccgcaucuuaguuaaauucuuauuaauuauguuugccugugaguuauuuuagguuuguuauagguuuugcuauuaucaacagcaaaaagugccagccaggaguaaugcuaaugggggccauugcuuuguuuuuaaauuugauagauuuuggggauacauuuuauuagaugaggaaguuucucauaagaaaaacuuugcuagguuugccaagaguuuauuaacuaaauaucuuagacauuaaauucuaucaaguaucuuuucaucauccauuaaggcaauaggauucucacugaaucugccaauaugagcuggucuuugaaugcaugugagacuauuggccaagauauagagcaagcaauuacuuuaccuucauaucuuaaacacugaacaaaaucugugaaguuacuaugggcaagaaauaaguaguauaugacaguggucccagagagaaggcacucagauaagguuggccuuguuccuguccuagcuuccugcuugagaggccacagcauagacauggacuuaccaggaguccauggucucuucugggaaggcaucuuugagaauucaggggcaucugggcaauaagaauucagagcaaaauaaaagaaaacugccucggagugagccaggaauugacaagauccacggagaucgguuggcuuugucuguaucuucacugauauguguaugugagaaacuaucugaguugaagaaagaacuccucccaagaaacaggcucaguccugggaaauuuacucacaucacaggaccaaacguguguucccacaagauaaaggcgaaaauuguugucaggccugggguguugauacuuuaaaaagcauuuucuccauauggacaaaauuagucugauuccaggcuuauauuuccucuaccaaaaucuggaggcuaauccacagacucgacauuuccagguaaccuagccgugccucuaaacaaagcugaggaaagcugucagcagaggauaaccauagacccaacuggccagcugccuucaagcuaggauguuauuuuaauaaguuagaaucacacagaauucaauuuucuguggacuuuaguggaacacaaacaugcuaccauauuauagcacccagcagaaucuaauggccaucagagaaacuucacauaauucucucugguucuuaaaagaaaauacauguugauguccauucucacuggagcauggcuuugcugcccacugcaaguuuaaacaugcccguuuccuuucccuuaucuccugggcauuagaacuagucacuaguuaguuuucagccucuuccucaccucuuccaaugccauccuggcaucuacugagccuucacugcuccuucucauuucucuguaaugucuuguccuggcucacugccucccucugcaguuagaccugucucaauucuuagcacagcaggcagugacccuauuacaaacaagccagaacauuucccuccuuagagccuuccacugccucuccauuucacucaaccuaaaagacaccuuccuuaaaguggucuccagagcccuacccauacagaugcacucuuccccacuauagucauccauuuuucuuuccccuaccacucagucuguacauuucagggacaacccuaccuaaaguucccuuuguauguuuggcuugucccuagaaauaguguuuuuuaaaguaugaucuuuagauuggcaacaucagauuaccaggaaaugguuugaaauaaaaauucuuagcuuuacaacaguccuacugagcuaacucugagaaugauagcagguacuguuuuuuaaauuaacuuuuaaucaacaaauacagacagaauccugauguuaaucaacccuccagggauaccuguuaaacagugaaaacugcuuccccugauaaguguguuccuuccuuucugaccuccugggcuucuuuugaucagucaccuucucaccuggucucucuuuaaaauauuagucauuggggcugcagagauggcugcauagcauacgagcauucuuacucuuccagaggacccaggucuucacccagaagcucacagccaucuaacucugaccuccauggauaccugugcugcauggacauacaugcaggcaaaacauacuucgcauaaaguaaauagaaauaaauccuuuuuaaaaauuguacuaccaccagugcaaucucagacuccuugucuguuuaugacacuuuguaauauagucugauguacuucuaguauacccgguuucuguacauucaguaauauacugcuucauuuuucugugcauucccuucagugaaauguaaguucuuugugggcaaaauuccuucuguguuaacccaaauauucugagggcugaugaaauguggcugacucuuaguagguaguuggaugaaaugugaaauguagauucugagcggucauuaugucagaacaauguguuuuguaauuccuaguugagagauacagcugugcuuuagugguaccuuugaaacucaggcaguggcucacagaggcuuguguaugcucuccugggccuacaaguugugaacuuccccaagaaggccauacagaaguguugggauugcuuaacugaaggcuaggcuggugcugcuugcuaaugacuagcaggaaacugaggagggggacaggauucaugacucuuuucauagcacuuucuucugcaucaggcuuucagagcuuuguauggauagaaccaucaaguuuugcaaccguuauugggaaauaaguagguugcuauugucugcuccaguugcauuuagaacauuuuagagaacccagacaccugugggcgacagcuucauuagcccaauuuccaagucuuaacauucccauucuuaaucuuucuagagcaaagaggauuuuaugaacauuugcauugaaccugacacugucagcaaaggagauuucauaaucauaggguaagugccuggucuguaggaaauggggcuucaucaaggaacugguguccucaaaccuuucuauccagagugugcugucugucuaagauggagaccugccaacggccuugucugucugggaauucuggccuucuuuuuuagaauggagcuggcauguguacuuuugcccucucugcucauuuugggaagaacagaacguuaacagucugccuuuccauugaaaugaaagaauucgguguuucaggccgugcuaaggacuaucuauagucucagggagcuugauugccuccucacuggcucuggaacucuaaggcaguugacuugucugaguccuuucucaucuguaaaauggaagguuaucaucaugucuacuaccugaggacuacuugucagucucaaggaggcuuuugacauugaguagcacuucccggcgacuuuuacugcgcaugcuauucaccuuguuuucccauucccagaacaucaaggacaaacuugaaaggacacugaauaucuacuuggacauuuccuaggcuuccccuuuucuaauacaguagacucuuccaaguccugccugauuuguuaacuccugccuuggcuggaauuucauuggcugaguauucuguaaacucuccagacauccucaaaguaucuaaggagcuguauguucguucccaugccaacccguaaucugcucagccuccuuugcuuuguccuggugcucccucuugugcccaauuuagggauuggacauugcuccugcagcaacugugucuccauggcugcaucauuaucuauuccagcauuggcugcagcacacuuuucauuagucuguguuguucucgccuuugauacaaauucuucagauacugaauggucccuucugcagccuuugauuacucucgcuguaugggaaaaggaagaaggaaaaaaagccugucccuuccacagugugcauaaaucgcacaguaucuuaagugcgucuagcuaaugggagcagccauauucaaaucuccuuuauaaaacugacacccaaaccaaaaaaacccacuguaucaauuaauuaaaugguauuauguucagcauucuuuaagcaaguuucccuuugguccuuaagagaaguaaauuugugcaaugcaugcauccacuaaauaucucaaugaaaccugaugaagcugguucugaaacucugaugacaaauucauacaugaaaaaauugcuacuucaaaauaacaaaagauuuuuuuuugagacaaagucucuuauagcccaugcuugccuuuaacuccccaaguagcucaggcuggauuuaaacuucucccucuauccuuuucucucuuuuuguauuuaccauaauuaacuaaauggaguacauguguguugaggucucgcauguuugugucugauugcuuuacuccaaggcuacuuagcaaagguaagugugcuaaggaggcuguuaucuauggagagugaugagaaaauagcuaagacuauuuauaaggguaaaagcauuaucuacccuaaagcagaauaaauugcccuucauaaaggaucacaaggaccaaggaacagaacuuugaugcuuuccucaaaugacugaauuacaucuuaauuuuuacauuugagaugcacaacuagauagauagauguagaaccauuuuaaaauuaagaaaauugagagaaacuucauggcagcuuuaugcaguucucacuccacagcaagucagucagucucguagaauguaccccaacacugguuagaaucccagggagacuuguucacugagcccuggucuccgcacucugccuuucuugcccucaucggugggcuuuucugaggucuauugcaguugccaucaaagauuccaaccuugcuuuuucuuauacuaauagaaguaagaaggugagagacccuggccugcgugcagcuggcaccgagugccuccaagccagccacuguacucugguucuuccugagguaagauggaccacaagcuguuuugaguugauuugucuuuuucuccauuuucuuccucuuuccauauuaacgccuaccauuuaggucccuucuguuuaacaacucguuaucaggucugaguuaaaggagaccagaaaagaaaggcaaacgcuuccaugcuacugauuuggagcaggccucugaggcuuagcgucucuaggccaagguucucccucgaagugauccuuaggucccuaaccuuugcuucuucaugccaggaaugcagaagauguuuaugauaguauuaucugaagaaucuuccauuugguggguaucggguuuuaucuuuccuguaaaguaugcuauagaguaccauucuuagaauaacaacuuuuguaaauaggaauaaagaaguggcgguacuugaauugaagguaacuugacugcugcggccccaggucagauuuacucaggccucuaaagaguuauggccaugcuguugcuguacugcauugaaacuguaggcaaaugcaagguguugacauguguggccaacauaauuucauggagcaaaugcugaauugaaugagcuauggcaggacugcacagggucuaaugauacuaguguuggcacauccaagucugaagacccugagucucagggaauaaugaaaaugaaucaguggacacaaaguaccucucaggaguaucagcugcuuuugcuaaggagacuuauugucucuggcccuauaaucaauuuauuuuuuccauaguggauauccugauuauguucuuugacaauuucauguaucuauaauauguaaaugcucuugccuucugauaaauguuuuaaaauucuaauauuauucaagcuccaaaguguuucuugagauagaagguuucaaaggaaaaccccucucuguggacuagagaguugaugcuuccagaaccagucaggacugagagguuuuuguuaggcugaguccucugcagacgcuuccucauccaguaaggucccaguugugcucaguacucgccucucucuagggaacugagggcuccuucagcauugacagcgaggaguacgaagccaugccgguggaggucaaacuacugcccagaaagcugcgguucuucugugauccgaggaagagagagcaaaugcugccgagcacaucccagugagcgacagcguggcgggcacucccaggcugcacugcaagccaccagugggaccacaugggggaugugugugcuucuguccccagagggucacaggaucccaagggaauuuucauggcaaguacccccagcccuccuguuugcuuccuagagcacauaccaugucaugcacuuguuuguggucaguacccuguuaacccucgcuuuccuuauguugagguaguugaucccucuuacacagugguugucucaggcugggucuagaacguucuuguacucccugaguugggaagggcuggaguuuugugauugucccacaguggagaguggaaucuguagaccaaguuccuguuucgguucucugaccguccuggggcaccccggggaggcagcugcugucuccgggagccucgcccucuuucugggcucucucaugggugcugcuccuuugugagcucucugcuuugguugguuggucucauccggaaagcaaaugugagguuguucccucuuuagccauggcagacguauuguaaaaugcuauuuuaaaacaaacuagugcuuccucauuguuaguuugcauguguacaacugaggcgcauguugaaaacuaacugaccugggaccuacccccagguugacuuuguaacucaaccuggcaggaagcuaggguucuucauuuuuaaaaaacugcuuccccaggugaaucaaccauaccgggagaaaguguuuuaaaucuacuucauaaacuuaaauguauuauauauauauauuuuuuaaaaucacauauuuguguugacaucuauuguuuccaugggaaguuaaacacuugucaguguacuuacuaguauuguguaaauauuguuuaaaaauaaaaacuguuugaucauucuuuuaaacauauccaguguaaucuaaaugcaccccuuauuuauaaaaauuaacuaguaaacuagaguuuuacuauuuga

SEQ ID NO: 2935 - RNA, 35397 nt, Mus musculus
gacagacuaagggaugcgcguccugcacccuacacuauggaucaagagcacccacauacagagaugcagagcugaagcccggaccaggccacggggcgcugaacccgugcgggccaccuuccagagcuccgggaccaagcaagugcgcugguguccgagcaggggcagguguggccaagcccagcgggcacccagagagccuccgcaccgcagaaagcggcagggcgggcaggcccggaggggagugcccgcagccugccccgccccucgcgccccggcuccgccucgccucgccaugguggagcagggagacgcggcgccgcugcugcgcugggccgagggccccgcggucucugugccgcaggaccccgcgcugcaagcuggaggauggguccggggcggcaguggggagggccgaguggccgcggaggcgccccgaaggcgggaacccgacgagccagcuccccccgaagugcugcugcagccggggcgccuagagcuaggcgacguagaggaggaccaggugguggccguguucguggucaccuucgauccucgcuccggugagagccacuuagggauggaaggauugggggggggcggugggggagacugcacacuggguuucgggggcgcgggggagggacucgcugcgcacgcacucgcacccacacaccugcaucccucccugcccgggggucccggggcacgggggcgcugugucuccagacuggagccgagggaucccgggggcuuuguuccgcccccugcuccgucccgccgccgcucucagcuccgcuccgccgccuagucgccgcucuccuauuugcuccgcuucagugcgggaggauugguuugcggcagcgggcacauuggcuuuuguuuucucuguuuuccugcugggcugaaagguucuuauagacgccgagaggaagacaccccccccccucccgcguacgucgccucccacgaggguucagaacgacccugcucugcgccugcccuugcuccggauugcucccugcgccguaacuuucccagccgccuaguucacuuucuccgaaggcuucauuuuuaggaauuaacgugagagcguuaggggauggggcuggagaagcuuucgcuggcaggcugccuuucugggaagacucacuggcugugucacaccgucucuacccuagccacccacuccgggguggggagugcguugcaacaguaggcgguuccgcgaggggauaaaagugaacgaauggcugugggcuccagcuuaaggcauuggaaucccccagcugcuuauuugaggaagaggaaugcucggaugcuucuuccucgauuucuccuuugagcugcuagcgugaggagcugguguuugugagggaaggaugguuuucuuccuucuggaaguucccagccagucuuccaacccugagaggauggaugggcuaggaagaagaaauaggauuaugugccagguacuucagagaugauggaugcugguggcuucuaggguggguggcuuaaccauggucaacgauucugagccagcaaacaggcuccuuacaaaggcgaaugcccuauuccuagcggcaggacuugugggaagaacucagcccccacccccaucccgucuacuuguugccuuaucccacagucuuucaaacuuuucugacuuuaaccugccauaucgaauuaaauuugcaucacaaccagaacauucaaacuaagggaagcccgaguuuccugauaggaaacucaguauuggcccccuccgugcuuauuaauggucaucacacauacugcccugacucauacagucaggauuugugcucagguaaaucgaggcaagcuugagagucacccgagguucagaacugggaacgagacauuaauggcuuucugacugcauaaugguagcugucuggugauagagucuagggaaaggaggggggaaggaaaucucacacuagucacagguagagcugauaaaauggauuaucgauccauuacucucauugauuacggagauugaggcccuuguaggggcucccauaucuuuccauucacagcuggugacuggcuuucugguuuauacugucugugugugaggggggaggaggggggacagacacagacacagacagaccaacagacagacagagacagagacagagacagagacagagagggggguugguuuuuauacuaagguuacuaugaaaaggcaagagcuguuacuaauacugugacauuugugcaagcauuuuacucugauuucauucuaaccacucugcaauuugcugauuauuuuauaccuaguuugcuuaugaggaaaggcaccaaggaugguuacauauuuuggaaauaaugagccagcuuaaccaauaucuuucuagcacacuccacugccugaaccuuggccccucacauugccuggucacuucccuuggggaucugcagagaggaaggugugugcacuugggugagcauuguuaacuugguuuaguuuugguggagaaagcagcuguuuccugcccaccucuuuuccucuaagcuaugccagccuucuauauggcuccucucauccugugaaauauacugggaguuccuguguaaaauaaaguuuuauagcacaucucuuagaaguagccaaggacugugugaagucacacaccuccgccccaggacaaaggaaagaggacugccuugccccuguguauggugguugaggguggccaguugagaaaggaucgugaggccugcuguuguccugcaagcuggcgccaucaccgugaccaguauugucuucucaucuuaaucuagggucuucucuacuuuccugagucccaucugccacguguuccuaauuaauacugggccaccaggcagguuccucagccugcauuaccagaaguagucaaguagauaaggcugcuguacacaaaucagaacgagucaccuuaacuucauaggugugaggguuuuguuucggguucuuccucugcccugacaucacuuccccauguccuuccuguccucuguccucacuuuucauuuuuaggagcuaaaucaacccagucaccacccaggcaguggauuucguguguccucucacccgauauggguuaccuugggcauaucuacaagucaguguguagggacaucucacacacacacacacacacacggaaugggaggagagaacccauagcuguggcuugucugucugucugucugacaagagcaacucacagaaggaaggguuuggcuugugguuugaggagauucagucagacgugacagggaagacgugcugaugagagcaugaggugauagugacaucacacgcacaggaagcugacaccccgccugcuuuccccuucuuacucaguccaggacucaugggaugaugacccccaccuucugagugggcuuccccuccucagucaaaccuuugcaggaacaccccgaaagacacccccacccccagggcuguguuucuuagaugacuggaaauccagugaugcuaagagacaaaauuaaccaucacagaaggaauaggagaguggagcggaucccugggacaaugugaguuccuguuuuagggcgggaaggaggagagaaauucguucacacuuuuaaacauacguguugggaagcuuuugggggcaucugucugaaaaaucagacaggaaaggacagacgugauaguuuucucuggauuccugacuuauugcuggaaaguuaugguugguugguuggcguacaaauggcaggaagaucaagggcgucagguucaagguaaggcacaugcaaauacacacacacacacacacacacacacacagagucucuaucuggagccgagaacuagcuguagggugguggugcuggccaucugggcuacaaagcugcuauugaaaccagucacagaugcuaaguuggcacgcuggguagaagagguuggcagccagaauauugcucgcucuguguguguguucuaugauuucagacccgacuuuaaaucuguucuuagacuuucuaguaaaauuuccuuuucucugcuucuuugagaaagguaugcucacacuugggcuggcagggcugucaccccagaguaauagaugccgaugaaguuuuaccccucaauuccugccuggcauccugugaaucugccuacuuuagaccuucucuuuaugagaguuacuuuaggcagcuguuauuuugugggcauuugugggcauuuuccugagcucugugugugugugugugugugugugugugugugugugugucuguguaugugugugugucugugugucugugugugugugucugugugugucugugugucugggguugcucagaaggggaaagagcaucaccuggugggguuuuccagauguuucuuuccaggcuacuguugaaucaccuguucucuugccaccuguagcucuuacccacauuaugcaaauaucucuucaccugugugaaugaugcaucugucaaaugggaauauuugcaaucagucacacauagcagccagguguggcccaugcaugacaauccuagaauucaaggcuaugcugggcugcauugcaaccuaucucaaaaauaauaaauaaauuaauuuaaaaaaaucacucauaccaguuuucauucuaaaccuuauagacucccugucugucauggaaauacaagcagagcagguggaaagguauaaugagauuagggcuaggucuggcacccaaucauaacuuggagugcugcccagcccaucugacuccuuucagaaaugggaggggcuugacaguggaaagccaauggaaacucuggaaauagacagucgcccugagagucaccagcucacagagcaggaaagggaaaaccaguucugauagguaagagggaagucccaggaggguucacacucgcuguccuuucgguguuuugcaucaccugucaguggcugauuagaacacaauugugguuauugauuaaugccacacuggcugaaucuuuccugggccgcuggugauucaccugcucugugguuucaagcugcaaguauguggccaucuguugggaauuuaguuucuucucuugaaaaaucuacaaagaggaaaguaaggguggugguuuuaaugccuacccacuuacugugugcuucuggggucucaggaccuguaccaugguguuuaggagcaugccucuggccccugcaacaguuuacacgagagaaaagcaaauguguggggcugugaagugcaugcgagugugugugagaguggccugguaaccagaaguguguuuuuuucuuuuccuuccuauguaaaauuggugcacuggcauucagccaugggcugacauauggcugccuugaaguuaccaggauuaauuucucccugauucagaacucuccauucugugucugccucaugcuuugguuguguucucauuuagggcuauguaagauuucaucaaaauacugaagaccugaagucgauugguaauggcuggacagggacuggaccaaaacacucuuugaugguucuucuaucccauggauuuaguggcuuguuuaaaaaacauuauuauauucaaguaauguguuguugcaaccaacaguuggcuccugcuucuugccuuuauuauuggguuguuguugucauuuguuugguuuuuguuuguuauuuugaggcaggaucugucacucuaacucaggaugaccuggagcucucuauauaacccagguuggucucagacuccuacccuuagccucuugagugcugggauuacaggugugagccacuacauccagcgccuaccugagucagaauuccguguuaucuccuagcugaagcuagagucccaaguguaaguacuaacaggagguggcugagagaaaagauacaaaaccaauguacaagucucaggggauguuuauagccccacccacccuuacagucuugcuaagaggaugccacucaauauccaguacaggaagccucaagaggaaguacuugacuggagccacccaaaagaagggggaaccaaauuucuaacuucuaagagguuggggucaggauuguucuuuucucuacuucaaaggcuuugagaugggccagccaguuuggcguggauauggacugugcucuguagacaccaguacacacuggguaaaguuauuucacauuuaagcagaguacuugggagacggguagcccuauauagaugggagacccugucuuacaggcuuugcuuauuuucaugguacuuggaauugaacccaggguuucacaugggcuaagcaaguacucuacuguacuugcuaccauaggauucucuuaaguauccuuagcuugggauagaaacccucccucaagaguuuugaaaacaucagcuugggaggcucucagaagagccccugggcucaccuuagagucaggggaggggggaauggcagaguucagaacaacgugugcauccacagcccuacacgcuuucccuaggaacauaagcugcuagcccaauuauuugucgcuccaguucccuugaaugggaguauguuuaccuuugcaugagcucagcacugggcauugugcugccaaguuagacucuaccaauauuuacugaaugaccagaccagcugaauguacacauuucagaucaccucauuuguuccuuaggugaccauaugaaauccuucuccuaagcugucuaugcaggaggggccaggcaggaccuuccgggcccugugauagacccaagguguggccuaagagcugggaggauacagagcuggaaggaaaccaagcugaagggaaaggcaugugccagcgaugaggcucuuuuauaaggucccugcuugcuggauuccuuccaggcugccacacuguucuuuuuucaauagaggaaagauguuuggugaauuugagagugggguauguauuccgagcgugggauagguaggaguacuacaugucaaguuuuucuggcauuaaauaauuucccuuaaggauuucuauuucuacagaaccuuuuuuucuuuaaacuacaaauuccauauagaaguuauuccuuaauucagaauacuuuuauaaaaagauuaccucaaaucauaauauuccccugucccaccucaggugugguuucuuuucucaauuacuggagguuuuuauaaaguccuuuaugcuucccucauauauguuaauauauacauacacaucuaucuauacaauacacauauauagguauauaugcaaaucucaagcauuucauuuguuucccugauuuguaaugagauugguuaaaccuuggggaaggggucgagaaaugaaagaaucgcagagggagaacuuguuuauccuuccuguagaguccccaucuguugacauuuugucauauuggcuucauucucauacagucaauuccucuguaauaugaagugacauguuccagaaacuucugcuaggaaauaucaugcaguguaaauuaauuucaugaaaagagugagaggaggacacaccccucaaaaaugucagcaacacagugagagaggggggaaggaggagggaggaagccagcaggaacaguaggacagucgucaggcugugagguggguaagaaauacagaaaugcuaaguaaggauauacuccuccuagcagguugccuaaggagguaaauggugguggucugaucugguggguucuagugaacuaggccaagagcuacaugagaucugaggggaaguuguaauaccagcaggggcagcggcagcuccacacaacaggcagacgcugaagaaugaacacuguacauuucuucauggcuugaguuuggaagguucugcauugucuggcauuucucauggucgaaaucaugugaaauucucugcuaucaaguuaccaaguuacucgguccuuuucaucaccauaguaaaauaucuggcacacacaacuuaaguaagguuggguuucauucauaauuucagagaugugaauuaagcaccuuuauccacugagccaucccggucugcucaacuuuagaauuaauuugccauuauuuauuaaaugacaagcuggguugcuuuuuaaaaauugggguuucauugaaucuguaauagaaaauguacaaauaucugugucuagauuguucccuaaucagcugccuuggcccucgcuaaacagacauuguaaauggcguugauaucauauggauuuagauauaccucuccccccgccaagccuccccccgccccgaacucuuugaaaauaaguugcaaugaugcuugaaucucacuccuaaauaauuaagaauaugcuuccucagaauaaggcagcuucccuguauaggcagagugucauucccacgccucggguaauuaccacugauucaucaaugagcugaauaaagacaugcuuguuccuaagaaaaacgauuguccaguuuguuuugguuuuacugcccuuccucucuuguccuaggcaccgagcuauguugggaugugagcaaaaaaaaaaaaaaaaaaaaaaaaaaaaaaaaaaaaaaaucaaacaaaauucccccucucccaucguucagagacuuacagaguccuggggaguguguauguguguguuuggggggggggggcgagguuaggcaucuaaagcgugauagguucuguggagccuaugccugguuuuucuucaaggaggguaucagcagaaaaugaacuucgcccagcaggguguucugaagccccaguccugucuaugacucaccuaccuguucugaggugccuggcuccgaacccagaagggcuugcuuccuaaaaggaaagggugcagcagacaggacacccucuccuucucucagcauccuuacgaugagugaugagcguuggugaggcacagagcuacagugaggaggguuuugagaacgaggcugaagaauggggacuuuauccucuauuucagcuguaguaaguagaacaugaacuuggucauaaauaccagguauccaguagcuacacuguagucaagauagaaucccuucccuuuucauguguguaauagcuugccuaaagacaaauaugaguucagaucaguggggccaucagagaccuggggucuuguugguuuauagagucguuguuccucagaucaugacaucaccuccguccaguguuagguagcaugacagagaaaagugcagugugucccuucccuuucagguccauuucgguagcuaugugccucacuucugucuggaucccacaccuacaugcaggaaggauggaggaacagccgucauugggaggucauguaccaagcuaaaaagggcagguuuuaagaauggauauugaggggcagcuugcaguaucuguuauaccaccaugucuaaaaacaccaaugaggccuucuccaaaacugcuccucaaaaauagaacuauugcaccaggcauauugacccacucccauaacucuagcucuugggcugagggugaaggauugggcagugagugucuggucagcuuaggcuagaguauaagacccugucccaaacagaaaacaacaaaacucagaggcagugucggaaugauuuuggaaaacaguguugaucucucugagauucauuauugcaacauggcauacuaaaugcuccaugaaguccuacaauauguguauguauguauguguguguguguguguguguauauauauauauauauauauauguauguguauauauauauauagauagauagauagauagauagauagauagauagauagauagauagauauagauauagucuuuguuucaccuaaggaaauuuagccauaaaagugucucacauacuuuacauuuuuuaaagaagcccuguucauauuugccuaaagauuccuugguuugcagugaaguaacaggaacgugugggaaucguguuagucaagauucagacaggggaacaacggcuaggacagccaugcaaggauugcugcagacacuagaacuuauguaaugugcugugaggacuacuuagccgguccauggagcuuggaauccauggguagauggauguaaaaggaggacagugaucuugggaaggaggcagaggggacuccugggaguggauagggaccugggugagugugaccguucccagguuuguuuuguccuuuucuucugagauggugucucacuacauagcccugcuuuggccugaaacuugaccucaaagucaaacuugccugccuuugacucccaagaguuaaguuaaaaggcauggaccacccaccauacuuggucaguuggucuccaguguuagugguguggguguccuauaagagaaguugauguucuuuauggaagagaaaacaccuaacuuaggaaacucaaggcaauugucuuagaguuucugucacugugaugaaaggcugggcugcuguucucaucccagaaggugaggauagcaacagugccuggugcuccaacaccaaccuuccagauguuaucccuucauagccacuuucagcuuucaauuggaaccaugcauggaagggaauucugagcagugcaguucagccuacucagggaagggccaucaaaacucagcccaggcacuuaccagauaacagauaacaaauugcuuaccgcaaugcuaguugccauagcuuuuagugagcacugaccuaaaugggcaccaguagcgaaguagacaucgugcuacaucuaaaugauagaagugacacacggacccaucauuagcauuguaggugauaauaauaagcagaagacauccuugcuuuuauaaaaugucaaaaagaccaaacuucuucaggaccacgauuacucaucagaggcugaguuuauuggucucucaggagguucucuuaugugugugucuuaugucugccucuugaccuuccguugcuuccuauacaggaaugcucucugggaaaacuggguguguuguauaauuuauacuuaaugcuaggcuucaguacgaaguuuagguaaguucaauuuccucaggcuauaaguggcuauggguuaguguuaggugagugcauuaggagugggggauagagccugggauggauguagcucaggugugucuagugugcaccagccuauagguuagaucccuugaauuuuggauggauguacaugcauaucaagggagaaaaugcaggaacggggggccuugauguauaggaaacuuaguuucacauucuuugugaacauguuuucuuaucuuuaaccaaaguaacaaaaugucauuuuagccuuuuuauuuuauggaacuuuaauuuuuuuucauguuuuuuguuuguuuguuucagugaauucauuaguuaguuagauuugugauucuuuuuuucuccaaaauagaauacuugaaagugcuuuagguuguugagugugggaccgggugauccucuucgcugucugcagugacauaagacaggaccauguuuucucugaugucccauacaaugaucugaaaguggugguggcuaagauaguuguugaugguuuuaaugccuagaaaacugggacuuggcgugcuaauacauuugcucaaaaaugaaaucucgcaaguuacuuagucuuucacuuuggaaacauuugaauaugcacaaaacagaagagauuucuaggauauugggcccaccuauagcuaacugugcagugcucuccuccccucugucucaggcacacucauuguugaugguucuacagccucuccuaccuucugucauagaagucaccuuacugagcugcaacugcuggucuucaucucugucauccuguuagcuuuagacucucaucucccucuggucauguuuccaacaccaagcuuagaaacccagaaaucaguucaggagugaaugagucccagaauuccugaggugaaggcugauaguugguucuugaggauggccacaugugaggagagggaugagcuacacugcacagaguaggagaagagccagaauuacauccucucaaggaagucaagagaaagaggaguuuugaggaauuagcaaauaacacaaagaggucagugauaaugacgaauauauaauauauauauacacacacacaaacauacguaaauacauacauauauauauauauacacauacacacacauauauauauacauauguauauguauguauguauauguauauauauauguguguguguguauauauauauauauuuggucagacauuaguggcuauuuggaugguaagauuaaaaauagaaucucaagagauugagguaacaguauaggaugaagaaaugggagcuuaagguuuaaauaaauaaauaaauaaaucuacuuggagagaugaagccaugagaggaagauuugggggugaccagaagggagcugcucaaaggauacugaaucugaagcugggaugagguccuucuacugcccccuccugguccucugguguaguucaucugagcaucucaguaguucuugaucagugugaggaacagcacauuucugaguaccgauguaugcugggcuaugcucuucucucugagugguuuuuguuucuguuaacuugaucccccuguuccuacaggaaacaugguagaauggugcuuaccucaagauauugaccuugaagguguugaguucaagucuauggccagcgggucccauaaaguucagucugauuucaugugaguacuucugagccuaucuggugccacucgaucccgucucuccuauguucucccgagcauguuaucgagaggugucuucagaugguauauguaagucuucuguguguuuauccagcuucccagcaagaagggcuccagcucuggaguucucaguggggucccaauauuccaugcucauacaacugagcuauuacugagcaaaccucagggagguuugguuuuaguguggguuaaauacuagcuuuaagcaggccaguuuuagugaccuguaaauggugcuugcugaauuuuguaagaagccaauggauaugcuuugagaauaauuuguagcuuuaaucucugcauuggccugaaaccaaggcugauucaagcaugaaagggagaaagaagugaaaugucagcugcauuggagcugucagaagccaaggaacugagagaauugggauuugugagagaaaacagacugagucccaaaggagccagaaggucaacccugguucugguucucccauugaagcuguuaguugugccagagaggauaccacagucucuggcugugggcauuugaacugcaugcuuguagagacuuagagacuuuaagcuaacucuacaccacccccccuucacucugggauggcacauucuagagucuuggagccguggccacucuuugggagacugaauggcuucuuuuaugacccagcuuuggagcucugaacauggucguuugggaugagauugcauugcaaaggaaaaaagcaaaaaaagcaaaaaaaaaaagaaaaaaagucaucuucccuaaauuagagccgcagugcauauuuggucuguuucagcuauuuucggaagggucccuucuuuggccuggccugcuuugccaacaugccuguggagagcgagcuggagcgaggcgcucggaugaagucugugggcauccucucuccauccuacacccugcucuaccgcuacaugcacuuuuuggagaaccagguucgguaaguggcgucugugaguggcuucuauauguuucgggcagcagcgggauuuguuaccuggugccugugcugugagucccuggagauggggacugugggccagggccacagcugucuuccuacagcaucaguggcucugggccaagccucaggugacccuccuuucuuucagcaaauguauuauaaaauagcucuucauccuauaaugaaggcuggggaagauauuuacuuucaguuuuuauuaauacucucaucacguuuuaaucagacaugaacaucuuuguuugcacucaguuggcugcuauccuuaugauuuuccccccagguaggcaggcagacuuuaaauauuguuuuauacauaucauuuuuuuuuggaguaguaggauaauauguaacagaagcagaaaaauuguuacuuuuuauauuuacauauauauuucauuaugcagguaaccuaauuaaacuucaaacagugcuggggauuuuuucucuacuccuagaagcauuguuaaaauguuagucuguuuucugauacauauauuuguguguuuugauaaaauauccuugacaacugggcaugguggugcuuuagcccaggaaauaaaagccuuuuagcuuacauuaguagcaacauagcaagaccuuguaugucacacauacaacauauauaagagaguguguguauguacuuggcacugauacuauauauaaacccuaugcaucucauucauucauucauucauucauucauucauucauuuugaguuacugucuugcuuuguagcccaggcuugccuuuuaauuugcaauuguguaggaugccaaacuuuuuauguggauaguaggaugugggcugcaguccucaugauugauuguacagugauuccucuuaaccccugagccaccucucuagccaccuggucauaguuaaagcugaugggaucuaaucugguccauauccuuugcccauccuucuuuccuuaguucucccuguaucuuacauuuuauucugacucccugucuacccaagaauacuuuggagugagcaagagucuuaacugcuuuuggguacagagaaguuggcuuucccagccucaugagaucuaaauugguggauuguaacagaaaugagcugcuccucccccaccuccccaaacacacacacuacuucucguuuuccuuacucuuuuuuuuuuuuuuuccccagcuucuaagccucaacacugugguuuuugauuccacaguaacucauuuucuggguaucagugucugcuuuagcuaaacuagaaacuaaguuccuauaacagagaagagaucccaagguacagcaguuggaacaagucagaauuccagcuuucuagcacaggguuugagaccagauggagagaaauguuccaguguggguggugacuggagcaagggcccuccgugucacccaucucccagcaugaugguggacggugacucaccuucaucauaugacauugcaaccaguaaggagagagauggaagcggaaaccucaacuuaaagacacuacuucugcacacauuccguaggcagaucagcgcaggggacugugggcuucaagagaaccccagaguggcuggcucuacaggggacucuccgaucugguucacacagcggaggcuucacaucugcagcauucacugagucauuuauuccccacuggacuauugcucaguugacaugacuggcuugugaaguuugaguuuaccugcccuuacugauaaccucaucauauccaucucugaaaaacaucuugucuucuaguacucuguugcccucagacccuuuguuuuuucuuggugguguggcuucaucuguuacaaaaucuaccauguguuuaaacccaggcucccucaacaguuggguaacagucauggcugagcugugaguuucuauuuaugccuccgaguucauguucucuucugcacugucuguuauuguuauccuguccuaccaagcaguggcucaaaggacagaguucugaauuaguuguuuucucuuuacaucacacaucuaucuccucugugugugggagugggaucagggaucaaacucagguugucgggcuuaguggaagagccggcucugucucuagcuuuuugucuaaaagacucauaguucugacguuuucuguagaaucuugguccagauaugguguugaguguagucaaaaaguaaaggcccacaacugaguagcggagugaguuauuuaaauguuaccuuuuuaaagacaauguagaaauucucagugggcuuuuaagggaaaauggauccuaaccuuugaacuucaccuaugcaucaagcuugacacauuucccugaagaguaccugcaacccacugccuucucagaacagccagccagacuguaagccaucaggcuuucuuguccagcccagcagcauuucugagagcaccggcaguugcucuaagcaccugaaggcuuguuuaucacauggcugccuccugaaucaaagcuuuucagaccccuaaaauuagaaagaggcccuuauuuuuaguaauuauuuucugaaauuuucuugggguagaggcaggguccuauguauaguccaugcugaccuugacuucaugauucuccugccgcagcuucccaagugcuuggauuauagaugugcacugucaccuacacacaacuaauaguaucuuuuuaaguacagugaugauguuguguuucugcuuuuaauacaaacuuguccgcauagucuccugccaucgucuuguugugggugcuggaagccacucugggcuggcagugacugaaaccagcuacuacuaccuuuucaguggaaaucuugacucugagcagcuugcauuccaacuuggagaaggaaggauucauggcauguuggugggagggaggagcggggauauuacuuaucaguguuguuucagccacagucagggaugugucuucucugaaguuucuuuuucauugugugguggucacuggaaggcucugagaaaauacaccaggguucagaagggaucggagcuuuuuauucauccuuauauuaccuugcugggacuggguagcaguaucuuuauuuagacaaaagaaacuuacugucucauaguuccagagacuuaaagagucaaaagucaaggugucagugucagcagggccgcuucccccgucucuccuggcuccgugcuuugcuggcuggcucuggguuccugggcaucugcaucaucccauugucugcaaucauccucacgugucuaccccacgccuuugugugugcauguguaauuuccccuuuuuaagucacauagaauccaggcucccucaaaagaccuuucuuuaaccuaauuguguccuacgauccauccaaauacagccaucuucuuugguaccaagaguccagcaucuuuggacaaggaacaaaaucaaccucuaauguuccuaugcaacauaaagcguugacccgguggcaucauucugcgucgcccaaguggucuaggaccuaagugucauugucuugaucugaggguugguugacaaggcucucagccugaguagaggcugagacagggguggaauaggggaggggagauucggauucauuuagcugauguggaaguaugagcccucagugaccuucagucauaacugacccccucuucccuuugagacauugagggcucagauucucucaguucuauuguaacagaacaugcaugcucacauucuacauaaagcaaagcaacuguuggcauggagugugguuuucugaguuaucucuucucacaauauaaacagugcuuugagaaguuacaugugaucugcagcauagauugcucaagaauuagacacuagacauggccuguuccuucuaaaugugcaucacauggugccguugaauuucagaccuuguguuugagcuuugcauaaagcuauucucuaacaguaauggagacuugaagguaaccuccaggugcagguguucugagugcaucugggccuuuagcccuuuugguagagauacguaguuaugcugggcagagcugcucacugugcauguguguuacacagacaccagcuggagaugccaggacauuacucucaucuggcugcauucuaugaagacaagaaaggggugcuccacgcuggccccgggagggguggcagcuugccaccugucuacugguugccuucuauucaccgcuauauguauccagagaugaaggugaggcuggcuguucucucaugugucuggggauagucauuauggguucauuuuuaaaugauaaagaaauuaugcuucagccucaugcagaauucugccuuugauagaauuggguuugauauaagcauuuuggguucauuuaaaacauaagguaaaugaucuuaaacaauaugccuucuguaaccaugcacagagccacauaugcugggccgcucaugcuggacucugaggagggcggaugcuuuugauugugucugcuaauguaaagccaagcauaaggauguagaguuugaagggcagacggaauauuucuuagcuauguuauuucugacguuuuauucggaauuuuuauugcauccuuugcauuuauacuagcaucucuguuuaauaucaacaggaaaucuggccacacaguggguagucagaagauauaaaagggucuaagaacacgaaucuacuauuucuccuuucucccuguucuguggcugggcacaagauauuucagugaagcuuaggacucccuuuguaaagaaauaaugcaugaguuuauagacggugucuugggacauuacuuaguuaggguuuuauugcagugaagagacaccauaaccacagcaacucucauaaaaggaaacauuuaauuggggcugacuuagaguucagaaguuuaguccauuaucaucauggcaggaaguauggcagcaccaggcggccauggugcuggagaaagagccaacaguucuacaucuggaucagcaggcaucuggaagauagagagacacuggaccugaagagacagcugagcuccugaaaccccaaagcccaccuccagugacauuucauccgacaaggccuccaauauugccuguggggauuguuuucauucaaaccgucccaggacaggagauggucacuaaagcauuugccuauguagaaaagaaggggugcuaauuccagaccuguuggcuggagguggggcaugguccuacuuucuuagcauagccuaugaguuagacauuaugcuaauguaucaauacuuaaaaguaagauuaacaggagaagguuguuuuauuaaucuuuguuuucuaguuaaagcaauugaagcuuaucaauaaaugguuuagugacuugcuuugggagacaggcagaaucuaaacccaggacuguggcaaagccaguguucacucucugcccuacuuaagauguggacaagaaaggacccagauauagcugucucuugugagacuaugccggggccuagcaaacacagaaguggaugcucacagucagcuauuggauggaucacagggcccccaauggaggagcuagagaaaguacccaaggagcuaaagggaucugcaacccuauagguggaacaacaauaugaacuaaccaguaccccugagcucuugacucuagcugcauauguaucaaaagauggccuagucggccaucacuggaaagagaggcccauuggacuugcaaacuuuauaugccccaguacaggggaacgccagggccaaaaagugggaauggguggguaggggagugggggggaggauaugggggacuuuugggauagcauuggaaauguaaaugaggaaaauaccuaauuaaaaaaaaaacaugaccuugaaagccauuauuaaaaaaaaaaagauguggauaagaggacacagacaugcucaugggucaagagcaaauuauuuaaaugagacugauuuuuuuuuuuuuaaugucauuuggccauagaggaaaaagaaaaguaauaaguaagauguuaucagcaaaacaagaguguguuggguauuuaaaacgaauucaagaggcugaaggagcagucagagaacagaguaacccuaugcauucgguaucucagacaacggaugcuaccucgcauuagcaagcuauugcugccuaccaaaucucccaagauuagaagcuucuagaagugcauguguaugguuccaugguuucuguggagaggacuccagucauggcuuaucugaauccaagaucucgggucugcugugagagauuucagggcuccagccaggguuggagacacggcacaagguucaacuaggcaagaaccuguuuuucuaagcucguaugagcacccacaggagcaaguuucuuaagggaugcuacacugaaggccucuauuaguguuugcccucagcucucaaccauguggggcuaucuagcuuggcaguuugcuucaucaaagucagcaaaaagagagugcuagcacaauaaagucagaacgcuguaaccuaaucguagacgugaaaggccuguauauagccacagucucuuuguuagaagcaaguuccucgagaggaagaggggauugcacaaggcuguaaauaccagggccacaggccuuaccuuggaugcugcuugccauauuuagggccagggcacaaggaggagugacaucaggcucagagcccaggaagcaggaaggaggggccuugcauugucugugccaguaucuccgagggacgcuguguuccacugagccugguacuguuuaaauauaugguccgacuugugcugagagaggcuggcagcuagugugagaagugcucccugcugcuggagaaugaagcagcuguaacaugaaggacauccaccuuuccuccggucuucauggcugaauucauggcuccccauaugcagaacuuaacaagagacuagguggccugggaguccaggggauggagcaugcagauuuccugcuccugugauaggguugagagacgguuggcaaggggcauacgaugaucagaaggauuuggagaauuuauugauugggacacugucagccccuuuucuucugaaugaaguuacucugcuaucaccaaacccaggggaugguggccaacauuugaccugaauguucuuagcuuccucaccccauaggcaaaggggggaaaaaagagaaaagauacuugcacuuggcuuugccccauuaaagacaacuagcuuauuaacagaccugucagacucacagaugugguagaaagauacuuauauaggcugaagauacaaaugugccucagugccacagucuuuaucaaaaaccagcaugccaacaauuaaaaauaaaugcuucuuuuguuucagcagccgcacugcugggaucugcccuuuagauaugaaaacaccagaagaguguguguguguguguguguguguguguguguguguaauuuugcaguguuuacgcaauagagagccagaauauucacauaguaaauagccauuaugaauaauaaaucagagcauaagacaacaacagaaaaguccuacuaggucuguuuuuuagcaagggcagaaaacuauaccuacuaugaccagacuuuguugaaccaucacaguccccagcaaaaacauaauauacauauuauguauuuucuaggaggcacaguacuucccucagagauccaagcacaggcaacauauuuguacggaauccacacaggauuuuuucccucauuauucugcaaacagugcuuacauugaaucauguagcauuuauaggauauuagauagaucaguaaccuagaggugauuuaaaguauaugggaagaacuguggcauuacaugcuaguauuuucuaugaauauauauacacauaucuaugaagacaacaauaugaaugaacauauaguccuuaacgcauguauggccuaagggcaaggugaagcauggggagugggggaagggcaacgcuucuguguguaacacagaaugggcuugggcaaaaugagagcacuagaagucauauacagccagcccuguauucgugauucuguauccagagucaaacaacacuucugcacugaacacauacagguuuuguucucauuauucugcuaaaagugcucuaaguguuuuacauagcauuuauagaguauuagguauaucaguaaucuagaggugauuuaaaguauaggggaagaacuguguauguuacaugcuaguacucuuuucauuuuauauaagagaccaagcagccacagguuuuggugucuagggagugggucuuaggaagcaguccuccauggagacugagcuuccaggacaugagugcauuccggguuuuuuuuuuuucuuuucuuuuuuguuagauauuuucuucauguacauuucaaaugcuauccccaaagcccccuauacccuccccccacccuacuccccaacccacccacuccugcuuccuggcccuggcguucccuuguacugggggauaugaucuucacaagaccaagggccucuccucucauugauaccugacucucauugauggcugacuaggccauccucugcuacauagugcauucacuuuuuauggaagaucguguacauguucacaaugggaaauuuuuauuguucuuuguaaaaguccgagagaaacaggcucagaaaauagagacauguaaagcaaaguaagagaaacacuggucucauugugcucugagcagguacggugcagaaggguaugagaucugugacuaaucuccaggagagaggaggacacccugugguggcuaucucagcacuuccuuggcacaggccuacauaugggccccaaggcacuagcauucccucaucuccaggcaacuuuauagacacacuuccuucugccaagacugugcccuccugacucaucauguugaugcuuagaugucacuuccaucaggaagccuucaccaucuaccagaaugcaaccaagcuuucucauuugcccccaauggcugcuguccuuccccaccacgcugucuccccaggcucuacucuacuugcuuucugacuugggcugcucuccaguuagcugcggaagucagggccugagugucuuuaaucuagaaacuagaauacguagugcuuuggcacaaaguaaucacuuaggagacaguucuuguuaauggguaugugcguccaugaaugaacaaauacaugagacgagaguuugggauaaauaauuuauucuaggacacacuugcccaagccccaucagaccuguguguaauguaugccaaaggccuaaagauggcagaaggaagguagggaggaguggguugugcucuggcugccuucuugucugucugcuguuugucucgauagaagauagugacugaagagaucugaccagucuugcucaacgugaguccucucuccuggugacugaaugacauauggagaggaaaugggccaagagucacaguggucaugcuugggaaggaggguggcuguguaugcagcauggggcuggugaauugagugucagguggaggguggagguugcuuugaaaggaaaauuccuccacuaaguagucuagucgaagcuuuggagauggaggacaguuaguggaggcagagugcaggggcugccccagggcuggcuuagugcgugggugcuccacgcaucucucagccuauuaaacucaguguguacuuuagagagcugcccaccuucagaacuuggcuggcccaccuuucguauggcagaugaacacucuuaaugccaacagcuaaguaucaaaguagcuuucugaaguacucacaggccucugacuugaagccucuagucugccagugacgccgguauuuucuauguauuggcuguucuagcuguaagucacucaugucuuggcucagguuguccuuaagcugggugagguaacccauggucuggucucauuauacagacuaagaaagaagacuggaaacauugggucacuuuuccaggcuucccugucagcagauuucagaggcagagugcaauuucucaagcuuacacucuuaagucccuuccagaagguagcucucagggagggggccucccugaaguuaucauuacaaggaaguugguuagaguugaaguuuaccagagggagucauggggccguuguacccuccuugccuguaacugcugcagauaccuugcugugcaagguaguccccuggucccugcauccuuugaaacccaacuucaaacuguucgcuugucgcuguagcauguacaauacucagugguuuuguguugaaggcccguuuauguguaucuauguaccugugucugugacagacagacagacagacacacacacgaaagcuuggauccccugggucaggagcugcagguauuugugggaugccuguugcauggguguuguaaucugaacucauguuuucaugauuauacaguaagcacacugaaucacugaagcuaacuuuucuuuucuuuucuuuuuuuuuuuuuuuuugguucaguugucauucauacacacacacacacacacacauacauacauacauauacacauauauuuuauauuuuauuuuuacacauauauauauuuuccacuuuauauccugcucacugcccaccuccuggucaccuccuccuaccaucccccccaacccucuucuucuuuuccuagugggugccccccccccccaguuuaagaaauaaaauucagcuguuuccucuucauuucuauccaaaguguuuauccaaaguguuuauaguccuuaaauuucuaacuucauucugucaggggagcugaugcauuggagaaauccaguuuaaagaaaaauguaaagcauccgaugaucguuuuguguggaagcaacuaucucuuaaugcuugcuggugcuuuggaguuuuuacagaaggcuguuucacagugguaaccucuaacaagcuguccaccuguccuuguguguuuccagaucacacacccugcuggcuguaugucucaguuuauuaaguucuuuggagaacagauccucauucuuuggaaguucgccuuacuucgaaagcgcauucugauauuuucucccccaccugugggugucgugugcuauagagguaacccguagcccaaguggggcuuuuccuaaaugcccaguacacaugcccucauccuuuaguuguugaccaacuucggaagaguuugggccauuucaaugggaucaaggcuucugaugggaauuaagaguauagagucuggaggcaaugaagauggauggggagggggcuuaccuuaguaucugcgaagagauaagugucuggguugaagcuggaaugguggauuguggguaagagguaaacuggaucagguuagcugaaguaugcagggguaugguugaagaagagucuaggaugauaaggaucaugaggccaccggaaguggggguguugugaucauaaaaagaggaagagcuauaagaauauguucuggcacagugugggggaagagggugccucagugggccuaugccaagguaucccuucccccugagggaaccagauacacaccgauauaguauagaauagaauuuauuuagggcaugggaaggggaguuaagaggguagcagaggcagagaaaggcagagaaaaggagagaguagagagaugggggccggccauggccauguggagagaggggggaagggaauggggagcaagggggcaagagguaagaaagaggcaagagcauaagggagagaggaggggccaagcagccccuuuuauagugccaugccuacaugguuguugccagguaacucugaggaggaacauaccuggcugcugccaggaacuguggggauggaguuuagacagaauaccaacagagggaccaaagaguaaugaguuguuuggugguggccuaacuuggggcgugauugguguucacuacuugagacauuuccagggagaugcucaucaggcaguugugugauuggguuagaaucucuggggaauagcugggcuugagagugacauaaagccuauguaauaaccuuggaaugacagcaucaccuggagagagugaggaaugaagguuuaagagguuggucgauaguggcucaagggcaggagacugaaggagagcauggaaaggggaggaccagaggaugggagguucuaucgagccagagccuugaggagggagaaggccagacaggucagugagaaaaauucagcaucuauuuggugauaaauuaccaaugaggacuuuaagauaucagguucugauauaacugucuccugagggccuuugccagugcuuggcaaauacagaaguggauccucacacaaucauuccauuggauggagcacaaggucccuaaugaaggagcuagagaaaguacccaaggagcugaaagggacugaagccccauaggaggaacaauaugaacuaaccaguaccccuagagcuccuuggaacuaaaccaccaaucaaagaaaacacauggugggacauguggcuccagccacauauguagcagaggauggccuagucagucaucaaugggaggagaggcccuagguccugugaaggcucuaugccccaguuuagggcugggccaggaaugggauuggguggguuggggagcaggggaaggggguaggggauagggguuuuucggaggggaaacuaggaaaggggauaacaguuaaaauauaaauaaagaaaauaucuaauaaaaaaaagauauuagguucugcaguggggccugaagauuuuccaagacuaccagguuauaggauagguagcacaaacaaagccuucccuggcuucugaaacaacuucccauuggccuagcuaaacgcucacucaaggcugggaagguuuguuugggcucaugguucucagaguccaagagaaugacacuggcuuuuggcuuuggucagcuuuugaggccucaugguggaagagaucauuggggagggagcaaacuuacuuuauaacacuuuagagauaacuuuuuauaaggguagcaccucugugaccuaauuccaucauagggacccuaaucucccaauauuauuauacugguaaccaagccucaauaugggguuuggcaagaacaaacaacagaauguagcagcuucauguaggacaacuguucugagguaucgaccugcuuggucuugggugggggagaagggaacaggagggaaaauuccucacucuggugucccccucuuacaguguacuguugcuguugucuggccaaugugucccugccuggcauugggggcaccaucccugaguccaagccuuucuucuaugugaacguggcugacauugagagccuggaaguugagguguccuauguagccugugaguauggggaccuccccaacucucccugugauguuuaauucuguagugagauuggacuggcuuuuguguguguguguguguguguguguccccuugggguucuuaccucauuuacccugggcuccaaagguaccacagagaagauauuugaagagaagcgugagcuguacgauguguacguggacaaccagaauguaaagacacaccaugaccaccugcaaccccugcugaagaucaacagugcagacagggagaaguaccgucggcucaaugagcagaggugagauggcucaucugccagaugcuuguccugugugcuagugagugcagcccaggccagugcugugcuaaaagggacuugcaggccagucacagcagcacccuaagcaggauggucccgcgaaucugcgaaaagcccacucuaucaccacuugagcuuucccagucuccugugcuuuaggaggcuggcaguccuccaucuugcccucacacaugggggguuccugaugggcuuaagacucuaaaccccagugaaggaaccagucacacuaccuuucagaaacaccccaaagaccuuugccugcauguuuggaauacccacugacugagcaucuacacuauguggacucauuaggaagcuuguguauguacacuguuccguguaacucucaauuguuuaugcuacaaaaugaaggguuaguauauaauauguauauaauauauguaacauguauauaauauauaauacaauauuugucccagucaguggacaaaacagucccaugacuaauggggcagggcgggggaccauuagcaaaaugggccauagauccuggguuugaguccagguucuguuccuuguuuacucaacuucaggccuggcacaacucugugaggugccgcuuccugagagauacagccaucauuggugcuuguugcugccaauuagcuaacuggauguaguguccacuggagucugaugguguucccccuuccaacaggcagaugcuguuguacucccaggaaguugaaggagacuacagcccaugugaagaggaccucuuugugcugugagucagccggggugucagcugugggguucugggaaugcuuucaguaccaacuucugcaaacaacuugcaucccuuccaugcaucccacugcaguggagggugacugucaucauccuugggcucucagugcucuguccuuagaggugaccugaguccugcaaagccaucagggugaaaccugaguggcugaagagacagggcaggcccuggagaaguggugaccgugaaaguacauuguauuaaacauuuguauccagaaugucaccacauagcuguccaucucuccacccucucacucacugccuccucugaaaagaccagggguuuuugugcugaguauuaugagaucaucugaaaauccaacguuugaaugcaguguaaucucucuuccccagaucugguagccacggaaagggccagcuccuuccaguacacauuauacucaaguggccacuggaaguccuguuucaaaauuagaguggaacuguaauugaaguagaaacaaaucuccuggaggggcccuaguuuugaugagggcaucucuacagagguugauccuguucuugaggcuccuuucuaaugcaugcauacugugcgaaugggcagacacacagucuaguuaagccauuuugguaugucuguagaagguccccaaccccccagacagcauggcugaacuaaugucuuucuaagcugugacucugaauccuguuuuauguaugcucuuccuccagacaccccucccaaauagagcaaacacgaagugugugugagcugugccagucucagucaguauggcuugccgccccuuuccacacugcuggcuucagaacugcugugccugcuccagccccucugaguucuccuuuucuaggcacagcaucagugaccacagacagcugcaaggcuggugcagaacccugugcucuccagugaggccuguuggcucucaguugcugugguccagucaaggcuuugaaaacugugcauauuuagucucagucuugaaaucucagucucagaacugcaucaucagguucugugucuugguuacucagagggagugacauugucuauggaaccucuccaaggggcuaugcuuaaagcaggaagacagcagucaggcccucauccauagagacacuacaauucuugcugugugucuuccuugcuggccucauucacacuaauagcaguuuuuaauccucuuaaaaauuguuacaaguuuggaaggcuuguaaaagcacacuacccaagcgcagacggggcucugcuuguuuggguuaucuagaugagcuucuugucuuccuuuuccugucuuggaaaugcagguuuuuccuagagcagaacaaccggauuuuucagacucuguuggaggugucagccagccaagauaaaacucuaacagcggagcaugcccgaggcaugggacuggauccccagggagacaggagcuuucucauggaccugcuggaggccuacggcaucgacgucaugcuggucauugacaaccccuguuguccuuaggaagcaugauaggacugguggugagacucacucguguagggugacaggagccuggagugcaccccaggcccucagcagcuucaguuuuaauuaaguugacacaaaggacuguuuauacuuuccaacacaugaaacuuuugccauuuucuuucugagccucagcccuggggcugggauggagcuggggugaggcugccugggcuuguagccuuugguuggacgugggaaucuacugucauccacugcugcuucuuuggguuuagucuuaggaguucugugagucagagucagacucugggaugaacuguucagaaaaccuguaugucuucguuugccuuuguugcauaugaaaauaagauaacuauguguccccguauggccuuagauguucaucugcuuaaagacagaaacuaauuagaugaucuuuccaccaaguucaaggagucaaguuaggaucgccuagucgugagagggcaagucugaaccuucucuguucgauggagggaccacaaaggaggaaagaauucuugaaauccuuccuaaaguaagcuaugaguuauagcauccacccacccuccccacugccucccaguccucuuggucagugcugaaggguggugcuggcccugagcuuauagacucauaagcauugaauauccucuugaacuaacuaacagguucaaauagguaagggaagaaguuuccaguuucucuaagagcucuguggagggaugguacacagucaguccuacagcagauacuucugaugaauucugaaauauagccagggcccaagcugguuaacucagguugcaaugugauguuaacaggucucuuuaccaaugugaaacucccacagacaucucugaaguagagacaacauuccuuaggcuaagcaaggaaccuaacagauuugucagggaaaacauaacagugccucccauccaagagaauggcuggaaaucccagacuaacaaccaugccugcuucuuuuggucugugaugggacugcggucacuuuguucuuuggggcugggauacuuuggacucaugcacuauguuggagggcagcugugaaccauauucagaaagccaugugaauagcuagcuagccagccaucagacauccaugucuguagcuaaagagcagccagguugaugcccacagcagagagaacuucaaagagaggguccaugccucuuaguucuggguucuugaggcuuauugcuuagcucaagaauguucacuguagcuccuugauaaaaaauccaagaguaaagagguuggugugugugugagaaugccaacagacacugaugagucaggguaacgucuuuucuguaaauauauaaguuuaggcacugacauaaacuguuccaucuaauugauuuuuucuccucugcaguguggguuuagccaucauuccaguaacacaauguuuacagaaaacagcugugcucaguggcugaaguuucuccugcuuuguccuuagggcuaccuuuuccucuugccccagggcugagcaguggggacuaccugaugcugauggagcaacaacuucccuuggucgcuaaagcucaaagucagggguagauagccagagauaggagcuucugagggacuggaagccccucuucagaacucauugaagagaggcuaagcaauugcauccacagaccuaacagauuugacagggaaaauauaacagugccucccauccaagagaauggcuggaaaucccagaugaacaaccaugccugcuucuuuuggucugugaugggacugcauuuguuuguucuuuggggcugggauacuuuggacuucauucaaaugaagcccccguuucugagaaccucccuagagccuucuguaugccagcacuguuugcugugcuguugaggcagcaagcugagaacugcuaaugaaggugagaaagguugucuguuaucaacuugggcuuuauggguucuuuuuaacugagcagcuguguuaggucuuaggcucugggcuugcuagcccccagaagcagaacuucuuguucaacaucuccuucagucuuuccuuaccuugccaguuuccucauagggccagaacauggcacaggugucuguguagccgacaguguguaugucagcaccccuuguacccuuugcccccuuuuaucagcugcagaguaagucuugagaugugagccacaucacuaugaagucauaccagacugcuccccccguggcagugggcagaugcaagucugcauaauauucugugaguuuccuaugaagggaaguaguuuguguagaacucuauaggaaucucuuuacagugacagcagaagcuaguagccacaggaugugcuugcccgucacucuugaaauacuuucugaaaacccaucuggcuuuauuuggaagaaguuaguucacauccuucauagcuuucugaccauuagcagagacaggcauuuuucuaaacacuggccucuaggaagagggcuaaaaucucagauguggguccugccauucugcugguggcucucaucagaccccugccagagcuggcagaacccuucuggggagcacuaauccccuccuguaccaugcugggaaccauguguuaaccuggaagcacuugcugacuugcauugcuggcuauucagucauuuuuaagguagaagagauuuccaaugguaaccaucuucagggggcccgacacugggguuuuggauacguggacauccauguuaaguacaacauacugaguagaacaagagccucuuaaaguggguguuugcaguuuugucagcagaugguaaugcccagcuaguuguugccuggcucaggacucuuuccuuggaagcaguaaaaauagcagagcuuaucuccuaccagucuauaaaggaaggccaagucauugccugguauuaguguuagcuuuaaacaugaagccuucccugugcugggcauggauccaggccaauguugguguccuaccuggggcccauaugguucaaucaguuaggaguacaaugcgacaggagguguuugccucccauaccucccacccacccuggcuucuggagacgagcugguuacauugcugggauagaaguuaggauaagaaccugaaacuauaacuuaccuugcuggaaaccacggaaaggugagagugacgcucagauacaauagugccagaugcuucaugggaagguuugcuuacacaauuaccuaauauaucuuagcuagauaauaagguaaauuaaaccguggcuaauugcugccuucauucuggaggcaagggggacgaaccuccugucuugaggaacugaaagccuaucaaugcagagagguaaaauggacuuacccuuccacagaagcuuuuggggagacuucuccaagagugcuagugaauuaccuggugguagaagucagccuccuagagaugcagggacuugggaacugucuuuuccccuaaacugcacagccagagaguggacugagaugcuuccuccaaguccagugcgaugguccuugcagagguaaagaagggcuaugggguaugggugaacagagcuguaagauaacgcugggucucacagugaacaugccuuauuaugagaagagcaucauccauuaggacgucuuccccuuaggcuuccaggcuaauaggcuaauaggcuguccagcaucccaucucucccucauagcgcauaguucugcccauagcuuaccuuagcaagcccaauuucaucccuucucauuuuaugaaaacccuuuucagucagguaggggaaaggaaggaguuaagggcucccucuaaacccaagucaugggcuuugacuaugccacuuuauagcuaauauaccucuguucccaggagcuacugagguacccagugugguggggaaaagacggugaauuaagguaaugcuuuuccuaugggaaauggaaguuuauuuuuauaccaguguuacugaauggugaauuaaguacugaagcauuggaaaggaauugcaaaguuaucaucuaaacagcaacgggcagcuuuuguggcuuaauagcaguggaggcccuuagacaugucgcugucugugacaggguuuugaagcaugagcacacacucucugcuguauuauuucagcagccauuacaggagagaaagucaacuggccuggcaagaugagagggacagugaccuugggcaaaucuguagaacagaagugcgcaaauagccuuucaaugacuaguccuucuugaucaagagagagagaggggaaugggagguagucugcugccuggcacuuuaauucauuuuaguggcuggaaguugggugauacuguaaaauuagaaaaggaauaggacuuuuuuuggugcuauauagagaaaugaaaauggggaggaauaaaacuccuuuuagagauuccucuagaacgucagcauggcgcugccucucagaaccauguugacuuaaauucugacagguuuacagcagaggguuuguuugcauuugcagcaggugccugugugguuugcugaguuuacuuugcuucuuaaugauacuggggcucacugggacagggcaggguuuuauaaauugugcauagauggagcugcaaagugaaaagcccauaaaaaagaaaauauauguaacugacauuguaucuggguaaauuaagcaaggagaguuuuuuuacauauauauauauauaugaaagucaggcaaacccaaaguucauuuuccuugcccuucagaaaugccaucagccaugagaaaugggggauucuguccucuugaacugccugcauaaguggcugccaggcuuugggucagagauaaacaaaaucaacuucauuuauuugcccaaaacuuggauaaauuuuugcauaagucuagaauauaaucuuuccugaaaaaaagaagucaugguaaucaaggaaaucuguuuuuccuaguuuuuuuuuuuuuuuaaacauagugucccuguugccuuaaauguaaaaaccuauuuugagaaacaaccccagucuaaaaguuauagcaauaaaagaacccuaaucuauuuuuguuucaagucuuuaccucaugacaaagucagaaggauaauugguaaguuuugcucuggguacuacugcaaaccgauguauccuuucuguguccucaauggaguauuauuuacagaccugaaggaaggugggcuuaaccccaaggcuaaguguaaauguuucuugaauugauucuuucugugguacaaguuaacaccuguguauaucauaucuguauauaucugaaccaaguuaugugcagagguugauaauaacuauauuuacaaaagaaauuuuuacaauuaaaguucacauuuuaacaugagccugugugcugugaucuuuuaccauguaguuuuugguaggaaggaaugccgauggccuagcccacggauagagcccaagggaucaaggcugcuuuuacucacagacacaaggacagacacuggggagcucuagcugguccugugagaggcugcaguuggauaaacacucuccacauaauggaaacuaaagucagagaaccaggaccuuguaccuuuaauccccacaggaagcuucuagacuuaagaaagaggauauuuuauuucagaaaucucuuaucagagcauuauauauugauaaauaugcacauuguauaucuauagggagaguuauuuuaaaccaguauaaagug

SEQ ID NO: 2936 - RNA, 1604 nt, Mus musculus
ugguaaaacguuuuacuguuaaggcgugagucacauauuuggaacuagcagcagcuguggguaggcagucauugaugauccucuugggaacaggaucaaagcagggagaccugggcuucacaaagucccuggaguuaacagguaacacaaaaauuuuaccaaguccuugucagaaacaugaggugaauucuaucuaaaaauaauugucucuugcuaucuuauuuuuuucauaauuuuaauggauauuucuuaugcauaccucuaaguuagucaccagauuuacccccuuccaagaacugagaaauucaaauuuuuauuuguaaauauucagagggaauucauuggcaauccuuacuuaccaaagccacagacaggcuuaagggcugcuuuccuacucacuuuuuccugcuuauuuuaauguagaaugccccccacccccaccccagcccuccagcuuaauaucuccaaacugcauauaugcaaggaaauaaauuaaugaucacuaucucgaccagccuguuauauaaauaaaguuaaaugcccaauggcaaccuuacaguccuuuugaucuugauuuguguguguauuugaaacacuugggauguccucugcuucacuuccugacuuggaggcaguuuucaccaagcucucgggauuauauaauauaugugcuccgcuccauaauggugacguucaaaaauucacaguggaauccuaguugggaaggcucuucaacccacgcgcaggugacagacuaagggaugcgcguccugcacccuacacuauggaucaagagcacccacauacagagaugcagagcugaagcccggaccaggccacggggcgcugaacccgugcgggccaccuuccagagcuccgggaccaagcaagugcgcugguguccgagcaggggcagguguggccaagcccagcgggcacccagagagccuccgcaccgcagaaagcggcagggcgggcaggcccggaggggagugcccgcagccugccccgccccucgcgccccggcuccgccucgccucgccaugguggagcagggagacgcggcgccgcugcugcgcugggccgagggccccgcggucucugugccgcaggaccccgcgcugcaagcuggaggauggguccggggcggcaguggggagggccgaguggccgcggaggcgccccgaaggcgggaacccgacgagccagcuccccccgaagugcugcugcagccggggcgccuagagcuaggcgacguagaggaggaccaggugguggccguguucguggucaccuucgauccucgcuccggugagagccacuuagggauggaaggauugggggggggcggugggggagacugcacacuggguuucgggggcgcgggggagggacucgcugcgcacgcacucgcacccacacaccugcaucccucccugcccgggggucccggggcacgggggcgcugugucuccagacuggagccgagggaucccgggggcuuuguuccgcccccugcuccgucccgccgccgcucucagcuccgcuccgccgccuagucgccgcucuccuauuugcuccgcuucagugcgggaggauugguu

SEQ ID NO: 2937 - RNA, 741 nt, Mus musculus
agugggcggaucaacgaugccaccuguggguaguuuuacgauuuugguuuuguuuuuuuguuguuugguuugguuuaguuugguuguugggguuuuuuguuuuguuuuguuuuuccugaucuccacccucgcuccgguaguggccccgcacuggcuaaccaaacucuggccagaacucuauucccagcccuaaauugaaauuauuugauguucccagccugggaaagggagugagguaggugaaauaaaacauauuugagccccuggaggaacuaaaaccgacacaagucuccuaaugcaguaagacugaagaauuaauugcugucaaaaccucggugaucuagauauguuaacauguuaagucaaaaaauucaagaaacacgugaggagcaaaauuuuuaacaucuuuauuaaguaccggucccaaacugugccuaaggcacaagagaaaugcgcccuuauauuauguauuuguauauauguuuucccuaaaacauuaaaaguuuaugaaauuccaaaacauuuugaagaaguguuaaaagucaaaacguugcuuuauuuuaaagcaaaguguaauuaagauuuuacuuuuauagaaagaaacugaucaguauuuuuuagauuuuuuuuuuucauuuuguguuucaauucuacaucuuuggcaguuauucuagauggaaaagcuuaaaagaaagaaagagagagagagagagagagagagagagagagagagagagagag

SEQ ID NO: 2938 - RNA, 13351 nt, Mus musculus
uaaaguagcagaguuuuuauuuacaauuuuaugucacaaauauuauauuuauuguguuuuucaaagcaggucuaugagguagguacaacuauccuuguuucacccaagaaaaacaaaacaaccgagagcagagaaaaugaaguggcuuauauucagcugguaaggagaccugaguugcuugacugcauagccuuaccuuugacuuuacuacuagagauuauuacccuuuugcuuuuucuuuuaaaacaagacacuaaguagagaaaguagauauagccugaagggugauauaguuguuauacacucuuauagcaaaauaaaucccuguggucuaaaacacagcagcaagcaaauaacugaaguucuuuuaauaagcuaaaaaugaugcuucaauaaccauggaaguuacccacuauuauacuagguaaagcuaugaggaaacaaagaggaaaacugagauaugagaacaaacuucaguucuacuggugucaaguagugagcuugaaaacuuccugagcaguccugacaauuucagugcuugguuggucaacaguggaaccaggagacacagugaaguuacuuugauugucagaagccaguagaggaacuaugacuuguuuuccuacaggaucaccaacagagaccaggagguagaguauuuccuucacuugugagccucucccuaacugaaaccuaucauuuauuucuaguauauuaagaagcacccuauauggggcauuccaguuuaacacuggguggcuggagcuacaucuggccaguggaauauaagugucaauggaagaaagcuaaaaguucacauaccugcauucaaagucccacuguauggcuuggacauuguuuuaaccuuuuuguuucugaauuucaucuguaaaaugauacugucacuuucuucuuggaaaaguuacaugagacaauaauaugauguguuuagcacaauacuugacucauccaauggacgaaggaggcucagucauuacuacacugauggccacugucucaguuguuucccuuuaacuuacuaacccgagagagcacugcuccuuugcuauauuugucuugcugcuacucccacuagucuucacagcacauaaugcaaagccugaaagaaaguaagaaagaugauccgacucucauuuccaugucaauauuuccaugccaaugaaugagcaggacaguacaaugucacugugcuaggcugagcuaacgaggggcauugggguaaucugaguagaugagaaacugauuuuaagaauuaaguggucucuuuugugaacaagggaaauuuucucaauaauuuucuuacccagcuauuaagcuuagcuuauauaacuugaugagcaauaaccaaucucccugaacagccucagaaacaauguguuugguguuugagguuguaugaguuaaucauccagucugagaauuguaguggaagugaucagugguuuucacacuggcccaucuuugaaaugcagccuucagagccaugcacacacuauuaacgggugagugaagacacaguacacaaguauaagaugcuaaagugcauauggccagggguauguacagaaggaaagcuuucuucaucacuccaguguaugaaguagcacuggcugcaggaugagcaggagcaaugcucugugacuuagaaaagagcccccccccaucuuaaaauacacuuucuguucuuaaaagcaugcacgagaaguauaaacaaucuacacacaauaccccuauagaaaaucaaagcauuugccauuucucuuucagccuuuuaaagcauauauauccuccuuacuuuugaaacauaauuuuuaaaaaauuggauacuaugacacauacuguuugacauguuuucuccuacuuuucuauguagucaucuuuccauuuaauauagaauaaaaucucaacgaacuugcagggcauuuuuaagccccaauauaaucacaucaaaaacagaaguuucaagaccccaaacuugaauuacaagucccuagagugucuuagugcuguuagcuucuacaggucuacucagugccgggugaagcugggagcagugagguuucucagcagauggggcugcaugugauuaggcuccagcagaucugacuggcuuggaaucggcugacaucacaaggaaggcagaagagucagccugagugaagugcugcugccuccgccucucagccuuucugagucacggagggcaggcagucuuuagcuccuggagacaauccugcagacgcacugcucuacuucugcagccuacacucaggaguggcuuuggcuuccaguugguuccuguacaggaugagauuuuuccaccuccaccuuguuuaaauuucacucaguuauacacauagccccucacaauguuuaaaauuaugaaagcugagaaaaugacaugagaguugcucaaacagaacaguguccuaucagaucuagguguaaucacaggaagaucuaguauguugaccaaugaucccaguggcagaaaaaguaggcagauagggaggacagcaacuccucugucucuggguaaggaugggguaaagcuaaggaacaaacguuacugucaggacagaaaggccguucagguauacaggaaucacuuuagaaagcaagaguccauaacacugagcagggauccggaacuucuuagaguccaacauaaucuaaacucucaaggcaaagaucaaacacauaggcugagcuggggagcaggggccggaggggcagcacggaacagacagaaugaggaauuucaaacacuaaacacagcaacaaacuucuggaaagcugcaggcugacuauggauggcuuauacaaaauuuaaaagaaaaaaagauauaaaaaacugaguuuauauacucuuuauugguaaauuacuaguaaauuuacaacaaaauuaacuaaauauauccagacucucuagggaggcaaagucgaagguaaaagaucuuugaaguagguacagcucaacgggagacggccugccuaacaugaccauagguuuaaucccgagcaccagagaaagaucuucauuuccacccuuaagcauauagaauaaacucugaaaaaaauaacacagagugguguggaaagaaggccuugacaccaggacaagaacuaugucaucuguaguuauacuucauucagguccuuagugcugauaaaaucucauaaaaauuacaggaaaacuaacaagaaacaagauaugaagguggguuaauucuacaacaguuuagaaugcuaaccaguguucagcagucuccuucaauucaggaucauuucccugucagcacuuacugguggcucuuccaugccaacacaacuaaagguacauacaggaacaccaaacagagucacuacuuaccuacagguguacagagauaugcaaaaacaucaguguuuacaacgaugacagacagacucuugacauaaggcucuaagguaaccaguggugaaacaccacagggcaagugugaagcagaaagggcuuuccagauguaugccuuggcccuggcacacauagggagccugagaauguauuacuuuguaccuuucuacagagaaaccacuccuaaaaaaaagcaagcaauugauaagugccaaaaugacaggcuuaauacacacacacacacacacacacuuaagauaugucaaucaagaaaaauauaaccacucauuucauauaaaaaauuuaauuuuuaucuuuaaacuauagacuauacaugauuugcaaaggagacuguaccaaacaaugaucaaagacgaaucauccguucuaugccuuuucuuuugucuggucacucagaaauauaauguuaucuggaaagaaaccaaaguguuaagagucacuuucagaaugcggucuucauuucauugauaauucccgucaacacagaaguccuuuagugguauuaaaaauuucaaaauaaguaacuuuuguuguguucauaagagguacacaagaggcaaucaauccaauagaacaggcugcaacugcuugcccaacaauucagacuucaauacaggaugagaccauuaagcucuccccagcaacaucguguaaacacuaguaagcccacccacacacaagaggaugaacacauuccacaucuacaugcugcaaccauguagcaaagccaggagccaccuuacaacuuagcaacuguaacauuauuugcuuuuaaaggaaauagauucaucuuaaagacugaauuucauauucuggcugggugguuguauugcauacucugaaucccagaauacaggaggcaagagaggcagauggaucucuaaguuuaaggccagccugaucuacagagcgaguucuaagacagccaggacuaagcagagaaacccugccucaaaaaaaaaaaaaaaaaaaaaaaaaaaggaaggaaaaaaaacagaauuucauacuuauuuuagggaaaaguuuuaaguauuacaaagcaagcguuuuuaaugcaaaaacaaaguagacauugcucugauuauuuccaagaaaauucgcuaaaaacaaccaaagauagagguuaaguagcauuucuuggauaacuccaaacauuuuauauguuuuaggaguaaugaucccaaaguguaaugaagucuaaacugguggcaagcaguugcagcauguucuauuggauugauugauugccucuugcggaccucucaugaauacaacaaaaguuacuuaacuacaaaauuaucuaaaagauaguuaauaguacaauuacuucaugacuguacaggacuagaauggaagccaagagugccaucuacugguguauuuuugcuuuaaaagucaaauauggcccccuaagugaaaaaguacuauacaaaaaaagagaaaaauggaaggagucaauauuaaaaaaaaaaaaaaaaagaaugaaaacaaaauaauaacaacagaaaauaauuuaggaugcuaaauauauuucuaaaccacucuauauuugcuguguuugcaaugugagaaagaggacuuacucuuuagauuauauuaauauacaauaaguuacagguaaacagaaaaaaucaaauagguuucuucaaacaucacugaaugcuauucagcuuuucugugaaccauagauacacagucaacugaccagaccaguaacaacuaugaaaaggaaaaaguaaacugaacgaugugaaauguuucucuaccuuaguuuguaaaaacucaacaauucaaauaauauaacugcccauagaucugacuuauaguggaacacaaauggagauuaaaaagaucuacauugguuuucaaagucaauauauuuucuuuuuuuuuaauuaauuaauuuauuuauuuauauaaguacacugucacugaaacaccaggagagggcaucagaucucauuacaggugguugugagccaccaugugggugcugggaauugaacucaggaccucuggaagagcagucagugcucuuacuugcugagccaucucuccagccccgucaauuuauuuucuaaaacuacuauuaggaaaauaagugauuauuucuuuaaaaaacauaauuuaccaauaugaacagugauuaagacauaaacauuggaacagagagaaaaggauuuuuaaaagguguauagauuauacuguggagucauucagagaagaguggagacaaugacaucuguuuucugaaguaaaaaaugccauaauaaucucaaccuggggggaaauaacaguguuacaaaaacaccuucucuuucagcgagacgagcugauauuuaugacuaaaauagagcaaugucacuuccaacugauccuggaagagaaagagcagccgaagaaccgauccagccaugagugggaagugaggaggcaaagcacacaagacaccauucucucuacucacagacuucagaaacagagcacucuauaggguaacaccucacuacagccuaucucaggaguucauacacacuaagaaauuucaguacuuuuuuuuucacuccuaucuauaaaacagguuucuaggcguuuauaacaaaaacaaaauaaguaaacugaggcuuaacucauaauuuucacaacauauucaagaaauaauaaaacaugucuaucucauuaaaagaugaauuuuaauagcauuuuaauuuucacauuaacauauuaaaaucuguuaagcagguacucuuaaaaaauggcauuaaauugguaaggcaucuauauuucauuaaucuacauauaauuugaguaaaaaaaagcauuuaaguuacagauacauaaacagcuauauuguuuuuagacaaaaguuuuuaaauuucaaaugaaggcuguugcaccuucacuuucaaaguuuugaauacaucacaaauuccuaccaucacaguucugcaacugcccgaguauacaccaagauucaauucuccaaguuaacaguauguacugcaggggcaaguugcuuucauaccccacagagucccccugaacuaaacaugugaguagacagagagccuuuuaaaggaauaaauaaauguggacaacauuagcacacaggaaaaggaacaggacgaaguccccuggggaguuuccugcagagcugccaucagggugcuuagaggccagcaaaagcggccuauacuacgccaacccuuccaaugaacaaccagagacacugugcaccacgagcuucuuaccagcuaugauuguuguugcuugccgccucacauuguuuuuauccauguacucgccauaguccacuuucccuuccacaaauauacgagcccugauauaaagaaaugcagucuuuagucuguagauucuaauccuggcuuucgaggugucaggacauggguagcaaguacaagcugaagaugaaauaacuguacuuugcuaaacaugucuucaauuucaaaacuaagaggacugaaacacaaugcaaucuaguuaagaaggacagcguuacccaggcacgguaguaucuucucauaauccaaugcacaggaagcuaagccagaggcccaccugggcaccucagugaggcccugccucaaaggaaaacuuuacauaaaguacaggagcuguaacucagugauagagcacucuccuagcauguacaaagcacuggguucaaucugucucucugucugccucucucucucucugucucucucucccucacacacauacacacgcacacucucucucuguugaccuuuuccuucaaauagcccauguuuaugugucuucauauauccauauauacauaaagaaaagguguguaauuauugcaaagaaauugaaauucuagucacugcuaaaauuauuucucaugaaauauuuuaguuccacaaauaaguauauuucuaaacauaaaaaguacauccacaaaaauucuuuuguuacucuauacauucagaaaagauacuuccaauauauaaucaaccuauguguuccaaaugggaauuacuaggucuaaaaaauuuauuaaauauaaaauaacuacugugaaagcuaccauaauaacuuagcacaucagacaucaaauaggccagauccucuaaagacauuaagugauugcucagaguccagguaugaccuccaugauccuugaucacagggacacaggauauccuacaaacgcuguagaugcuuugcaaaaggcaccugcagcuggagaaucaauggccacgcaguaucuugccucauuuauuucuauuuaaguacagaugcuguuuguccuaacuugucagcgggcuaaaaccagagacuuuccaugaacaggauauuaaggaauaaauacauacuaaugucagcacuucggagaaaggcagacaagagaacacuuguuaccgacccuuucucuaacuuaccccuuuuucacauacugauaugccacaucucugaggccuggucgaaacacugauauucugugccacgucgucuucugacuaacgucaccuaaaccaccagauacaggaaaugagguuauagaugccagcagguaacacaaaugccaacacagaacaugucucaggaaaacaagcuuucaauuucuauuaaaaaaaaaaaaaaaaaaaaaaagaacagaacuaauaaagccagacuaccuauaaguuaacauuuuuauaauuagguaagaaauaauaaguaaugucuacuuauuguugauaaauaacaacuagggccuuuuacacucacccauuugguauacuucacuauccccugaucgccacaucucauuuguugcuagagaaaauauugugacuggguuuuuuccuuccaccugucucaugacaggguccugaccuacucguccaaguaacugaacacgauucagagcugaaauacaaagaagagaggaaaugaaacugagaacagcugaugacuauguucuauagagccaugugcucuauguuuaugcauccugaaagcuugauucucugcacuuuaacuuccagugugacaguaucuggaggugaucucugugugggaaauuagguuuagaugagguuaugaaggugaagucuccgugagggaauuaguguccuuauaaggaaagaaaaaagaucagagucccaacuaccccacuacugccauccaaagacagaacugacagggcaauucucugcaaaccuguaaguugugccugacagguaacccagccaugcugacacacuggucuuagccuucaagaccagagaugugagccaucccuguucuauucauuauagucugcaggguaguuauacaggauaaacccacaccugaaacugacagacauguccagggaaugaacaacugcaaauacugcuucagcaguaaucucugcauuaugaaaaacucaagcucaagaucaacaaauaaaggaaaagucuguaggggagaaaggauaagaaagcagaaagcagaaagcagccccacagaacaaacuuuaugcucuuuaucuugagcuaaaaaagcaaaucuuagguuuaagaaaaucucuauuacaaaaagaaguauuucugugagucuucuuugaacccuguauaacacacucuugaagaacucaucagacaguggggcaggagggggugauauccacacuauaagcucuauuuacacuaaguuuucacagcuagaggugcaggguaaaauaaaccaaauguaggauggguugcauacugugaaaguaucuuuuauuugcuugaaguaacuguugucuccaaggauuacuuuuuauuugcccgaagaaaguguugucuccaaggcuugcuguaugcuaaccuaggccuccuccuggaagcuucuagccuuguacaaucuuaguucuacaauguuuucaaccucugaaacuugcugcugaauaagcucacucuuagucuuucugaacucuggccagcugguaaacucugcuguuauagcucaaauuccucuccaagcugacugauucaaccuggcuucucuuggccucucacugaauugcucugguuggccucauacuaacuuuagcaauaugcucuaaucuucuggcuccuucuguccucacaaccugucucucuauaaccaccccaguaaaacugccuccucucucugcauugacccucaggcaccuucccuuucuguucucaugagaguuggccauauccuauucugucaaaucuuucugauucacuuugucugcuagucaauuagacaucacuuucaaauaugggugcuuccuucuacaaacaaauuuuaccuucauuguuugggauuaaagggcagcucuguauuucaccuagagagauuaaagguaugugcuaaggcugagccacauugaaacuagaaacaguuuggguguuuguuuguuuguaucaguaaauaacacaaucucaggguucacagugugaucaaauauccugcaacccauggcugaacacaguccaccagauuauaguacuuugagaguauuagcaaagcacuguaaauaacauuguaaacucagacucugguacuuacaucguucaagaaccaaacugcuggcuacuucagacucaugucuuacaaacugacgaaauaccuaaaggagaacaaacacguaauaugguuuuaaacuuuuuagaaaagagaaaugccaauagaagaccuacucauauuuauucaccauuuaaucaacaguuccuacaaguuccagaaaaggacagcaaaggagaacagaguagaaaguagacuagaaagcaaucagugcuuuauagagcaacugaguaaacauaaaaagcaauugagugguaugauauuuaaacauacuguauauuaagcaucauucuaaauuguaggcaauaagaaaacuaguuaaacaguagcaaauauccauuacauuuguuguauaucuuuuucacauugaaauaagcacuauggauaaaaucuuacaaggucuauaauacauuuuuuuucugauugguuguucaaaaaccauaaggaaauggacaucucaaauguuuggccuagaauguuccaucuaagagugagcacugacaaugaagagcacugauuucgugaggcugcuacagaaggucagcagcuucuuagugagcuuggcgcaguggaaaccucauuccuugaggagaucacagaaaaggaguacaaauaauaugguucaaagguauggcaaugaaaucauaauuagugaagaagaaugcagcucuuaacacacuaaacaaauuacacuuuuaccauuuaauccuuaacuuuuguagacacaaagucaaauuacccuuaccauaguuccaaggaaaguuaagcccagagagucaccacuuguccaggaaacuaggaauucaguggugauuuaugccuuacaacuccgggcuguguggcaccaagcuuguuuuuccaauuugcccucugcugucuuacaggcauucuguucuaugguuaccacgcagguaagaagagucuacaucacuacacacaagagaguucagagagcuagacauguucuaagagagaaacauuucgcacguggcagcauuguuaauauagcaggcagggaucccccacacgggaaaaaaaaagggacuggcaggcaggccaaagaauucuuuuaggaccugcgggcacugcaggcuucaggcaguggcugagggugaugcuguuuuugucugucacucucacuguuagugaguuagagaguuagaacuucucacacucacuuucaaggacauucuaccauauaagaagggucauuucaacugguccgugagagcugcuguguucguaauuuccaguuaugcaacuucuccaugcaaaugaaggcagagacaggcuacaacucugaggugacagguuaccacauuaugauuucuaaaccuagcuuuuuaaaaauuccaauugggaccucuuuccuucccuggucuuuuaauaccggccuucucucuccauaccacucaaaugaacaccuuuuccuggagugauuuuagcuauauacuaucacuaagaauaaauauaagaauaagauguuacacgauacaggaccaaaaugcuacucaguuccuuugucacgaucacagaaaauacuaaugugacagauucagaagagccaguguucauuaaauguuauaaaauaacaauaugccucaucuuaggaacauacacauaaucuaguagaaaagaagaaauagggagaggauuauuucaauacccucaaaaugcaaacuuacuucccauuugguuuaaaaagauacuauaguauaacuucaauuuuaaaaggcucagaguauguguggauuacaguaaggagcuaaggauagaccaacuuaagaguaggauggggaagacaacagacuuuuauaacgaauuugacucauuagucuuaagaggagaagaaaaguaauagauuuuacauuaggagaauuuacaagacuugguacccacgugccacacugaggaaaaaugguaauuaaggccugcuuaaggcuggcuagaguagaggacacccgacuagauugcagaauggucaugaauuuguggcaagaagugagcucugcucucuggauagcaagaugggaguggggaggagaggggccagaaggucauaaaagaccagagccauaugggacaagguuagaagaaaucaggugcgauggggcaggccugaaauaccaucggugacaaaguagaagcaggaggaggaagguucuuggucaucucagccuaacagugagucucaagauagucuuaacuaugaguggcugucucaaaaacagcaaaacaaaaaugauaauaauaacuuacauaauuaaaugaauacucugaucuaagcacugguaacaaauauuuacuaaauuaaauucaugagguguacuacauaugcgaauacacuuuaaaaaucauuuuugauucaguaaacauuaugagcuucacacacacauaaacacacacacacacaaaaucccuucugaaucucccacaucaaauaaacacauagaacacgcuggauaggcguaagaaucucgugcuuauguaugcaaaaucgaaaagcaacaaaacaaaacauggcuauagacuauggaaacacgguuggagcacucacuaauguagaaaagugacuaccuguaacacaggucuucgaaacauggcuucuguuuuucuuacaaccuaaucuuuaggcuuuuccuaaaggaaagaaagaaaagagaaaaaugauaaaucaagaaacuacaguauccaucaagaacacacaugcucucuaguccuaaauccuaagcgcguccagcuucucgugcacccaauuugcaaccgcauuuuuugcacguguggggaguuccuuucuuuuugaaaacaaaaacugagcgagacaaaagaaacucugugguucugggucucaaccagcagaaaagaggggaaaaaccuguucucacuugcaauccauugucugcuagauuucuuuacaauagaaguugucucggacauuuuuuuuuccaacuuguucuguuauucuagaccccuaaaacugucucuacaaacagugcgggcacaguaaacgcuacuccgaaaggacgcaaaucagugccuucguccccguuagcgcugaguaagcccggcuccccagccucgccgcgggggcaagaggcugcucuucccccaaaguggcgcucgcgagcagcacagggaacggcgggggacacucggacuccagcgaggagccgcacaacuccucccgagccccgcacgcgcccgugcacucgggaaacacaacuucgugccagccuucuccccucccucaccggacacgcagagcccgaccgccagcggcucgcuuccggcgcacggagcccgcaaagcucgcgagaugcaaggaaagacaggaaaucucugaagugcgucguugaaaug

SEQ ID NO: 2939 - RNA, 1004 nt, Mus musculus
uuuaugaagcagagggucccuuagauccagguuucagaugaccacacucacaugggagcauggccacaaauguaugcuucagcuuguuguuacauacuaugagaauaaaugaaucaccaacaagguaugacauugaaaucacuacuccaauuauccuggcgauccugguuucugguaggaaacgacuggaugacaaaaucauaaaggaaagaaaguagaauaagaagaauaggagaaaggaagagaugauucucauggcucuuuugugggccucagcacucugaucucuggagucaauacuguauugcugcaucugcugugugugcuuccccagagagaggagcagcagaagguaggcaaccagggaaacaauuaaggaaggaaucuuccacagauucccaagaacaugcaucagauuauauuccugucgcuucagucugauguauucagucauauuuggugugucuuugcuucuagugagggcagaauagaucuuaaauucauucaucagagacaugguacugacacaggauaagagcagugcgccccacagcaucccaacaaccacucuagaagcucuccauuugagccagaggaaugaggggugggagaaacuggcuauuuucaggcaguagaaaacacugagacaggagauaagccaaauacugaagugguuuguaaauguccagaaaacaucaauuaguugcaucauuaucccugagucaugagucugguaagagaacacuauuauaagacuaucaauaaagauaauccacaacagaaagauccugaagagggccaagcugguaaugaugaaguuagacaaagaaaucuucuugcucuugaaccaauagcugcuauugauugacacaaugaaaccauucaccagauuuccaagaauaaacucagugauagucagaaccaggaacaccccuucaaugaauccaaacauauuagaauuuaggccacccugauccuugcuuguucuguucauaaaucucauc

SEQ ID NO: 2940 - RNA, 4695 nt, Mus musculus
agggugcugcauuccaaacuuucuguuuggagaguuuauuugaguuuagggaccauguaagcuccuucagucaauggcagaggcaaugagaugcggagggaaaagcagggcaucaugucaucuucuccuuagugguuuucucaauccaugguacauaugaguaaauguugguauagaugccaacguccccucccaugaaguguccaacuucaauucccuggagcuuguuuuuacaaaugacaguagcuacagcaaccuccugccagagaugggagaagaaggggugagggagagagaaaauuuaaaaauucaagccaaugaacaucagcaagaugugauuaaccagggauauaugaugcucuuuaauaacuaaaaauucuuuguaggaagauuaugacugaaaaaaagcaggugucauugcaacaaccuuacaaagucucaaguuacuuggaaauuaaaauguauuaugauuaaauagucaacuagacacauacaaauaaaugaaauuugaacauagacaaaaagauuaccccaaaaauucggcugaauacuuucacaaaucugacacauaaggaguuucuguggcugcuuccuuguugaguuuucuggcagucuuuguccgucaucacgggagcuuccagguucugccguaagucagggugccugccugaggggaacaacaucuggcuuaucccuaacccuuaccuccuauacuucaauggguaguacuuuguguaugcauaaaaaaauuagaaaggugagaaaggagaacaacucccccaaaguuuuguguuauugaguguuaacccugcagauuauccucauuucacaaaugaaguaccagguacacauaguuucauuuuaccagugugaaauagaccugugugcuuuggaaugcaauuuuccuucuacucuguaucuauaaaugaucugauucagguucuccaaaacuaucccuuacaugugaaaugcacauguacagggaguagggccaccaccuccuuaauguaaauggugucugugacuauaagggauguccuucaugcagucagauggcccaugagauccagcugcuggaauucugcagaggccacugaagguuuacuugacccccugacaguagaggagcacuggaauucuagacagcucucucuuagaccacuccuguagauccucccuuuagccauuuucuacuccaucccaccuuccagcucugaggacauggcuguuccucauuaagggugaagcugauggcuuuccuugcuguggaaggugugcuuaccauuguuuucuugacuccaguccaaaccugaaaguguacagacagugccuggccggacauuagugguggcuaugggaagaaccuggacuuugugguugaagguggcaggcuuagcuaguuuaauaagcaugaggucauccuguggggcuguguggcuguaguuccaguagcggauaaucuggaugggauaaauugucugcucugucccaucucugacucugcucuugaaauuucccaacaucacccucagauuucuggaggaagaagggauaggaagaaaccacuguuacuaucaccacuacauucccaccuauuacacccccacccauuaccaccaccaccaccaccaccacaucaucaucucaucaucaucacucacuaucaccacuaucccucaccuccaugauaucaucacucaccaccaucaucagcacucaucagcaucaucauuacucaucaucauuacucacaaucaucaguucaucaacaucaucaccaccaccaccauuuuggauauuagaugauacacugugcaagauacugcgacaagaacuguaucuggguuaccuuuuacugauaauacguuugugcaguagaucuuauguuaauucucacuuuacaaaugaagugcuggacacacucccacaguagugauuuacuuguagucagaguaaacaguggagucauuaucuacuguuuuugaauguagugcaugggagaggaaaauaaugaauguaaaaguaaaaguuaguauucaacccucuuugggccucauuuauccaaguggguaauuuccauucuaguggaugcaugagaguaaaaugaccagaguguuggauaacaagcccaccaacaacuccccuuuuccuccucccuuuuugauuuggaagaugaugugguuuaaaucaaugagcuuucuuuucuggcuucuaaucaauaggaaguucaagaaaguauuuggaggaagaagagugauguuggaguauuuaucuucccagaccuuuuccaggagguacugccauagacuuuuaaaagugccuuuuggcaaaagucacaguuccuaucacauagcaucuucauucagugauuguuccuauucuauuaaaaccauucuuuucucuuaggauaaggacggucacuguauuugcucaauauuucucuggugggacauggaacuaucucauacuauaaguuccuuuaaagaacaucucuuuucaauuuacucagcuuaugaauuugagucaccugcugaaccccuacuugacuagauguaaucacauuuccagggggaggaaaaaccuugaaaagcucauggggcagcaggggaagcauaguacaaaacagucugucaacagcagcaccgaguuuuaggugaagacaucuucuacggaaauuuacagcaucuuucuaggaugcuucccauuagaagcuaguagcacuauuccugauugugaaaauccaaaauaccuucagacauuucuaaacauaucauggggggaaaguuguccccaauugagaaucacugaucuaggaugaggagaaccuauuuggggaggggaugcucaauacucacgguaaauagcagugagauggggccagcacccagcuggcuuugaugaggacacccacgcagggauugaaguuagacuugagguaugcuaaguagggagcaugguccucuuucugcacagaugagugagugacuaaagcuguuccugagaaaacaauaucacacaaauaucagagcaaaugagacauucucaucuucccagcaguaaagaaguaugaaugauuuuaagggaguaaucaguugucugggggaaguaguuuuuccucuaauaaagauguaaauuaaaaugacauacuuuaagaaaaauaauggcaauauugguaauauucauuguaagaaaagguauaauauaaaugauauagucucugcucauaaauugauuuuauugucuuggaaagcaauuuagaaaugggcaucaagagcuauaacuaguucauaauugucgcuugaguauuccaacaauaggaauccauuuuaaagacauaaccagauguaggcaaagauaauugauaaguguauacauuuuuaguaauacauaauaguuguuaaacauuggaagcauaaaaaucuaauauauaauguuagauauugaaauaaaaaacacacaaguaaguagaacacaucaaaaauagugacacuugauuuaaaauuuucaaaaaguaaaaaaaaagcaguggaguguaauagagauguaggcugagacuagggcugucuucuaugcucuuacugguacuucugccaacuugcccacaucugggccuaugccuaaccucuguguaaccauacuuaaaaacuucaaagcagggaagauagauuauuaauaaaggcaaaagauuuugagcucuauaugaggugcuggguuaguuagauuucccaaagucaauccagcuaguaugugacaugggcugguggaaaauucuucaaucccaaauucauggaagcagagacugaaguaguagaaaccaucaaauuaagucuuuuguucuaaccuuuaccacuuccugcauuccaaguuaugguacagaggagaaaccagaagucaaacugggccuucugcucaugugaucacauuaggaucuuccccgaaagcaaugaggcucauauuucacaaucaccagagggcacucucauuguugaggguucuacagggcagguauaugccauaaucuauccaagagcuuaauacuuaggguauacuguuuguguuuagcccuuggaugggcucuaacugaagagacucagauucuacucauaucaguagauaugcauaaaucugcaagccaucaacccacuuauuucaccucacuauguuuagguuaacccacacuguaaugaacagaguacuaagucuuaaauacauaccagcuaggauggugagauagauaauaaguuucaugaugguccagcucuuuccuuucgagguauagaaagaagaucagcagaggccggaaucuucugcucacuugucuccugggggaugucuaccggagccagcagguuuggauagguaagggcucuaggcaaaaucagcagguggagaaaacuccagauaggaagacugagaaacaggagaguaugcuucuacugggacuuuucaaacaaagggaaagaaguuugauuugaugaacuucuuaguccaagucauccuauaugcuacucuccuaaaagcuccaugcacuauauagcuaguucaacuguuugggaagaggagcuccaggcucaagacucaccuuucuugcagaguuucugagcacagagcugugaggaacaggauucucuaccuuggcucagggagagcaugcccuuaaugguuugcucugaaccucccaauggucacuucaug

SEQ ID NO: 2941 - RNA, 438 nt, Mus musculus
aaugagcagcaguuaugaaagagaaaugaaaaccuacaucccccccccccaaaggggagaccuaaaagaaguucaaggaccccaaugcacccaagaggccuccuucggccuucuucuuguucuguucugaguaccuccccaaaaucaaaggcgagcauccuggcuuauccaugggugauguugcaaagaaacuaggagagauguggaacaacacuucaguggaugacaagcagcgcuaugagaagaaggcugcugagcugaaaaagaaguacgggaaggauagugaugccuacagagcuaaaggaaaaaggaaaacaugaugcagcaaaagaggggguggucaaggcugaaaaaagcaacaaaaagaaggaagaggaagaugaggaggaggaggaagaggaugaagaggaagaugaaaagaugaugaugauaaguaag

SEQ ID NO: 2942 - RNA, 1345 nt, Mus musculus
gggggagcaggugggagaaagaagagagaaaagagagaagaggggagaccaggagaguaaagaguagacaaaaggacagcauagcaaaaauagcuggauuuauaggggaagguagcuggggaaaaggcagcccauccccugggcuggagaaguuuagauuagagggucuguauucuggccauaucauauacuagguagggacuaaggaaugcugagugaagcuggcauccagguccacaaugacauguuaaauaagaacuucaguuagccauuugcuuugggauugaggcauaauaaacgccaguaccccaagccagcucuguccacuuguccucaguaagugaacuuaaacagccaaaccaguaaucuaaauaacuaacuaacuaacuaacuaaaucaaucaaucaaucaaucaauaaaaguagaaaagauuuuuucaguguaaacacauugguaacauggaaaaagauccagagauccaguaaacucccugugucagucuuggggguccugaagcaagauggaaguuuagagggccaaggauaagcaaucuagcucaaaguaugguccugcccugcauugacccauugccuaggcuuguuaaagcugugugaaaucucuuuccaggagauacauucccacucucgcuggugccuuuccuuucuuccauguuuuccuggggaaauuucucuuucuuuggggucacuuuuaucaauagccugcuguucagauugaaagacugucucuuuagaaugucuuuauuucugccaggucaguuauagaaaguggcauguuuuccuuuauucaggacaaaacucccauuuugauuuucugcuugcauuccuggagucagacagaugaguauucacugcauacagccucguauaacccugcaaccaccuccacauguucacuuaaauggagacauuuuacucucuugcaagagcuugaaacucaaacucagaucugugaaaacuauaaauccaguuuuccuuccaucccugcuccuggagugaugacccugagacuaauuaucaauaaaugccuagagcauaagcuccagcuaguucucugacuugcucucaacuuauuaugccuuuuauucuaacccagcuuuagcuacauggcugguuuccucuccuugucuucuuacuucagucuccucagcauuacagcucgaaucucuguucuauuucucaaguuccucuaccugcuggauuauguccuuuuccucaguguuccaggcgaaucucuacuuuuauucuaucuugagugacuaguuacuucugcucagcucccaugauucugaccuccuguguuuucaggcaaaucuuccaugcccucu

SEQ ID NO: 2943 - RNA, 17527 nt, Mus musculus
ggguggggcuugcuggcgucgggcggagccgugcgcaagcgcggcgcggugggaggcugggggagggaugcgggggcuggcgcggcccagcguuuguuuguuuuguggguggugcgugugcagcccgggaaaagcuggaaauggcggcgccgagcgggaggucgcaguccucccugcacaggaaggggcugauggcggcugacaggaggagcaggugaggagggcagaggaggggaggcggccaggcgagcggcgcggcuucuuggccuggugccgcguguacaggggcugcagcagccucccuuuguccagcgcagaggagucuaugagagcgaucuuguccgucccgcgcuacuucucgccugcggcaucucaccuuuuccagagaugcuccggcuuuuccuuccaguucuuagcugaggacuuaaacucauuucucuuuaaaaaccagagacuucgcagcucggccuugggcgcauuugacuuggauugacuaucucgugcccugcacugcuuucucauauaauagauguuugucagagaguuccacacagguuugggggauuugaauccuuugagaggauuagaugguucccguuucuccgccuccuccgucaguuucgaugaaaacauugcacaggacgacacaauuuuauuguuuccuguccagaccucuaacauuaauauagaaacgggaacucuuacaggacacggaaucaaagcguuagaaaccucucgguguucuuuuucuccauuccacuuuucaugggugcccuaaaauuccaggugacuggaaacuucgggaaaguucauauuuuaagccugguaguuugagauaaaaggaaguggcaggugugcggaguagguggagccucagauaaaacacggugacgacugcuucguuaaaaauucaagccugggacauaagaggauuuagaacuggagucaguaaauuguaccugaggaugcaauugucuagagaaaagcccccuccccuuuauuuuuuugcaaggguguccuagugcagggccagcauuuaaaggcuacaaggcuguaauccuggcauccugaugccugaggcaagagaaucagaaacugaaaaugaguuuggucuccuggucuaguccugucaaagagaaugagguguugggggagaggucaggugcccucuacaggaaaccggaacauggcuagccaacugaaacuggagagagcaguagaguggaagucgaggaaaugaagccgcuuaagaaauggaucuuccuaaugaccuaagaacucugcucuaccauucauuauauaccuaaugauaaacccagcuaacagcugcuguauucauuuuaauuuaaccaagguccuguauuuauccccauuacuguguugucuuguaaggugauucuuaacugagguuuuaaauucauguagagcaugaauuuuaaaaccucaguuaaaauucuagugaauuuugaaauagcagguacauucugaauauuuacucugcgucaauaccucuugcuaaugcaguuucucaggacccuauuuuuccaucuaacuguggccugaaaggacuuaaaggagccuuuauacaaggggcauucgaccagugcgugguauuucagugauugaaggugcuuacuugugcuccuauauuuuaccugcauugaaaucgggauucaucuaaaaaucucugauguauaaagucaacuguuacacugucacuccauugucaucagacuuaagcauuuuuucauacuaaauaagaucagggagauucauuggacacauaaaggauguauauuggaaaugguauucaccauucuugagcauaagcaggucucuuuacaaauuugagaggaaaaacuauggaaucuuuuaaauacauuuauugcugggaacuaaauuaccaagauaauuuaaccauugcuuacacuguccuugugauuacaauuuauaccguguucaccauuaguaucuaccuucuguggcuuucacucaguuucacuuacccauaccuuguaggauuuuugaucacuuuuuaguauuaguuuaucauggaaauguaagauauuuuugauauuuaugugagccaucuagagcaagugugugugucuuagagauauggguguuagcuuuagguuuuuauuacuuuauuccuguccuaagaucauuuucaacuuagguucgauuucuaagauaaaaaguaugucauguuuucugaacacuaaagcuugucugucagagaaguguuucuucucuuggauguguuugugcuucuuuauauuaauuugaccaaguuggcucuuugcucuccuaaucagaucauuaucucagauagucugaugcaaacauucucuagagaauuauaccuuauguccuuagggucagcauauuacugcauaguacauucugauguaaagagauuuaacaaaaugugccuugugugugcuuuuuauccacuucucuucuguguucaggcuuacgcuugaaagucccugugucugccuucuuucuguaggauuuuggcaguguguggaaugcauccugaccaccaggaaacacugaaaaagaaucgaguggugcuggccaagcagcugcugcugagcgagcuguuagaacaccuccuagagaaggacauuaucacuuuggaaaugagggagcucauccagguaucuggguggggaaggcuccaggaagauaaacuggucugaggcaggcuuggagaagggugugcugaggaagaggaaugcccuuguccggcuugagaguuugauagaaaaccuugucugugcauucucacucuguaaagaggaauugcaaagaugaaugagcacgcuacucuaggaaccucacguggaaaaauagcauuacagcuagauaaauauaauuuaguauuguuuuccuguuccuuaggccaaagggggcaguuucagccagaauguggaacuccucaaccugcugccaaagagaggaccccaggcuuuugaugccuucugugaagcccugcgggagaccaggcagggucacuuggaagacuuacugcucacaacccucucagauauucagcacguacucccaccgguaugaagcccuaggacuguagccugggguggguuaguuuguccagaaaauauauagagcaaggggugugggaaagagaaacuugauuuuaguuaagacagaaccaucucucugaggucauggugagucuuuugauuucuuucaguugagcugugacuaugacacaagucucccuuucucggugugugaguccugcccuccucacaagcagcuccgccuauccacaggugagaaugaaaaggacaaaaggaaccucccacguugacuuaaccugcuuuuccacuaguaucugacuuuucccuaaaagugagacgaauuucacgacaggaacagggccuuaugaauuuugacaggcaagcaagauugguuugguuagagggauauaaauuggauccauucccuuccaucauauguaguauucuucaaaauaauuggcuuuuuuuguguaccuuauggagauggaaaaugcaauuuacuguguaugauuugaguugccuucucuguaaagccaaacaagaaaagcagggauguagauucagggcucccugucugcagugaggugacuagaaccaggcuugucucagaagcacuuucuaccacucagcaaguugaguaucuacuguuugaagccaugggggggggggggggcgggggcuagugaugaacagaagccaacagggucugugcaagcguugagcuuacauguuagaggaaauaaacguuaaagccuacauuuaaagugugcccuacaguuaaaaugacuaauuaaugaaguuacaggagcagugcugaaauguguacuaacuuuuggcauucucccacagaugcuacggaacacuccuuagauaauggugaugguccucccugucuucuggugaagccaugcacuccugaguuuuaccaggcacacuaccagcuggugaguuuacauaauuucaagaagagaggaggggacugagaggcuuuccuggucuucugaguguuuugcugcuuuugcccuugugagaaugucaucgaugacugaugccuucuguggcuucuccuuguuaccuagugugauuuaaaaaaaaaaaaauacaggagguuggauuuggggaguugucugccuuugggauguggguuauuauuugggguguguuuugaaauuuuugaucuuguaggguaacgacauugccugucaucaagaagcuccuggucuaauuggccuccuccuucuaggccuauagguugcaaucucagccccguggcuuggcacuggugcugagcaaugugcacuucacuggagagaaagaccuggaauuccgcucuggaggggauguggaccacacuacucuagucacccucuucaagcuuuugggcuacaauguccaugugcuacaugaccagaccgcacagguacucgaggcuggaaaggcugacauguauauugggugggcugcacuugggggcugagugcuucuguuccucuuguuccugcuggauguuucucacuguugugcugcuuccugcgaucuaguaaaaggaacuagggccagccaguuucugaacauugcugucucaggguaacugagauuucauggaguuagaauaguacagggaggcuuggguucccacauguauguguuaagaaaccugacucccggucacucaggaagugaggagacaccgagauccauccagacaaacuccagaaggguauuuauaaaucaggcuaugcagggauuuacuuuauaguugauacgauuacuugagaccaguuauuguuuaaaucauuacuucugcuagauucaguagauugcaaguagaaaaauacauguaaauccuauucagagacagacuaagucaguguugaauuguuuuaggcuagguugcuccuguacagucacacguaagcaguuaguuaugaguuguccuuacugacuuguuuuugaguaucacugguggaucaagaccagccuccuuuacauaguaauuugaagggcagcccaggcuacaugagaccuugucuuuuauaaacagaugaguaaauaaauucccuuuguucccuugcaguagaggaucgugguuuuguguugaaaguuuauucuggucaucuuggcugucccacuucuaucuuggguguggucaguuucauaaagugugugccucagugcuguuccugacauggugcucuucccagcuugcccauaauugcccauuuaaaauccaucuguucuugcuucaaagccauggcugggguugaaguuguggcuuggugguuacacaguauaugcaaagccuugaauauaaucuccuccaaggaaaguggggggaggcauagcaagaccaaacuuuuccaucaucaaggggauugaaguauuuagcuuguccuccucaguaacuguugagggaacuggagggucaccuaacaagcuuugugcuauguuugguuuccaaggguauggucugucuuuuccuuauauuuuucuaggaaacuauucuguuaugguuuucuaaauguauguuguugacagugaaucuuagaugccugauaaaggauuccauucuguuucacuaauagaguggaauacugcugguuuuucauuuuauuuuguuuuguuucugaaauauucaggaaacuugaugaauccuuuauauaggccauuuccauuuuggcuguauuuaaggcagagucaaggacuacugaauucucacucccaaguuguacugucacauggguugcagugaaacuaaauuuugagcaccuuguaauuucaggacuguuaaaacacacacacaaauuuaauuuaaugugguucagaauucaaggauagauguggggggagcuuuuaacauuaguucaucccccuauauuacuaauagagcuggagcuucuauucuuacaagagcugagaguauaaauaacuugaguagaugaggucagaagaguaagugcaguggguggaacucacagaggcagucuaagcagagggagcaguguauagauaagauggacauuccuaagccagguguuugcugugaauacaggacuuugcuacagugggaauacagugcagaauucucuuuuccuguuggacuuaucuaaaaagacuacuuuuuaaacauacaguauguggcaaacagaaacacaaccaagaaaucuaagauccuccuuuguaucauuauuauucguuuugacuaguaauucccuugaaguaaaaaaaauaguauaacuaauuauggagauuccucccccccccccauuggugcugaagagaacacuaacuaguguucuuaccacuuaguuauguauucagggucugucaucaaauaugcauuguaucuaccuugagagguaacuugacucuugaaucauaguuuagcacauuuggaaguagagauguguucuaaggugguaaaucucauccucaccacaugcuguuguuuuuaauuugcauuuggguuacagacaacugggagacuguaaggacauucugugggucaucccuggaaaauauagcuaucuauacagcuuugcauuuaucuguagaugauauaccauucauauagccuccaguccccagcuaaagaauaaccaagagcuauaaacacugcuauuuauauaaguacuauacuuuuauaaucaaucaaucaaucaaucugcagcuccuauuuuaagcuaugucauguauggaaaaaaaaauccacccaaauaaguaaucuacauuuguuaaaugauuucucuuuauucagugacaaaguauguauguucucuuagcuuaauaguccuccuuuuuacugauauaauaagcugcaaguuuaacauggccagggguguguguguguguguguauguguauguguguguguguuaauuuuuauuccauucuucaagcgaaauuaacuuuuaacugucucuagaauacucacagcuauucauucucuucaaauaaauucauaguauuuauaacaaauacuauguuauagguugcuucugcuuacccaaaaaauaugucuccuuucucaccaaaaccaguuucaccauuuccaguuauuacaaggguauacaagcagaaguauccgagcaggccagguaugaucaugaguguuggugauccuauaccagcuuaggacacuaaggcagaagaagcacuugagaggucaaggccaguauggguuuuauaauaaguucuggcuuagccugagcuauguaguuugucccugucucuaaacaaacaaacaaacaaacaaaaaacaaagaacaaauaaauuuuaaaaugucagauuuagggggaggguuuauuacaguaaugugcugaagcucagcuuuucacauauugacaaguuaggcgccuuuaaaagcuccagaacauugacaagugagcagccuguugagaguggagaggaugguaaaugugagucuugugugcugugacuauucugccuauagcaaauucauguucauuuuauuucuuuaaaauuuguaauaagaugaacuagcauaaugaugggcucuuuucuuucuguccacugcaaguggaaggaaggcuugaacugggccucuucaguugcaaagggaggaccuaggucuaaaaacuguaauggauacuauguaguuuucuuucaaaaaaccaaauucugaacuugcugguaucuguauaguuaaucaaugaagauaaaauucuuaagucgcaccccagguugagcaauaauaaauuucuuuaaaccaauacuguaauuauuacucuaucagacauguuuauuauaauaauggaggaucuuugaaguaugugauuagauuuacggugauucuuucuuugcaauauuccacuuaacugucacaaacuaagagacaauuuacuuguaaugauuuucucauaaagagaaaaguggauguuagagggaaaguuaaaaucuuuuguuguaauauaugaauuggguuucccaacuaaauggaucugaucucagauccauauguaaagucuucccuauauggaggaucaucacagcugcuucucaugagcaauggaucuugugcagacaucauuguggcacacuuagaaucagacagauacuagauaaguccugcuguucuccagucuugagacuagauccugugucagagcagucuaugcucuuauagcugagaaaguucugucuccuuauguacaaaugggcugagggcuugggaaugagucauaguuggcacacucaggguaacuucauguuuguuuguuuucuuaacauguauuuauguguguugacauguguuuaggggugugugugugugugugugugugugugugugugugugugugugcgcgcgcgcgcaugcauguguguauguagagucccuaggguugauguuaggacuuugcuuucuaccuuacuuguugaagcaaggucucccaguugaacccagagcuugcuggugugauuaguguagcuaucgagccagcuugcucuaggaguuccucugucucugccuuccagguguuagcauuauagucacaguccugugcucacccaguauuacucaaguacacuuuacccacugagcuguccccacacacacacaccauguggcuuauuugggaacucacuuuaauacaggaguucuuaaucacuucaaugaacucgggacuccauauucagaguuugaugucugaagucauuugcauuuuucuugugaauauauaguuuucuuuagccuuucagagaguuuauguguuaccaaugaucacaggaaaauggaggaaaauaccuuuaucuuccaguagauuggguuucauugaagcaaggcagagauuaauucaaacaucagagguugaugcuggcuacagugaacaauacuagcaggugucucugucuucuaggaaaugcaagagaaacuucagaauuuugcacaguuaccugcacaccgggucacagacuccugcguaguggcacuccucucacaugguguggaagguggcaucuaugguguagauggcaaacugcuucagguguguauaauuuuguguccuaucuguacaccuguauuagcuacuuuuuccuugcugugaccaaauaccuggcaggaagcuucugaaaggaagaguaacuuuggcuuacggcuugaaggcacacaguccguuguggcaguggggacuuaaggugguuuguucagccaugucaucugaaguuuugauacugcugaacauagaauaucuucauuguuuucagggguaguuaauuuuuuuuuauaaucaucaaugcuaagaacacugauuaauaugaauacauagcauaaaauggcagauguauguuuugaacuguuucagaaauuguuggaaaagcaaucccaaaccaaaauccauucaauaauuuuuuuaugaaacucaauuuagcaauucaaaaagcaauuuuuaagaccaaacuuucuaacaguacaguccaaaaauuccaaucuuauaugucuaugcuaacaaaugcugauagaaaaguauuaaaaguguguuuucuauaauuagaccauuagcuucgcuaaagacaaaacucuuuguccaauaaagacacuauaggaaucuaagcuaaguauuuaagccugcuuuacuggaacaugcagugccaaguacacauguuacauguucauaacuaaggcugaaaugaagccacacaauagaacaagcacaggagcauuucagauucauuaugcauuugauuuuaaauaagacaccugaacagaucaccuuuaaacauagccugucccugguucucuuuaagacuuaaugggcaucucauagugaaaaauauauuucuaagaaucuucuaaguuuuagcuguuucaacacugaucaaaaguauaaauuuaaaguauuaugagucuggcguuaaaaccuguaacagagaaccaguuacacucaauauacgguggcagaguacacauuucuguuccagaaaguaagcaaugggacaaaugaaguggacagaaacugcccugaagccccugagugaaugacaaacccagcucagcaucugggguucuucauugcagcguuugcuccagcuaacaugaaaaucuugcuccuugcagcuuggcauguggcuuauguggccucuuugcuucacuuggugccaacagcuuuccguaucuggggucccauguaucugguuucuccauauaugaugucuuuguuuacaucuuagcagucacuuucuguuuuacccacucaggaguucuauacagggauccagccuuacugaggcuacacauugccuggccucuuggcuuucuggagccuugguguaagucucugauucuaccuccuucucugcugccagcuugagauguagcccggcuacagcagccucuggcuuuagcugacccucggaaaauacuucccuggguagccuguauccaggcgacaccuaaagauuauuuuuucaggcacucuguuauuauuuuuuaggacacaccuaaagauuauuuuucagguacucuguuuuauggaaauuuguacccucaacccuguaacucuugauugggaucuuuuccccuaguuucccucuuucccauuguccaauguagaguucaauuuuugccuuaauggcugugauagaacucucucccaugaugucugggacugggcucuaguuauccucaaggacaaguuuccuagagccuuugacaccugagagucugaggcauucugguaaauaauaaagaauuucuacccuguccuucauuuuaaccaagcucaagggccuuucuucaugaaagugcauuuuuauaucuuuaugcuguacacuucacucacuguaaugguggguaaguuuagugagcaauaggucacuauggugacccaugucacacagccugaauguuaugguaaaauauacucugcuaaauaaauuaguccauuauuuaaauucaaccucaaguuuucagaauauagacgacugcguccaauuccucaccaaaguaggacacaagcugaguucucauuaaaguccuugaucuguucuaggaucuauugagccuagccugugucuucauuuuucuuaauuaacacuugggugucuugaaaacccacuaaaauugccccugaagcccugcuuagagcauucugggcuuuuuagccugcagcuucuaauucucccauauuccuccaacaaacuaguuccaauggccuaugaaccauguggaaagauuauggcuguauugaccccaaacuggcauaaguuuucaguauugguuuucuuggacugagaccaaaaauucuuaacgagaaacaguuuguuuuggcuccuuguuugacaauauaagcccccguggcaagaagccagcucuccaguggagacaggagcaguaggcuucuuguauuuggguaaauuguguagcauaaaagaagagaugcuggcaugucuggcuuucuuugccccaacccuuucagucuggguuccaggucuuuccuccucaguuaauucuuucuggaaauucaauacccucaaaaauaaacuaaguguaucucccaagugacuguaaaucuaguccaguugacaagaucagcuaucucccuaccuuucagaugaagguugaauuuguauguguuagacuucaagaggucucacuggcuaccuaacuuccccucucccuuauuuguuucugguagcuccaagagguuuuucgacuuuuugacaaugcuaacuguccaagucuacagaacaagccaaaaauguucuucauccaagcaugucguggaggugagugcccuggcaaaccagcaccugggugguggcuccugggcagccuccaccagcucucacuuuccuguuugcuccucucaggugcuauuggaucccuugggcaccuccuucuguucacugcugccaccgccucucuugcucuguaagugucucccaaugcauggggugugcuaggacuugggcagcccauggcucucagucugaccagcucucuacaccuccauggcugucaggaaucucuuaucagugugugcucuuuuccuaagaacuuggcucuucucugcuuauuaacugcaauguacuuuuuauuguuuuucauuccaguuaaggauuucugcuugacucuuccaaaucuuccuucucuuacccuugcauuuucucucugugccauguucacgcucccaugcgcuugccuccuuucuuuaccauucuuggagcaugcaggagaacaguacagaccucaugucugcaucaugucugccucggacucuccugagcugcuucgauccucuugcaugcagugucuucuaccccuuuaagagccaggccuguguaacauggcucagaagacacauaggccuccuucucaucuagaggaaaacaguaguaauuaagaaucuaaauuuggaaucagauugugacucuacugcuuaauaauuauguaaaguuagagaagucgcaucacaucccucuacuuuauuuccuucuuauaaacuguguguagucaacuucuuuaagcuguugugaugauuaucaaaauuggcaccuaagagcuuucaggguaaauguggaaagaaagccagucacagcugcuacaaccuggucagcauccucccuggguuaaaguuuguauuauccaaacaugcaggucccuaauguuucccuguguaucacugcagaguguauuuuaaagucuugcaaugacuguaaauuccaucacagaagcagaaggaaaugucuagcuaguauauggauuacuagggaaguuaaagcaaguguguguggagcaucuugaguuuaaaucucaugccaggaugaaauuugugugauagcaacuguacaaguaagaguaugcagcaaugaggugaucuugucugaggcucauuugacaaggcuuuuguagcugcagaaagacuuaacuuaaaccgugcauacaugcuuuauacaggugugaagagagccuuucccagaaaagggauggaacacaugacaaacacaacauuauaaaauuuaucuucuaaguguauagugugccaccauuuagcauuauccacccaccccaacuauauaauauauuugccgugcucaaauauacaaggcuaagcaccucuauaagugaugaagugagauguggcugaucguaagcuguuaaucuagcuaauuacaaaccuuuagucauagcugagauuuugagcuuuaacggauaauacuuugugagcuuaacuaugaaauuaauauggugcauuuuuccaggaacguuaccguggaaggggagcugcgcuaagaaaagaacaugugagggagggcaagcauuuuucauucauagauguuucucuaggcccagagcacugcuguacacacacaguagcacuuagaaguuuugagugaaagaggaauuguaugucuagaaaugggcagugauguagaaagcaguugugaagagaagguggagaauguuuauugauuaauaugccugaaacuugaaggcaagagguaagcucuccaucgcuuaaaggacauccuuagccuggucuagauggcaguaacaacaaugcagaccauuuucuuccuaucucagaaguguauguagugcuggaguuggaggaagaaauugcucuuuuucuggaguaauuuuuguugcacuuaauccagugucuaaaaucaggcccauuaaaguaugacaugaagcugaggcuucucuaaaaguucgaguuugccagucuuuccaaaauacaaugauugacucccaagcuagaaggauaagcucaauaagaacauaguguuuaacucagugugccccuagaucuuaguaagagacagugccugauagguacaugaacaauacuuuaagaaaaaaaaaauuugccgggcgugguggcacacgccuuuaaucccagcacuugagaggcagaggcaggcggauuucugaguuugaggccagccuggucuagagagugaguuccaggacagccaggacuacagagagacccugucugggggggugauugagucagugaaucuugguccuuuucccaaaauucuucaggcuuugguuugucuugcaugcagggcguccugugaaaaggugaucuuggguuugaugugcugaccuguugauguucacgcugucaaacauauguaacaaacauaugccugcuauguccuuccuaacucuaaaauaaacagcagcuuguucauuuuuuaggagaaaguacucaaauuuguuuuucuaauuuuaaguucuuccauuuuugaacuucucuaaguuugucuacaaacuuaguaagcaaguaagaaaaguuuuagaaguuugaaaaacacugugagaaccucugaucacaccuacucucauuuuuuuaaacugauaacauaguuuaagguuguaauuuuaauauagaauaugaauaguaagcagacuuguuuuuuucuucuaggacuaaauaccacaauuuauugucuaauacggggggaguguaauuucuguacauuaugcuaacugaacaaguuaaugcgacuguccuaacugcauuugcacuuaaugcugaauaggaauauagguacaugggccuggccuuuagaaguuaccccuccagcaaugauacauguuuagaaaguaauaacuuuuuaauuuuuuuuuuuaauuuuauagcuacagguuggaggcaacagcuaaaaauggcucuucagucgcaauuguagggacuuugacagaucuauaaaagauggaagaaaguaacauuuuugucucuucuguuggucuuuuugcagaugagacagauagaggugucgaccagcaagauggaaagaaccacacacaauccccuggaugugaggagagugaugcuggcaaagaggaguugaugaagaugagacugccuacucgcucagacaugauauguggcuaugcuugccuuaaagguaagagugcaaaagguuagacuguccuggaugugggguuuauuuccuuuuguuuugucuucauacugaagucuacuucauacuagagaggguagaaaaaggacuagaagucugacuuugugaagcuugcccaugaccuucacaccucugguuguagguaaugcugccaugcggaacaccaaacgggguuccugguacauugaggcccucacucagguguucucugaaagagcuugugacaugcacguggccgacaugcuuguuaagguaaguccguuccagcugccuccacaagccuuugcgucuccauacuguugccuucuugccuugcacacuuuuuucaucuacccuuuugguuggccuguacauggaagcacaaagugaucucggacuuuggaccauugguucugccuucccaggugaaugcccuuaucaaggagcgugaaggcuaugccccuggcacagaauuccaccgaugcaaggagaugucugaguacuguaguacucugugccagcaacucuaccuguucccaggcuacccacccacgugaugccgccugcuauuccugcuguuggaggccacuggaccacugggggcacaauggagacuucucuucagaaugguuuuuguucugucuacccucucagggauaugagauucucccaggcuuguuuccugucagccaucucugucuuuggguaugaaacauaaggauggcuccuccggugucguguucucuaccuauagagccagcucugaauggauguguuaccagaagcauuuuagcuacagccuagaaaaugacauugugaacacaguauuauugugggaagagggcauuuggauuucucaauguuugugauauuuuuguucccaaggcaucuuaggaguacuuggaucauagcuuuuuuuuuuuuuccuaaaucaguuaaggagucucagagaucaucuccuuuuuuuuccauaucuacaaccucauuuuucccacaguggagauuuggaagaugucccaauuuaauguagguguuuucaucugucaugaagggacagaugagauccuacuacuugcgaaguuucuaugcauaccuuuaaguucaggcccuaggugaaggacagucccucagccuuuccauugguuccuuuguguucagugcacccagccuuugaacagagccuagggucuguaugccaugacacuggaagucauagaaauuucccuggucaugcuuuguuugaacugucacugaaugaaccuuaucgggcauaacuacaugaaaaugcagugacagcugagugugcugugucucacacuaucacccgucaucaggaugucucuccuuccuuacuguggcuucugcaugcacuuacacuguacuugacggcuggccuccagggucucucuugcuuuguacugguuccccucuuuaccuucaccauucgcugcuucugccaagucugugaagccguccuuuguaggauguuucuugccacuuacgcuguacuguaguugcuuauucuuucugccuucugcuucagcgugaggcuucuuugguuuucuguggcagcgucucccuucucauuguuucucuguguuuuaguggggauaguaccauaugugauauaaccuagaagcacuugucucugcucuuaugaaacuugcuuauucuugaaaaccuucugcauuuccauuuuuuccucucuuccaauuuauucuccauguaacagaguaguuugguuuuuaaaauaucuggugaugucauucucuugcuuagaacacuagcuuccuguuacgcuucaucuaaaaugcaaauucuuacacccagcuuacgagaucuggcucauaccuucccuuuggaucucauuaaauggugauuucucacuaugcuccagccccucuuagguccucaucuccgucuugcagguguucugaacucuccuuuggcuagucucugauuuuugagucuggcggaggccucuugaccaugcugcccaugcugucuacugugccuccuuaugagggcaucauguuggucucuguugugcuuacugcaggcuguaauggcacuuuugcuuguuucacuuguucccucugaggcugaaugcuccaagagagugggaacugugcuucuuacuuacugauauccaguaacuggcacuuacuaggucuucaugaauguuuccugaguaaaggaaggagaccagcagcuaaccuuaguuagagccuaccuuuugcaguuucuaaauugcuauuauaguguacaguucaauuaguauauggguuuuuuuuuccagguguuuuauuuuuauccacuguuuuguuguuguuuuuuuauauuuucuacauaucacgugugagacaacuucuuucacaucuccauagugcccagcaaauuugaggccuaugguaguugaggugcucaacuaauguuuguuguaugaaccaagugguuugaagacuugcugccaaauucugccuuuugggucaguauaggaugcauaagugguagaaucuucacacuucccacugccaagauuuuguauugccaucaggugccaaauaaauguugauacuuauuacugauu

SEQ ID NO: 2944 - RNA, 29074 nt, Mus musculus
caaaagcagaggcuuaaggagcuacuugggggagacuaggagcaagcaggccaaggccuggcuggggcuuggggggagaacacauggagcggucccagucccagcggcauggaggggaacagagcugguggggcagugccccccaguaccaguacaugcccuuugaacauuguaccagcuacggacugcccucagagaaugggggccuucagcaccggccccgaaaggacaugggucccaggcacaaugcccacccaacacagguaauguccuggggagggaaggggagcagcgguugucuggggccaaggauuagugaaaauggauuguuaugugagaaggggguacagaauuuauuuugaaaauuaaaugguaaauauauucaguauaugaaagccuuuuaaagaucugagcuuaguguguuugcuuaagaguugcaugcacuuuuacauagccuuuacuaacaauauucaaaccauguggggaaccagcaaagccacacuuaaaugaagagugcaagcuuauguucuuacauaaccagagugguuuuuguaagagcugaaaaugcuauaaggaccuccucuaccuucacccacaugcaggcaacaugggcuuucucuacacaacccccuguagaaugcaugugcgcgugugugcaaacacacacagauaaacacacuuucacaaaagacagaagaaaggcauuggggacaagcagaggaaacaaagugaaugauuuaucaacaaucaaugaccaguaucaauaaacacagaauugggauccaguuuuuaagggcuuggagguagaauucuggugcagcauuggccuagcuugagaucuguguguuuuguuuguuugcugggagguguaauuguuaaaaagggccaacaaaaugauucaguaaguaaaacuguuugccucuaagccuaacaacuuaaguuugaucucugggccccaugugauggaagggaaaaaaaucuacugcagacuguucucugaccuagacacacacacacacacacacacacacacaccccuaaggaaaguacagagcuaugaccaaagguaauuacucuccagagcuuggggaucagugguauaugggcaacuagaacagaaauaggugugggcacaagauaaggagguugccuugggaauuuuacaggccacuauuaacauaagugaauguaccucuuagcugcagagaaugcagaauggaagagaauagaaggagucugagauagagaucagacuuagaaguuuugcugacagggugucaggcucagaaccuggaggugggcuguauagauggugucagcacaagggucaugaggaucucugagcaguugcucaugaguaccgguagguacacaguggggagggaaauguguugagcaggauauaaaugucagagacagcucauccucaccccaguacuggucauuucuggagaaggcuggaugaccacgugagaaaaggugcuaucagagcacuuuuucuuuucuuuucuuuucuguugguuuuucaagacagggcuucucuguguuuccuugccuguccuggaacuagcucagucagucagguugaccuagagcucacagagauccaccuggcuuugccuccagagugcugggaauaaagguaugcaccacugcccagcuaguuagagcacuuucuggugacaggacccuuggccaaaggaagaauagcaaguuuaguuugggaguagaguucaucgagauucuaacccaccuugaaagcaagcagguuaguaauguguuuuccuuucgucuaauguuuaugagggaaauacuacacuuacacagaaacuagagugguguagagcucccaggauacagcagucaucagcauuuugucaagaugguucuguccccaaucccuaccucauuuguagauagagacucucaaagcauuuugucaaaguaguuuugucuccccuucccaccucaauucugacauucgaacuagaggacucacgacacuuugcagacauuucaucacuuguacauuuggcguacauuugggcuuugauuucucccucccuaaaccugucauaaugugcugguuacugcugggcuagcagaauacaucugacucuuaacaguguucucccugcuugaguguuuguucgaagggaccaagcacacuguuuccucauuucucccagucuacaagucagagugcuaagagaaccccaagaguugaucuucaagggaaacauuuucuggcuuuguuuguuuguguuugagaauggaucuuaguaagcuguuucucuagcuggcuuggaacucucuauguagaccauguuggcuucagauucacagagaucugccagccccuaccuccugagugcuaggacuaaagguguacaccaccaugcacagcuaggaguauuuucuaucucuggguuacugguagaguuugaagagaaaugauuuccacaggagcaagauaguuaguaugugccugcuccucauauugugaaauaagaucucuucuacccaggcugucccagaaucauggccugggcugacccuggccccggaggaugaguuaguauagaguguguugggccaucaugaagugacuagcauucuucuacauccuucacagacacaaaugcuaacauagggauagaucuggccucuucgcuuguugguaggacccaguuaccucacauugggaaguaaauuaacuugcauucuugaacccaguuccuguuugugucuauaagcucuggaaugugagauggaugggcuuuguacaacuuuaguaaggaagcugagugucucaaagcagacaagcauacgaaggcaaaacacaugcagacaccaucuagcacuauaaauauauaacuauguuuacuauauaguuauauuacuauauaguuauaaaauauauaauuagcuagguuacuguggcccucuuugucuuaguugggauccugagaugguaagucaaugcaggggugacagggaaauagagagacauguaggacacaggguaauacaggaaaugccugucugguauggaugaguaauuuccacacaggucucaguaccucuacuuccaaguagaagauaaguuucuugaaaaaaaagcuacuauggaccaagacaugucuggauugggagaaauggugaaacagaagcaggcauggaaaaucaauggaaaacagaaaugugugaauggacaggagaguguugagagaggggaagaccauaaaguacucuguaugcaaacuucaacaucauacaggauucaaaacagcucuccuuuucucuguaaaucugagucuauguaaugccuucuguauucuuuuugacucuucaacaagauagacacugaccguucuuuauucauucagauauauggccaucaaaaagaacaauauucauauaaggcacaggacgggggaaugcccaagaagaugggcuccaguucuaccauggacagcuuggaugaggaccacuauucuaaaugucaaggugauggggacugaggaauaaaggaaucuggaauaggagauacagggauugagagaauaaccuagaugccccauuacacaucucccaacacauaugugugugugugcauguucacacacacaugcacacauagagauauauuuuguuuggcuucuuucccagccauaagaaacaagaguuuuacaugaacauuguauuuacaagggcauuacaggacauuacaggaguaggguuguagugcuuucuggaaugauaggggcaguaacuggcagagacauaaagagauguccagugaccaguacagagcugacuccuaccuccauuccucagccugcucccaaaaaaauggcuagagagcugcuuucuuccuucuuucccuuuacuucucccuagacuguguccaucgccugggacgugugcugagaaggaagcugggggaagauuggaucuuucuugugcuccugggccuccugauggcucuagucagcuggugcauggacuauguuagugccaagagccuucaggguagguucucccuggacugcagcagcccucuaccuuuuccauauggaaacuauuucggaguuuuugccuagaguagaccagguguguuugggcugagcauguuguaugaaugaucaaguaugacucugacuccagauagaacuaaacuuauugagaacccuaacaccacccaggccuuuccugccagcugccaugccagcugugaguaccccucuaacaggguuacuggccucuguagcuuucccaggauucuucagucucaucacugaaauuucuaagucuuaggggucccuucuguugucagugguuaguuacccuauggccucuagccaagugcuacaacaucuucauacucaacucugacuugcaccacagccacuggcuaccucugccagagggaacuuggacagauagccaccucccuuagcucagaguuucuaccuguacagugaaaggaaugcccuggggccaggcaaacgagaugcccagggcaugagagcaaguuggcauacuauccuaucugguggugugaaugugaggguaguggugagaugaccucacugucaaccuuccuucaauuuuaacugacccagagucuguguuccuguagccuacaaguggaccuaugcccagaugaagccuagccuuccucugcaguaccuggccugggucaccuucccacuuauccugauccucuucagcgcccucuuuugccaacucaucucuccccaggcugugggugaguacuuuguauaagaugaugcagucugguuuuuuacagaccucccacucugaccugccccguccuccucaacuugguuaucuccuuucccaucucugcuuuccucuuccauuuaaucucuagcaugacauuguagguacaucaucuguuuuuaacccuuuuaggcucuggaaucccugagaugaaaacaauucuucgugguguugucuugaaggaauaccucacacucaaggccuuuguagccaaggugguagcuuugacagcuggacugggcaguggcaucccuguggggaaagagguaagcgugcgcagcugaaggaagggauggcagagcugccugaacucggcuauggacaaagggcaguaacaagggggaagccuuggaaguuucucacccuuguggguuuggugacacaacuacuagagcugugaaacuuuacggcagccccacaauugggcaaacuaaggucuggggcuggaaaacugcugggaagagggguguugcucugaccugugagaugcuagcauuaucccugacuuuuaacuguagacaccaguagcaggcccaaguuaugacaaccgaaugucuauagaaaacgucuguccucuacauaaucugaaccagucuccucgucuuauuuauuauucauuuauuuauuacuuauuuuuuaauuuguguuugguuauuugcuuguuugaaaucaucucauucuguaacucaggcuaaccuggaacuuuuauguugcccaggcuagccucaaaaucaacacaguccuuggguuucccauuauuuuggcaugagaaaacugagaucuagagugagacuuccuccuucaagcugccuucuagguuccuccaguuucaccccugugaacacacuugcccugcccccuaaucaccauugugcacaguagacaaagcaucuuucaaaacagaauuugaugcuucugaccucuagucaagaaagccacaagagcuuuccauaucacuuaauauaagaucuccacuccucccaacagcuggccagccccacagucugccuucaucccugugcuuggauuauaaggcuuuucuccauuuuucugccauuccaugcuggucccacucaggacaccugaaauaucuguucccuagaacacucccacucugacacccaugagccucacucaugucauuaucucucaagggacuaacuuggguggugacuggcaagggacaaccaccuucuccuaguccccaccuuaccucuuuugccuuacuucucuucguuugcuuccuaggcuguggcauugucugcuaugauagcacacugauuuuucaucucuuccuuccucgaaugagacuccuuuaaggaagaacuuuugucuggcuucuccacuucuagcaacuagcccagggccuggaacaggaauuugugguucaauggcaucucuguguuucuccuccaucccugagccccgucucuccucuucucuuccagggucccuuuguucacaucgccagcaucugugcugcuguccucagcaaguuuauguccauguucucuggugucuaugagguaagggugaggcaguacagcacaacaaggaccaguugguagaaggaagcccucgcgugugcagagagcaggggaggguugccugcucugggcuggccuuggggcugaaggcggaaucuuacuaaccuaugcuccaguuuuccauggcccugccugcugauccuagccauaucauccccucuguccagcuucugucugucuuccucgugucuaucccuuccugaucugugucucccuuuggugacugagccaggccugccccauguuaucuuccuacccacaugaacugugucgauuccuuuccauguuuccuccugugcugcccccguucuucugugcuuccugacacccauccaccugguuuacauaccaccugucugucccccucugccaccugccucgcccgucgugcuucucuguugcagaccgugccugggcagcuugaucuccuggugccagccugugcagugggcgugggaugcuacuuugcagccccugauggaggcaaguuucacuuccucccuaccuugguugccugagccagacuuggaggggugguuugugucugcuguggcuuugggguugaggggccaugcucacugaaggaacuuaugggugggcaaccagggagugacuggauugccacaccugggcuccagggacccauauguuucuacccaagagcugaguacccuuuugacauuggcugcucucaccuccugguuuucuguuggagugaagucuugccaccucuugcuacuacuucucagcccuuguuuguuuuaucacuauuuguucauuugcugggcaucuauuuacuuaacauuuuucuugauguguuuuggauuguuggccuugagcucauaaagucacuuccugauugccaaacucacugaguuucuccuggccugggaaucacagggaugaugggaccguguucauuccugugauauaggucucucauucucuuuuguuucccaucuauacuuauucuccucccaucucucugccucugcucuucuccuccuaccugucugucugucugucucucccuaguagcagccauacuauuacacugacauccugacagugggcugugccgugggggucgguugcuguuuuggaacaccacuuggagguaagucugcccuauccccagagcaugagccgaccagcuuguucuugucagcuucgccaagugcugcauuuuaccauuuccacuauaacaagagcugcuggccgcucuuagguagcaccugcauuuugccgccuucuaaccauuuuacaugaauuccuaccuaauacuaugagugcaguucaguagagcaucauagaaagaccagugacuggagcaggggcauauugacaucacaugcagagucagguauuagaaacacagcaucucucuugguuuccacuuaugcuaaagccuuuugcauugccaagacuuuuacuuuacacauacuguucuguaacaggagaaucuguguacuuccuucuccaagggaaaacuuaccucuuuuguuuuauuaaagacaccgggauuucaguagacuguguauagauuaaugaugagcuuuagaaugggaaaugcuuaugggagcuuuagaguggguuauuuuguauaugcuagcaaccuaaaaauggguuaaacucuuucuauccguauaugaaaaacagugauauuaucauagguuaguagcgauaggaccuaucacaaaaagcaggccuguuuauucccuuaucaaaguugaguuguagcuauguuagcagggcagggguuguauggcucauucauugaagucacugauggugaaauuccauguugauaauugaagaaaugcaguuauagaagggcaaaugcuucuuaaacaaccaguugcuagaagcuucuuugaugaugaaacugcagucuuuucauagaggaguuuucuagguaucuaaaauagcuuaacucagaaaugauguacagugagaguucagaauuaauaaaagcauauucuauaugccucguucucacaugguggcagcauacagcgugagggcguccaggaccugugcucgccacuggcauccuguuuauacuucaguugucagcuccagucauuaacgccauuagccccugucaguggauggucguguguuugaguuucugcacguuagacauucacaccuauaauuacacacaugcuguguuuauuuaccccuuagucuuacaaauaaaagaagaauuuaugguuguuuugguugucagaaguguuuuaaaguggagggaaucugcauucucuuccugacgcuccuguuuaugaggagucagagguucuuucuggucuugggacuuaccugaggaaaguuaugguaaggcauugcucuuggcacaggaaacugcuaagcacuugugaaugaaggggcugugcucaggcuuuuugcuuuaugcagcaaaugacaaaccuaugugcagguggcagcacuugguucuuuuuugugaauauagaauaacugagagagaaaaauguaguguugagauuuuacucacaacauaggcagcuccuaauuccuuguagugaucaaaguaaucuacuucaucauccuacugaaacaaccaaagcccuuuugcucccauugugugccagguauugggguuggcccugcacucucaaggagcucagggagacaggcacacagaucauugcaggcaguguagugaccauguggcuuccuaggcaaagugcagcgaaccuccaaggcagccuggaggagcuugugaaacuuuaugacagagacauuguuugcauuggguguaauuagaaaguagaagccuaaaaggagaaaaggaaacccugaacagaauggacagcauccaaagucaauaucugcugcuacaguaagaaguaguacuagggagaauggcaaaguauaauaggaagugagucagaacagauaaaugggccugaaucaugaagcucugcagaagucaugcagaguaauacacguuuuauucucuaggguaggauuugcccaaauauguuucucagagcgcaguucuucccaguguuaauggguguaacaggugaaaacugacucugaguuccaguugguuagaaaaaugggagaguaaaaggaauaaauaaguaguuaaaaaaaaaaagugaacuggaaagguaaugagaacaucugagcugucagaaugccuuuugaguacccaggguggcugcaaacaguauuucuaaucaagccuucuuuguagagaccaugucaugggacuuguauuaucucaugagacugacuuugugaaguauugucauggaagaaucgaaaccauggaaggauuuaaaacaaggaagugacaugguuagcucagccugccuauccaaucccuuuggcacaaaugugcaggauagaguuggcuguggauuaacgggauugaucuaagauuaacaagaagaccauuguccucacccugauucuacacgaugacaggcauaacugggcagcaaaggagauagaggaagggcugagaaacuccagugggcucaaguccuauugaugcugccugguggccaauauuuugugaagauaggagagagaguucuaugccagcacccaggcucacagugcuugcaaugccauagauacggauaucagugaccuugagagaggacagaggaaguaaccuggaucugggggaagugaacaaauuuuacuuagaggauauugaauuuaacguuccuauggcauggccaaauauaaaacugucaaugaaucuacaauccaggaacugaguugaaucuaaucaguauccauugcugaugccacaggcauuaauugagaaagaaaugguguuagugacuagcaggagauggagaccaggagcaguggcuuaauuggacagaggcauggcaugggggccagagagaaaacagagcagaagaauagagcaauguuccagaucuaagacaccagaguuucuaacugcugcucauguuucuaaagcucuguuuucuuuuagcagcacauuuuauguuugucuugggcuaacaugaaaguuagcucucauucccaaccacaaugugacagaccugcuacagaaaagucuccucggucuccaucauggagggaaaauaguuguaaaauguaaguugaauaauugcacccaggcagagcaaagcugguuuuacuuuuauuauggcaacaugauucacagcauggacuucugcccuugggauuuaagagcaggacagaaagaguggcaggcauagcucuucauuacucagcuccauccuuugaaauucccucacuguggucuuuccuccuccaucucuucucuucuccucucuacuccaguauaggcauugaacuccaaauggguucucaccacuaugccagggcuuaguuuccaaggaacauccaaucacagaaaacuuaguagugugaacaaauagccacaucugaaaguggaaaaauacaauaauccaaaaugccacgagaggaggaugagaacggaugcuuucuacuugacaaggaaaaugggugugguuuucuagagaaggagauaacagagaaauccucuacccaaacacagcuuuggcuccaggugaaaauagcccuaagccacuaucuccuuagauucaguguggcuagucacugucaacugcaaaagaaauggugauggucaugaggaauuugggagaugugacuuuugaauacagcauggggagaagagaauuccuuucaagugagcugcugucugaauacagagggaauggccagcccugagcagaccaacaaaguacaccaugagaaaaggacaaagucugcccuguuuauguuuuguuuuuccuauugggcugguccucagcuccaucucaguucucugaccuccugcuugauacagaagaggcuuagcuaagguuuaggucaggucauugaugaccuaaucaaagaucaacucccuuauccuaaagcuuacagauuuccuaaagcuucccuuuguuguugcaaauggugcuuuucuggccucgcugguguugcugccuuuggcgcagcaucuuguauauguuacauuugcccuccucguuuuaagcuugagccucuccccucagaacaagaacuagugacuacuagcugccauuccuauuuaccucacucaccuugcuaagcauaaugguuuacuuucucacccuggcuauccuggcuuuagaccuugugagcuaccuuuuguauugucaucccuguuagaaacauuccucugcuuucuuuuucucaaauauugaauccuguugaugugcagaaugcccuauccugucuuucuuauuucucauaaauuugcccuuggguagaaggagcaauagggagaugaaaaggguugucaaggaauaugcaaacccugaagccucuuuggcaacaaugcugaccaccuccucuggaagcuucuucacguuuaauuugcagaacuguuucaccuuuccauaaaucuccauggauacuugacaguugugaaccucacucaguccuauaauuuaaguacaaagauacuugagcuugaaguucagggauuaaaagucuauccauuucccaccuucucuguaccucauugguccacauuccugggcuggggguggaaaagccuccauagacaaguaugugacuguaguaaggaacagcaagaauacgucacuuccauuggugcuucgcagacucacaacucaggugaagcuccugaggucccagcaguggggggcauggggugucugcaccugacuugcuuuccugccccauaggagugcuauuuagcaucgaggucaccucuaccuacuuugcuguucggaauuacuggcgaggauucuuugcagccacauucagugccuuuguguuccguguccuggccguuuggaacaaggaugcugguaacaggggaggucuugguggaggugguaugaaauaggggugaugggaagguggcagaaaguguagcucuggagcacuuuagauaagaaugcaugguguugucugggaaggaagaccaaggcucagggucuagggagaaaacuagaucaugguuugagaguauaagcauggcgagaugcuaguaggaaaaaggaaaauucaauggaagagaagagguugggguugagguagggaagauaccuugacacuugucuuccucucccugcggcucucugggagcucccacccuaaugcugccuuuucauccuacagucaccaucacugcucuguucagaacgaauuuccgaauggauuuccccuuugaccugaaggaacucccagcuuuugcugucauuggguuaguggggccacucuuucuggcuguggggaucagagguugggguguggcuagggaccaggaagaagcuggggagagcauaagugaaaguauggauuuaccaugaggcagcugaguagugagagaaggggaagcugcuggccugcuucccuccagcccugugacuugcacccuuaggauuugcugcggguucuugggagcuguuuucguuuaucugcaucgccaagucaugcucgguguccgaaagcacaagugucucagccaauuucuugcuaagcagugagucauugcccuucccuuacccugcacacuuagcuucugauuccccccagcaguuaguuccuccuuuaggugaaugaaugccuuuagguaggauugcugcuuacagcuaugggaagcccugauacuguggguaggggcuagcugugcaggcucuuaccacgugaucauuuucuugaccaagagaguaugcuuugcugaaaugaauagaagacuaugggaaacaacagcuuggaagcugaguguggcugcacugugggcuggcuaagcgggggauagagcuaacccuuuuuccuuuuucagccgccugcuauauccuggaauuguuaccuuugucaucgccucgcucacauuuccaccaggaaugggucaauucauggcuggagaggucaguucuagggguaucuaagagcaggggguuaacucauaccuguggcucuggaucuaagccaggagcagggcaacugcucgaacuuggagcuugcauaguuuugcccaaggguauacuuucucucagagaaaagaacaaaaagagcucugggcuaaccaggcuggggauacauucucuaacacaggacauaugguacauucguggaaaaccugccuguucugcuucuuccucacagcugaugccccgugaagcuaucaguacccucuuugacaacaacacauggguaaagcacauaggugacccccaaagcuugggccagucagcuguguggcuucacccccaggucaacgugaucaucaucauccuucucuucuucguuaugaagguauucugcccgacuacagccccucucagcuucugucuguguacagaagggcccaggccuuauacaggagggauagagcuucagcuucucuguguccaaccuagauggaaaucaggaagaaaccacagcacaaguugccugucuaucaaaaugaacuaggauguaguuuaauugcuccauucauggcaaucuagugauguuugccauaauuauaauaacccuuuuaguaguuccccuuguuaucuuuuuaaggcaucagagcagucaaguaaauuugagcaagacagaguuuagcaauauagauaacuguguaaaaaccccaggccaauuaaccaaauuccucccacggguuaagauaauuagauauuuaaucuccacagauuuguuauucaauuccaggugauuugcacacaaaucucuaucaucucuuuucuagaauuuugaaggugaugaaauaccaaaucaaccuuacuaagacuauaaguaauuuuuagaaauguaauuacucucuguucaggcagugagaguauaagaccaguuuuucuaacuuuaauuaggaaauaaaagcugauaccuuuacauccuuaccuuuuuagaucugucuaucacaaguuacacauguaaaggcuucacauuauuaccuuguacaaagauuuguuuuuauuaccaagcccgauuguaacaccuacauaguugaugauugucugauguuuccuuuugguguucuuuuuuacuaauaacaugccuuaaauaagcaagccaguaucuccuguggguacugggauucuuuuuuuuuuuuuuaaagauuuauuuauuuauuauauguaaguacacuguagcuguagucagacacaccagaagagggcaucagaucucuguuacaggugguugugagccaccaugugguugcugggauuugaacuucggaccuuuggaagagcagucgggugcucuuacccccugagccaucucaccagcccgguacugggauucuuauagguaucucuguccaaccuaaacucucaagcuuuucaauaccuugcucuuuuaugauacuuuaugaaauaugaaucacuaaguuauauugguauuguuuuuauaagacagugaccucacuuauucaauaaaugcuaugaaauaccacgugccaaauacauaacucuuggccauuggcuuuuggcuaguuuuauauuuccuaguuuugugcuguugcuuguuaauauauuuuucaaugauauuauuauuaaagaugccagcugcuuccugcagcaagucucagaucacgagcuuaggcuccccggguuugcuguggauuucucccuuuccagcucauucacugacggugaacuaacuuaauccauauuuuggacacuuuauuuuacccuauauguuucuuucuucaaaaugaaugcuaauuuuccugaaaauauuccaagaaucauauuaacgauucgaugucuagacuuucauuuauaauucccaucuucuauaauuuauaaguucuggcuuuuuauccugguugaacuuacuuuacugggaguaaaguuaggucuuacuguguaaugcacgcuagccuuaaacuuguccucuccugcugagauguuagcaugaaccccaacccaauaacucugcacugacaguugaaucuacagucccuucugcaggagcccaguccauguuuuaauaguauuucagaaucuauuaugcaguaaauauggcuuggucuaagcaguaugccaccuuugggguccuguagacugcuaaaaugccaagauuuugaaaaguuuucuaaaaauaaaauaucuuuuaacacucacuccuuaccuuauccgcauccccagauuucaaguuauauaucuccccaacaucaagcuuauuuucagauccccacuuggaugauauggaaggauucaucuguaugucacuauaauuaacuucucacugaauuauauccuagagaacauuuauauuguaaguguguaagaaaaagaaacacauucugggcuauauuucaagcucaacaguuuauagaagaucuacaauauuuuuuaguacuucuaauuacuaaaguauucuuugcuacaaacuccguuuccccagucacugcuucccaguauuuucauugccuaaucacugcacuugcaacaguacccuuauuuuugucaaaugugaaaaauagaacauauagucaaauuaaaauaaggaaguccuuauaucugucuguuuuuuccuuauucuaauuaaauaucugagguaggcugccuuauaaggaaaagaguaauuuuuggcucacgguucuggacaucuaagguuacagagucauaccagcauuggugcucuuguucacagaauccuaagcugugaggaauagcacacagcaaacaauaagaagcaccuguguuuggguucauccgucuguucucagaaaggcaccaugaagccaucacuaaugacucaucacagugucgugucuaauccuaacaaacuuccaaagacuccacuuccaagcuccacagcuagauuagguccucauccucuugauagcacaacagagaugaguuuccaaacagaagccuaggagacacucaaauuguuaucaguccaaaacagggacuaguaguacucuucccaauuagguuugaagucuaguccauguccacgcggccuuuuggcagugucaggaggggagcuuacauucucggcucagcugcuucuuaauguuggcaaaagggauguccuacuucccuaccugucccggucucacggugugcgaagugucaucaugcuguacacgaagagauuuuccaugagcaugaauauaauucuaaccucucugcucccuuuuacuaauaccauccauugccugcuauuguugaguucuagcaucgccugaggcccucugggagccuuuuugccugguuuuuauauuaguucuccuugugaugggucuaaauauaauguagucagugauaacagguuuuuacuuucucauuucuuuagaacuggaucuuuaaaaucaacuuaugugccacaugacucuugguuuuuuucuucauguaccaauagcuaaaaaaaguuugcuaaucucagucacccucuuugugccaugggaguugauagcuucagcacccccaggucuggauuuacacuucucugggaagauaaccugcuuuaugcugcaaaauccugccuacccauugcccaccaucugcaucauuggagcuuucagauaauccgagccuacagaauccuuuaugacuaccauguugugauucccaagaauacaugagagugcaaggauucuugaugugcuaaaugucaccacuuaggaagcuuaagcaacacgugcaugggaguccugccuccagaggcgucgacucaucugcauuuuaaacaaguucucuggaugaacaggacuuugacauguuugaguaaauauuaagcuuugagagaccucuacuguuuugcaugaauauuacuccaucaauauauugccuuucuuuacuuccugucuacauuuauggagcacggggccacugcagaggaggcagaaauaaggcucaaccucuucccgcaagaagucaucggucugcauccucuucauuuugcacauuuaauugcaguucucagccaguuugaugaucauauucucacgaaguagauauuuugcuucaucucacacuucuggaguaaaauucucucuugagucuucaucauugccucuuggguucagccuuggcuugaagcaaugcuuucuaaaguucauaaaauuuauuuuuuuauucauguaccauacuuccaaauacuuuaaucuuuacagcuugcuagauuuuuagcuguuuucauuuuguaccuaauuacuuuggaauccuuucugagauuuauuaacuuacauaggaaguacuuucaauacuacaccucggcuuuugguuuuuuuauuagauauuuuaauauuuagccauuauucuuguucugcucuauuucugaauucuucugcauucuuugccucagaauguacauacugcuuuugcucuaauugccccaauuucuguuggaaugaugccuugcaaaguugaccuuggcuaucuuuucugguauauugaaagacuaaucagguucucaguuugccccugugguacagccaggacauaucaggaauuuuuuucucaguacugggcauugaacacaaggcugugcagauucuaagaauacacuuuaucacuguauguccccaggacccagauauaauuuugauccuuguuuaaagugguuugguuucacagacaaaggcucaagccgaacagucuucucuucgggaucccugugauccuugcuuuucucuguggcuuuguaaauggucaaaucaaagcgaaauuaacccuacagaaguucaguagacuuuaagguaccugaugcauugauuuggggcccauuuauaaaaauauaagcugagaagguaagaacaucuuccagcuuagcaucuuagacuacuccacagagauaaacucucugggcugacaggguccacugggugagggucauuuuggaacagugaaagaugaaucuucagggguucccuuguucuagauugccaaaaagaaaauacagucacucaaaguuggaaggauuugugucagccaucuggaggaacuuucuuauccugaugucuuuguugaucucucagccugaaagcgccaaguuuuucaggcucuggagaauggugacagacaagaaggcuuccaaaaggguuagcuaucccaggacauuucuguuaugacucuugaagcaagagggaggaggguaaagagcagagaaaggcaugggggaaacuuuggaaagaguacuguaaucuuucuuuuccucccuaguuuuggauguccauuguagccaccacuaugcccauacccuguggaggcuucaugccuguuuuugugcuagguaagaguugauggcgucauacugauagcuacaaucuggggggccggugggaaaaccuaggaugguugucucuuaaugccugagcaaauaauaugcugaaagcauagagacaaagaaauuuaucuuaguauuuuucuucuuuaucuuccuucuaggagcugcauuuggaaggcugguaggagagaucauggccaugcuauucccugaggguaucuuauuugaugauaucaucuauaagaucuuaccugggggcuaugcaguaauuggugagacguauuccuaaccucuauaaccagauauugaauacccugaauccuuauaaucaaagucugcaaacacaucuucuuucaauguacagcaaaauaauuuaaauacaacacuaauuaauucaaguuuuguucaaacaacuggcuuuuggcucugccucucaugguuucucuuuuauaagccuuaguccucccuccuguggaaaauggacauaggaauuaaauaagaaaauaggaaggggguaaccugcauugucuuugcauuuuuaguaggcuuuuucuuuucugauaauuauggaaccaauaaugcagguaauggucccaaguccauccaaauugagcugugcuaauguuacuggagacuaagaaggcaggagugagagcugggagacaggaaccggggacuucuaagaugacuugugagguagaccuaugcuuacgaggcauucuacugccugauccuaguccauuuauaaagcuuccgauaucgguaggcaucuucuguucucuucaugccucucaagugucucucuucuuccauaauguauacuucccaguacacacacuauguaguugauguucugaacuaugcgucaccuacgaggaucauacaucccaauauuaugcuccgugaccuuuuauucuuauauugucacauaagccuucuccuacuuucccacaggauaguuucaucauuuuauuagcuuuagggguuuuuuagguuuuauuagcuuuaggguuuacuagcuuuuagggguuguuguugucauugccauuguuuuugagacaguaucucuuuaaccaacucugacuguccugaaacucacuaaguagaccaggcugaccauguucucauguuugaauaagaaacaaaguuaaaguaugagugacuagugaguugauaagaaaacaauuuaaaauacauaagauugauucuacuguuuagaaucauaaugauuuagauguauaagaauuuuagaagauauuuaguggccuuuauagucaguggaugagagcacgguaucccagggaaauaugcuuuguuaauacaguagacacaggauuggaaucuguggauucugaucaauaaagacaaugccaucgcuuuaugucuacagcaugauucuugaauuuucuaccauucauucauaaacuguuggcauugacaccagaugcucaaaguaagaugcuaucacugggucuuuuaauauguucaguggaaaagcagagaauggguaagcuaucacucuguucacauuaugaaugaaaugauaugcacagauuuugugacuuacugaauguuaugcauaaauuugaucaaagggguaauuuuugaacaggcgagcuuucuagcccuuacucuugaaaaguaguaauccuagaauugcugacacugaccaaggucugucuccuauucugugucauucccauuguacccucauuuguucuccaugucaagaaagacagcuccaacccauuaauacauuccugucauuccaggagcagcagcuuugacaggggcugucucccacacagucuccacagccgucauuugcuucgaauuaaccggucagauugcucacauccugcccaugaugguggcuguuaucuuggccaacaugguggcucagagucugcagcccucccucuaugacagcaucauccaggucaagaagcuucccuaucugccagaccuugguuggaaccagcucaggucagggccauuggcuggaauuaguuuagguauggugggaugugggagggccuggaaugaagaaugagucuaguauuaguauugggaagcaccgcuuccuaauuauuuucuuguuuccacacacuuagucaauacuguaagagaaaggaaacauggcagacuuugugggaagaaggaagggccagcauaggccaagagugggcuaacccaggaugcuuucuccuccuuagcaaauuuacaauuuuuguugaggacaucaugguacgugaugugaaguucguuucagcuucuuguacauauggggaacugagaaaccuacuccaggccaccacagucaagacuuuaccauugguugacuccaaagguaaguggaaaguaaggaugccaacuaagacuacccagcuggugacuagcagguugaacaguggcagagagcaccacugucaccuuaguaacuuucuaacgcugauauuaaaauaccuaauguaaacagaugaagagaagaaauguuuauuucagcuuaugguuucaaguucaguccauuuugguagagaugagauggugggacagagcagcacacaucauggcaggccaagaugcaccccacccccuuuugugcuuguggucuuuucugugaugcaaagcuaugggaucaugccaccuauauucaguggaucuuccucgcuuaguuaaucucuagcaaugcccucauagacacacccagaagugugccucaccauucuccuaggugauucagaauccagcugagcugacaguaagcuucaccauugcagguauggacuugaacucagagcuauccagcugcuaagggaggcucaguuuguacuuacugagggacauguucuuccucuagaaaaauacauaaacacacacacagccauagcacaggcacacaaaggcaguuaaaauccaacuaaggaaguaugggcaauccuauuauugccuguauucauggcagccaugaauuuuaaagucuucuugagcuuagaauucgugaacaguuugcagaagaauguuccaagggaaaauucaaagcuaagucuuuugacucuggucacagcauuuuugccaagcaaucaauaauagcuguguuuucugucucucuuuuaagauaccuuauuuaauaguauuuugucauuuauuaaccuugaacuugugaccaacagcacuguaaucuuacccagauaaaacucgucuaacacauuuucucaguaagacaaagcacagccuucccuuccugugcucagaaacaguagacagcgcucagcagugcauguggggacacuuuagacagcagagucaccgcacagagcagagacuggagaaacacuguggcuuagguaggcugcucacagaacccguuuccucgagcugaaaugggaaggcugagugcuguuuguuuggccucagcugggaacaugagauucaugccguucacucuguuguugcucugugcauggcugugaauucuagccaagacaucucuagcaguguaaucauggacauagauucuggugagugaguucacaaauagagacuucauaaacagugugggucaacuguaagucugcuccccacauacuuaauuaaauucuaucauuuuuuuaauggccaaccuaaggaacagugaaggaguaaauggcuuuaguaacuguugauuucacauuuccuucuauucaccauucuuccugcccaccaacuucacucugguguguaucacuucucacuguaguuugucuuucucauuagauuggguggucuuugaauguagauagcauaaucucuauauuuuuauaguucuaauuauaagcuggaccuucagcccucauuucccuagucuguaaauuagaaaauagagaugaagaacuguuuggagccagaaacaauguuaguuuuuuauuucagauauucagaguauccaaauuucucaagcugcacuagugcaggcacuucccuaagcucagagaccuucuaaggagcuucugaagccauggcucuuccuuagagcaaggguggagccagugggguacaagaucuucauaaugauagcaaaaauguaacaguauacgguguaucugagaucuaaguaggugcucuuggugcaaugcuaugggcguuaacuugcugaaaauguucagcacuguagcagaauuuauauaaacacaugaaagguucauggaaagugaacauuuugcuuauauucuaucaggcuguaggugcuuuaaguaaugaaucuucuaagauagaagacccaaugcuagcauugcuuguagacuucuuucagagugugauugagucucagauugcuacaacugccucuugagucucauuacauuuagauagaguagaucagccuauuuuaauagcuuacauauuugcaaacacuauauuagggcaguguacagauaaguacagauuagcaccaauuaaugugcugccaauugggucuguaagugcuaaauguguagaguuacagugaggccacacuggaggaguuuaagaugaguuuuuaguaagaaaagguaaaaauugcaguaagaaaaggcucugagcuucuacuucaccugacuugcuagccguguagguguggagcaggcccucagggaagcaugguugucccccagauucaaugauccugcugggcucuguggaacgcucagaacugcagucccuccugcagcgccaccugugugcagagcgaagguugaaggcugcccaggacauggcucgaaaguuaucagagcugccuuauaauggcaaggcucagcuggcuggggacuggcauccugguggucgaccugaguccuuugccuucguagaugaagaugaagaugaggaccucuccaggaagauggaggugaccaagacaaaaggggaagggaggcugacagagggggaaaugccaguaggugucgccagggacauugucauggcugggcugggcugggcugggcuuugcuaagacaagugcuggagaaaaggaagggagaaggaaaacauugacaagugagaaagugacaauauaagguccauugcaaaagagaccaguguuuugaaaagggaaaaaaggggauuugggaggugggggaaagggguacaguuauaucucuagggcauccacuaguaaagguagcaagguaucauguaauguggaacuucucugaagcuaagaaguuuugcuuauuuuauuuuauuucuuuuuuucuuuagcuuccacugacuccagcuccucccccuccuuccccuccuccuccaccuucccaguuuccuauugcuccaucaaacccugaagaaccuaaugggccacugcccagccauaaacagccaccugaagccucagacucugcagguaaagaccucucaacaugucuugggaauuacauccgggacucaccuuucccuaagagcugcucuuguaaggagaugugaggcuaggcaguuucaagagcugauuccauaaugcuguccuagggagcugggacagagguagaaaagaggaaacucuugagguacagcauugaggaagugcaguucuuuaauggcacaguaucaggggccacuggaaaccccuagccacuuccuccaucuucuuacuacuccuuucagaucaaagaucauccaccuuccaacgccugcugcacugcuugcuaggaaaagcucacuccaaaaagaagaaaauaacacagguaaagauguguuuagagaaacaaggauggucagaaauuggucuuuuaggaaugagaaacucaaguccuuaguuagaagggcagagguccaaucacgaugaugguuugaaaagguggcuaauaccgacccaggaggacauaguuucugagaaccauuacuaaccugagaagagaagggaagaacuuggccuuguaucuuucuucccuaggauucaacagauuuaguggauaacaugucaccugaagagguaagaaaauccacagccugaaauggauuguuucauccaaugaagguauugcuuuuauuuuuguuuuauuuuugagacagggucuuacuguguagcccuugcuggccuggaauucacagguaucuaucugucuuccucugccucccaaaugccaggauuuaaggugugcacuaacauuucuuacuguaccaagaagauugaacaccagguagucaugaauuuggcuacucaauaccuguuagaaauaaaaugcauccugguacaaaauacugauuauauauuucuaguguauaucuuucucaaacacacauagaggagacauuauugaggaauaauucaauaaaaguaaauauuuaguauauuuugagagaugauaaccuugacaacaccaggauguugauuuugacaaaaaauauauugagccaauacagaaauuacacaaagaauuucaugugaaaaaauucaccugcucucccagcuaugauuuaaauguaacauagagagagccuuggcuuauaacuggugcugaacuuuuuauaagacccggcagcaacauccucucccccuggaacagaagcuggaguugucucugggauguggucagcacacaaacacuagaguccacuaaugacugccuauggagcccuuggcagacuuagcacagugcaucuguacuucaucugcaaaauguagauagagagaaaauuguuacgaggauucuaugagcuaaaacugaacagcaauucgaauuaugcccagcacagaugaaguuauuggcaaauauucucugaaaauggugucacuauuacuggggaaaggcaaaaacaaucaaacaaagcugagaaguccugggaugaucuuggagcaagaaaacagguccuauguaaguccugcagccccauccucuuuguacccuuuuggauaagugucuacucaugcuaaaaguccuuuaggcuacacaugaccauaggaguuuaaaguauacauggcuguguccagaaauuuccacagggcaugacacauggagggaggcucacugaugacuccauacuaaaugcaaggacauccuuuacugauacucuccuaaggcuagagugcagauuugacaaacagaguugaagugacaucacccagaaaguaggacuaaagaacaucuuagauucauuuauaaugcuggagagaauggcuuagcuguauuugugucuuagugauuugguuaauagaccaacaaaacaaaaccaagcaaaacauagacaguucaagucaacuacauaccaagugguacagagagucugcucagauucaacaaauauucgcucugcuuuacaccuaagggacgacugcuagcuucuuuggacuucaccuguugauaucacuuagcacucaaugaguguucauccaguaggcagaggaaaggcaagugccaauaucaggcugaguauaaacagugccauuucugaaaagcaaagacuuacaaagugucaaagguaugauauggauuauuagacaggaaaauacgucugauugggagugucaauaagacacagaaugaagguuggaaagaugaaaaugaagauaaugaagguuggaagguuuagagauccaggagaacucagcagacuacaggaggagccacuuucugcguaccugaaggugaaggguagagucugaggccagauaacagaggagaagggaucugugguccucugagaagaaaaaguauacuauugaucaaugguguauacgauggccaccgagggacaaugccgaguugaaggggucucugugaaacucugucaacagauugaggccugggagcgggagcagcugagccagccugugugcuuugauugcugcugcaucgaccagucucccuuccagcugguggagcagacaacccugcacaaggcaagcccuugcugacugcucugggcuuugggagggcagaaguggggccaugcugaccugggcuuucuuuccccaucagacucauacacucuucucacuucuuggccuccaucuugccuaugugaccagcauggggaagcucagaggugucuuggcacuagaagagguaaggaugaauaggccccccuugagcagagagaggaaggaauggauccaggacaagaggacauggauggggaacauagaaagcaaaugucccuccagaagacugcaaagcauguuguggucacauaguucuccagcccagaagggcacccaugcguucuucucaaaggggccugacuugaggaaugggcuuuaggugugagcuauggggaggggugugggaccaugaggaagauauucaucgagcacuaggaggagaagcuuccggggggggggugcuuuuuuagggaacugcuuugucagggauagccuugucuuucugucuuccccuauaacuguucccuguccgucugucucccuuucuuacuauuuccauuucuguuuccuccugguuugucuauuucuugugcugucucucauuguccuccaucuuuuuuucuuuuuccuacugucuaucuuuuuaccucuccucuuccuccucagcuacagaaagcuauugagggccacaccaaaucuggggugcagcuucgcccuccacuugccagcuuccggaauacaacuucaauccggaagacuccuggggggccacccccuccugcagagggcuggaauguaccugaggauggagauggggcuccuggaagagaagucaugguuccuaccaugccagagacuccugucccaccaccaucuccagaggccccuuccugccuggccccagccagagcggagggugagcuggaggaacuggagaugguggggagccuagagccugaggaggagcuggcugacaucuugcauggccccagucugcgguccacugaugaggaagaugaggacgagcugauccugugaacaacccccucuaugccuucuucuuaaaaaccacagggcccaugucagagaguggacguguaugugauauggagaggccuccacuucaucuucuuccuaccaccacugugaaaggugauggugauaaucuuaaggagaacuugaucuugggcagggaagaauuuggguccaucagaccuccccccgccaccccccauuuccaugcuuaaaggacucuuguguuuuccugcugugcagguucagucccuaucacucuaaagccccacaguucccaguguucagucaccauccuggcccugccuguuuauauucaguuuccauacggaguaggugaguggagguccauauuggaugaaucugcaagugucacauuggaagggaaugugggaccacaauauugccauguggauugacuacccuaaaauguguccccaagucugccaguccugugugcucuccaaaaucugucuuagaccccaucagugcugccauugucuguuuccaggccaagcccauaucggggcugaaaaggccaacccuuauuuccgaggaaccaagugcaguucccccgggaagagguugagguaagcuuugucuggugaggcaggugucagaccccugcagcagaaagcucuaguccuuaucccuggcgcucugccuaguucuauguuacaccuagaacaugcuucuuuccuuccgcccacuggaguggcuaacuuagccugccaagagucaccucugccuuggggccacucuugcuagagcuccucccaaaucacaccaaggcucucgugccacaguggggaaugcagauuccaguccuuuccaguccuuccagcuccuugcacccuugacuuggcaagcuuuaguuuacuccacucuuagaggaguuuuccuuccaaaccagcaaggcgcucaauagccaugcuguauggcauuagccugcuuaaccuagaaccauaugccaggugcugugggcauucagacucucugcuccauuugggggcucuuucugccccucacuauauacuuuuagcucuguaguugagcccucauauauucucccaguucugcccccccccccauucccagguuucuucugucccccaaauaagacacucauagucaaaggaugccaccacauucuguuuaguguuguuccacacagccucuggccuucuccaacaugggcuccuuccaccaaccaaggcuaagacauugaggccuagguaggaggauuagcagggggcuuccaagcccaugcccauguguauauaaucuauaauacuuauauauauuuauauagaauucucucuguaauauaugucauagacuccuuccugggccuggggugagaguuucacauuaagaaaacaugcuaagacugaccauaaaaauggguauuucucagaccuggaagacagagugugggauauauauggacaaggguaagaacuuguccuucacgauuccuuucuuaacacaaggaaaagaagggagguaugugggcugggggaggcaauggaagggaaggaauggaagguuuggauuuucauuuaauaaagucaauugaaaauga

SEQ ID NO: 2945 - RNA, 10464 nt, Mus musculus
aacaacccccucuaugccuucuucuuaaaaaccacagggcccaugucagagaguggacguguaugugauauggagaggccuccacuucaucuucuuccuaccaccacugugaaaggugauggugauaaucuuaaggagaacuugaucuugggcagggaagaauuuggguccaucagaccuccccccgccaccccccauuuccaugcuuaaaggacucuuguguuuuccugcugugcagguucagucccuaucacucuaaagccccacaguucccaguguucagucaccauccuggcccugccuguuuauauucaguuuccauacggaguaggugaguggagguccauauuggaugaaucugcaagugucacauuggaagggaaugugggaccacaauauugccauguggauugacuacccuaaaauguguccccaagucugccaguccugugugcucuccaaaaucugucuuagaccccaucagugcugccauugucuguuuccaggccaagcccauaucggggcugaaaaggccaacccuuauuuccgaggaaccaagugcaguucccccgggaagagguugagguaagcuuugucuggugaggcaggugucagaccccugcagcagaaagcucuaguccuuaucccuggcgcucugccuaguucuauguuacaccuagaacaugcuucuuuccuuccgcccacuggaguggcuaacuuagccugccaagagucaccucugccuuggggccacucuugcuagagcuccucccaaaucacaccaaggcucucgugccacaguggggaaugcagauuccaguccuuuccaguccuuccagcuccuugcacccuugacuuggcaagcuuuaguuuacuccacucuuagaggaguuuuccuuccaaaccagcaaggcgcucaauagccaugcuguauggcauuagccugcuuaaccuagaaccauaugccaggugcugugggcauucagacucucugcuccauuugggggcucuuucugccccucacuauauacuuuuagcucuguaguugagcccucauauauucucccaguucugcccccccccccauucccagguuucuucugucccccaaauaagacacucauagucaaaggaugccaccacauucuguuuaguguuguuccacacagccucuggccuucuccaacaugggcuccuuccaccaaccaaggcuaagacauugaggccuagguaggaggauuagcagggggcuuccaagcccaugcccauguguauauaaucuauaauacuuauauauauuuauauagaauucucucuguaauauaugucauagacuccuuccugggccuggggugagaguuucacauuaagaaaacaugcuaagacugaccauaaaaauggguauuucucagaccuggaagacagagugugggauauauauggacaaggguaagaacuuguccuucacgauuccuuucuuaacacaaggaaaagaagggagguaugugggcugggggaggcaauggaagggaaggaauggaagguuuggauuuucauuuaauaaagucaauugaaaaugaaaguguaccccaccccuuaaaaaaaucauucagcaagagcagucucauucacaagaauauaaaaaacagcccugcuccccagcugcuguaaaacgugcugcacagccuuuaaccccaaaggaaaagcaacccuucccacccaccccuaacagccucuuccugcacaugccccaccccuccccuuaaaguaggcuagaagcaaaccccccaugcacccugccccagcaccagagagguggucccucccucuaaaaaaaaagaguucaaaaugguccugggccagcuccuugcaucuucucucuucagaguggggugggccucaccugccucuguggcaguaugccagcagccuggggaaaccaagucccugcucggguacaaacccuacuagguuucuucaggucuuuuguagucuuucaauggggaccauuuggcuuccuugaggaauggaaggaggaaagaaagcugcuuuaguuuacucuuccuaacuuuccagggcccugagcaaagggaaccgagaugaauaaaccucucacuggacucgcuguccgcggucaccugggggaagaauaugggggcagugagaugagacaaauguguugauagagcaggguagacaaggcaaagagacccugggaauagauuagcuucaacaugcaaacucccaggaggcuaggacaggaggccagggguuaggggcaguugccaggguuggcaggcuagcccuuccuaguccuagaaaugagguccugauaagcuaaaccacaacacauuagcaaacacgagguaucucuucucccauucaggcagcauuagaugagcuaagugacuguucaccuacuuuggcucuccugguuuauucccauguuccuacauuaagagaccuuaagaucccaugcuucccccuccccugaaggaugagggucaccuacucugguuacaguucaguguaugaaugugguacaggacagcaucacagaugaacagaaucacucuagcggugagccucaucauuuugauggguaagggaguaguuucggaccccugacauuauaguaggacacaaggccuugggacuggagccaugaauagacaggaggaaggagaaaaacacggugacaagcuugggcaucuccuaucaaaacucugcuuaugccaaaggccagauuggagauguggcugcugcagcacccucauaacaauacugcacugacuugcuguugcucccuguccccaugguccacaccaaaucaaaggaaaggagguauggacaggcaagcuuagguaucaccacagccacuccuauaaggaacacuggauugaggaccccugggaacagcugacaaaaaacagaagcagccaguguccacccuggcccucagccagccacccacccaguccagccaaggcagugacagcaccagacuccccacuccacucugcucaacccugaguccccaagaaguuauaaaaauguagaaaaggcaaagagaaaaguguaaacagcuccagagaauuugggaagguagaggggggcccagcccucaugcuuccccacggauggggacacugcauccuaggucaacaauuugagacgcuuccccuccugggggcugggugccagaugaaagaaggcagaaagagaagccagaucuggaguagccaaccccagugggcuuaaggucccccuuccagccacaggacauucaaguggcuguguuuauucuuugucucauuggugacccucuugucucugaguaggccuugggacaaagaaucauaccaugaccccugucaaccccagcuccaugucuaccucacuuuuggcuccugaucucaaaagccaagauugccugagcugggcccacugucuaugcugaacacagaaggacccuucaggccacuccuucaggcagguauucugcuguuccugccaagccauguccaacagccccugaggccugcuucccacaguagggaugcacuggugccaugggcagagagaacagaaccaggaaagcagagugaaauggagaaaagaggcauucggacagcacagccaaggcuccuggaagacgaaaucggggguguaaaaacugagauucaguguucagcgcgacgaaccugggcauggacccaagagccauagccauggcucaucucccaccacccugccaccuaauugucugggucucaguuccuggaaugacggguuucuggagugcgagcccagauaaaacccccugcugguccuucacuugccagggcgguaacggccuggugaggacuggaagcucccaguucccugcugucuucugcccggguuucaucugugcugcuggagcuugggaggguauggguugcagccgugccccucaggucagaguggggugggaagaagcuaguuguuggcauccccuuccuccucaucaaaggacugcacaccugaggaugugacaucagacaccuuccggcugagagcaguggacaucucuggguccucucguggggaaagugacuccagaucccggcauccugcaucuucuuccuccucaggggccaguggucucuucucuuccucuacagguccccuggccaguuccaccccaccaaccucugaugcccagucagugucuacccccaacaaagguggaggcuccugagcagaguauccugaagcagguugggaaggccccaugucaugcaggcucggcugugagucaucaaaugcagggccaagauaggauccgguagcuggagaugcaaugagggacugaucacuugcuucccaggcgucagaugaccccagacaguacauccccugugacacguaggagugaggccauccauccauuggggcuugagcuagugcaucuguaaacagaaggagcaggcuuggaggagccacagaacacucaucaugggcaguaaggggagcucacagaacuguccuguuguuaugacacuaaugcagaggcacuggagaagcugagacaaauggaaaacuccuaaaaaccagggacggguagagggggucuacauagcugagaagccucuuaggccccaaggcuugacucuagaaccauuucucacccugacuuuccaucagcuccugguaguugucacuguaguugcaguccaguggcuccuggguagaauugacacucauguccucaccauccauggaagaccaagccauaaguguagccucagaaauagcaaacuguuccaugacaccuaugagaaaaaaaauguaauuuuauuuagaguccucagcccaacaugcuggcucauugccuuuaaccccagcacucaggaggcagaggcaaguggaucuuugaguuugaagcuagucuggacuauaaagcaaguuccagaauaaccaggcuacacagugagacccugucucaaaaagccaaaucaaacaaagaaaagagcccucuaauagcccuuagacccaugcaagggauauggagaaaccuauugcugcaugguucaguggagguaaaauauaaaccauguaugaaaucauuuaagaaaaguuagcagaaacaagugaaguaaguuuuaauaaaucuaauuuaaauauaauauauaugauucucuuuuaacauauaaugaauauaaacuuuuuuugguuuuucaauauaaacauuauuaaagagcuaucuuacauucuuaauaugaaguagacagugacuacucuauuacucugaaauaagucuagaccaugggucuuacuuaggauuccuagcuggggaaaggagggcuuuucuggugaaauaaccugggggggauuaaauguaaauguuccagaaguuugucuuuggaaguuuuagaauuugaacagaagagauggcuuauggguaaagaguuaacugcucuggcagagggccugaguuugguucugaggacccacaccaggcaacucagccuguaacuccagcuucgggggaauccaacagccucuaaguccucuugcacacaugugaagcacauaaacuuaugcaggcaaacauaagaacuuaaauaaaauuaaaaaaaaaaagaaguugaaccuaguuuuagguggucuaggacauucaagaucauagaaagacuccccaagggagcaucagguaaaugcggguccccagucguagaaggggcuauaucagacuagaagaagggagggccuaaccaugagcacgugaggaugugaguauugcagaugccuguucuagucagagccaugaauaagcugaagcucucguugcuaucaccuuguccucccucuguccuccacgacuauaacccagccccacucggacuuccuccgccauccaucacccacaccaacaacacuaaauccuuccccucucuucagaccuaccccucuucuuggguaucuucuugauaccugcugacaggaucaauucacuuuuguaugcacaccacauacuugucaucagaccuauuccacuucccuggaaccaaaccacuguccccagggccauucccuuaaucaugcacuagcugucacaguaaugaguacaguaagucaauucaugaaaccaaauguugacgagcauggccucaagaaacuccccaggccucuuuccuuuuuagaaacaaauacaagcagaguuauuugaagcccaaggcccccguguuuuucuucuauacuaagagaggccugggggaagacaguaccauaccagagaaaagaaaacaucugggacacacagccuuacaaauuucaccagagucccauuuucuaaggcuauaauaaaaaauauauuggagggcauuuauccguauuagccagccccaaaagaaaaaccaaaauaaauaaauaaauaaauaaauaaauaaauaaauaaaaaaaaugcuugagaucaaggcugguagaaaaaugugugccuaugguccacaugcagaaagagaaagacaauuuugccaucagggagcagauuagaggggucagucucugaccauccaaacaacagugaacuaucauucgaaggcuugagauguugggguagaaguaccugcuaggaaacgugccuccuucucgccaucacugaggucagaguaggcgucuguaucccugcgcacagccucauggcuauguuguggcugaauuguuggagccuucccccagcccugccacucaaucaugugggccacccggccuuggcccauggcgguaggcuuugucacaugguccuucaugcuccucgagaucccuaugaagucagacaauacccauagccuucagaauaucacacaguacuuaacagauucugcagucaucccuaccccaggacccaugggauuccaugcacuagggaaaauauccccuaguagccugugggugacacucaggauuggagaggcuugacauaaaaccaggugauucggaguugugggcaugaaccccaucaggcuuaaggaaaagaggaacaaagaggaaccugacagcagucccaguuccagguuuggagucucaccugagaaugaugacuuggccagggccccaaugccauaggcauuagaguuucgcuuaagcuucggaaggauggaagugguguccuccauggaaagcuaggacagggaagguaagagaauaggcagaggaauaagaaggcucggggugccuuacauacagaauagaguuucuggcucccaggaagauagauacccaaggcagcaaucgacaaagaaaaccaagggaguauauaccugguacauacugggggaucagcagaauagccugucuauagaaagucccagaacaaaagaaaagaagggucaagggagauugagaagggcuagggguagcugcacucacauugaugccgucccaggagaaaucuguucguguuugcuguaggagagaggagaggggaugguaucugggcaccucuaguaacgcaaauaauccugccuuccucugaggaacuuccagaugugcauagagaggcagaccuuccagagacugagaaagaccucaguguggagcauuugguguguguuuuagggaagcagggggaucuaugaggaggacuccccgcuuggggcuuuaugggaugaugaaaugggugaagcagcuaggagcuugggggaggugauuguagaggaugggcuucggaagcauccagccuuaccucugucgaaggccgauggagacugcugccaugcagcgagcuggugcuguccauguugaucugaucaacauccuugaggccuuuccaguccacggcaaucacuucguucccuaaagcagccagaagauuaguuucuuaccuucauuucacuggcuugcugcuucccuuuccauaaaagguagaggccacacccuaggguccagccccuccuccuccacccucaacaccuccgugucucccaaugucugcuuccuacuauccauuuccuucuaugucuaccauucccuaauuucuggagagagaaauaauaugugaaaugaaacacucauuuucagcucaguggggaauagcauacuuagggaaaaaaaagcuuucuggccuuuucugguguuguuuacacagagagggagggagucaaagaccaagcuguaucaggaaaaccauucuccauucugugcugagcaauuguugagauugucuuuauuggauccagacugcucaucaauuacugcccuaaaaacaaggacacagcuuucuaggggaaccuacucgacuugauauuugagggaugagaggaaugaggcuucccccucccucaaggccuuccuaagcggcaggaacuugguugacaggaugauacuggggauagaggcagcugggaggugaaaacuuaggacuguuucccagagagccagagggcuccaagaugagauggaugcuuugagcccaauucucuugggggacagggaauagauucaggaaauagagauaguaacaagaaacaagaggacuucauaauuucagagcuaaaagaacagaaauuuaaggugagaagacagaaaacaauggcagagguggacaggacacuuugagaacuggugaaaaagucgggaaccaggagggagauuccugaccuaagugcaagguuuccucuguaacucuuggggaagaauuccuugaguauuuacagagagauucaagaauaaucggguggcagccauccgcccuugcuuacaugaacuuuugcuuuuuggguuuaggaucauagguccccccccccccccuuuuuuuaaagaagugcacugacuaggucuugggcaggaagaagcauccagcaugcagcaauagaacuggcgacaaacaaaggggauggcggucccagggacugacagguagggcugggcugccacacauccaaaguuguuaugccuucucuugggaucuugugaaacgaugagagacaggacuaggaccuguggcuaggucagaaagacaucuggaccuaucaguaauggggcaggcagagcaagcucucucggagaagagugggagcgaggggagggaggggguggccuuugaggaagagggggagcugagucagagccuuagggggcagggagauggaggggaggagaacagggaaagagguaaaagcagaggagggucuccauggaaauaaaccgggucucagaaaucaggcuuccggagaguguaguuuguuuguaauaauaauacgaauuauucucucagccugaggucacuagggcguguaggcgggagaaauugggaguuaggaaggggaaaauugggggguuugggagaggacuguacuaauguguucagcccuaaaguggaauggaugcguaggguggggguagggggcgguaguaaggcaggggcuggaaggagaggaccauuaaggaagcgccuuucuucccucccccugccaaagguaaauaaaaagccggcccugcuccgccugcccccgcugacaggugcaggcgggucccaggguuccuaggcggaccccacccucugggaagcggacucccgaccucucucggggagguaaaccuccaccuccucccugaguccacggcucuuccagagcaccccggcccaagaccauucccuccaagcguggaacccauucccucccgguggcacacgcucuucccgcccccgccccagagggaaaaugcacgugaacaaagcaaaucggggggaggcaggagcgacgggaaaaggcuaccaagagggaaaugguugggggcaaaacacacaugccauauggagaagagggugaagaugggagggggcgugcggaagaaagucagggaugaggcuggagaggagguucugagaagaggggcugcucccgaaagaagggcucggggaggcucuggcuacagcagaguagacgcgaauggccugaagguggagggauggggccaucgggaguagggaacagcgacugagccgcgaaggaugcuguggagaggcuaccagggaaggaccgcgccugcgggagggcgauggagagaaggcuaugagcugagagggauggaagcccuggaggcgcgagggcacaaggauagagggaccuuagcggauggagggaaaguaaaggcgcgaggcagggccgggcgggcgcggagggagguccccaggggcaaggauggggaugggggagggggccggaggagcgccccggggcgagcuugccccugacccgcgccgggcugcgguacccacccacaguccgcgagccgaugcagcccauggcuccgggggccgccgggucccggcccucaccgacucggggcccucgccggggggagcaccgggaaccgcgccgccgccccagccgcucugcagcgccgcggcugucuccgcucggcuccgcuccccccuccccucuccaucccuccccacggcagccuccgucgccgccg

SEQ ID NO: 2946 - RNA, 10464 nt, Mus musculus
cggcggcgacggaggcugccguggggagggauggagaggggaggggggagcggagccgagcggagacagccgcggcgcugcagagcggcuggggcggcggcgcgguucccggugcuccccccggcgagggccccgagucggugagggccgggacccggcggcccccggagccaugggcugcaucggcucgcggacuguggguggguaccgcagcccggcgcgggucaggggcaagcucgccccggggcgcuccuccggcccccucccccauccccauccuugccccuggggaccucccuccgcgcccgcccggcccugccucgcgccuuuacuuucccuccauccgcuaaggucccucuauccuugugcccucgcgccuccagggcuuccaucccucucagcucauagccuucucuccaucgcccucccgcaggcgcgguccuucccugguagccucuccacagcauccuucgcggcucagucgcuguucccuacucccgauggccccaucccuccaccuucaggccauucgcgucuacucugcuguagccagagccuccccgagcccuucuuucgggagcagccccucuucucagaaccuccucuccagccucaucccugacuuucuuccgcacgcccccucccaucuucacccucuucuccauauggcauguguguuuugcccccaaccauuucccucuugguagccuuuucccgucgcuccugccuccccccgauuugcuuuguucacgugcauuuucccucuggggcgggggcgggaagagcgugugccaccgggagggaauggguuccacgcuuggagggaauggucuugggccggggugcucuggaagagccguggacucagggaggagguggagguuuaccuccccgagagaggucgggaguccgcuucccagagggugggguccgccuaggaacccugggacccgccugcaccugucagcgggggcaggcggagcagggccggcuuuuuauuuaccuuuggcagggggagggaagaaaggcgcuuccuuaaugguccucuccuuccagccccugccuuacuaccgcccccuacccccacccuacgcauccauuccacuuuagggcugaacacauuaguacaguccucucccaaaccccccaauuuuccccuuccuaacucccaauuucucccgccuacacgcccuagugaccucaggcugagagaauaauucguauuauuauuacaaacaaacuacacucuccggaagccugauuucugagacccgguuuauuuccauggagacccuccucugcuuuuaccucuuucccuguucuccuccccuccaucucccugcccccuaaggcucugacucagcucccccucuuccucaaaggccacccccucccuccccucgcucccacucuucuccgagagagcuugcucugccugccccauuacugauagguccagaugucuuucugaccuagccacagguccuaguccugucucucaucguuucacaagaucccaagagaaggcauaacaacuuuggauguguggcagcccagcccuaccugucagucccugggaccgccauccccuuuguuugucgccaguucuauugcugcaugcuggaugcuucuuccugcccaagaccuagucagugcacuucuuuaaaaaaaggggggggggggggaccuaugauccuaaacccaaaaagcaaaaguucauguaagcaagggcggauggcugccacccgauuauucuugaaucucucuguaaauacucaaggaauucuuccccaagaguuacagaggaaaccuugcacuuaggucaggaaucucccuccugguucccgacuuuuucaccaguucucaaaguguccuguccaccucugccauuguuuucugucuucucaccuuaaauuucuguucuuuuagcucugaaauuaugaaguccucuuguuucuuguuacuaucucuauuuccugaaucuauucccugucccccaagagaauugggcucaaagcauccaucucaucuuggagcccucuggcucucugggaaacaguccuaaguuuucaccucccagcugccucuauccccaguaucauccugucaaccaaguuccugccgcuuaggaaggccuugagggagggggaagccucauuccucucaucccucaaauaucaagucgaguagguuccccuagaaagcuguguccuuguuuuuagggcaguaauugaugagcagucuggauccaauaaagacaaucucaacaauugcucagcacagaauggagaaugguuuuccugauacagcuuggucuuugacucccucccucucuguguaaacaacaccagaaaaggccagaaagcuuuuuuuucccuaaguaugcuauuccccacugagcugaaaaugaguguuucauuucacauauuauuucucucuccagaaauuagggaaugguagacauagaaggaaauggauaguaggaagcagacauugggagacacggagguguugaggguggaggaggaggggcuggacccuaggguguggccucuaccuuuuauggaaagggaagcagcaagccagugaaaugaagguaagaaacuaaucuucuggcugcuuuagggaacgaagugauugccguggacuggaaaggccucaaggauguugaucagaucaacauggacagcaccagcucgcugcauggcagcagucuccaucggccuucgacagagguaaggcuggaugcuuccgaagcccauccucuacaaucaccucccccaagcuccuagcugcuucacccauuucaucaucccauaaagccccaagcggggaguccuccucauagaucccccugcuucccuaaaacacacaccaaaugcuccacacugaggucuuucucagucucuggaaggucugccucucuaugcacaucuggaaguuccucagaggaaggcaggauuauuugcguuacuagaggugcccagauaccauccccucuccucucuccuacagcaaacacgaacagauuucuccugggacggcaucaaugugagugcagcuaccccuagcccuucucaaucucccuugacccuucuuuucuuuuguucugggacuuucuauagacaggcuauucugcugaucccccaguauguaccagguauauacucccuugguuuucuuugucgauugcugccuuggguaucuaucuuccugggagccagaaacucuauucuguauguaaggcaccccgagccuucuuauuccucugccuauucucuuaccuucccuguccuagcuuuccauggaggacaccacuuccauccuuccgaagcuuaagcgaaacucuaaugccuauggcauuggggcccuggccaagucaucauucucaggugagacuccaaaccuggaacugggacugcugucagguuccucuuuguuccucuuuuccuuaagccugaugggguucaugcccacaacuccgaaucaccugguuuuaugucaagccucuccaauccugagugucacccacaggcuacuaggggauauuuucccuagugcauggaaucccauggguccugggguagggaugacugcagaaucuguuaaguacugugugauauucugaaggcuauggguauugucugacuucauagggaucucgaggagcaugaaggaccaugugacaaagccuaccgccaugggccaaggccggguggcccacaugauugaguggcagggcugggggaaggcuccaacaauucagccacaacauagccaugaggcugugcgcagggauacagacgccuacucugaccucagugauggcgagaaggaggcacguuuccuagcagguacuucuaccccaacaucucaagccuucgaaugauaguucacuguuguuuggauggucagagacugaccccucuaaucugcucccugauggcaaaauugucuuucucuuucugcauguggaccauaggcacacauuuuucuaccagccuugaucucaagcauuuuuuuuauuuauuuauuuauuuauuuauuuauuuauuuauuuugguuuuucuuuuggggcuggcuaauacggauaaaugcccuccaauauauuuuuuauuauagccuuagaaaaugggacucuggugaaauuuguaaggcugugugucccagauguuuucuuuucucugguaugguacugucuucccccaggccucucuuaguauagaagaaaaacacgggggccuugggcuucaaauaacucugcuuguauuuguuucuaaaaaggaaagaggccuggggaguuucuugaggccaugcucgucaacauuugguuucaugaauugacuuacuguacucauuacugugacagcuagugcaugauuaagggaauggcccuggggacagugguuugguuccagggaaguggaauaggucugaugacaaguauguggugugcauacaaaagugaauugauccugucagcagguaucaagaagauacccaagaagagggguaggucugaagagaggggaaggauuuaguguuguuggugugggugauggauggcggaggaaguccgaguggggcuggguuauagucguggaggacagagggaggacaaggugauagcaacgagagcuucagcuuauucauggcucugacuagaacaggcaucugcaauacucacauccucacgugcucaugguuaggcccucccuucuucuagucugauauagccccuucuacgacuggggacccgcauuuaccugaugcucccuuggggagucuuucuaugaucuugaauguccuagaccaccuaaaacuagguucaacuucuuuuuuuuuuuaauuuuauuuaaguucuuauguuugccugcauaaguuuaugugcuucacaugugugcaagaggacuuagaggcuguuggauucccccgaagcuggaguuacaggcugaguugccugguguggguccucagaaccaaacucaggcccucugccagagcaguuaacucuuuacccauaagccaucucuucuguucaaauucuaaaacuuccaaagacaaacuucuggaacauuuacauuuaaucccccccagguuauuucaccagaaaagcccuccuuuccccagcuaggaauccuaaguaagacccauggucuagacuuauuucagaguaauagaguagucacugucuacuucauauuaagaauguaagauagcucuuuaauaauguuuauauugaaaaaccaaaaaaaguuuauauucauuauauguuaaaagagaaucauauauauuauauuuaaauuagauuuauuaaaacuuacuucacuuguuucugcuaacuuuucuuaaaugauuucauacaugguuuauauuuuaccuccacugaaccaugcagcaauagguuucuccauaucccuugcaugggucuaagggcuauuagagggcucuuuucuuuguuugauuuggcuuuuugagacagggucucacuguguagccugguuauucuggaacuugcuuuauaguccagacuagcuucaaacucaaagauccacuugccucugccuccugagugcugggguuaaaggcaaugagccagcauguugggcugaggacucuaaauaaaauuacauuuuuuuucucauaggugucauggaacaguuugcuauuucugaggcuacacuuauggcuuggucuuccauggauggugaggacaugagugucaauucuacccaggagccacuggacugcaacuacagugacaacuaccaggagcugauggaaagucagggugagaaaugguucuagagucaagccuuggggccuaagaggcuucucagcuauguagacccccucuacccgucccugguuuuuaggaguuuuccauuugucucagcuucuccagugccucugcauuagugucauaacaacaggacaguucugugagcuccccuuacugcccaugaugaguguucuguggcuccuccaagccugcuccuucuguuuacagaugcacuagcucaagccccaauggauggauggccucacuccuacgugucacaggggauguacugucuggggucaucugacgccugggaagcaagugaucagucccucauugcaucuccagcuaccggauccuaucuuggcccugcauuugaugacucacagccgagccugcaugacauggggccuucccaaccugcuucaggauacucugcucaggagccuccaccuuuguuggggguagacacugacugggcaucagagguuggugggguggaacuggccaggggaccuguagaggaagagaagagaccacuggccccugaggaggaagaagaugcaggaugccgggaucuggagucacuuuccccacgagaggacccagagauguccacugcucucagccggaaggugucugaugucacauccucaggugugcaguccuuugaugaggaggaaggggaugccaacaacuagcuucuucccaccccacucugaccugaggggcacggcugcaacccauacccucccaagcuccagcagcacagaugaaacccgggcagaagacagcagggaacugggagcuuccaguccucaccaggccguuaccgcccuggcaagugaaggaccagcaggggguuuuaucugggcucgcacuccagaaacccgucauuccaggaacugagacccagacaauuagguggcaggguggugggagaugagccauggcuauggcucuuggguccaugcccagguucgucgcgcugaacacugaaucucaguuuuuacacccccgauuucgucuuccaggagccuuggcugugcuguccgaaugccucuuuucuccauuucacucugcuuuccugguucuguucucucugcccauggcaccagugcaucccuacugugggaagcaggccucaggggcuguuggacauggcuuggcaggaacagcagaauaccugccugaaggaguggccugaaggguccuucuguguucagcauagacagugggcccagcucaggcaaucuuggcuuuugagaucaggagccaaaagugagguagacauggagcugggguugacaggggucaugguaugauucuuugucccaaggccuacucagagacaagagggucaccaaugagacaaagaauaaacacagccacuugaauguccuguggcuggaagggggaccuuaagcccacugggguuggcuacuccagaucuggcuucucuuucugccuucuuucaucuggcacccagcccccaggaggggaagcgucucaaauuguugaccuaggaugcaguguccccauccguggggaagcaugagggcugggccccccucuaccuucccaaauucucuggagcuguuuacacuuuucucuuugccuuuucuacauuuuuauaacuucuuggggacucaggguugagcagaguggaguggggagucuggugcugucacugccuuggcuggacuggguggguggcuggcugagggccaggguggacacuggcugcuucuguuuuuugucagcuguucccagggguccucaauccaguguuccuuauaggaguggcuguggugauaccuaagcuugccuguccauaccuccuuuccuuugauuugguguggaccauggggacagggagcaacagcaagucagugcaguauuguuaugagggugcugcagcagccacaucuccaaucuggccuuuggcauaagcagaguuuugauaggagaugcccaagcuugucaccguguuuuucuccuuccuccugucuauucauggcuccagucccaaggccuuguguccuacuauaaugucagggguccgaaacuacucccuuacccaucaaaaugaugaggcucaccgcuagagugauucuguucaucugugaugcuguccuguaccacauucauacacugaacuguaaccagaguaggugacccucauccuucaggggagggggaagcaugggaucuuaaggucucuuaauguaggaacaugggaauaaaccaggagagccaaaguaggugaacagucacuuagcucaucuaaugcugccugaaugggagaagagauaccucguguuugcuaauguguugugguuuagcuuaucaggaccucauuucuaggacuaggaagggcuagccugccaacccuggcaacugccccuaaccccuggccuccuguccuagccuccugggaguuugcauguugaagcuaaucuauucccagggucucuuugccuugucuacccugcucuaucaacacauuugucucaucucacugcccccauauucuucccccaggugaccgcggacagcgaguccagugagagguuuauucaucucgguucccuuugcucagggcccuggaaaguuaggaagaguaaacuaaagcagcuuucuuuccuccuuccauuccucaaggaagccaaaugguccccauugaaagacuacaaaagaccugaagaaaccuaguaggguuuguacccgagcagggacuugguuuccccaggcugcuggcauacugccacagaggcaggugaggcccaccccacucugaagagagaagaugcaaggagcuggcccaggaccauuuugaacucuuuuuuuuuagagggagggaccaccucucuggugcuggggcagggugcaugggggguuugcuucuagccuacuuuaaggggagggguggggcaugugcaggaagaggcuguuaggggugggugggaaggguugcuuuuccuuugggguuaaaggcugugcagcacguuuuacagcagcuggggagcagggcuguuuuuuauauucuugugaaugagacugcucuugcugaaugauuuuuuuaaggggugggguacacuuucauuuucaauugacuuuauuaaaugaaaauccaaaccuuccauuccuucccuuccauugccucccccagcccacauaccucccuucuuuuccuuguguuaagaaaggaaucgugaaggacaaguucuuacccuuguccauauauaucccacacucugucuuccaggucugagaaauacccauuuuuauggucagucuuagcauguuuucuuaaugugaaacucucaccccaggcccaggaaggagucuaugacauauauuacagagagaauucuauauaaauauauauaaguauuauagauuauauacacaugggcaugggcuuggaagcccccugcuaauccuccuaccuaggccucaaugucuuagccuugguugguggaaggagcccauguuggagaaggccagaggcuguguggaacaacacuaaacagaaugugguggcauccuuugacuaugagugucuuauuugggggacagaagaaaccugggaaugggggggggggcagaacugggagaauauaugagggcucaacuacagagcuaaaaguauauagugaggggcagaaagagcccccaaauggagcagagagucugaaugcccacagcaccuggcauaugguucuagguuaagcaggcuaaugccauacagcauggcuauugagcgccuugcugguuuggaaggaaaacuccucuaagaguggaguaaacuaaagcuugccaagucaagggugcaaggagcuggaaggacuggaaaggacuggaaucugcauuccccacuguggcacgagagccuuggugugauuugggaggagcucuagcaagaguggccccaaggcagaggugacucuuggcaggcuaaguuagccacuccagugggcggaaggaaagaagcauguucuagguguaacauagaacuaggcagagcgccagggauaaggacuagagcuuucugcugcaggggucugacaccugccucaccagacaaagcuuaccucaaccucuucccgggggaacugcacuugguuccucggaaauaaggguuggccuuuucagccccgauaugggcuuggccuggaaacagacaauggcagcacugauggggucuaagacagauuuuggagagcacacaggacuggcagacuuggggacacauuuuaggguagucaauccacauggcaauauuguggucccacauucccuuccaaugugacacuugcagauucauccaauauggaccuccacucaccuacuccguauggaaacugaauauaaacaggcagggccaggauggugacugaacacugggaacuguggggcuuuagagugauagggacugaaccugcacagcaggaaaacacaagaguccuuuaagcauggaaaugggggguggcggggggaggucugauggacccaaauucuucccugcccaagaucaaguucuccuuaagauuaucaccaucaccuuucacaguggugguaggaagaagaugaaguggaggccucuccauaucacauacacguccacucucugacaugggcccugugguuuuuaagaagaaggcauagaggggguuguu

SEQ ID NO: 2947 - RNA, 884 nt, Mus musculus
ccuaaaaccucaucuucagggccuuucucaguuugggguugcuaaacagcaggaugauggaguucaaaaagaugccuguguagaugauagccucucuggcccaauaguaacucugcaugcuuuuccuuuuuguacuagaaauuaccagggccaagaaaaaaaagauauaaaagaugaagaagaagguaagggauuucagagccaugguaugugccugaguauggagaucccaaggcccaggccuguggccccucaucuucuccacaugcugguacagugagaacaugagcacgauaacggacacuagaaacaggaagaaaggagugaaccacaugagcacugagugauacagguaauaguaccgauagaaguccagugacaugugaccaaaagugcaguuuccauggaaacccugggagauggucaucugauuggccaugaaguucccgguggcugaaaugacagcugacaggccaccuaugaugagagauacaaccagcagccugggaacuaacugggaaauccuccacuugagccaaaagaggacagggugggagaaagaggagaucuucacacaguagaagauggcaagccaggcaguaagccaaaaaaugagaguguuagugaaaucccagaggaugccaauaagguucgcuugguaacaaaaaucaaaggaggccaagagguuggccaggauggcgaucccaugcaagcagaaccgggaggaagcaagagaggccacaaucaugucagcugccgguaguguccgguuccucauccacucucugcccagcacaaucaucaugaagccauucugcaacauagaggccaaugacaccagguaaaagaugauaaugaagaucaauguggguguggagggcauc

SEQ ID NO: 2948 - RNA, 42127 nt, Mus musculus
cauugcuugcucccccuucucugccagugacuuuccacgucccccauccacugguccaccgccuauucccuugcaggccugaagcuucuuccccuuggguagcuuccuccuuugcuguugugccuccgaaucagcacuucagggaacagcgacgcagagugagucuggcuccgcgauagggucugcaccaggagaggccugcgaugacaaaggccacugccagaaggguggggugcuucgcggggaagggggcaggagguggcgagugccuggggcugcguggggggcuggugugggcaacucgggcgugcggagguggcugaugcauuccacauugagaccuuccucucugucucuuucugagcuuuccgcugcuuuagauaucuccuucagucuuccugcauuguuaucccuucgccagccaggaacccccucccagccguuucccauuuccuuauugagugguuuguguucagcagggagccuuugggauuugaugaaaggaaccucagagguugcggaaggagacuccacacagaauucuuuaagggccacagucccugcuuagccuccuuuacccgcccccagguaaaaguccucuccauguccuuuaagcacccaggggccuggaguauauuugcucugagaggugggugggaggaugugggcagggugcugcugaaauggguguggggcuucuggagaacgcaggucuggaccgccuucggccugcagcagcaggggcuuagauuauccaguuggcagauacacaaccccccaccccccgcaggccuucuggguuggcccaaccugaaaugaaggacaaaaauggaagagggggaaaaaggaucuugccaauuagacaaucguggaaacguggaggaagaaucucuuaaagagaugaaccaaugucucuugucuaugggcugacccgcuaaccauuuguccauucuccaaaggauuugcaaagugauugcguuucagcuagcucuucacucuguuuugcguugcuuuaaagacuuaagaauaaaaugaaugcuuaucauuccaaaguggucuaaucuacaagauagugaaauaaacgcuuggccgucuuguaaguaaaaaaauaaggcuugaauaccauaauggagggucucauuucugcccuucccugccugagacuuggcauccuucgcgauuuuccuuucaacuacgccguuuucauaguucuacucuuauguguaaaacauacauggguugcuuuaugauuuugucaugcuuucauucaugaauauuauccuguauauucuuauagcucuaggauuaauccuugcuuauacuuccuucauuuuuauuucuaauugguuuaauacccuauaguuauucuaccauugagcauuuagguuucucacuuggggaaauguauucauuuuuuuuaaugugacaagcuaucccaacacauaacaguauaagaucaauaauaaacaacuacaaagccacuucuaauauuucuuuaccaccugccaguuucuguggaucuagacuggagucucuggagguucucacacacuguaguaaagggguauuggcucagccugacucaagggucauuggaacuaacacaggacuguuguaaacuugggaucucccugauuugggccaggcaugucuuucucugcagugagggccucauuacaaaggcuugcugugacauaaguuuuugcuccuucuaccccaacccuagagugaggguuugccaaaagagagagaagaaccauauuacccuuuucuucucuaaucucaaaaauggcaucuauuuuugucacuuccauucuuuagaagugauugacccucccacccccacccuauauauacacucaagggguggauuucacaugagaauggacaccugcagacaaacauuaaaaugacuaccuaccauggcaaccacauaauguccuuuaacacccaugacuaugugugcaagugcuuuuuuacugugugcuuccaagaguagaaaaaauaggucauaggauucauaauauauucagcuuuaauagguuauuuccaagaucuuccucaagugccaaacuauuuggcacucccuccagcaaagggucagaaaucuugauguuccacaaaccugucauaacaaauuacauuuuuagucuggagaguuauguaguagucccauuccaguaggauuuuacuuagcauuuccaggcagccaguaagacgggcugccuuuuguauuugcugaucaaguauucagcuuucugucuuccuuucugauaccugauuuguacuuauucuccuaggaaguuguuuuucuguaccuaauugacucauuggagucuuuucuuuguacaauccaugucucagucaauaucuaagucauuguaugugcuacaaaugucugcuuccagacugcuucugagauuuucucuuuaucucuccaugugucucagugaaauuuuuacguuuaaguuacuggaacuuucguuuaucauuuguucauaauuguaucuucaagaaagaaggggaaaaaaagaauuguauauucaaggagugggagagaugguucaauggauaaaggcccuugcuguguaaauggaaggaucaaagcuggacuaccaagcucccauagaaaaggugggcaagugugguagccacaaauaauaccaauauaaagaggaagggauuucaccccucgccccacccucaaagcaagcuuauuagcuaaauuaucagauucucaacuuuaaguccagagagagacccugccucaguaaauaaaaugaaaauaauuucaucaauuguuucaguggcuguggaaagcauuguguaauucauugggcugaaauagcucagcuuuucauggcaauacuccccuugcugaaaauuggcaauucccagcauugaaagguaacacacaacccgcuguaacugccuggcaaccaccucuggccucugcaagugggagcacacauacaagacacauccacacacacacacauggauaucacacacaccaaggcacauacagagcacacaguugcauccuugggauucuaaaguaacuuauugucuuguguuccaaugguuuccaaugguuuugcauuuggcauucaggcuuaguccauaugaaaacggauuacuuuguuguuuauuccaugaagaucaucacuuguccccacaucacuggucugcaugaaucaaguuuuccauauguguauaaauuuauuuaaagcucccuacucucauuaguauacuuaucuuuauauauuaauuucuggucaaucaaauuugacauaauuaaauagccauuuuauuuaccaguaccugcuuucaaauuugccacaugaacaauaauauaaucuaaaaaucaugacaacaugaacaauaauaucaucuaaaaaucaugacaacuuuguuucuuucuuuaucugcagaucuuuaaucuuuaauucuguuuccuuccuuccugcuuuggcaaggcccaucuguacacugcuuagaaagguuuuauuauguagucuucaaaaauagcuucuaucgugguuaucagguaaauucuuuauuuggugaguaaguuugucauaagugaauguuucaucaauuguuucuguggcuauuggaagcauuauguaauccauggggcugagagaaggcucaaaaauugagaguauauauacucccccuuaucuagaauuggagauagcucacuacaggcuguaacuccagcuccaggggagcccacaccuugcaccucuguggaauucugcacucacacacaugcacacaaacacacaaaauaaaacaacccuuuuaaaaacaaaagguuucauguaacucuuuaucuucaaauauauuuugguggcaagcauagaauuuaacuucuaacaguaagcuagcugaagucucuagaauaucaguguaucucuaguguguaugucauggcauuuauuaauagcacaccgagacaagcauuauuuacauuuauguaagcuaguauuggucuauacuuaucgcuuucuguacuguucugaucugccauugguaucaucucaaaauagcauggguaauguuuuuuuccuuggcucuguuaaagaaaaucugcacaauguugcaauuaucuaauccuugaaugguaaaaccuucuggagcugaagugcaggggguuuuaggcuuguugguucaauuacuuuauuauagugaaugcuuuucuuaaacucgcuguaugcuuuuauuuguaaguuaaccagaauaaagcaacuucauuauuuaaaaauacaauuauaggguuauuuagguuuucuuauggauucaauuuugauaaauugugcauauguauucaguauuaguaaaauaaaaauaaaacccaguauuacuaaaaacauuaccaaaauucauuauuaguuuaaaucuuucuuuuuuguagaacauaaucuuaauauuuucaacuguuaauagucaacaaacagauuuuuuuuguuuguuuguuuguuuguuuuguuuuuucgagacaggguuucucuuuauagcccuggcuguccuggaacucauuuguagaccaggcuggccucaaacucagaaauccuccugcccugccucccaagugcugggauuaaaagcuugcaccaccacgcccagccaaacagaauauuuuuaagauauauuuucuuguuaugccucccuuuucauuucugauuuuguuaauuaggauacugucucugugcccucugguugguuagucuggcuaaggguuuaucuaucuuguugauuuucucaaagaaccagcuccuacuuuuauugagucuuuguauaguuccuuuugucucuauuucauugauuucagcccugagauauuuccugccaucuacccuuuuggguauauuugcuucuuuuuguucuagagcuuucagguaugcugucaagcugcuaauguaagcucucuccaguucuuuuuggaugcacuuagagcuaugaguuuuccucauaccacugcauucauuaugucccauaaauuuugguaugaugugucuucauuuucaauaaauucuaaaacaacucacaguagagucuaguaggauaccaauuccuuugaguuauuaaaauuaggauugaaaccaaauuuucuuugagcuaggaaggaauguauaguguuuaauuuugugaugccauauauauaccuuuaaaauguuuuauguucgaauccuaugcauccucaucaaaauuuugucuguaagaauuauugcaugcaguaccuuaugcuaaaauuuccccuuauaagguaaaauugccauuucuuauuguagaacuacaaaaauuugccuuguauaagauauuuuauuaguuaauuuuggugaauuggaugcaggaauccugaagagcuaucaaucuuacuuuaaaaaucaaaauuuaagcagggugugguaucacagguggcaaaggaaagucacuuucuaugguuuugucuacauagacaaguuaagacuacguacaaaacaaaacaaaaagcaaucaagaacaaaccaaggauauugugccugaugcuugccuuauuuauuugucuuucaaagacagauuuguuuauuucuaauaaaaaaauuagguauaaauuaccuaugauagaaguuuaccugggucagcuguacagcuuaacaaauuuuaucuuucuacauuaaauuuguuuucaaaauuucauacauguauacuacguacuuuguucauaacuaaagcauuccccucccuccaaccccuucugcauguucuccuuccaacuucauguguauguuuauagguacacacacacauauaugugugcauauaugcauaaaaauauguaagcauauguuaauggacuuuuucuuuuguuuguuuuuuucugcccaucucaaaggaaaguuaugaaucuaucuuuuuaauagacauaaauccucauuacucuuaaacauacuucuaauucauccaaguagauagugacaaacaguuuuugcagaaugacuauagcagucuagugucauaagaaaugugugucagucccaccaauugcagaucuuucucaccaguagauauuguaccacugucaugguuagccuucaaggacugacugaagugucuguugaagauuuaacaugcauuaaaugaugacucauuacauuaaacaguauuuuuuuuucauggccuuuuagauuuccuauuuuacaaagucuucagauguuuuguucuuuugaggguaagacaugguuuuguuguauucuggacauacauauggauuuuucauuguauuaaucuucuuccuuuugcuugccuuucacuuugauaaacuucuaauaaaaauaacuguuucacuuuacuuaauuuuaauuauauuuuuaaaaaauaacauacuuuuuagacaaagucucacuuuguagcccagguuggccccagauucacagcaagguugcuucuucagucuuccagguacuggccuuacugguaugagccauagcacccaguuaauaaccuuuaacuucuauaauuagagcuaagcccuuggaauuagggcuggaguucuguuuaagaaaacucuaguuccauaaaucuguccuaugcuuaguugcuuccuuaccguaucacacuguauguucauccaucuaugagggggaacuuuagucucuuuuucuuccugcaagaaaacuaaccacagguauucaacauugauggcauuaucuaaacuuacauugccacccaaagucucuacauucuugucaguuugaguaucugcaagugagcuuuggagggaaacaaacagaucccuaacaaugggauuggagucuacuuaacugagcccuguuuucucuuugugcuuguguuuauuuuuuuugcuuccacuggaaucaaguauuuuauaguguucuuccucuauauuacuuguauagaugugaauuguguguuuuguggguacaucacacaugagguaggggagcacauuuauuguaucacucuccaucuuauccccugaggagacagugacucacugaaugcagggcuugcuauuucugcuacacugccugcacuggugugacagauaugugcucugccaauccccccgccccagauauuuaagugaguacuagggauugaguucaguuccucgccauuggagagcaaguacucucagugacucagccaucgcccagucccuacauuauuuuugaauaacauaauuuuaccaguuuuaaugguaauuauacauauugcagcuugccacagucuuugucauugcaaauuauuacuuuuaccuauuuuaaaacaaaaaucauaauccaguucauuuccgugaaucuagucuuucagauguguuagucguauauuugauuuugcuuuauaccuuaccacaagaugugauauuuguuuauuuuuuuaaaagccaauacuuguguaccucuuacauaguuugcuccuuacaguaugcuguuucuucccacaaugugcuuugucuuucuaggauaguucugcuuaauccugaagagcuccuuugaguagcucuuguacuguauucugcuguucccaguuuugcccagacuauagucauccagaaaugucuuuauuuugccuuuaugcauagaauuguaggcuucagauuuuauuguuucuuuuguucaacucuauuaugcuauucuguucuugcuuucaucauuucuuuugaaagccagcuguguuuuuguuucuuggagaggaaagugucuuuaccucuggcuugucuucagaucuauucuguaaauuugguuuucagcagcugacugugaagaguguggauuuauuccucucuauuuauucugcucagggaauacagagcucuuuguguuuuaauguuuuucaucugucuuggguacuucucagacauuaauuaugaacauauugcuucuccuucuuuccuuucccauagaacaccaauuguaugcauuuguagcuucuugccaugucucacuuucagcucuuguuuuagauuuguuuuuaauggauugccuguauguuugcacauguggguguggugcaugcagaaaccagagaaagaggucaaauccccugaagccauguggcagugaacagccuugcugggacugaacuccugcccucuguaauaguaguaccagcucuuaauuguugagucaucccccaccuacuagaagguagguuuuuuaucuuuuguuuguuuguuugguugguugguugguuguuugguugguugguugguugguugguuuugguuuuaguuuuuuguuuuguuuuauuuuguuuuguuuuuguuuuuuuaucuaggcagcauuuucuacuuagcuucuuucaacuuuuuacugaguuuaagauguuguugaugaaaaauucuagauucuagcugauguuuuugccauccaagaacauuggagauagagguacaaaaauauuugagaacagcaauucucaacuuguggaucucaaccccuuugggcuucaaaugacccuuucauuucacauaagaccaucagaaaacacaguugauaacaguagcaaaauuacaguuauaaaguagcaacaaaaauaauuuuaugguuggaaggggucacuagaacauaaggaacuauaaucaagggucacagcauuaggaagguugaaaagcauugcucuagaaggaaacuauuaaacuuauuuuuuguuauuacuggcucacuucagguguaacuuugcagugaaaacauaaucuuuguggguaaaguguuauccuuacagauaaauuaugacuuuucuucuguguggagugaaagcacaacauguguacaaaagccauuuuguuguagcuugauguccacuaccaucuuuuagcuacagaaaugaaugacuuugggcaagauuuauuggagucuuugcccgcaaguaucauaggaaaucugcuuguaagaguuuuuauuuauucucugaaguucuauuucugagaccucucuuugaacuccauuuuguuuguuaaucuugaacuaaagagacugacagaagccuggguuauuuagcacuacggguggaaaaaaauguucaaauggggagaguuagaggaaagguggaguccuguguuuucugucccuggaggauuugucucuggaauccuuucaucaagggccuugaguuguuuauucuuuggaauaggcuuucuauguuuccuguuuuuguuguuguuuguuuguuugcuuguuuguuugucuguuuuugcugucuucagugggucuuaccccaaagauagcauuaagacuggaacagcugaucucucagcauuauguauuacaucuugguuuguuuaucucucauaucaucaucuugucuuccuuucuuaagauucauucuuuagaauuuucuuuaaucagaucucauaaauucucaauauuuguuggccugaaaaauuuuuuuaaaagauaguuugcuggcuguauauuccagaaaugccccccauauacucauaaggagugccauuauuggagguguggucuaguuggacaaaaugugucacugagaaugggcuucgaaguuucagaagcucaagccaggcccagugucacucucucuuccugcugccugccaaauguaaaacucucaguuaccucuccagaaccaugucugucuuuuucccaccaugacgauaauggacuaaaccucugaacuguaagccagccccaguaaaauauuuuccuuuauaagaguugggguggucauugugucucuucacagcaauagaaaccguacuuacuacaccuguuuuuuuuuuaauuuuguuuauguugaaauaucauuguauugucuucuuguuucugagaaaguugugugaugucuagcuaucagcuaugucucaaugaucccaacucuuuuuacccacuggaauuucucuuacucacccaucacaucagcacacugauuggugcuuuaugccuuuggguucacuaugguauacauuuguaaaaacaaaacaaaacaaaaaaaacaaaaacaaacaaacaaacaaaaccaucuacccucuuugaauguguuaggcuuccuagaucugagaacuggguuuuuuuuucaugaacucuagaaaaguaauguuaaucacuucugccaaaaguaacuuugguuuuuuuguuuguuugguugguugguugguuuuguuuuugguuuuugguuuuuuuaauuagguauuuucuucauuuacauuucuaaugcuaaacccaaaaguccccaauacccucccccccacucccccccagaaaaguaacuuugguauaauuuucucuaauauuuauuuagaggucagaccaaguacauauuaaauuuuuuccugugccuuccauaucuuuuauuccuuuuuguguuuuccauauuccuuugcuuuacucuacucuaaauccaguuuaauaauuuuuacuuaauuuuccucuguacuggauucaaugcaauaauuuacauuuaauuuuguuuauucuuccauuuaauguauucaacauuuuuauuuagaauuuuauuuuaacuaugccguuccuucauuucugauucuguuugauaucuuauaaguauagcuuuuuaaugcucauauuuguuuugaugucuccauucuuuucugucuguuaaaugugguuauuuuauguucucuauguaacaauucuccaaguucuaacuguuucugauacccugcuuuuuaugauuccuuuuaugguccuuugcuuccuagaaugucuauugacguuauacaacucuuauugugaaugccccuuuuguguggaauuuuauucucuguaguaauucuuuauauacauugaaguucacuuucuccagaaauuguugacuuucuccagaauuauuaguuucuacauaauucaaauauuaccagcuuuuugaauaauaauucaaaguuauuuuauuuucuuagacuuuuaguaaaaguggccaauauucagauuccaagucuaaaugaguaacugaugcaaguuuaauaugagucucaaagguuuuucccucuccuccgggaaaacuaagaugggcaaauugcaguaguuucuucuaggaauagucuucuagugagugagccuucaauuacaccauuuacaaaugggagcuugcucauaccauccuagccuggcuauacuaaaaucuucucuucauucguuauccaagguuguucaaaaacaugugaaagcucuucuuccacuuguuucucacaguguccccuaguuuuacuuuauuuuggcuuuguauauuccuuacuuucauaucauaaugacacauuuauauguuguauuuauaaucuuuuauuauugguuuaacaugggguaucuaaucaaauauaauuccagaacuaaaauaaaaauagaucccuuaaccuacuguuagcaaaauacuugcaagaaaauguauacaucugugaaauguagaugucuauguagcuuuaugaauuuuugcaaacuuaacacauccuugguucaguaauuaaauguuuaaaaauaacaagugaaacaauauaaaaaaauuaagagugagccacagcacauuuugggccauucacuaucuuaucuaaaagugaacauuauucuaaacuuuauucuuaaaguugacuuuccuuuuuuaaaucuauuagacuuuuaaaaaauguguuagaauugucucugugacaaauacuagcuagagagcaacaauuaaaaaagaggaauggcuuguuuaagcuggcgaauuucgagguuucaguccaugguagacucacuccuuugcuauaggcugagccaagaaugagagaccauagugauaaagcauacuggggcaaacuugcuaaugacauauuaaccaggaagcaaagaagaguaaaaagaaaagcucuggcacaagguaugucugaccacauagguccucauucagugacccacuucuucuaacuaagccauguuucuuaauagcccauucaauuuagagucugaagugagcaccuuuaugauuuaagcacagucauccaugaacugggaaccaagccuucaacuaaugacccuuuuggggugggcucuucauauguaaacuacuguacuguaaauauauuccuguaucuauugcugggaaaagacauuaugaccaagacaacuuagaaaacaagcuguuuccagugucacacuucuuccagcaagaccauauuuacaccaacacagccacuccuucuaauccuucucaaacaguuccacuuccugguuaccaagcacucaaauauaugagccuauagagucauucucauucaaaccaccacauuucuacagcauguaaucuguuacugcacuuggugacauucauccauauuggacucauuguugcagcacaauauuuauuacaaauauacaauaauuuauaugaacacuauuguugauaguauucagguaacagcuggaugccacagugcaugaaaaggcagggaaagaagaacugaguaucuuucaguuuuacaguauuauagauucugcuuaguguauggguuuuauauaaauguauguaugcaguucuuuuggguagagaccuaagcgugauuagcaaguaauagcauuuuuccaugucaaaguaggagcauaaaauuuucaaugaaaaaaaauugagagaauucaucaguguaagaguugagcuaauaccuuuaaagaauauuuuguaguuuggauuguuuauuuacucacacauggcagagcacauagacuuaaugucucaagaguuaugucagcgcuuucagaauuuugugacauugucccuaacucagagcuacggagggcaaaaaaaccuuaagcaaaacaaggaaacucaggaaauaagaaaggguauauaaaacuuaaaauugauuuaguagcauagacucugugacagaggaagagaaaagaaccuucuuguguguuaaagaaggcacagagaugccagaaagacuguucagugguuuaaagugcuugcuuacucugauccucugauuaguucucagcauccacaaugaacagcugacaaccaccucuaacuccugcucuggggaucccucuucugacuugcacgagcacucaaauauguacaggcaugcacuugcaaacccacucaauauuaaaauaaaaugaaaaaaguuuuagaaggcguuuggggauauaugaaggaggaaauucagaugaaaaugaacuuguagaacuucuacaucugacaacuguugguuuuacucagaaaugauucuauauacuugcuuccucaccuacagccauuuauccuuucuaucaauccaguggacaccaugugccuuagcuacuuuucuguugcuauuauaaaauacacugacaauaguaacuuaaggaaaguuuuguuuuguuucauuuuuguguguguguguguacaguuugagauuacuuauguuggggaagucacagcagcaguucguuauguuguccuagcaaucagcaagcaaaaacuggugaguguuugugcucaucucacuuucuacuuuuuauauagugcaggauccuggacuagggaauggagccucccauugugggagagccuucccacccuaguuaaccuaaucaagauaauccuccacagggaugccuggaggccuaucugucaggugauucuacuucucaacaagcugagaguugauaccaacuaucucacuguggaacaccaguauaugaccuggauaaaaugagaaaauaaaaggcaaacaaagcacagugguuaacuuauacuuccuccagauuggggaguuguuaugaagucuuaaauaaugcaaucugauacuuuuguacccuuuaaccauugaaucugcuuuccuguaaagauucaaucugggaacugccucuucuaccugguacuaaggaaauaaagacagagauguugaagggugggaggcuggagaauguguaggagcagcacagaccuccuucagcuuuuggugcauaaguggcuuucucccaggguucugcccuugcaaacacaugcugcauagacagacaagguucaagcagagcauaucacaaagccaagucauggcuauaaguuuggguguuggaucccauccucaauuuuaaaagaguuaggacuagaaacaaaauucaaaaaaccaugauacaggcuucauaaagucagcaccagaaguuuugccaggaauuuuuaauuuaguuuuuaauugauuagguuuauuuguuuucauuuuaaaauaauauaauuauugaaauguuaaugaagugcaugaaaaauaaguauugaaaguaagaauuacacaguuauaccagacauggugauacaugacuguaaucccaguaguuuggaggcugaggugggaggcucaagaguuguacaccagccaaagcuuuuuagcaauacuaauugggaggagggggcaaaacuuauaaguaauucacuuucuugucugaaguaacuaauucuaaugcuuugauacaaacuuucuauauaauuuucaugcuucuaguauaaaauuaaaacuauuuaacuauauuagaugauuagauguuuuuuuaaaaauaauauuuaaugaugugugugauuauaugcauauaauaauaugaucuugaaagggagagaaagggagacaagaaaaagaauaaaagaaagagagaagaaaaaaggaagagagaaaacagggaaggcagaaacagggguuggaagagaaacgaguguacuccagaagcucuuaagagcgucaauauauagagauacaauucauccuugaaaacaguuguguauuguuuaacauaaagacuuauuacacuggacaaggagggagguauagucuaacuucaacucuaggaggucagaagcaagucaaagcuagccucugcuacauagugacaguuaaucuuuaaaaucagucuuuccugcugcacuccuaggauaagcuccuagccuggggucuuaacuagaaucagaaacugacacuaagaaggaagguccugagcaaaccagaguaacugguggagcucugcccucauccugaaguggccaguuggcuccuggaaccagcccuuccaccuccaaccacccaccgauuuccuaggcuaucugcucuacuuccuugucacacaccucugcuggauagcugcccuuccauugggauggggcuaguggccuggaugagggaacugccggacccaugaagaauguuucuaaaacgauguuucuagaaccauaguauggcagggcacaggauccagguuaaguaagggcuucuuggaucugccguagccuggguggaagacugaaguugucuaaguccgugggagccuggaaugcuaacccagccgggagcucuggccugagggcuugcugggcccaggaagcugguuucugucaaaagaguggucugugguuucugccucucccacuuuuguucaauguguugauuuauuuuuuuccccuuucaaacuuaauuaacaaaagucuaauaauuuuugccauuagacauuuuucauuaugaaauauuucaaagugacaugaggaaaagguaauuuuucaaaugcugacauuuugucaccuuguauuccccacccaacccccacgacccuuuucugaaaccuagccucauagccccauccuuggagucaaauuggcguguauucuucccauauaauuuuuaccuuuuauauguauuuuuacauacacagcaugcauuuuaauucugaccuuugucuugccgauugcccccccccagcucccaacccccaaacucauuaagagguuuuauccugacaucucagaucagaaugggacuuaauaaugagcaugucaacagccuccuccuuuaggagcuaggaagucugggaccuggacaaaaaaagggguuauacuuccugccucuugaauggccuuuaccugguaggaccuggacucugcuuauuugauuuuuuuucuagaugaucuguuuacuaaauccggccacugagcucaucugccugaggcucuuuguguggcauucauaguauuuauuuuggaagaaaaucuauuaaaaggagauguggaaaggaaguguagaucacaacccuacuuggauucaaaggcacacacacaaaacacugaaucuugggcugucugaauguuuauuuugucagauauucacacaguuuuauuuaugucugguacucacuuaagaacaagaaucauaaaugaggaaaauaccuaauaaaaaauauuaaaaaaauaaaauaaaauaaaaacaucuucccauaaaaaaaaagaacaagaaucagcccaucuguuuaaacuuucuaucugugcuauagguguuuaugacccccccccccaccucccagaaaauaaaagaggcauagauugagugucuuaaaaccacacagcuggaaaagugcagcacuuuugauuugaauccgccccacugaugauauuauccuuugcauuuuaguugcuagaccuggcaccaucagcaguuggagucaucacacagauaggaccagaaaacucauaaggagaagucagcugauugucggggaggaaaaacuucccggaacaauguacuucagcuguauaguauucuuuugaaauguuacuuugaauuuaccagucacacacagugagaucaguaagguuauauacggucagugccuuuccagauuaaacaguauggauaguuagaaaggucucuuuccuuucucaucuccccuccaaaaggcgaaagcauauucaacaaucccugcaaauucauguguuucccugcgcaauauaccaaggucaaucuauccuaaacuuuacaggaauguagguucuguguaagcauagaauguaauaagucacagaaugaacaugccuugguuuguuuguuuguuuguuuuuauccuuuaccuuauuuguaaguagaaaaguuuuaauaaaaaugaccauccacacugcugggaugagaccuccucuaggggugucccuaauccaccucaaugccuugucgcuugagccaguuacacaaagaagcgcugucuauuggcaagcgccgccccucgggcuccuacuccagccgggaggaaguggggaggagacugacugggaaccccuccucuccucuggcuccguucuccuccccguuacgcuccaggcuuucggcggcugcucggaggcgacuuggugcuccgccgagaauccccuguucagcccuccuggugcgguccuagaagggccaacccagcugccugguggaaucgcaggguaaguggcccgcaggaacaguccgugggcaaaggagccugugaccaggacuggauuccggguuggaggcaaguggggcgggaagccagugcuacuccagggacguuagagaccugagagggaccugggcacugcgggccuggguguguccagaucugggcagagguguccuagggcuuccugccuaccuucucuuggugaauuugcucuguucugugguggcugagcauccuccucacacccccgaccuagcguucuuacugcugcuggccuugguuugacagugacguuugugugcuaccgcuuugugugggcgaguuccagacaggccccgcuagcaguggucgcaucuaaucuaaaaagcggcuucagaggagggggcagggcgugcuugucacacagguagcuggugauagagcaccauuccacgcuaauguuuauacaaccugacaaacaggaucauuaggacccagaucgcuagcccacugggcauuguucacagggaccugggguguggguguguuuagagagggcaguccugguccagaggccugagaauccgcagccgagauuuuccacuuggcugcccuccuccucuguuagccgaaccucccuccuccugcgcccccacccccugacgucacccacaugcucuaaagacuggccauuagaggaaaaggaaggaggagagagggccuucgccaggcuccugcguaguugugacugcccucggugguguggaaagaccuuuaucacccacuguauuuguuagaaccccucuggggcaagcugauggacuuacagcuagguggaugauggcagcaccugagcuucuaacggcaaaaggcgggucuccucacuccugggucagaauccucaguucccuuguucuuaguuacccaguggggaaagugaacuaaugugggagcaaacaaaaaaagaaaaaugaagaagcuagagggaaccagacccaugagagccagcccuggacuguaggaacgaguguggugagacuggaauauggaacaguaaaagccaaguuuuugaucuuacuccuguaagauaaagaggaaggucgaaagagggauucaaggugggggcuugagagauacuuucuugggagcguugauguugugaaucuuauauggaaguguaacuuuuuaacggugauuuuuaucguuuuauugucuauucuuccaugugcauuaagcauucuuucauaugugugaaugaaacuguuucuuaaguucaaguuaauaaggauguaguggaaagugucccacgauggagugcaaaagaaagaacugaguccauuugaauucugguuuaguagaaugugauggacauugugagaaaaaaagccaauguauaaggaaaaaaacaaguuucuuaguggaaaaggacauggaaaagagaagacacaaagaauuguguuucugauguuaaggcaaggucaggcuaggcuagcuguuacugagaaguauccccugauauacccauacccucacacagucuuucagucguacauccauggaauacaucaagggaaugaaaugcauucucugaucucauauauguaagucuguguuucaaggccuggaaugcaagcagugaggaaucccuucucccaagauggccccaccuccccuuccauaauuccuucacaggaaaaaccauguugaagucuacaggacugcuuugugauaggauuagaaugucugcuuucuccccauuuuccagacugugccuggaauaccuuuuccgcugaaagagaacguggcacguucaaagugggcuacgguuagcaccaacaaaagaggagagcaaccaugggggaacaauuuaaaggaugaaaauucauaugaagacaaaccauuuaccucuuccuuuccuaaggugaugaggccgcuguguuuaacuguggcuuccacagagcuuuuaugaauagaacaaacaaacaaacaaaaaaaauccuggaacuuagcaaauacuaacauauuugacauauacccaaggaccguacucuuggguagagcgauggcucagugguuaagaguauuuugguuugguucccagcacacacauagugacucacagccaccucuaacuccaguucuggagagaguaacuccuucaaccucuguuaguuccugcaggcauguggucaacauacauacuacucagauacauguugucauaguuacgguuacuauggcuaugaugaagcaucaugaccgaaagcaaguuggggaggaaaggguuuauugggcuuauacuuucaccucguagaccaucacugaaggaaaccaugacggggacucaaacagggcuggaacuuaaaggcagaagcugaugcagaggccauggaaaggugcuguuuacuggcuugcucaucuuguuuucuuauagaaccaagacaacuaugcuggagauggcaccacccacagcagcugggccuuccccuaucaacgauuaauuaagaaaaugcccugacagcugcaucuuacggaggcauuuucucaauugagguucccuccauucggaugagacuagcuugugucaagcugacauaaagcugguuagcacacauguacaugcacugcacguaaaauaaauaaauauuuuuuaaaggacucuucuuuaguucugcauuuccuguacugcgauccuagagucaccacuuaccuaucuaugagauauuaagcaagggacaaauucccugaccacugaaaagaucugggguuuucuccuccagaaaauuauacaauggggauauugaugauauauauacccuauaaguuugucagaauuuaauaaauaauaauguguuacaauaugggaaacuugauaagguguugcugugacugucauuacuacaguugcuacacuguuaucauugccuuaaccacagaaaauauguucagaacuuacacaggggcuugaaauucucacugaaaguauuaucuagaucauucuaagacaccaaauggguuuaucucaugcacacacagucuagcuaagagaacaaccaaugaggcagauguaugaauaugauuauucacaacauggaaagcauugaccaauauacaggagucugaugggcagcucuugagagaauguguauuagugucaggagaugugcaacaagaugucauuugguguacaauggagugucuagggagauuaugggaaaaaagugugugaucgaauuucagauccugaacucugauacauagcaaugauccuaggaaauucccuugucuuugaucuauguccacucuuguguuucacuuaccaguguccauuuguaguuuuguaggguguucagcauccguaaacauauaucuuuaauucugccuaucuuauuacaaaaaaguaugggugggucaaucaauuaucuucauguucuccuucaucuucccuaucaucucuccucugucuccucuuuuucuuaguucauccuuugaugauguuaauuauauuuccuauugcuugacucauggcacugauuaauuuuucauagaaaaugucucgaauuuucuccucuguguacaucucaaccuagaacgguuguuuccauagacagaaaaguagugguggggaugugagagaaagacagaaaaggaguuggaaauagaagcagagucugcccugaguaguaguuucagggaagaugggaggaaaugggaaucagcuguaaacuugcuguagcugacacccugccauggggaaggucagacugggagaaaggagucagguuuucuccaauggauacaggugacacucuguggauuucucuuuaaggacaaaauaauauuagaguucuuucagaauaauaaagcuggagagacuuggacaccagauuccuucagucuagacacgaauuacuaaagaaccaaacuggguuccucccucgcagugugcugguagauugucagugaggacauugacagggcuugugacggaaaugagaugaagagggagaguggacauuacaguggcugugcacagugugcuauccuggcuauuuguggacaucacaaagggcgaggauaaguuucucacuaacuaucuauugggugguugguuguauucuuuagcuagucucugagguggguaaaaaaguuagcucugguauuuaacagcugaaagcaucuguuuguguaauuuuacuuagaaaagcuucuucuccccuugagggaagauuuuucuuuuuucugaggcagcaucuaauguagccaaaccuggccuugaauucuugacagaccggaccacuguaucaggucucagaggcagccacauuacaugacaacacuuaaggugguuaacauaguaggauuuuauuuccucccaguuugccucuaucugaggcaacgugcugagguuucagaagugugccaccauacccaccuguaauuuuaaggcuucuguaaguaaaugacaugcuacaggcaguagcugcucuguuucaauagggacuugaguuuauuaacuauaugggauaaaguucuuuccaucuauggcuguggaaguuguagcccacaggccaaggacuuucagggcuccagagagauauguaaaaauaaaugccacagccauuaaaauuggucuuagcauuagcauuaauauuagcugcaaaauaggaaaacuaugaaaccacauccaguaaacacucaacguggugguuguaauaacgggcaacagguuagacuacuuugucuacuuugugaguauuccauauuacucacaaauauaaaguaaaggauuuacuuuuaaccaaacacauaugugcaaauguaugguaugugcacaugacugaacccugcuggaagacuggagaagagcauggaggggauacucccagggaagaagcagaggacauuuaagagcugaugcacacagguacagcuuccucagcugugucucgggugccuggaagaaucugccguaauuucauagcuugcuacuuucugcuucuuauugucugggauaugguauucagccacggagagcuuucauguuccucuuauucaguuugugacugacccaagccagggaucccugaauauucagccuaagauacuaaugcuccaaaccgagguuaauaugacuagagaugaggccaagguggaugagaguagugugggaggagagccaucuacacaacuguaacauucucaaggcauccauagcaaaugaccacaauuacagugguucaaaaugaugccauuuuuucccuccaaguucuagauucucaaccuguggguuauaacuccuuugagaguauaucaaccuuuucuccggggucacauaucagauauccuacaugacagauauuuauauuaugauucauaacaauagcaaaauugcaguuaugagguagcaaugaaaucguacugaauugaaagauuguagcaucgggaauguugagaacagcuguucuagaggguuagaaguuuaguacucagacuugagcagugcugauuucuuccagaauuucagagguagaguuuuuccacgacucuauuacagcuucugaguuuugccagcaaacccugguguuccucggucugcagacacaucacggcauuccuggucuucgucuucugauggcauucuaaccuauguuucagucucucaguuuccaaauccagcaugauguccuguuaacucgguaacaucucccuucagaaacacuauauccaaacugucguaaaagauagcagguuaggaauucaaacuuugccucugggagacacaauucuaucauuauuucuccucucuguguugcuuucuucuguggugguauagaauccuagacucucuaaugauggcaauggacuaaaugcgguggguacugagucuuaucacacagugaugccauugccauaccugauggaauaaacaccuuggucaguuuuuuauuguuuaaccauucuuugcuaaauggagucuuuuuuuuuuuccucuacagaaaccaacagaaccauggcaacucccucugcugccuuugaggcccuuaugaauggaguaacgaguugggauauccccgaggauucuguuccaugugaacugcuucuuauuggagaggcuucauuuccuauaauggugaaugacgugggccagguccucguugccgccucuuccuauggcagaggccgcauggugguagcaucucaugaggacuucuugcuggaaagccagcucuuugucuuucuugucaaugcuguuggguggcuucguuccuccccuaacucagccauuggugugcacucaucuuuagcaccauuggugaaaauucucgagagcuguggaauagagucaaagauugagccagaagucaaugacucccuggggguuuacugcauugaugccuacaaugaaaccaugacagauaagcuaguccaguuugugaaacguggagggggcuugcucauaggaggcgaagcaugggauugggauacccagggugaugaugauagaguucuguucgcauuuccugggaaucuggugaccaguguggcugguguguacuucacugacaacaaagcagacacaaguuucuuuaaagucuccaagaagaugccuaagauacccaucuuaguucggugaguaucuuaccagaguggaaaguuggccucauacuaaaaccugacaugauucugucuucagguugcuuccaggcuaacagaaaagaauuugaaauucagucaccuguuugccacagucaauuagauguuuuaauacucugaggcucaggagcgacacuaccuccccagauccguuuagcucuuggaggcagagaagaauuuugacuaugauauuccucggaacuuagcuugaaaguacuguugaccccaagaauuggccugcuuuguuuaggaagguucacaggaaguuucuuugccaugcaaaggaaacucuuagggaaagaaaaacagaaaagcccucugggccaaagucaggagaacugugagaagcauuuugaaaucuuuacgugaaguuagaauagaaacaggaagcugugcauucggaaauugagcuagaaaagagacgguacaauucuuuauauuaaugcuggucauuagaagaagacguucaccccugcagucaaaggaucuucugagaaugggggaaacagaccauggguacaagggcaggauucacuggagaucaguggacaguuuuaccaaaucugguuuuuuuuccccacacacaguguuguauaugaaacaauuaauaagcauucagugaguauuccuuaacuauauagguagacugaugaaugagaguguuugaagcuaaguuauucucaggagcagaauaugugcaguagguacuuccuauuauauauaacaauucuuagcuuucuuggaaggaauaacacugugauuucugacugauaaaaccaaaggagucagauuaggugaggaagaugcagugagccuuuagauagaugaugaauaagcuaaauuaauaaguauucaugacaaauuaacccagcaaccuguguacccuauauuuuugguaagaaagaaucuuguuugauuuuuaacucaggacuggggcuucuacaaggaguucaaucucuuuuuguucauuuauccauuaguuauuccagaguuuauugaauauauucugugucagauauuaugucuuaagauaaauuucagauuuaccuauuaagaugaguuacaaaaaaaaaaaaucugaacaugaagugcacagaaauaucucuaaugacaauaucuagaagccauuuuuaaaaaccgaguaacuguguagcaagaugcuguacauuauagugcagacgacucuggaauccaggaucuaaggccaguaacucuacagugugucccuagaauguccuuccaccuccuuccguccagaggaggagugcuggaguagaaccucuggguuccucuguacggcaccaaucccuuucaggcucugggucuucugguuagcaagauccuuggguuuucccaaggucaucaggcauuugcggaaauggaaauggaugaacauguucugaauacccaagugcucuaaauaaauccuuuugcuuaaauaucacagugaaaccugaauuagccagcucuuauguuaugugugccuuuuccagccugaauauuagugaaaugauauuggcaacugaaaaaucuuuugacuuucagauuacuaaagagacuucacaaucuuaaaaguugaagauaagcauuagcuuggaaaaacgucagggcagguguagauaaguauuuguaauaggggucugcaaauccuuagagguuguugcuaguuaugugucgacaauauguagaauagaguaaaucaggaaaaccaauaguugcuuaaugggaaaaaaauucaauaaagugauaagccacuggauaaucuggucaugacaacaagagacaauuaaaaauuucaagaauggaaggagggucauuaauguggguuuauagacauuaaaggguaauaagauaguugauacaacuuacgccacugaauucauuaacuuaaaugaauuggacagccuucuucauaaacacaaauauaaaacuaaacauaagaaaaaagacaauauaauaaaaugaauugaauuguaauaaacccucccaauauuauaugaaaggugguuuacugguuugaauucuagaaaucauucaacagaaaagcaagugaaauuuauggagaguuuuccaagcaugguggcucaugcuuuuaaucccaucacucagaaggcagauguaggcaaaucucuacauaaugaguuccagaccagccuggccuauauaauaaguuauuggccagucaaaacuacauagcuuuugucucaauaauaauaauaauaauaauaauaauaauaauaacuguuauaguaauaaugaugacaauaacaaaaaguuagacauuuuuguucauuaacagagcucaacauaaagucuaggcuagccuuagacuagugaacccucuaccucaacauucuaaguggacugauaggcacuugccacaugucuagcuaaguacuuuaguaacuaguacuuaaccugugcuaaggucuuaguucugccaaguauaacucagcuguuuaacacuuuuucaguaguuaugucaaagauauggagaaacaacuucccuauuguuuuaaacacacacacacacacacagagacacagacacacacacacuauauauauauauauagugugugugugucuguguauauauguaugucaaauagcaccccaguccccaauagacuuacugaugaauuuuaugaaacuuuuaagaagcaaauaaugagaacccuacacagauauucuuccagaaaauaggaggaaagcaccccaaaaguuauugcuucaccagcauuucuguucuacugaaauuaaagaaagggcuggugagaugguuuaaguauguaaaauggcugugaugcaagcaugaugaagaccugaguuggguucccuaaauuccauggugggggaagaggagucagccaggguaacacaccuguaaucugaacauugaguaagaagaacaggaggauagccugggcuugcuggccaggugguccagcucaguugaugagccuggauccacaaaaagacauaaggcagaaaauaagguagaaagugauugauugaggaaaguaccuagcaugauaccaaccucuggcauuugcauaugcgugcgcacacacacacacacacacacacacacucacaugcacacacacaugcacaugcacacaaauaaauaaggugaaaaaaaggcuuuuuaaggaaaagaaaccuauagaacaauacuagaugcaauguucuugauuaaauauuaguaagugcaauagauuugcauacacacacacacacacacacacacacacacacacauauauaagcaaaauucagcuauucuagguaugaacuacugguuuugcaaucagaagccagguuaauuuagcaugacagcguuaaaagugagaacaucaugcaauucgauagaugcacacaaaacgcuuagcaagauuccauaaucaaucaugauaacauaucaacauacuccauauaaaaaggaaugucuuccaucugagaagaggcaugcaacuagaaaccuucucacuuugucuuguuaauuuuauuuugcuucauugguguuuuugagaaaguaucucgaauaguacaagcuggucuugaugaaguacagugcagccaaaucugaccuugaacuccauaaauccugcugccuccacacacccuggcccacaaguuguaugauuacaggugugugccuuuguauauaucuaacuauagaaacauuauauagggauaaaauggugacugcuuuuauuuuagaauuagccuccaaacgaugacaccauugcauacacuagcaagauuuugcugaaaggacccugauauagcugucucuugugagacuaugccgaggccuagcaaacacauaaguagaugcucacagucagcuauuggauggagcacagggcccccaauggaggagcuagagaaaguauccaaggagcuaaagagaucugcaacccuguaggugcaacaacauuaugaacuaaccaguaccccggagcucuugacucuagcugaauauguaucaaaagauggccuagucagccaucacuggaaagagaggcccauuggacacgcaaacuuuauaugccccaauacaggggaaugccagggccaaaaaugggaauggguggguagggaaguggaggggaggguaugggggacuuuugggauagcauucuaaauguaauugaggaaaauacguaauaauaaaaauauuuuuaaaaaagaauuucuaaaaucuaacucugaauuuuaucuaauccuuugaauucuguuuguccccuuacuacuuauuaaguuuuaugccagauaugccaaaauuaaaugcauacuuuagccauuaaaaaaaaaagaagaaaugagaacaaggcaagaguaacacuugugauccuacuuucucuaaaggcuuguauugaaagcacuccaccaaugcuauaagacaaaaaaaaaaaaaaaauaggcacggauauuaaaaauuagaaaauggacuuuucuauacauaccuaaauauacuaagguuuaauuuaugaauuaaggacauuauuaguauaacaauggauacuaauaaaaaucuaacaauuguauauaauauauucuaacaaaaggaucauuaauguggucucuuacaaacuaucuuuuguaaauuuauuauuauuauuguguauaugagagagauguggaggauggaagggcaugugcaagcacacguguggaggucagaagaaaacagaaucaguucuguccuuuguccucuacauggauuuuaggaauuggacucaugucucuaggauuauacagaaaauaccuuuaucuucugagccaucucaccugcucucagcaaaccucucccugcacuauacgcacccaucuggugaauggauaauccaaugccuguguaaaaaaaaaaaaaaaaagaugugaaaugaacaaugagauggaaacacugugaaacugccacaaggguagacaaauucgucacugaaacagaucacauuguccagagagauuugcucagugaggaaagagcauuguuuucagcauacagcucgggaucaacuaaauaccuuuaugggaaagaugaacuuugauccucaaccuauuucacacaaaauacucaaaaacagguccagacucaaguacaaaagaaaaauugaaaaacuucuaaauuacagcacagaaaaaaaaaaucacuugcaauccugcauuaggcaaagauugcuugggaagacaggccugcaaaauggaaagauugguaguauuucagccaucuccuuccuaaguaaaaaccaaggaaaaauaaauaguguccucaccaaaacuucacauaauaagcuauccucucaccagcauguaugcugagauuaucuucuuuaucuugacuauuguguaaaugcuucaaggaauaugagaguguuuggaaggcacugaucuuauuugcuuuggauacacacccaauggagaauugccugggucaggugguaccucuauuuuaggcuuucaaggacuuuucaacccauuuucuauauugguacuacuaguuuaaauuccuuccaacuguacgcaagaauuuccuguucuucaugucuucaucagacuugguaucuuuuaauaauacucauucuaguagaugggcgcccauaccucgcuguuaauuguauuucuauuuccauggugaguaauaguggcaagcaccuuuuuguaggccuguugagcaucuauacgcugugauauguagugauucuuguccauuguaaggugcaugagaauucugggcugaucuuuacuggcuccugugacuucuugucccccgccccccaaaaaaaaaucauucuggcccuuuuguuccuucaccuucucuuacucacaugcaucccacacucuucucuuccuggaggccucugauucaucugauuccaucuacguaguguucaguauaaauagcugccucucccacuuuccugauugagcccugcuauacugcaaguuuaucuucauguucuaucucaucacaggagaguaugaaagggaagucaaaucagagccagaaaaaugauuuucacgguuguugccucgaggaaggagaaagccagucugcugcaacgccccaguuucucaucacuuagucagaacucugaacaguacggggacuaaaacuccauucuccugacacaugacugccauagcgugauuccuaacugaaguaacagauucgauucuggaauuccaaguguguggagguuauccuaggcauccaggacucacucucccuuuggcauuuauagguggcuuaagguucucagcagggaaggggguauauuaugcauaggaaauacaccagugcugagcaaaacuccacagcacuccagcacuccuguugagcaagcaagagacaggugaaguuauauauguaggcaguggucucaugagauaaugacugaccccaaccccaucuucuaagauacugacucuuugccgacaccaugaacucuguuuuccacagacuuuuccuuuaucacauuaauggugagaaauguaucaguaagacucauucuaagaaucagaacauaauuccucaccgaauucuuugcauucuggaauacaugguuggaauaaacaugauccuaugucuagaagguggugucuaaaguuuagugucagagaaacacagcaagauuuuccauagaauuuccuuugaagaaauggugauuuuaaaaugagcauaacagaauuaauugagaucuuguaucuccuucccaaaauuuuucacccacucuguucuccuaaauuuucuacaauaacugaaaacagaauuaguuaaagcaauaguaaauacccuuauguagcaggcagcauucaaggaacuaaaagaagaguaguccuucuaaucaggagugugugucuuuugcaguugugaugacgaccucucagaugacagagaugagcuucugcguggcauaauagaccuggacaucaccaacucggacugcuucccaucccagcuacuaguucaugggucuuuggcuuuuccuuuggggcuagauaccuaccauggcugugugauagcugcagcucgcuauggccggggucggguaguuguaacuggucauaagguuuuauuuacuguggguaaacucggccccuuuuugcucaaugcuguccgcuggcuggaugguggccgcaaaggcaagauugugguacagacagagcugagaacacuaaguggucugcucgcaguaggggguauagacaccagcauugagccccaccugaccagugacgcaagugucuauuguuuugaacccacaagcgauguggggguuaaggaacuacaggaguuuguagcagaggguggugggcuguuuguuggaacucaagccugguggugggcuuuuaagaacccaggaguguccccucuggcucgauucccaggaaaccugcuccucaaugccuuugguaucagcaucacaagccagagucucaauccaggaccuuuccguaccccuaaaauaggaacaaggaccuaucacuuccgcucuacccuagcagaguuccaggugauaaugggcaggaagagagggaauguggagaagggcuggcuagccaagcuaggcccagauggggcaacuuuccugcagauuccugcagaagagaucccugcuuacaugucugugcacagacuccugaggaagcugcugagccgcuaucggcuuccaguggcaaccagagagaacccggucaucaaugacuguuguaggggagccaugcuuucccuggccacaggucuggcccacucuggaagugaccucucacugcugaucccagaaauugaagacguguacagcagccgcuaccugcgccccucagcgucucccaucaccgugaaugucaauugcacuaauccagguacagcagaagggugggagcuugguuuuaugggcaucugcaaaacaggggcacaagacugcugcaguguugcacaucuguagaaggucaucacuauccuucauugccuucuucuucaagauuauaggggucggguauuaggcaguguuugaaagggucauagcaacaugguagggaaaggagcagcugaagucaugagggauccgugcagcacuguauggagcagggaugaagucugcccuuccuguguuuuggcaggcacucgauauugcuggaugagcaccggacucuacauaccuggaaggcaagucauagaugucuccgugccugagagugcugccucugcugaccugaagguaaggccacucuccaucucaccacauaaugcagaauucaaaugaucuugcuaucccaguuggcauuguagguggucuguguaaaaugcugcuggcaguuuaggucuguuuuaaaccccuuuuccuucuuaaugaugaaaaaaaccuauguuuuuauauauaacaaaauauaucaaaaugguacauuguagagcccaggacucuauaccauuuugccucagaauagcaaucucuacucuuaaaauuuguucuuuuaacuuacaucguacaauaaagacuaagaaaggccucacauggaagguucccugacaguuuguagauauucaguuggugaauaguacuuuacuuucuaucacauaacuuaguuccuaugaacucaagaaaugcuacaauuucaauacuauuauacauggccucgucagugguacauggggucauaaccuaauggcccuucugagucuacuuccuaugcucucuugugccacccacauacuccaugugacugaggguuauuucucugcuccagauacaaauuggcugucauacugaugaucugacaagggccagcaagcuguuccgaggcccccuugugauuaaccgguguugcuuggacaaacccacgaaaucaaucaccugccucugggguggucuccucuauaucauugugccucagaauagcaaacuggguucugugccccuuacagugaagggggcuguucgugcuccauucuacaagcuagguaaguagacacuacaagguucacacugcgaggugggagaagcuaaaacugaagagguuucuggggcuacucaguacaggagguggggguagacgaguggagggaggugauuggugucuuuaaguucugcuuuggugccaagaaaaauaaauaaaucacacccacggggacguccaaaagagaugugugguuucuuaucuugugguucucaucuggagugaaaguuguagauguguuuuaucauaagggaucuggagaaagguauuucaaggcaauauuucaauugccucucuuuauaggggagacauccaaggaagaauggaagaggcgucuccuggaauauccagguccauggggagaacuggccacugacaacaucauccugacugugcccacugcaaaucuucgaacgcuggagaauccugagccacugcuccgccucugggaugagaugaugcaggcuguggcuaagcugggaggcgagaccuucccuuugcgucugccacagaggauaguggcugauguucagaucucaguaggugggugcuccggaagcucugugugucugcccccaaggacccucucuccacagccgcguagcuagaaggcaaggagaguaaaaauguuuugcuugcaagacguguagauauauuccuugcuguuuaaauggaaaagggaggaaucgauuuugaaauaaauaguagcuuaugucagcacgucaagaaguaucaaagacaucaagagaugugaccuguggugccgcucagggaauuuuaagaauuaggaaaauauaguagagggccucaaccugguugagaguccuggaagacucugaacaaagcuauuugaaaaggaaccaagaagccaaaacaaagguuauggguacaacacagaagcaccaucaaaauuucccuggauccuuauuuucacaaugcaugaauaaucuuguaucaauguagguaaucccauaucuaagagugggguggaggcacccuuucacacccucacauggacaccaucaccacccugcuccccaaagggacccucauacaacagcaugacugguccucagcaaccugcacuccccagggcucaagucacaagacaggugcaaauggcagugcagacugagcagagggaaaccugcgagugucugggcucagauggugccuuaggacaguacaggugauagaaggaaccuggggcuacuggacgcuuuggaaaagauacgguccagauguggugaugagguggaaggguucuuuuuguuuguuuuuaaauuauuuuuuuuaauauuuuuuauuuauuuauuuuuuauauguaaguacacuguagcugucuucagacacucuagaagagagcaucagauuucguuauggaugguuaugagccaccaugugguugcugggauuugaacucaggaccuuuagaagagcaguuggcgcucuuaaccgcugagccaucucauuauccucucucacauauuacauccugaccagcuucucccaccccuuccucuacccccuaacccccaucucucuucccuuccuucucuaucccccaguuccaccccacuccaccuccccucaaacaagagcaggccucccaggaauauuaaccaaagacagcauaaugagcuacauagcaggcacaugccaucacaucaaggcuggacaaggcaaacuuggggggggggggggaggguccuacaaguggacaaaggagucaggaacagcucccauucccacuguuaggauuuccacacacacacaaaacgccauguuacuuacccaucauguauaugcuggggcucuaugaucugcaaguucccaagucccagucacccgauucaauuguucucaugauauguaccugaccccuccgauuccucugauccuuucucaagcugggaggaggaugcugaccugcucucuuuuucuguguccccaggcuggaugcacgcaggguaccccaucaugugccaucuggagucagugcaggaacucaucaacgagaagcucauccggaccaaggggcucuggggcccugugcaugagcugggccgcaaucagcagaggcaggagugggaguuccccccacauacuacggaagccacgugcaaccugugguguguuuacgugcaugaaacgguccugggcauaccccgaagccgugccaauauugcgcuauggccuccaguucgggagaagagaguccgaaucuacuugagcaagggacccagugugaaacacuggaacgccuggacugcguuggaaacguaccuacagguacugggaaagacuggagggcgaugggacaagugggacuaccaaggccacaugaugagaugauaaguuggugaccccagagaccaccgcugcaucugccucccacauccagcuacaugagaacgagagaaucuggggauaacagcauguaaugaugcuucucgguacaguauucuguaugacacuaugaagugcacaacgcugaacugacuuaauaaugucagcuguacccccaucgagaggcacaagagcauagcacuaaagaaaaaaaaaucuuaaaccugguugaggcacaaagaguacuacaaauauacuuuuuucuccauagcuuuaaagccaggcacacccaugacugaagccagccuuuccuacugaguagcuaucaggcaacagucaccacauauucuaaaaugagcuaugauccaauuuuucuuagauguguguguacucuccuugcuauggcuuugcuuugccacagauuccaccauauguaggcaacccaggaucgcucucugccuuggguuuggagguucaccuucccucagaacugucauucagagccaucguuuucagccgcagugccagggaucagucccuagauuacucuggggagugacaucaugguuagauucaagccaggcauaauuuauucugauucuuccaccuguucaaauccuucucuguccacugcuacuuucuccugaugugaguuacuuugcucauccaggaaaugaagacauguugguucugguaacuuccauguggccccuuaacggcaaagccugugacccuggcuagccugggcucuuuccaauagucucaugaaaguuacuguuaaagaagccaugugacucuuuccaguggcaucuucuaacgcucuuuuuuguugauguucuagagcucauauuuuguucuaauuaacuaggcugucuagagacuucuacuugauucacuuucuauuccaaaggccguuuuuaguggccuugugaauuagugugagggugacugaggauuguggggauuuccaagcuauuagaauuuaacuguacaacugggcaaaauaaugauuguuccaccccagcagguuuuaaaucccuguguguaaaucucauuacuccauucaugaucucaugaucggguaaacgcugaccguggugagaaacacugacgacuggagcugcuucccuacccaucccucacugagggucugcaagcacugcccuagccucaacguuuuucuuacgauuacacaaugagaguagggcaugaagccagcacacaaaaugcucagugaugggugcaaagcugaaguuuagcaggcugaacucauuaaguuugccuguguauuggaccuucuuuuuguagauuggaugucucaccuacuuccaacuuucccuuucuagcuccaagaggccuuugguugggagccauuuauucgucucuucaccgaguacagaaaccagacaacaucgagcucgccgcccucagacaacgucgacaaaaugaaucuaugggucaagauguucucccagcaagugcagaggaaucuggcuccauucuuugaggccuggggcuggccuauccagaaggaaguggcuacaagcuuagccuaucugcccgaauggaaagagaauauaaugaaauuguaccuccucacacagauguaaggagugcccaucgagguggcagguagagaggcuuggggugguaggcagagauggggguuuacuccucuaccucugucuucuaaaguucuggcuuucuccuuuuaauucauugcuccugugucuuauuaccgacuucugucucuaggaaguggguuaaaaacacagcacaaaaugaagccagaauuucuuaggaacgaggucugugcuuaugagcccgaccccucugcuucucaguugucagguacccugcugacccuguauuggccuagugcugggagcuugggaauuuguuucuauccagccuucuugaugagccauagagggcaauccuucccuuggcuuccuuggcuucgggauagauauaaaagucucugcuucuugugguggacauggagagucuggcugaugguuuuaaagaagcuuguggacuuuaugguguaugccaauggaaggguucuuccacuucaugcuggauuauuagcucccacagcucagaaguucacaucagccuuucucuuagacuccuucugcccaaauucuaggucuuuaauugaccauuuguauguuaccagcaagaaccuugccuucuccaugacucuauggccucauucuauacauugggaucuauuucauauggguuuuuggaguuguacagugccucuaaaagugauuacagaggcuaguggguauugagaaaacaucauuugucauuuuuguuauuuaacccaacaacauucuggaccuaaacuuuuauuuuagauacuauaaacagauagucauaaacuuuuaauuuuucaacugauaaauauaaagcucacaucuauuagcaagauaccauucaauauggauauauauuuuuaauacuugaauuaggcaaagcauaucugucuccuccaauaucuaucauuucuccagaccaagcacauucacaaucauuuguuauuguuuuuguuuuuguuuuuguuuuuguuuuguuuuguuuuguuuuguuuuguuuuuaaauacacaguacauaacuguuauggagugccagagagagggcucaguguguaaagacacuugccaccaagaccucaaacaugaguucaauccucagaacuggaaaaguggaagaagagaccuaacucuugcauguuguccucugaccuccacaaguggucugugauccauucacaaacacacuaaaucaacuuaaaagaaggaacugcuaucugcccuacccuauccuguaugauacuuuucacccucuaaaguaauucugguacauuguuuuaugaaucuaaaggaaggauucuaaacuuacauuggaguauuuuccuggcugcuugagacaaugccucucugugauagguagggcuuuuuuacuucaaaagcaaugcucuuucauucuugccauuaagagcuguguuacaggugugcacagccacacccgaguucacaauguaggccuuuuccuuuuaucuuuuacagcuacuuagauauggccucuuuaccuaguucuuucagcuuaaauucccacuuugauaaaauccagagaagagauuuucacaaaaacuagaacaauccuaagauaaguguuuaaccaucaauagacauuuuuuagaaaacaauagacacccagcuuuuaaaugguauuuauauucccauagugagauauuuaagauauaauugcuguggggguuuauugacuauacauauauaaaaacuucaguuugggacaagaaauuccacagagcuaacacaacuuuuauuuaauugcuauacauucaaagaucucuugguuuucccccauuucauuucaaguuucuuuuaugaguuuuaauuaauguuauaucuaagauugauguuguacacaacuggcuuucugauuucuuuuuuuuaauuuauuuuaguauaaucuguuuuauuuacauagcuuguaagugggugaaugcagagacuauaagacauuuauguguguguuuguguaugugugugugugugugucuuuauuguacaaauucuuaauccuauauuuauuucauauuuauauauacauauauauguaucauauagggauuuuaaauaucuuuaaaauaauuauuaucaauuaucacauauugauaauauguguaugugccaggcauuauauuggucccuauauauaggcuaugcuauuuaauugucccaauagucuuaugaaguagaaauuauuauuacucuuauuuuaggauaaaagagcugacuuuuauggagauuaaguaaauuauguaagacucuacugcuaauaaugauaggccuaugauuaugaagccaugcacuaugauugcagaauggguauuaauaauuauagugcuucaaauaaccaaauaaaaaaccaaaucaacaacacagaacauuuauacuccugcuugccagagucugggcucuuuauacuuagccucuaucuaaccuuagcaggacaaaaagacucucuguuucucccaaacaucaguagacaggaagaauuuaaaucaggcuccuaaagugcuuccaguacaaaagagugagccauuagcaucaggcgacucuucuagguucugauuauuuagauugucauucucccuuggguaccauaaaagcaauuuuugguuuauuagauuuuaaauaauguagcuuauuauugaagucccugacuucccaaaguccuagaugcuucauuuucucagaaagacaauaagaucuuuaaucuuuuuuucucuuuuuauuuuuuauuagauauuuucuucauuuacauuucaaaugcuauccccaaagcccccuauaaccccccccuugcccugcuccccagcccucccacucccgcuuccuggcccuggcauuccccuauacuggagcauaugaagaucuuuaaucauuuagaguaauucuucuccauucccacucuugccccuuucaucuacuuucagcagucaagccugagaucuuuaccauaaaguuaccuauacucuuucccugucaaauguuuccagugguacuccagauuugagaugauggacuaaacauguaaguuugccuucccuccuuucccaggccccacugaaacugaaguccaggaauacaaaagaaaacugagaccucucagcaaaggagacuaaaagcauuugguuggagaagaucucaacaaauuucaggaagagagaaaguaaaugaagagaaauaaugaucgggaaacauggcgguccauuucagacagaauauacugauccgaacacuggaaccccaaagagacuugagcacuagaaaacucuagcuacuaaauaauuauaccaguuguaaauugacccccagucuacucagccccgacccuuguacauagaaaacagaaaaccuaccacugaaacuagugaaacuguuauuguuacuguuguuugaauaaagaaaucaaauaaaccaccugaggagagguaaaaaauuagugcuccaaaggauauucuuuccauggaaauaagugccccacuagccugucagguaauuuucuucucagaggugacacccuuacucacacccuaaaagcccacagcuucuagguauagcagacauuugcuggagaaacaggacucauuuaacgagcugauaguuaacaaagauucucagcauggauuuccugauagaauuuuucauacaucgaaggguccaaggaagaagcauaaagaaaauaaccacuuagacauaaaaagcuugaggaauuauaaacuaauggaagcauaauuuauaaggaaaaaucuguaaaauucugaccauuucuccaagagagacuugaggugcauuacuaagagaaaauccugaacauuguaaaagcaaaacgagauggccauaaauuuucaucauauagacuggaaaacaagauagaaugaaucuuuccagacaugcaucaaaaugaaauaucacacaauugaaaagaaggaaagggaaacagacaaucacuguguaacucuuaggaguuuccagaaggcagcacagaaagccuggacagugagagaauaagaaagacuugaggaacagcagagggacggcacccaguaccaaccacaucuaggcaggguccuaaagaaaaguggaaacaggagggcuagaaggaacauguugaaagugcccagggaagggaaagaggcugaaccaaaccugagaauucuagcagugcugaaugcuagaagucaaagaaccaaugguugacuuuugaaaacuuuuguucccagaauuccauauaguacagacugucaagaguaauauaaaaagaaaaacauuuuuggcagggaagucuuuagaaacucucccuccccccuuuguacccuuauuaaggaaguuuuccauuuaaaagaaaacuuucuuuccauauauauguggaagaaaguccaaaaaagaaaaggaaagaagaucuggagacaguggcccucacucagggugucucugucuagagugguagauaucagaagagagcacuacccugggcucugugaagaauaugccagaguagcacugaggagaugggacauuuggagauaugaaaagcaugcagucuuuaaucacaaaaauuaaacagaaugucaagaaauuugggcugagccaugaaggaaaauagaaugggauaggauuucaaagucucguggaguaugagaagagacugauugggcacuggcaguagguauguuuccuuuccuuugauauggguaucauggcauugggaguguagagaaaauuaaguuucuuccacuuggcuugguaaaaguauuuuaauagcccaaauaauguauagaugccacuuauagaucuucaaugguuugaucagccuaucaacaaagacugaaagguuuaauguuacacucauaucagagauagaaagggauguugaucaguugaugcacaaaacuauagcugaauuaguugagagaagggaaguaaaaggaaaaaaauggggcuacuuaaauauucaaaguguggaugaaaagcugcugucuuccgauaauagaacacaguuguaugguuagugugcuggccaaugcuauaaauuagacccucaaaagaauaucuaccaagcauuuggagaagaguaggcaggagaaagguggaggugguguauguuaaagcauuaucuuuuguaauggugaaagauuaaagauagucuaauguuaauaagucaagagauuauuguucaaacauguuauguaaagguaggaaguuagccaacagaagauccaaaaauagauauuaaaagcaucuaagaaaugagacuauagaaggaggguggggugggaaccguguuuuuauuuaauguuccgcuguacuauuuaauuuuuuuuuuaccuugugcauguauuauuuggaaaaguuuauaauaaacucaaauaaaacauccuucagaggcuu

SEQ ID NO: 2949 - RNA, 935 nt, Mus musculus
cucaagagguguccuccuuuaagaguguccucuucagagcacuuuugaccucuuuguuccucagacuauagaucaggggguugagcauaggauuaaaaaggcuauggaauagcaagagauauuucuucugcucauuggacuucccguguugaggcccaauguacaugacaauggcuguaccauaaaagaguccaacaacacagagaugagaggagcaaguggagaaggcuuucuggcgccccugcugugacuuaaucuucaggauggcacacagaauaugagcauaagagacuacaauugaagaaaaugguccgacaagcacagacacagccccagccaaaaccauuaacucauugaugcggguaucugaacaagcaaguuugagaacagcuauaauuucacagaaaaagugauucacuuuuugugagccgcagaaggguaaugguaacaacaauacuagauggaccagggccaagaguacuccuaaaauccaggaagucagcaccaggauaacacaaacucuccagcucaugauagcaguauaucggaguggguggcagauggcuacauaucgaucauaggacaucaccaccaguaggagacauuccgugugugcaaacgucaaaaagagaaaggucugugucaugcagccagcgaaagagauuggcuuggcuggauccaugagguuuaccagcaucuggggcacuguguugcaggcauaggcaaugucaacgauggccaggugagacagaaagaaguacaugggaguguggagucuggaguccaggcagauaagucccaggauggucccauuucccagcagggugaaggcauagaacagggagaagagggcaaagaggagcaucugcauccucgggcugagaggaaaucccaggaggaugaacugugugaucaaggucugauuuccccccauu

SEQ ID NO: 2950 - RNA, 1061 nt, Mus musculus
uaacaaaggacaaugaauaucccuguauuuaagaaauaauuggagaucaaaauuacaggaaacuaccaaggcuuguggugggaacaccacaccaaacaagaaugacuuucuuugcacagugcccuccggagggcacccuugacuucagcauuccucaggcuguagaucaggggguucagcaugggguugaaaaaacuguaaaacaggaaaaggaucuucugcugcuccucugggugcugggacuugggggccauguacaugacaauggcacugccaaagaagagcccuaccacacagaggugggaggaacagguggagaaggccuuucugcgucucuccccugacugaauccucaggauugccaccaggaugcguguguaggagacuaguacaaagcacaggggccccacuaaagugaacacacaggcugcaaaaaugacaacuugauugaguguugugucagcacaggccagcuugaggacagacaggauuucacagaagaagugauugauuucaugagguccacagaaggggagccucaggaugagaaguaaauggaccagagacaggagaaagcugacuauccaggaaacagcagccaugaugguacacacucuccaguucaugaugacaguguaguguagcggguggcagauggcaacauaucgaucauaggacaucaccacaagaagaagacauucggugauagcaaaugucaaaaauagauaagucugugucaugcauccugcaaaggugaugggccuggucucauccaagagguuuaugagugucuguggcacuguguugcaggcauaggccauaucgacaauggccaggugggacaggaagaaguacaugggaguguggagucuggaguccaggcagaucauugcaaggauagucccauuccccaguauggugagaguauagaagagagagaaaagcagaaaaagaacuaggugaauccucgggccaagacagaaucccagcaggaugaacucugugacuguggucugauuuuccuccauuucacuaugaaagaggaugcagaaaacugagac

SEQ ID NO: 2951 - RNA, 1316 nt, Mus musculus
gcaauuaugagugugucuaagcuagcuaaacucuuuaaaguuuaauccuccaaaagagcaugacggaacuagggcauuuuuugaacacugcauugcuucgggacuaucagagaggaggccuuucucccuuggucauguuugauucugcagggccuuccaaacaacugcuuagccucuucugccagggccagugcagcagcgguggacacagggaucaggggacagucuacccacaaaagcugauugcaguugugggccacagcauuccuaaaagaaaaacagccaaagagccuguuaauucuccuggggaaaaagucauuaugguaccccccagagccaggaauggguuuggggagggagccuguggacagaacauccaaaguuccugucauuagguaaagguguguguguguguguguguguguguguguguguguguguguguauucucucuccgaauacuggaaagaacagaggagggucauacaaacugagacauaagaucuuaaaaugaacucuggaacaugguggcaaacagaggcuaucuacagaaaagacauaagaauguuucacaugcacccagugaagagagagaggaacaugggaaggagagagggggguagagagggagagacaagagauagagaagcauacagacaggaacagaagaacuugugcaagaacccuuuaucuuauggcaaacaccaaguaaagaaacacgcugacaaucccaaaucucagauguucggaaacaucgaggggcagaaagucagccggguccggaugagccucaguuggagaccugacgaggacccacggaggaagagacacgcaggggagucuagggccacgccggacaccggcgagucccgugcccaguucucuccugcggcuccuuggugacuccugccuggguucugccccuggacggccacggccugccggugcuguggguagagcucaaucccgcggagcucgcucuucccagcucugcccggagcugccccucccccgggaaggugugucccuguuuccucaccugaaacuuccuugggagaagccggucccucccucccguccggcggcaggggcgggccgcggguggggcgccggggcggccuggccuggcuggggaccgcggcgggcgcccggaccuggaggggacucucgggccagcccggggcagcaugugacuccgaccaggugggugcucucuucucuucugagccccggacucuggguggucguggagccggguggagguaaggcaggggcgggaaagaagagagaacuaggccucccccgggaccaguccc

SEQ ID NO: 2952 - RNA, 1316 nt, Mus musculus
gggacuggucccgggggaggccuaguucucucuucuuucccgccccugccuuaccuccacccggcuccacgaccacccagaguccggggcucagaagagaagagagcacccaccuggucggagucacaugcugccccgggcuggcccgagaguccccuccagguccgggcgcccgccgcgguccccagccaggccaggccgccccggcgccccacccgcggcccgccccugccgccggacgggagggagggaccggcuucucccaaggaaguuucaggugaggaaacagggacacaccuucccgggggaggggcagcuccgggcagagcugggaagagcgagcuccgcgggauugagcucuacccacagcaccggcaggccguggccguccaggggcagaacccaggcaggagucaccaaggagccgcaggagagaacugggcacgggacucgccgguguccggcguggcccuagacuccccugcgugucucuuccuccguggguccucgucaggucuccaacugaggcucauccggacccggcugacuuucugccccucgauguuuccgaacaucugagauuugggauugucagcguguuucuuuacuugguguuugccauaagauaaaggguucuugcacaaguucuucuguuccugucuguaugcuucucuaucucuugucucucccucucuaccccccucucuccuucccauguuccucucucucuucacugggugcaugugaaacauucuuaugucuuuucuguagauagccucuguuugccaccauguuccagaguucauuuuaagaucuuaugucucaguuuguaugacccuccucuguucuuuccaguauucggagagagaauacacacacacacacacacacacacacacacacacacacacacaccuuuaccuaaugacaggaacuuuggauguucuguccacaggcucccuccccaaacccauuccuggcucugggggguaccauaaugacuuuuuccccaggagaauuaacaggcucuuuggcuguuuuucuuuuaggaaugcuguggcccacaacugcaaucagcuuuuguggguagacuguccccugaucccuguguccaccgcugcugcacuggcccuggcagaagaggcuaagcaguuguuuggaaggcccugcagaaucaaacaugaccaagggagaaaggccuccucucugauagucccgaagcaaugcaguguucaaaaaaugcccuaguuccgucaugcucuuuuggaggauuaaacuuuaaagaguuuagcuagcuuagacacacucauaauugc

SEQ ID NO: 2953 - RNA, 3565 nt, Mus musculus
cagaguccagcaaggagggcugggauucacacugagcacgugugucugcccaggcuugggcuguuuucugggauggacuaccugaaauucaucacgugaguagcucacucagugaaaggcacuucaguggggucuuaagugggggagauagaaauagggagagggacuugaagugguuuugacugaaggcaucucacccuaagaagagcuagaaaccuaucugaagucucacaauauugggaauagccagucaagacugcaggaagaugaauccaucacucaacaggaggagagggcuuggaaagaagccauauauaucuauauauauauaucugguccaagacuugagcccccagccuaggacaggaaggacagaacagugcuguugcaacacccacauuugaccaucacuaauaucuuuuccagggaaggaggcagagcaucccugccacuggugucugaucuucccuggggacuucagucccuggcaguagcaaucuuugcauguacacucagagagcugccccaauauacgacaaagaucaaugucaguaucacgggaagcaccacgacagccacucuccucuaauucuguacuuaggcacagguuuuuacuuuguauguguguuguuugugugcuuacgcgugugcucauggcuccacuccacauccaugugugugaaagugccugaggaggacguggaaugcugccacauaucuugcuauaaauauacacauaguuacaggagccaggguaauuuauguucaggcuauaagagagaaaguacggugguuccucauguuacaucuagguacauaggaagaagcuggagagagguguggucaggccucuguuaccucauacaauagccuguugccaugguuaaaggcugugguguuggugugagggagcucaggggugggcugggaucuggaaggaacugcagguuuguugggcuguauguugggagaauauauacagaucccucugaagaaguccugccuaaaccucauugugcuauacugggagagaggaguaaggaaguguaugaagcauaauguggccuugaagugaccuuuaguaggaccugugcuagagcaguagaaacaguugcaguaaguaucagcagggugugugugugagcaugugugugugugugugugugugugugugugugugugugugugugagaccaugugcacgcugaagaacuugccaaaccaguacucagggagacaacaccuacaacucagcagagaaucagccuagggaauggucacacccagcucagaucauaugaaaagacuccaggcucuagaccagugcuggaugaagcucugcuguugugcccuaagccagggacaacuaucagcuauggcagcccauagaguccagggcagguaggagaugguccagaguccuaccaucugggcuucugaaaggacuuugcuuuuucacaguaauaaucuugucuuuuauguccagggguugucuccagcaugaccgaaagcagguacucaacaggacauaucauuccagcacucuacguaacccugcacacuauacauaauuauauuuaaauuguauguuagugugcaugaucugugaguacauauacgggagugcaugugccuucagguauaaaggcaugcaggaaagagcaggagcaaggaucugaauggcagugacaggggccccaugaaguucuugagguguuccuuauuuaacacagcaggaguucuguuaagccagaacagaaguaaauacaagggugccugccgaauggcaugcuagauauagacucagggaaaagacaccauacaugccaguaagaggcucuggaagaaacugucaagucagugccugcuuuuaagacucaaagaucaugccuauaagugauuaacuacuuacacuguccccuaugucauuaagucacggaacauaugcuacacagguucauaaggaagugcucucccaggaccuuuucuguggcuuuuuaaaacacgaaccuuccuagaaaucuucauuuucaauucacaggcccuucccugcauggacagacauugauaucacaucuucucugucuacuuuucauauuuauauuuauggguguuaauguauuggugaaugaaucuguaugcauuguguguguguguguguguguguguguguguguguguguguagaggaucaugucaguuguuucuuuagugacauucucagaagucaucaaauaccaugaugaggccagggagggaaacuuccugaaaugcugcuuucugggaaauccuaguacaaucuguguuuaauguuggugaagagacagguuggaggccaaaauuucaaucgauuugauaccaguccaaaaggcaccugugugucuggacacccuuugagcuuuccuaaacagagugaggcuuggccucugugaccucacagaaggggucacugucaugguuaugggugugcccuaguucugaggguagcagaguccaugauaggagaagguggcagggauccuuucuagguaagucagugcagaaacaucuuuggguaaagaccugaucucacaucagaucauguacuucacagagggcuucuugugaaagaggugacuaaggcacaguucagugucugagggcuuuugauggacaggacagaugugguaauagcaaggacuagagggauaucuucacagaccauggccauguacaacacauagaaagaagacugauccuauauaggaaauugugaagaucugcacagccuucaaugccuuagcaagacauuuggaggacuaaccucuauuguuucuccuaacuuccugugauauuccaucaugggaccuccugaaggagggaaaugcaucauggggccuuagagacucucuuguagcucucacaacuuagaagcaacaaauuuuccacaugaguucauggguacucucucccacaagaacggacagcuaugcaacaggaugggcaugcccagacaguuuuuuauuaaucuauuucuauaauguauaauuuguuuuaccuggacuguaagcuauaugugucaaugucuuagcauguuuccuagaggauaggucaaugauguucugaguacauuugagaugccagagaaggauacuaaauaugucuaucaauaucugucuccuuuauccccaggaauauugaccauaauucaaggcuaacaacaaaguagcuuuggaaacauaugaacucaaaauuauacacuauuuaaaucuuaaaaaagacucagauacccugacucugaagauuucugcaccuagauaaguaggaaugaaaagaaacagggcuggacaaacaaaccagaaaguaaguaugugccuugggcaaauugugaacuugaaggaguugagguccaaaagaaguauagauguggaccuaggccuauuccuaacucaugaggaggccugggccaaaacaagaagugaugugggccugggccuauccccaacccuugaagaggccugggccuaaugaagaagugaugugggccugggccuaucccugaccuugaagaggccugggccuaaug

SEQ ID NO: 2954 - RNA, 3765 nt, Mus musculus
cagaguccagcaaggagggcugggauucacacugagcacgugugucugcccaggcuugggcuguuuucugggauggacuaccugaaauucaucacgugaguagcucacucagugaaaggcacuucaguggggucuuaagugggggagauagaaauagggagagggacuugaagugguuuugacugaaggcaucucacccuaagaagagcuagaaaccuaucugaagucucacaauauugggaauagccagucaagacugcaggaagaugaauccaucacucaacaggaggagagggcuuggaaagaagccauauauaucuauauauauauaucugguccaagacuugagcccccagccuaggacaggaaggacagaacagugcuguugcaacacccacauuugaccaucacuaauaucuuuuccagggaaggaggcagagcaucccugccacuggugucugaucuucccuggggacuucagucccuggcaguagcaaucuuugcauguacacucagagagcugccccaauauacgacaaagaucaaugucaguaucacgggaagcaccacgacagccacucuccucuaauucuguacuuaggcacagguuuuuacuuuguauguguguuguuugugugcuuacgcgugugcucauggcuccacuccacauccaugugugugaaagugccugaggaggacguggaaugcugccacauaucuugcuauaaauauacacauaguuacaggagccaggguaauuuauguucaggcuauaagagagaaaguacggugguuccucauguuacaucuagguacauaggaagaagcuggagagagguguggucaggccucuguuaccucauacaauagccuguugccaugguuaaaggcugugguguuggugugagggagcucaggggugggcugggaucuggaaggaacugcagguuuguugggcuguauguugggagaauauauacagaucccucugaagaaguccugccuaaaccucauugugcuauacugggagagaggaguaaggaaguguaugaagcauaauguggccuugaagugaccuuuaguaggaccugugcuagagcaguagaaacaguugcaguaaguaucagcagggugugugugugagcaugugugugugugugugugugugugugugugugugugugugugugagaccaugugcacgcugaagaacuugccaaaccaguacucagggagacaacaccuacaacucagcagagaaucagccuagggaauggucacacccagcucagaucauaugaaaagacuccaggcucuagaccagugcuggaugaagcucugcuguugugcccuaagccagggacaacuaucagcuauggcagcccauagaguccagggcagguaggagaugguccagaguccuaccaucugggcuucugaaaggacuuugcuuuuucacaguaauaaucuugucuuuuauguccagggguugucuccagcaugaccgaaagcagguacucaacaggacauaucauuccagcacucuacguaacccugcacacuauacauaauuauauuuaaauuguauguuagugugcaugaucugugaguacauauacgggagugcaugugccuucagguauaaaggcaugcaggaaagagcaggagcaaggaucugaauggcagugacaggggccccaugaaguucuugagguguuccuuauuuaacacagcaggaguucuguuaagccagaacagaaguaaauacaagggugccugccgaauggcaugcuagauauagacucagggaaaagacaccauacaugccaguaagaggcucuggaagaaacugucaagucagugccugcuuuuaagacucaaagaucaugccuauaagugauuaacuacuuacacuguccccuaugucauuaagucacggaacauaugcuacacagguucauaaggaagugcucucccaggaccuuuucuguggcuuuuuaaaacacgaaccuuccuagaaaucuucauuuucaauucacaggcccuucccugcauggacagacauugauaucacaucuucucugucuacuuuucauauuuauauuuauggguguuaauguauuggugaaugaaucuguaugcauuguguguguguguguguguguguguguguguguguguagaggaucaugucaguuguuucuuuagugacauucucagaagucaucaaauaccaugaugaggccagggagggaaacuuccugaaaugcugcuuucugggaaauccuaguacaaucuguguuuaauguuggugaagagacagguuggaggccaaaauuucaaucgauuugauaccaguccaaaaggcaccugugugucuggacacccuuugagcuuuccuaaacagagugaggcuuggccucugugaccucacagaaggggucacugucaugguuaugggugugcccuaguucugaggguagcagaguccaugauaggagaagguggcagggauccuuucuagguaagucagugcagaaacaucuuuggguaaagaccugaucucacaucagaucauguacuucacagagggcuucuugugaaagaggugacuaaggcacaguucagugucugagggcuuuugauggacaggacagaugugguaauagcaaggacuagagggauaucuucacagaccauggccauguacaacacauagaaagaagacugauccuauauaggaaauugugaagaucugcacagccuucaaugccuuagcaagacauuuggaggacuaaccucuauuguuucuccuaacuuccugugauauuccaucaugggaccuccugaaggagggaaaugcaucauggggccuuagagacucucuuguagcucucacaacuuagaagcaacaaauuuuccacaugaguucauggguacucucucccacaagaacggacagcuaugcaacaggaugggcaugcccagacaguuuuuuauuaaucuauuucuauaauguauaauuuguuuuaccuggacuguaagcuauaugugucaaugucuuagcauguuuccuagaggauaggucaaugauguucugaguacauuugagaugccagagaaggauacuaaauaugucuaucaauaucugucuccuuuauccccaggaauauugaccauaauucaaggcuaacaacaaaguagcuuuggaaacauaugaacucaaaauuauacacuauuuaaaucuuaaaaaagacucagauacccugacucugaagauuucugcaccuagauaaguaggaaugaaaagaaacagggcuggacaaacaaaccagaaaguaaguaugugccuugggcaaauugugaacuugaaggaguugagguccaaaagaaguauagauguggaccuaggccuauuccuaacucaugaggaggccugggccaaaacaagaagugaugugggccugggccuauccccaacccuugaagaggccugggccuaaugaagaagugaugugggccugggccuaucccugaccuugaagaggccugggccuaaugaagaaguuaugugggccugggcucuucccugacucuugaagaggccugggccuaaugacaaagugaugugggccugggcuuuccccugacucuugaagaggccugggccuaaugaagaagugaugugggccugggccuauccccaaaccuugaagaggccugggccuaaugaagaagugaugugggccugggccuaucccugac

SEQ ID NO: 2955 - RNA, 583 nt, Mus musculus
cuuuuuuuuuuuuuuuuucaaaaggagaacaagcucaccauguuuauuccuuauacccucaugacccaaggccagagagagcaggguuuuggaagccaaagagcagcauuuauucaggacuccaauagauucauccaucacccacggaaugaggacaaauccugugcuggcuggggcccugugguucauggcuccuugcuugccugugccuuccucagucucaaggcagacaggcugugucagagguagagauggcaccucuggaggguaccagagcuagguggauacauggacccaggggcagaaggagcaagaaguaaaagaugcauauccaucacugcagugggaugcuacuugcuacccgccaugauccugagguacuguagggcgcugugagcagcaucaccucgggcugccucccuggugguugcagaaccauaacacacaguggcuggcuggguggacaguuccacuaggcacuggcagagcccacucaggcucaguuccucaauauccagauagcugacauggaaagccugcuccucagagagcucacugaggacacugcagcaggcagagccca

SEQ ID NO: 2956 - RNA, 9371 nt, Mus musculus
auggagugguucccaaauucagguucugggucuuuauuaucaucagaaauaucaauguuuagcuaacauuccuugagcuauuaucaccuccauaucagaggaugaugaaacacugagaaguuuaauaacuugcucaagccuacccaguuaaaaaugguucacacaaauauaaacucugguagugucagcuucugguuuugcucuuuuccuuccaaguuugggucuuagaucugaaguuugcaauuaugucucuggguaauucacaaaccugugaaacccauuuacuuuccacagacuaguuucuuacccaagucuuagaaauaauaguuccuaugguuguucaagugacucaguacucuucaaucugaguaguaaacaugcugugagcaggcuucaauguucuuccagcaaaauacuggaaaaaaaaaaaaacuggcaaacuuaagaaaaaauccugcaccccaacccauaccugaaggcacacaugggaagcuagcaaugagguauuuuaaaaauagcuauuuuaaaaauagcuaaucuaaaacuugcguuuuuuccaguucauuauuguuucuaauuuacaaagagauuuuaaucccauugacuuuguccugauaaagaccuuugggacaguuuugagcuuugauucuggugucacucucuuuccaaacuggcucauccaaagagauauccauuuugcugagacagagaagaugaagaguguuuugagcaugaaaguuacuauuauaucuuuuuauccuguuagguaggguuaucugcucagaacagaugccaccugguugcaaaguggacacaggugaaugaacaaaucaaugaaaaugauaguauugacaguaaauaagauacuuuaaaacaaggaauggaggcagggcgaaucagggaguggauucagauagauuaaauacuuguauuaaggcaaaauggguuggagaaaacccucaaguugacauacaaacucauauccagaggugaaaaaucacaggaaaggagaccauauagacuggugagacugaagacaacagauuaggaaauauagagaggaaguaaacuguuuucuaugaauacaugggaauccaguuuaaaaugaaagccaaaauauacaaggaacaagccuuacauuuaucuccacccuuaccauaugucuacagaaaaguuacuaaaaacauguuucuuuugaaugaguuauugagguguuugacauaaaacaaauuaaaaaccuuuuccccagacaaacguaaagauaauauaauuugguauacacaugcagaaacaacacuucuaaaaaauacuuaauagauguugacaaaaagcuacaguucgauagaagacacuaaaccagcaguucuuaacuuccuaaugcugugacucuuuaauacaguucaccaggugacccccaaucagaaaaugguuuuuguugcuauuucauaacuguaauuuugcugcuaugaaucguaauguaaauguguuuggagauagaaguuuguccaacggguguccauccacagaaugagaacugcuggacuacacaccagugggacuuucuuuugagaggaagcacggguuacucaaguuguggauuugagaccugucaggucugcugaggauuucugccccgaaauggugcauuagaaagaaucucugugguguucuaguuuggugaaaaguuacagaaguuacaucaaauacaucuuuggcccagaugaugagcuaacugaaaaucuucccuugcuaguucacagaauuaaauggcagaucuaagcuaggauauuaaaacagcugccucuaacaagguaugggguaaauccauucuuucuccagccucucaccuguggcuagggguguugccaaauuuacaauugaauauuacaaagcacaagaugacagcagcugauuuccaaugggugagauuauucuagauguaagaauacuacuucaugccaucccagguuggaaucgcaacucccaacucucccuaacuaaaccauauacagugaaagugaaaaaaggcucucaagaaggaagggaggccacugcugaaaaguauuaaagagggagacacacauccacguggguaugugggcaagcuggagguuuccgcaggaggaucuccaaggccugcagguagaaaggggggucggugaagcaguagcacuuuucucuugaguccgccugcccauuugacuuucucaucucacgguuggggauacugccucugguucaacuccaggacaggagacaccagccaggaucagugcaguugggacccaugucagcucccgggaggugcauggaggggaggggcaggggagcucaaagccccucucccacagccgcuuccggaagugucuucagaggucagagcccccagccucggcucggucuccacgagaaguccgaaguggcgggaagccggcacucgagaggccgccccgacgcgagggcggcgggaaaaccuggcggaggauuccgcucguccggcaggacccggcucggcguuugggaagcagaggccauggcucgcagguagaaaugcccgcgcgaagcggguccuggccacgaagcgggugaccagggccucugggggggccguuuccgugccccucccgcgccgccgcaggcccggcgauggcggcgacgguuucuuggcucccccgccccggacgccgauggcggugcguuccggcccucccucccccacggcuucgccccgcggucgccagagccggugaagccgggagggcggggagcggcggagggacggcgagagggcggagguugcguggugcaggcggcggcggcggcggcgggaggaggagggccggcaggcgggcaggggaggaggaggaggagcgggcgccgugucgcacgcagcuccaggcggggcagcccgggcgcugagggacgcggccagaccucggcgggccccgcgagcacuacacgccgucgcccgagcgucggggggcgcccggagaugcgggugaguagcggcucgggccgcgguggcgggaggcagcgcaggccacggcggagccgcggcgucgcagugacucgggccgcggcguccgagcccgggcugccggcgaggccugaggcgccgcgccgcggcuaggcggaauggcggccgggccggagaagucgugggcguaggacgccgagggcggagcggagcggccaggcccggccugagucacccggccggccaggcucggccugggccgggacucgcagggccaggcccuggcuacgcacugggaaaaagccggacucaccgcggccuguggcgccgaccucggcgccucacgcgccaccccucccuuccccucggcccuggggguuccgcuuggccgggguggcucagggccgggggacucgugcucucggggauccgggggcacucauuguugcgacggugcggggcaugauuauuggguaacaguggugccgggcuccguucucucugggagcguggccgagcaaggcgcgccgggaugcggugugcuuuuccaaaggaacggagcccccgggcguccgccagcucuccucagucgaacugggcccucccugugcggcggccucggcgcguccccggucccggcgggagcgcgcgcucugaccccaaagguaacccggcaccgggccaggaggacugagucgggggcuguagacucugcgggccucuauucuuaaaucccgcguggcccugagaacccccucuuucugucaccugugcacuguguuguuacucaggagauaacuaagaaagcaaggaacacuugcacucucauuccuugagccuaagccccaaaguuaagggagcuagguaugccaaaaaaggaggauuccccuuuucugagaggucacuguugauacuugugguuaguucacagucguuggggguuugugggacgggcacgcaugccgaaaugcagucaaguuguucaagugcuuuuaguugcccuguguguacuugcucuuugcuggaguagcauuaaaacagccaaaagcuaagaauggaauaaaugauuacuguuuuagaaaggcacuggggugacaaaagaggaacuaagcuccuuuuacuucaauuuuuaggaccuaaaccuaacacucugaagaagccaguguaguugaggaaaauaaggauaugaggucuuucuuuguuugagaaggcuuuaagauuucucuuuuuacuuaaaacuuguauuuguugcuucccauaguaaguugaaacaguuauagcucauuuuaaauucugaguaugcaacacaacacuggcuuguuuuaucuucuauucugcccauuuuuggagguuuuggggagcauuuacuaagccuuaagccugggagaaaagaccaaagugcuuucuaaaaaugcuaaccuuucucuuuccucccuguuggcaucaucuuuaaaaaacuguuuugcccaaaagacaaccaauuuuagauaggcuaggguguuuguaagauacaucuuuccugagucuuauggucaggcccuggaagguguggcccaaauuccuaguaugucacauacaucugaagucugagcuaauuuggccaggugucuuuagauauuacauagacucuguuguucagggaacuccaccuucuugcgcuaauuaauuuugucagugcaggcuuauuucccauacaugugacuaugaaaucauugaagacacagacuaaguccuuuacuuuguaacccucagauaacagaacaugaucuugcugguaccaugaaugauuuuuuuuuucuuuuuuggacuaauccuaggguuuuacuacuccccuucauuuuggcugcagaaaacauagucacuguugcugcugagcuuguuaaaagugcaaguuuacuauuauguugcaugcuucccuagagugaaaacuguuauuuuucuugugucccccuuccaccugcauaacuacauacuguauccuagggaaaaaaugguugaggguuucuuuaguuguggaaaucuaaacaguuuguaaaauuaaaauuaaucauucuaauuuaaggagucaguauuuuuuuaaaaaacaaguuuguuuaccccuuugccuuugaaguaaagccgguuaguauuuaaggcuguuaccugcugggaagauaguccagcccaguuguaccaaaaguuucugugggaggauaagggaccuucauuucagcaaggaaaauuauguuuaaaugaacaaaccuuaagucaaacaauaguuacuuggcauucuuaagauuuaauuuguuagggccccucaaaguuauaacugucuugaaguuugagcacuucauaagucccaaagccuagucuuuuuuaccuuucccaugaagucaugggauaaauugauuuuugagaaucagugguuucauuuugaacucaucuuuuagguaugcuuggaggaaaaagcuguuaaccaucuauuuuaaaggacaguucuaaauucaucuuuuaaaaaagcauguaugugcaugcaccacagugcacgugugaaagccagaagacaaacuucauagucucuucucuaucuugugggucucagggauuccguaaacuuggcagcaguuccugagucuuggcagcaagcaccuaagguaguuuuuaagugauaccaucuaacuucuaaguucuuaaaaugaguggauuccaugggaacauaaccaaugagacauuggagaacuaccuuauagagcauaguauaucauuucauguuugaucaccaggguuauguaaagucuugauaguauuuuuuuuuucccuugggaaaccuggacagaaggaagauucugcucucuggcuuccacucacgcuucagcuugauuguacuucugaucuguucugggucuuuuucuuaucacuuuagcucaggcaucuucauuuuaggaaagcuggucuugccauccugucuaggaccuuucccuagguccucauguugucuauguuguuuaugucauguugucuauggaucuaucccagugcuuaacauucugaugacacuuggugguuucuucuauuagacugacuuuaccuaggggcagguggaacaaaucugacucuaauaccuagcacaaugcucaugucaaaaucuauguacauccucccacuucagaucuuuacaaagccacgugaaguguaaguacugacauuuagcucuccuuguagaaaauagaaggguccuggacuuuggguaguuuucaucaagacuaugaagguguaaagccucagguaggagguuagagcaagauggucaucccagaguuugaacuuuuaaacaagggacucaccuugaaagugauguauaugaaauuaaaggaagauuagcagagauuaaaaugaaagagucuuuaaggauugaugucugaccauuacaacagaauucaucauacauaauaaguaugguugguucccaagaaugaguuucuucuuccugguccuucagaaaacacuagagaguagacagugaugguauaagcauaaacauuuguagaacuuuggggcuauuguuaaauuggguguaauguuaugauucauuggccuugcaaaaaaucuuaaauccauuuaauaagcuaauuuuuuaaaggccugugucagaaaauacuuaagaaaacagacuaccaauuuaaguauguguaaaguaugcaguggcuuaaguaauuaaaccacuguaaaauaguagugauuuuaggugaacuugugucuuuuaaaagauuuuuauaaaaaaauuaguaacaaagaaaguaucaauuucaagucucagguuugagaaacuuaauaccaaaaauagacuuuaaagaagaacugauuacuucagacuuguaaaacuuccuuaugguaaaaucuuguaaacaaaauaaaaggcaaaugacaaacuaagaaaaugguuuuacaugcaaauuuauuuuuuauacuaucaaagggggcuuguagacuaaugggaaaaagauuuccuccuaugguaaaaaaaugggaaaauuggaauaggaaacaugaaaaauccugagcuaaacuagcaguauucccagaaguggagaucuguaauguuuuaaaauaagucacuuuguugagaagauggagaaguaugccuacucauugcuaaaaagaauauaaguaaauauaguuuuuuagaguacauuuuuuuuaaagguuuguuuuauauaaguacacugucaccgucuucaggcacaccagaagagggcuuuagaacccauuauagaugguugugaaccagcaugugauugcugggaauugaacucagaacuucuagaagagcagucagugcucuuaaccacugagccaucucuccagcccauaaauacagguuuuuaaagaauuugguuuuguguguaugaguuuuugcaugcacauguguauacauuccauaugugugccugggcccagagaccuugugaccucagaggguagaagacaacauuagaucuccuguaacuggaguuaaggacugccauguuggugcugggaacugauccuggcuucucaggaaaugcucuuaacugcugagccaucucuucagccccaauuaaauauuuuucaagagcaaaaaguguagcagagacuuucaaaaugauguguaguuugaaauagcucaccugcuuuuaaggaauuuguuaacaauauaaaaaggugaucaauagauuagugauuuuuuuucccuccuguauucuuaucauucauuuucagcuugggguuauuauggaugacuauuccagcauuguuuagguaaauccuugcauuuguguaauacuauauugaauauuaaaguacaaagauacuaaaaauuaauauguauaaaacuuuuuacaagugugaguguaugcauuuuggaaaguaaguacauguuagugauuaucuuuaagaagugguucauuuuaggguuuuuugugcuaauuuuacuauacugcauauguuuuuauagauagacaacugggaauaaaauauagugaguugguuuuucuuuggacaguuuuuggagcaagauguuggggauugaacccggggaagcuucaaagucuuuguauguuaggcaaguccucuacuacuauuucccaggacagugagauaauuuucaaaagcauaaauccuaagaaaauaguaauagaagaaucacugucaaggaagaucauucugcuuauucaaugcagaguuacuugguuuuugauuuccuuuccauguguuaauagguggguuaaaugucugacuugguagccugauuccaguggucaaguucuccuuugucuucuguucucauucauucuugugucauccuucacauuccugccauuaaacagucuuaaucucaugacgcucaauauguuuugauauuuuauuauuuauuuaaaauaaccuucauaggggaaguuuccuuuuccuuuaaaaaaagguguguguguguguguguguguguguguguauguguguacacauauauguacacaggcaugccaccacacaguuguggagggcagaggacaaacuuguagcauucaguucuugagauuaaacuuguaaagucaccaagccugcaggcaggugccuuucccugaugagccaucugggcagccgaguauuccuuuucuuggugauaauugaacuucccaauuuguuuugcuuaguucauaacuccuaauaauaggagauacauuuuaaguugaauguuuaaauuaugaugccuccauuuauagcaauaaaacuuacuaaaaauuaauuacuugacacaguugcucgguuuguuuaaucaguuuucugugaaagauccuuuaaauuagaaauacuaugggaguuaggagaagagagauauauagaaaugugcauaaaauguacagaaacugucaccagauaucaauggagaaauaccuuugguauacaaaauacacuagagucucacuaaaauagcuaaaauagcugugccugauaggcaucuuaaagucacaaaguggagaaaagauacaagaacuuagaucuuccuuccugggguuuggaaaaaggccugcucuggucauacuagaaggggagguuugggauccugcaugagcaugagguugguaagccauggagcagacuccccaguuccaaguggaaucagaucccaggcuuaccuuuaggaaguaugagacugguuugggagagagauggaagaggguacaggguaaugaacuucucccaucuuaaggauugagucuuuaaguuuugcuuauggguuaauguuaaaggaacacugauguucagcauuaaguuugugccacagacuuuuuugacuacaugccuuugacuuacuggcugcugcuccucagcuuucuccuucuuguaauuaaaugccuuauacuggaagaaguccauc

SEQ ID NO: 2957 - RNA, 9371 nt, Mus musculus
gauggacuucuuccaguauaaggcauuuaauuacaagaaggagaaagcugaggagcagcagccaguaagucaaaggcauguagucaaaaaagucuguggcacaaacuuaaugcugaacaucaguguuccuuuaacauuaacccauaagcaaaacuuaaagacucaauccuuaagaugggagaaguucauuacccuguacccucuuccaucucucucccaaaccagucucauacuuccuaaagguaagccugggaucugauuccacuuggaacuggggagucugcuccauggcuuaccaaccucaugcucaugcaggaucccaaaccuccccuucuaguaugaccagagcaggccuuuuuccaaaccccaggaaggaagaucuaaguucuuguaucuuuucuccacuuugugacuuuaagaugccuaucaggcacagcuauuuuagcuauuuuagugagacucuaguguauuuuguauaccaaagguauuucuccauugauaucuggugacaguuucuguacauuuuaugcacauuucuauauaucucucuucuccuaacucccauaguauuucuaauuuaaaggaucuuucacagaaaacugauuaaacaaaccgagcaacugugucaaguaauuaauuuuuaguaaguuuuauugcuauaaauggaggcaucauaauuuaaacauucaacuuaaaauguaucuccuauuauuaggaguuaugaacuaagcaaaacaaauugggaaguucaauuaucaccaagaaaaggaauacucggcugcccagauggcucaucagggaaaggcaccugccugcaggcuuggugacuuuacaaguuuaaucucaagaacugaaugcuacaaguuuguccucugcccuccacaacugugugguggcaugccuguguacauauauguguacacacauacacacacacacacacacacacacacacaccuuuuuuuaaaggaaaaggaaacuuccccuaugaagguuauuuuaaauaaauaauaaaauaucaaaacauauugagcgucaugagauuaagacuguuuaauggcaggaaugugaaggaugacacaagaaugaaugagaacagaagacaaaggagaacuugaccacuggaaucaggcuaccaagucagacauuuaacccaccuauuaacacauggaaaggaaaucaaaaaccaaguaacucugcauugaauaagcagaaugaucuuccuugacagugauucuucuauuacuauuuucuuaggauuuaugcuuuugaaaauuaucucacuguccugggaaauaguaguagaggacuugccuaacauacaaagacuuugaagcuuccccggguucaauccccaacaucuugcuccaaaaacuguccaaagaaaaaccaacucacuauauuuuauucccaguugucuaucuauaaaaacauaugcaguauaguaaaauuagcacaaaaaacccuaaaaugaaccacuucuuaaagauaaucacuaacauguacuuacuuuccaaaaugcauacacucacacuuguaaaaaguuuuauacauauuaauuuuuaguaucuuuguacuuuaauauucaauauaguauuacacaaaugcaaggauuuaccuaaacaaugcuggaauagucauccauaauaaccccaagcugaaaaugaaugauaagaauacaggagggaaaaaaaaucacuaaucuauugaucaccuuuuuauauuguuaacaaauuccuuaaaagcaggugagcuauuucaaacuacacaucauuuugaaagucucugcuacacuuuuugcucuugaaaaauauuuaauuggggcugaagagauggcucagcaguuaagagcauuuccugagaagccaggaucaguucccagcaccaacauggcaguccuuaacuccaguuacaggagaucuaauguugucuucuacccucugaggucacaaggucucugggcccaggcacacauauggaauguauacacaugugcaugcaaaaacucauacacacaaaaccaaauucuuuaaaaaccuguauuuaugggcuggagagauggcucagugguuaagagcacugacugcucuucuagaaguucugaguucaauucccagcaaucacaugcugguucacaaccaucuauaauggguucuaaagcccucuucuggugugccugaagacggugacaguguacuuauauaaaacaaaccuuuaaaaaaaauguacucuaaaaaacuauauuuacuuauauucuuuuuagcaaugaguaggcauacuucuccaucuucucaacaaagugacuuauuuuaaaacauuacagaucuccacuucugggaauacugcuaguuuagcucaggauuuuucauguuuccuauuccaauuuucccauuuuuuuaccauaggaggaaaucuuuuucccauuagucuacaagcccccuuugauaguauaaaaaauaaauuugcauguaaaaccauuuucuuaguuugucauuugccuuuuauuuuguuuacaagauuuuaccauaaggaaguuuuacaagucugaaguaaucaguucuucuuuaaagucuauuuuugguauuaaguuucucaaaccugagacuugaaauugauacuuucuuuguuacuaauuuuuuuauaaaaaucuuuuaaaagacacaaguucaccuaaaaucacuacuauuuuacagugguuuaauuacuuaagccacugcauacuuuacacauacuuaaauugguagucuguuuucuuaaguauuuucugacacaggccuuuaaaaaauuagcuuauuaaauggauuuaagauuuuuugcaaggccaaugaaucauaacauuacacccaauuuaacaauagccccaaaguucuacaaauguuuaugcuuauaccaucacugucuacucucuaguguuuucugaaggaccaggaagaagaaacucauucuugggaaccaaccauacuuauuauguaugaugaauucuguuguaauggucagacaucaauccuuaaagacucuuucauuuuaaucucugcuaaucuuccuuuaauuucauauacaucacuuucaaggugagucccuuguuuaaaaguucaaacucugggaugaccaucuugcucuaaccuccuaccugaggcuuuacaccuucauagucuugaugaaaacuacccaaaguccaggacccuucuauuuucuacaaggagagcuaaaugucaguacuuacacuucacguggcuuuguaaagaucugaagugggaggauguacauagauuuugacaugagcauugugcuagguauuagagucagauuuguuccaccugccccuagguaaagucagucuaauagaagaaaccaccaagugucaucagaauguuaagcacugggauagauccauagacaacaugacauaaacaacauagacaacaugaggaccuagggaaagguccuagacaggauggcaagaccagcuuuccuaaaaugaagaugccugagcuaaagugauaagaaaaagacccagaacagaucagaaguacaaucaagcugaagcgugaguggaagccagagagcagaaucuuccuucuguccagguuucccaagggaaaaaaaaaauacuaucaagacuuuacauaacccuggugaucaaacaugaaaugauauacuaugcucuauaagguaguucuccaaugucucauugguuauguucccauggaauccacucauuuuaagaacuuagaaguuagaugguaucacuuaaaaacuaccuuaggugcuugcugccaagacucaggaacugcugccaaguuuacggaaucccugagacccacaagauagagaagagacuaugaaguuugucuucuggcuuucacacgugcacuguggugcaugcacauacaugcuuuuuuaaaagaugaauuuagaacuguccuuuaaaauagaugguuaacagcuuuuuccuccaagcauaccuaaaagaugaguucaaaaugaaaccacugauucucaaaaaucaauuuaucccaugacuucaugggaaagguaaaaaagacuaggcuuugggacuuaugaagugcucaaacuucaagacaguuauaacuuugaggggcccuaacaaauuaaaucuuaagaaugccaaguaacuauuguuugacuuaagguuuguucauuuaaacauaauuuuccuugcugaaaugaaggucccuuauccucccacagaaacuuuugguacaacugggcuggacuaucuucccagcagguaacagccuuaaauacuaaccggcuuuacuucaaaggcaaagggguaaacaaacuuguuuuuuaaaaaaauacugacuccuuaaauuagaaugauuaauuuuaauuuuacaaacuguuuagauuuccacaacuaaagaaacccucaaccauuuuuucccuaggauacaguauguaguuaugcagguggaagggggacacaagaaaaauaacaguuuucacucuagggaagcaugcaacauaauaguaaacuugcacuuuuaacaagcucagcagcaacagugacuauguuuucugcagccaaaaugaaggggaguaguaaaacccuaggauuaguccaaaaaagaaaaaaaaaaucauucaugguaccagcaagaucauguucuguuaucugaggguuacaaaguaaaggacuuagucugugucuucaaugauuucauagucacauguaugggaaauaagccugcacugacaaaauuaauuagcgcaagaagguggaguucccugaacaacagagucuauguaauaucuaaagacaccuggccaaauuagcucagacuucagauguaugugacauacuaggaauuugggccacaccuuccagggccugaccauaagacucaggaaagauguaucuuacaaacacccuagccuaucuaaaauugguugucuuuugggcaaaacaguuuuuuaaagaugaugccaacagggaggaaagagaaagguuagcauuuuuagaaagcacuuuggucuuuucucccaggcuuaaggcuuaguaaaugcuccccaaaaccuccaaaaaugggcagaauagaagauaaaacaagccaguguuguguugcauacucagaauuuaaaaugagcuauaacuguuucaacuuacuaugggaagcaacaaauacaaguuuuaaguaaaaagagaaaucuuaaagccuucucaaacaaagaaagaccucauauccuuauuuuccucaacuacacuggcuucuucagaguguuagguuuagguccuaaaaauugaaguaaaaggagcuuaguuccucuuuugucaccccagugccuuucuaaaacaguaaucauuuauuccauucuuagcuuuuggcuguuuuaaugcuacuccagcaaagagcaaguacacacagggcaacuaaaagcacuugaacaacuugacugcauuucggcaugcgugcccgucccacaaacccccaacgacugugaacuaaccacaaguaucaacagugaccucucagaaaaggggaauccuccuuuuuuggcauaccuagcucccuuaacuuuggggcuuaggcucaaggaaugagagugcaaguguuccuugcuuucuuaguuaucuccugaguaacaacacagugcacaggugacagaaagaggggguucucagggccacgcgggauuuaagaauagaggcccgcagagucuacagcccccgacucaguccuccuggcccggugccggguuaccuuuggggucagagcgcgcgcucccgccgggaccggggacgcgccgaggccgccgcacagggagggcccaguucgacugaggagagcuggcggacgcccgggggcuccguuccuuuggaaaagcacaccgcaucccggcgcgccuugcucggccacgcucccagagagaacggagcccggcaccacuguuacccaauaaucaugccccgcaccgucgcaacaaugagugcccccggauccccgagagcacgagucccccggcccugagccaccccggccaagcggaacccccagggccgaggggaagggagggguggcgcgugaggcgccgaggucggcgccacaggccgcggugaguccggcuuuuucccagugcguagccagggccuggcccugcgagucccggcccaggccgagccuggccggccgggugacucaggccgggccuggccgcuccgcuccgcccucggcguccuacgcccacgacuucuccggcccggccgccauuccgccuagccgcggcgcggcgccucaggccucgccggcagcccgggcucggacgccgcggcccgagucacugcgacgccgcggcuccgccguggccugcgcugccucccgccaccgcggcccgagccgcuacucacccgcaucuccgggcgccccccgacgcucgggcgacggcguguagugcucgcggggcccgccgaggucuggccgcgucccucagcgcccgggcugccccgccuggagcugcgugcgacacggcgcccgcuccuccuccuccuccccugcccgccugccggcccuccuccucccgccgccgccgccgccgccugcaccacgcaaccuccgcccucucgccgucccuccgccgcuccccgcccucccggcuucaccggcucuggcgaccgcggggcgaagccgugggggagggagggccggaacgcaccgccaucggcguccggggcgggggagccaagaaaccgucgccgccaucgccgggccugcggcggcgcgggaggggcacggaaacggcccccccagaggcccuggucacccgcuucguggccaggacccgcuucgcgcgggcauuucuaccugcgagccauggccucugcuucccaaacgccgagccggguccugccggacgagcggaauccuccgccagguuuucccgccgcccucgcgucggggcggccucucgagugccggcuucccgccacuucggacuucucguggagaccgagccgaggcugggggcucugaccucugaagacacuuccggaagcggcugugggagaggggcuuugagcuccccugccccuccccuccaugcaccucccgggagcugacaugggucccaacugcacugauccuggcuggugucuccuguccuggaguugaaccagaggcaguauccccaaccgugagaugagaaagucaaaugggcaggcggacucaagagaaaagugcuacugcuucaccgaccccccuuucuaccugcaggccuuggagauccuccugcggaaaccuccagcuugcccacauacccacguggaugugugucucccucuuuaauacuuuucagcaguggccucccuuccuucuugagagccuuuuuucacuuucacuguauaugguuuaguuagggagaguugggaguugcgauuccaaccugggauggcaugaaguaguauucuuacaucuagaauaaucucacccauuggaaaucagcugcugucaucuugugcuuuguaauauucaauuguaaauuuggcaacaccccuagccacaggugagaggcuggagaaagaauggauuuaccccauaccuuguuagaggcagcuguuuuaauauccuagcuuagaucugccauuuaauucugugaacuagcaagggaagauuuucaguuagcucaucaucugggccaaagauguauuugauguaacuucuguaacuuuucaccaaacuagaacaccacagagauucuuucuaaugcaccauuucggggcagaaauccucagcagaccugacaggucucaaauccacaacuugaguaacccgugcuuccucucaaaagaaagucccacugguguguaguccagcaguucucauucuguggauggacacccguuggacaaacuucuaucuccaaacacauuuacauuacgauucauagcagcaaaauuacaguuaugaaauagcaacaaaaaccauuuucugauugggggucaccuggugaacuguauuaaagagucacagcauuaggaaguuaagaacugcugguuuagugucuucuaucgaacuguagcuuuuugucaacaucuauuaaguauuuuuuagaaguguuguuucugcauguguauaccaaauuauauuaucuuuacguuugucuggggaaaagguuuuuaauuuguuuuaugucaaacaccucaauaacucauucaaaagaaacauguuuuuaguaacuuuucuguagacauaugguaaggguggagauaaauguaaggcuuguuccuuguauauuuuggcuuucauuuuaaacuggauucccauguauucauagaaaacaguuuacuuccucucuauauuuccuaaucuguugucuucagucucaccagucuauauggucuccuuuccugugauuuuucaccucuggauaugaguuuguaugucaacuugaggguuuucuccaacccauuuugccuuaauacaaguauuuaaucuaucugaauccacucccugauucgcccugccuccauuccuuguuuuaaaguaucuuauuuacugucaauacuaucauuuucauugauuuguucauucaccuguguccacuuugcaaccagguggcaucuguucugagcagauaacccuaccuaacaggauaaaaagauauaauaguaacuuucaugcucaaaacacucuucaucuucucugucucagcaaaauggauaucucuuuggaugagccaguuuggaaagagagugacaccagaaucaaagcucaaaacugucccaaaggucuuuaucaggacaaagucaaugggauuaaaaucucuuuguaaauuagaaacaauaaugaacuggaaaaaacgcaaguuuuagauuagcuauuuuuaaaauagcuauuuuuaaaauaccucauugcuagcuucccaugugugccuucagguauggguuggggugcaggauuuuuucuuaaguuugccaguuuuuuuuuuuuuccaguauuuugcuggaagaacauugaagccugcucacagcauguuuacuacucagauugaagaguacugagucacuugaacaaccauaggaacuauuauuucuaagacuuggguaagaaacuagucuguggaaaguaaauggguuucacagguuugugaauuacccagagacauaauugcaaacuucagaucuaagacccaaacuuggaaggaaaagagcaaaaccagaagcugacacuaccagaguuuauauuugugugaaccauuuuuaacuggguaggcuugagcaaguuauuaaacuucucaguguuucaucauccucugauauggaggugauaauagcucaaggaauguuagcuaaacauugauauuucugaugauaauaaagacccagaaccugaauuugggaaccacuccau

SEQ ID NO: 2958 - RNA, 72749 nt, Mus musculus
auuuccaaugggugagauuauucuagauguaagaauacuacuucaugccaucccagguuggaaucgcaacucccaacucucccuaacuaaaccauauacagugaaagugaaaaaaggcucucaagaaggaagggaggccacugcugaaaaguauuaaagagggagacacacauccacguggguaugugggcaagcuggagguuuccgcaggaggaucuccaaggccugcagguagaaaggggggucggugaagcaguagcacuuuucucuugaguccgccugcccauuugacuuucucaucucacgguuggggauacugccucugguucaacuccaggacaggagacaccagccaggaucagugcaguugggacccaugucagcucccgggaggugcauggaggggaggggcaggggagcucaaagccccucucccacagccgcuuccggaagugucuucagaggucagagcccccagccucggcucggucuccacgagaaguccgaaguggcgggaagccggcacucgagaggccgccccgacgcgagggcggcgggaaaaccuggcggaggauuccgcucguccggcaggacccggcucggcguuugggaagcagaggccauggcucgcagguagaaaugcccgcgcgaagcggguccuggccacgaagcgggugaccagggccucugggggggccguuuccgugccccucccgcgccgccgcaggcccggcgauggcggcgacgguuucuuggcucccccgccccggacgccgauggcggugcguuccggcccucccucccccacggcuucgccccgcggucgccagagccggugaagccgggagggcggggagcggcggagggacggcgagagggcggagguugcguggugcaggcggcggcggcggcggcgggaggaggagggccggcaggcgggcaggggaggaggaggaggagcgggcgccgugucgcacgcagcuccaggcggggcagcccgggcgcugagggacgcggccagaccucggcgggccccgcgagcacuacacgccgucgcccgagcgucggggggcgcccggagaugcgggugaguagcggcucgggccgcgguggcgggaggcagcgcaggccacggcggagccgcggcgucgcagugacucgggccgcggcguccgagcccgggcugccggcgaggccugaggcgccgcgccgcggcuaggcggaauggcggccgggccggagaagucgugggcguaggacgccgagggcggagcggagcggccaggcccggccugagucacccggccggccaggcucggccugggccgggacucgcagggccaggcccuggcuacgcacugggaaaaagccggacucaccgcggccuguggcgccgaccucggcgccucacgcgccaccccucccuuccccucggcccuggggguuccgcuuggccgggguggcucagggccgggggacucgugcucucggggauccgggggcacucauuguugcgacggugcggggcaugauuauuggguaacaguggugccgggcuccguucucucugggagcguggccgagcaaggcgcgccgggaugcggugugcuuuuccaaaggaacggagcccccgggcguccgccagcucuccucagucgaacugggcccucccugugcggcggccucggcgcguccccggucccggcgggagcgcgcgcucugaccccaaagguaacccggcaccgggccaggaggacugagucgggggcuguagacucugcgggccucuauucuuaaaucccgcguggcccugagaacccccucuuucugucaccugugcacuguguuguuacucaggagauaacuaagaaagcaaggaacacuugcacucucauuccuugagccuaagccccaaaguuaagggagcuagguaugccaaaaaaggaggauuccccuuuucugagaggucacuguugauacuugugguuaguucacagucguuggggguuugugggacgggcacgcaugccgaaaugcagucaaguuguucaagugcuuuuaguugcccuguguguacuugcucuuugcuggaguagcauuaaaacagccaaaagcuaagaauggaauaaaugauuacuguuuuagaaaggcacuggggugacaaaagaggaacuaagcuccuuuuacuucaauuuuuaggaccuaaaccuaacacucugaagaagccaguguaguugaggaaaauaaggauaugaggucuuucuuuguuugagaaggcuuuaagauuucucuuuuuacuuaaaacuuguauuuguugcuucccauaguaaguugaaacaguuauagcucauuuuaaauucugaguaugcaacacaacacuggcuuguuuuaucuucuauucugcccauuuuuggagguuuuggggagcauuuacuaagccuuaagccugggagaaaagaccaaagugcuuucuaaaaaugcuaaccuuucucuuuccucccuguuggcaucaucuuuaaaaaacuguuuugcccaaaagacaaccaauuuuagauaggcuaggguguuuguaagauacaucuuuccugagucuuauggucaggcccuggaagguguggcccaaauuccuaguaugucacauacaucugaagucugagcuaauuuggccaggugucuuuagauauuacauagacucuguuguucagggaacuccaccuucuugcgcuaauuaauuuugucagugcaggcuuauuucccauacaugugacuaugaaaucauugaagacacagacuaaguccuuuacuuuguaacccucagauaacagaacaugaucuugcugguaccaugaaugauuuuuuuuuucuuuuuuggacuaauccuaggguuuuacuacuccccuucauuuuggcugcagaaaacauagucacuguugcugcugagcuuguuaaaagugcaaguuuacuauuauguugcaugcuucccuagagugaaaacuguuauuuuucuugugucccccuuccaccugcauaacuacauacuguauccuagggaaaaaaugguugaggguuucuuuaguuguggaaaucuaaacaguuuguaaaauuaaaauuaaucauucuaauuuaaggagucaguauuuuuuuaaaaaacaaguuuguuuaccccuuugccuuugaaguaaagccgguuaguauuuaaggcuguuaccugcugggaagauaguccagcccaguuguaccaaaaguuucugugggaggauaagggaccuucauuucagcaaggaaaauuauguuuaaaugaacaaaccuuaagucaaacaauaguuacuuggcauucuuaagauuuaauuuguuagggccccucaaaguuauaacugucuugaaguuugagcacuucauaagucccaaagccuagucuuuuuuaccuuucccaugaagucaugggauaaauugauuuuugagaaucagugguuucauuuugaacucaucuuuuagguaugcuuggaggaaaaagcuguuaaccaucuauuuuaaaggacaguucuaaauucaucuuuuaaaaaagcauguaugugcaugcaccacagugcacgugugaaagccagaagacaaacuucauagucucuucucuaucuugugggucucagggauuccguaaacuuggcagcaguuccugagucuuggcagcaagcaccuaagguaguuuuuaagugauaccaucuaacuucuaaguucuuaaaaugaguggauuccaugggaacauaaccaaugagacauuggagaacuaccuuauagagcauaguauaucauuucauguuugaucaccaggguuauguaaagucuugauaguauuuuuuuuuucccuugggaaaccuggacagaaggaagauucugcucucuggcuuccacucacgcuucagcuugauuguacuucugaucuguucugggucuuuuucuuaucacuuuagcucaggcaucuucauuuuaggaaagcuggucuugccauccugucuaggaccuuucccuagguccucauguugucuauguuguuuaugucauguugucuauggaucuaucccagugcuuaacauucugaugacacuuggugguuucuucuauuagacugacuuuaccuaggggcagguggaacaaaucugacucuaauaccuagcacaaugcucaugucaaaaucuauguacauccucccacuucagaucuuuacaaagccacgugaaguguaaguacugacauuuagcucuccuuguagaaaauagaaggguccuggacuuuggguaguuuucaucaagacuaugaagguguaaagccucagguaggagguuagagcaagauggucaucccagaguuugaacuuuuaaacaagggacucaccuugaaagugauguauaugaaauuaaaggaagauuagcagagauuaaaaugaaagagucuuuaaggauugaugucugaccauuacaacagaauucaucauacauaauaaguaugguugguucccaagaaugaguuucuucuuccugguccuucagaaaacacuagagaguagacagugaugguauaagcauaaacauuuguagaacuuuggggcuauuguuaaauuggguguaauguuaugauucauuggccuugcaaaaaaucuuaaauccauuuaauaagcuaauuuuuuaaaggccugugucagaaaauacuuaagaaaacagacuaccaauuuaaguauguguaaaguaugcaguggcuuaaguaauuaaaccacuguaaaauaguagugauuuuaggugaacuugugucuuuuaaaagauuuuuauaaaaaaauuaguaacaaagaaaguaucaauuucaagucucagguuugagaaacuuaauaccaaaaauagacuuuaaagaagaacugauuacuucagacuuguaaaacuuccuuaugguaaaaucuuguaaacaaaauaaaaggcaaaugacaaacuaagaaaaugguuuuacaugcaaauuuauuuuuuauacuaucaaagggggcuuguagacuaaugggaaaaagauuuccuccuaugguaaaaaaaugggaaaauuggaauaggaaacaugaaaaauccugagcuaaacuagcaguauucccagaaguggagaucuguaauguuuuaaaauaagucacuuuguugagaagauggagaaguaugccuacucauugcuaaaaagaauauaaguaaauauaguuuuuuagaguacauuuuuuuuaaagguuuguuuuauauaaguacacugucaccgucuucaggcacaccagaagagggcuuuagaacccauuauagaugguugugaaccagcaugugauugcugggaauugaacucagaacuucuagaagagcagucagugcucuuaaccacugagccaucucuccagcccauaaauacagguuuuuaaagaauuugguuuuguguguaugaguuuuugcaugcacauguguauacauuccauaugugugccugggcccagagaccuugugaccucagaggguagaagacaacauuagaucuccuguaacuggaguuaaggacugccauguuggugcugggaacugauccuggcuucucaggaaaugcucuuaacugcugagccaucucuucagccccaauuaaauauuuuucaagagcaaaaaguguagcagagacuuucaaaaugauguguaguuugaaauagcucaccugcuuuuaaggaauuuguuaacaauauaaaaaggugaucaauagauuagugauuuuuuuucccuccuguauucuuaucauucauuuucagcuugggguuauuauggaugacuauuccagcauuguuuagguaaauccuugcauuuguguaauacuauauugaauauuaaaguacaaagauacuaaaaauuaauauguauaaaacuuuuuacaagugugaguguaugcauuuuggaaaguaaguacauguuagugauuaucuuuaagaagugguucauuuuaggguuuuuugugcuaauuuuacuauacugcauauguuuuuauagauagacaacugggaauaaaauauagugaguugguuuuucuuuggacaguuuuuggagcaagauguuggggauugaacccggggaagcuucaaagucuuuguauguuaggcaaguccucuacuacuauuucccaggacagugagauaauuuucaaaagcauaaauccuaagaaaauaguaauagaagaaucacugucaaggaagaucauucugcuuauucaaugcagaguuacuugguuuuugauuuccuuuccauguguuaauagguggguuaaaugucugacuugguagccugauuccaguggucaaguucuccuuugucuucuguucucauucauucuugugucauccuucacauuccugccauuaaacagucuuaaucucaugacgcucaauauguuuugauauuuuauuauuuauuuaaaauaaccuucauaggggaaguuuccuuuuccuuuaaaaaaagguguguguguguguguguguguguguguguauguguguacacauauauguacacaggcaugccaccacacaguuguggagggcagaggacaaacuuguagcauucaguucuugagauuaaacuuguaaagucaccaagccugcaggcaggugccuuucccugaugagccaucugggcagccgaguauuccuuuucuuggugauaauugaacuucccaauuuguuuugcuuaguucauaacuccuaauaauaggagauacauuuuaaguugaauguuuaaauuaugaugccuccauuuauagcaauaaaacuuacuaaaaauuaauuacuugacacaguugcucgguuuguuuaaucaguuuucugugaaagauccuuuaaauuagaaauacuaugggaguuaggagaagagagauauauagaaaugugcauaaaauguacagaaacugucaccagauaucaauggagaaauaccuuugguauacaaaauacacuagagucucacuaaaauagcuaaaauagcugugccugauaggcaucuuaaagucacaaaguggagaaaagauacaagaacuuagaucuuccuuccugggguuuggaaaaaggccugcucuggucauacuagaaggggagguuugggauccugcaugagcaugagguugguaagccauggagcagacuccccaguuccaaguggaaucagaucccaggcuuaccuuuaggaaguaugagacugguuugggagagagauggaagaggguacaggguaaugaacuucucccaucuuaaggauugagucuuuaaguuuugcuuauggguuaauguuaaaggaacacugauguucagcauuaaguuugugccacagacuuuuuugacuacaugccuuugacuuacuggcugcugcuccucagcuuucuccuucuuguaauuaaaugccuuauacuggaagaaguccaucuuuguuguccugguuuugacaugugccacaaaaauguauaaugcuaaucaucauauagucuauugaggugaaaagaucuuauuuggugaaagaaauuaugcagaaagaaguaggucacuauuaucaggggccccaaaacauacagaaagaagaaaacucauaaccgguggaguaguuuugccuguuagcauuucaguguuagcuuuguacauguuuuguacauaauugacuuugccuuguacagagauuuuguuuuguuuuuuuuguuuuuguuuuuuuaaaaaauguauauggguguuuuacugcauguauguggugguuugaauaagagugacucccauaggcucauguauuugaaugcuuagucacuggguuguggcacuauuugaaaaggauuagaaggauugugagguauggcuuggaguagguguggccuuggaggaaauguguccauacugggggugaacuuugagguuucagaagcccacaccaggcccaggcacccagcuccagcaugcucucucuccuccuuacucccccaccucuguuuguggaucaggauguagcucucaauacuucugcaccugccuguauaugcucccuaccauaaugauaauggacugagccuggacacuaaaccagcccuuaguuaaaugcuuuccuuugauaacgguugccuugguuuuggugucucuucagaacaauagaacaggaacuaagaaaauaugugcaccguguacaugccugguguuaaggaggccaggagaggguguuaaauccucuggaacuggaguuaacagcuccaccauguggguucuggggaccaaacuuugguccucuggaagagcaacaaguguucuuaaccagugagcuagcccauuuuguuuuguuuuuaauaaaagagaucacuuuggauauuccaaaguuuugauuuguuuguuuugauucuaauacuuuauaaugaauagacucaucaaccuguuaacugcuuuuucagaauuaaaauuuuuuuuccuugucaguacacaugcaaaggucagaggacacuuugaggaguuguuuuucucuuuccaccauguggacuugaaaaucuaagaucaugaggcaaguaccuucaucugcucagcuaucucaccaaccccuugugaauacauucuuagugcugcuaaaacuaugggggaagucuggauuuuguaguuuuauuauucuuuaucuuuaaaaaaauaaguguauuuucacauggaaacauggauaauggauuuuuaaagcuacuugaagaugagcuugaaagccuuucuugagcaauacccaaguaagugaagcaaguuacgugacagcaaaaauacugaaauuguugcaguuugauuguuagauguacuagggccuugguaaugguaggaaaguaacuauugagcuauaauuuaccuccagcccuuuuuauuucuuuguuuuuuuccaacaugcucccugccaaaaugucucuagaaauuauauguguuggccuugaacuaucucugcagcuuagguuguccuuaggcugcagcuuagguuagguaagcuuucuuagcuuccauaguagcuggaauuaauaggucuaugccauuaguccagucaccagcaugguuuaaguuuaguccccuacuuuaaaguacagcaguaaagacaguguguggcuuuguguaacacuaguuaaaacugguauaagaauagagaacaugaacaccuuugcagggagagugugcuuuauguuuauuuaaaauauagacaucaguguuguuuaguuugguuuuugguauugggcauugaaucuagggucagacuucaauuauugcagaugagacuuuagugugucucuucugccucucaacaguacuugcaauccuagcuugaggugggaggaucacuggagcccaggagugugaggucauccuggauccaguuaucgcuaggaacugguaacuagaaauccuaguuaccuuauauuucgacagauaaaaguaagcuaaaaaugauuuguaauagaaaaggaagacaugaaucuugauuaggaacagguacaguucaagaaaaaucuccagcuuuuacaaaauguuacaagcuuauuuguuugaaaaacauuuucuaaggggaaguugauauugcaagauguuagucuccaaaacaaaacccaaagcagguugauggcaucugaggggcacuuaagguuggccucuagcuuccacauacgcauggacaugauggcuuuuuguaaauguagcaugaccacaugcccaaaacugggugacagaagaagguacaccaaacuuacuaugaacucuugggugcuuuuaagauuuacuauccaaggugcucaucagaaugggccaagauuggugugcuugaccucucauuucuuuacuugaggucaauacaauaguaaguugucuucaaaucaaacgauguagaacuccuuaaaggugguucuggugugaagaucuauaaccucagcuacacagcaggccaaggcaagaagaucacaggucagguuaagccccagcaacuuagugaccugccucaaagugaaaaaugugaacuauguuaaggcugcagccaugugcaauguacaaugcuugccuaguguuucaugaugacuccugccacaaaaaaggaaagagaaaaauaaaaaccaaauaaaaaaguguauucucuucagcuaauuuguaguggaguaggaagauugcuugaaugauggccuaaguaaggagaauggcugaugaguuuucagaccagaguuagaugaguucuuuuagcaaaauaaaaaaaagagugaguuguuugguuuuuuuuuuauuuuuguuuuuuuuuuuuuuuuguuuuuuguuuugucuuuaauugaaaaccuugaagaggugaugaauagcuggauguuuucaucaugaugugccacuuuaaaaaucuuauucagcagguaguuucucggaccuuguauccacuggccacagaacaaaguggucacugcacaugagaccuuuggaaauugaguaggauuuguggggacuaugaguugaaguagaguccauugcugcagucaucacaugcuuguacuucuuagcugaagcaguuuucauggacaagccuaagugacagaaggagagagacaagggaucauuacaagggaccaguacaacucuacugggaacauuuugguguggauuugggggcaguauugacucuguaccaucauaucaaaauauuguggaauuuaauggcagcauuuauuuacuucauuuugccuggaaagccaguauuguccccuacaguaaaagcucagcagugaagagaucuacuagugaguuguggugaggauuuaaaguuccauaaacacauuugucuuugaaauacucuuguguuucuaauaaauaguacuggagacaucugcaucugaaaugcuuagugcucuggguacaucuuugacugucuagaauagcuugggaugggcaguccuuuccaccagcuagauuccugaacucaauaaaaaggagaaaguuagcuaaguauagacuuucaucugccuuuguuuccuaacuguggcuucagugugaacagcugccucauaccugccaccaugccuuccucuucaugauagacuguuccuuuaaaagauucagaguaaagccuucuuuccuugggcugcuuuugugagaauauuuuauaacagcaauagaaaaaaauaacaagugcaauacauuuucauaauaaccaaaaauaauacagguauaauguaaacccuacuuaauaaaacauugauuacccaaauagcaauaauuauuaauaaauaaaacauuuaauauuaguaucuuuuguuuacuaauuuuucuguccuguagaauacaaguguguuucagaaguacgauaaagaaacuuaacagugaacuucuaauuuccuuuuuaaggaaaauuuuacaaacacaagaauaaguucacccuaggacugcucuuguguuuaauggauuauaagcauuuucuaguaaaugcacaugaguagaaguuuauggguuuuaaggaacaucuucuaccacucuuaaguuuuagaaggaagaaagcaaucaauuguggggaggguuccuacuauguccaagcuguauuuuuacccacaggguuguaucuaaucuuuacauuaauucugagaauuugauguuuacuuucccucccccaaucuuucuuaagaugaaacuuguuuauauuucugauauacagcaugauaauuuuuucuuuguuuugugguagugggguugagaccuagggccucaauauaugccagaccagagccccuaucucugagauguuauacuucagauccccuaaaaguggcuaaauaaugaaaucaaguuauaaauaauuuuaauaaccacauauuuauccuuuuguaagaauuuucaggauuuccuuuuagcacuuuucuuguuucucaguauguauccaguauguuauuaacuacaaucacuaugcuauguaguagcucuguagagcuuauucaugugcuaugacugaaacugaaucccuugaacaaucccugcacuucucccuuccuguacgcuccacacccuguguuuaguuuuuaaggauuccuuuaaaaugaagucaauaagaacuguucacuauggaaggacccaaccguuuugacuucuaggugaaucugcuagucacacuugccauguuuaucuaaucagcacuugguguguauguucaaugccaucugguggugagcugaguugggggucacaguguugagguugccaaaaggacuuauuuaagugaauggaaagcagaaaaagaaacaugcugcagcagaauauacuguuuuguaucaggcugugaaaucauagucacauaaauucagcaaggagaugcacagaaaggacuaauuauuucugaauaaaguaugugguuuauuuuugguaauugaggcaugauaguuaucauagcuacccauuuauuuguaaguuacacuugcauucuagcuucagaacucaaaacucacaucucauucuagugcucuaguggaguaagcucucacaucugagauguucuggggauccuacugugacaauggucucaggaggggcagugucugcuucuguuagcaucaggaauccaccauccucuucuuagaauuguuuggagugggcugguuuccauuuuuaccugccccaugaguauuggagauugaaccuagggccugugcacacagcacucuaccacuggcuauuaauucaucugaaguaauauucuuuuuuucuuucuuuuugguuuuucgacacaggguuucucuguauagcccuggcuguccuggaacucacucuguagaccaggcuggccacaaacucagaaauccgccugccucugccucccgagugcugggauuaaaggcaugagccaccacgcccagcuugaaguaauauucuuuaaggucaccuaucuccagacacuuacuuuagucaaugacuuuuuccaaacagaucuuuuuguugauagguggucaaccuuagugcuguugcgcucaucacacuguaucuggcacagcacaggaaauccuauggccugguggcuuauauugugaguaccaguccucauaucuauucuuuuuuauauacuuugagaauauuguccaggcugaugccuguacuugugcaguuuugcuuauuucuugaggugugguuuccuuucggcuucaguuuuauguuuuacucuuuuacacauauuuauuuugacauuuaucaugacacaccuauggaggucaguggacaacuuucaggaauugauucucuccuuuuaccauaagagcacaggaugaacaaacucaggucaucagggucagggcaaggaccuuugcccacugagccauuucacuggcccaguuuuauauuuuuaaaaccuguuugcuugggcauuuucauuuuguuguucuucuccaaguuaauauauguaaaauuaagacccuuuaucuccauucuugcaucaugccucuucacguaacuuauuguucauacaugagaacuuucaaaucaaguguucaguuuaguacugcaggaaguuucacagaaacuaacagaccacuaacaggugucuaaaugaucauuuagccggucuagaauuguuaugaaguagcauacuuuugaaugccauguuuguuuauaaugugguauuguuaggugauugccuaaacagggcacaguugguugagauaauacugguagcuguggucugaaccuguuucuauaacucuuaauaauuuuuugaauuuuuaaaauuuuauuuguguguuuugccuguauguaugugcaugcaucacaaucaugcaugguaccugaggaggucagaaaggauguuagcuuuccugggacuggaguuucagaugguugucagucaucauaugaguacugggaauggaaacuguucucugaaagaauagucaguguucuucugagccuuugcaccaugagaaauguucaaguguaacagaccuguccaccagagacuuaauauuuacuucccacuuaaaagguaaugaguggauucuccuguaaucucaauauugguggguauaaaugauacuggaaauaacuguagcuagccaagaaaaucacaaguuucuuuuuuccuuauacugccugccugucugugccugucugucugucuuucucucucuucccccugccccaacccccuucucuuucaagacaggguuucucuguguagcccuggcugucuucaaacucaaaaagaucagucugccucugccuccugagugcuggaauuaaaggugugccccauuacugcuuggcugugucuguggccagcauucauaaucagggaacugucacauuucagacagguuaaugaaaaucaggauguuguuuucuucuucauucacaaugucccugaauuuaucuauauaugagugugaaaggaugcauguggguucauauggaaaucagaggauaauuuucaggagucaguucucuccuucccugcaaaagacuaucaauuugucaaaaacaaacaaacaaacuaaaacaaaacaaaaccacccccccacacaaaaaaaaaacaaaaaacaaacaaacaaaaaagacccugaauucaggccaucaggcuuucaguacuuuacuucugagcuccuuuaccagucucaugccuaugaguucuauccauggaccccacugaaguuucuuucacuugaccuaguuugccaagcuuccuccucugaagcuggcuuuuuuuuuuuuuuuuuaaaucuuucuagaaacaaaaauauacucguguccguauguugguauuuguucuucccuauacauagaaggucuccugcuuugaucagcuaaugucuacugagaaaugcuuguguggucaguacccagaggcccuccucauuccuuugcauaauugcauaggacaccaagguguggacaggucuucuuguccccugcugauggaauuuuuuuuuuuuuuuuuugauaaauuacuaguguuuugcagugacuaaacuugaauuuacaacuucuuggaauuuuggccuguuuauuugggggagagauuccuacaaauggauuucugggccaaagguaaaauguuuccguuuuaggaagaaaaaaagccaacuuuucuaucauugaacauuucuacuaguuagaacaaaguugcacuuuuaaaaaagauuuacuuuuauuuauuucaaauuauguguguguaggggagagguaugugugcauauuuacauacaggugcccuccaaaucuagacgaggcauugucaaaacccugauugugcuagaaacuuuggaccucugcaagagccccaaacacuguuuauagcugaacccucucuccagccccuugaauguuaauuguuauugucuguucuggaauugaaagagaaauuguuggagguuugaaaguaccaaucugcgauagccauuguugucuuucagucuuuaucugugcuacuauuacacaguuuauuuaccauaauucuuacuuuauguuucucaucuggucuuuguuuuucauugcugauguggguauugagacaguaucucaauugucuuguuaaaguuccuguuaguuuuacugccugugucugcucuuaggucaaacuucacaaaguugucagacuaaaaaaaaauuuuuuuuuuuuuguuuugguuuuucgagacaggguuucucuguauagcccuggcuguccuggagcucacuuuguagaccaggcuggccucgaacucagaaacccgccugcuucugccucccgagugcugggauuaaaggugugcgccaccacacccggcaaagccuuucuucuugaucuuugugcccagacaagacuucuuucccuucugaacuuguauucaacuacuaucacuaugucuuuaggucuuuaguaggaugaugaacacauacacacacacacacacacacacacacacacacacacacacacauauauaugaccagugaguuuggguaauucuuggaaauuguauuuuugcuuguuuguuacagggcaagguuuuaaguuggagggcucaguaauuugacuuuuagugguagguuaaagcauguauauauguagaaccaaagucagcuuauagagauguucuuguuucuguaaaugaacaaaacaacucauaaaaauuuaaagcuagaguguuuaaguuuagucucauccgcacccccaagaauucauuuuuauucuaauguguagcaauuaaaauuaauacaaauguuugucguaaauuaauacagugacuuuuuuuuuuccuuuauccuagcuaguuccucaguaaugacacagaccaagauuuacucaaucaagcuguaucacauaaaaccugggcagucauugaucuauuuuaauccucuaagcaaaucccugagauacuuguauuuuaguacuggucuggcccucuuggcucuagauguauuuucccauaaugucuccucucucuuacucuucucucuccccccuuacccuggcuagcugaaauccugcccuauucucucuauugccuaguuauuugcuuuuccagcuucuguugauaaggcagagaauaaaugaugaacauuguuuacacaaacuugagacaggagauucuugacuuaagcaauacaaugcucuauccagauugcagcuagauaugagggcagagaaaucagcauuugaguaacucaaagauaaacuuuacagagugcacaauaacauuauggcuacacuaguguaugaauauuuugccuguaugugggucuggugcccaagaauuccagaaaagggcauuggaucccuuggaauuagaguuaagagugguugugagagcuauuugggugcugagaaccaaacccagguccuaugaaugaacagccagugcucuuuacugcugagccaucucuuuaguccuucuuuccuccuuaauaacuuuguuuaggucuuguauaucuuaaagcacaccuguuuaaauuuauaauuagauuaucucuagggaaguuaagaguuaugcagccaaggcuacaucuaauuuagaauguuucuacaaccuaaaagauuucugugccuauuugcagucauucccacccuggaccuaggcaaacacucaucuacuuuuaaugucuagagaugcuuuuauuuaaaauugguagcacgggggauaaaacaguauucuaccguugagucacugugucaguccugauuuaauuuuuaugugcuucauaucauaguuguuugaauagaaguuuccuuucauuuguauuuaagagagauaauuuaaguuuuaagugagaguuucaugagccuugaauuucaguacuuuacaaaaagaaugcugauuuucaaauacacagguaguauuuacaacauaccaguuucuguucuggugugcuuaaauggauuuacaaaauaguaaaaauuacaaauaauuacuaaagagucaaacaaaaguuuugaauagauuuggaaguaugaguaaaagucaaggcuguguaaugaccugcucacuugguagcaguguagacuugucugcaccuguaccaugaaccuucucaacuguauuuuugcaugguucuuuugggagcacccaaugcuaguuguaauauugacuuauaaguaacucuuggauacaggcuccuuuagguagugaagaggcccaccuucauaaugaagcaacauguggcaggggauagaauauagauuccagaauuucaauuuuuagguuggaaucuuugacauucaguaauacugaguuugagcaaauuauuugaugucgcugaaccugagguuuuuuuguaagauguagauggugucaucucugggggcucuugaguuuggggcagcaaagugagauccugccucuaaaacaaaacaaaaagugcuguauaggcaguccaguguaauaaccuauaguggauuuuaguuucuuuccuucugugggauaguucuuuaugguggagugguuugagaaugguuggggaggugguacaucaaaagcagguguagaagauuaggauuaaaucauuuaacaaaguguauauuucucuacuguggagauuuucuggggcagcaguuuagaaaguugauuagaagggcaagaugucagugagagcaaugaagacccucaauccagguggagguagugcccaaccucuaguagucaugggugugaagagacugaauggauuuaagagauaacugaaaaagcuaagauuaauaaaacugacuuuauguuucgauaagaacaauaagaaucaaaaugacuucucuuaccagggugggaaauauaaaaauaauauuuauuugauggaugggagaugaaucaggagguuggacuuggccuguaaaagauacccuucucagagggcccaggggaaaagggugugguguauaaguggccuuaaggaaaaaguggugcucucucaguuuugaguugaccaacagagcuuuccuuuauaaccugggaagucagggagaaagaaggaaggaaagacugccaaggaguuuucagaugagauuuugcaaugaacuucccuucauuuuuguuuguguccugagauugggagaguuuaaguauaauggugaaugacuaauuggcagaggaacuugagggcaggccagcauucaggcucuauggcugagguauugcuggcuucuuugagccaaguauacagagaacugucaguaaaaaguagagugcaaauguuuagaaauuuuauaguuuuuaguuuauaguuuaaauguuuuauaaauuuuauagaaaagaaaugaagguagaggccaagggaauauggcuuuugaagagauuggagcauuaaaaauagugcucaacauggcacaauaggaaaaaaguuugaaggcauaagaauuagucaaauaccaccaucacaagcucaaggguaaggaagagugaauucaguuaacuuucccuugaggaguacguuuagggguacccugcuccauagggacaccuuagaguuuuaucucaccaugcuuaacuauguaguacucaaagccaaugugauuuuuauccuaaaggccccagucugacaaauuuugaaugcaugauguguacuuuucuuguguggaaaaaugccugaguaugagauuuuugagcauacacccagacuucaaaggaaaucuuggaaggccaggcaaucagugagagaaugagaagauccuucaguuagcaccugcagugcauaaaacuggaaagucaaguguaacccuguuguuggagaugccaagaacuuggcacauugccaaggaaagcagaggccacagauaaaaucauguuaacauggagcccagguggacuacaguaggaagaucauccagaugugggugcugaagcccuuugacaaagcucuagauacuauacagcucucugagaauugcuuucccuucuagauaacagucuucuugugguccuauccuuuuuugucucuauuuucuuuuugaauaggauuguuaaaaguucugugccauuguauccuagaauuguauaauuuguuuuugguuuuauaggggcuuacagccgaguuugccuugagggucaaaggaaauugagcuuggacuuugaacaguguaggaacugugaagacucuggagaauccuggugaacugaaugcauuuugcauuauuagaugggugcgagcacuuugagugccaaggaagauauguuugggugucagguugaugagaaguagacuugugauggcuagucuugauugucagcuuaauuggauugagaagagcuugugacauuaguaaaccacaccucugagugcauuugugaggaccuuucuaggaaggauuaaucaaggagagaaaacuacuccugaaggugauugguauucagccuugccuagccaggaugcccaauagaccucugaaacuaugacuagcauucuuguucuuuuaaauuaugucagguauuuugucauagcagugaaauagguaacuaauucauuagcuaucacauagcuuauuugugaauucugcuaguagauaugugaacugucuucccuauucauauaaauauucuuauaaauagccaaagucugguauacacauguagaaguuucucuaggucugaauaacuuuacaguacauuuuuuuauguucacuucauuuuuuuuuuuuuuuuuuuuuugaaacaggguuucucuauaagcccuggcuguccuggaacucacuuuguagaccaggcuggccuugaacucaagaaauccgccugccuuuuccucccuaguacugagauuaaaggcgugugucaccacgcccagcgaacuuaucauuucuuuuuuuuuuuuaagauuuacuuuuauuauuauauguaaguacacuguagcugucuucagacacuccagaagagggcaucagaucucauuacagaugguugugagccaucaugugguugcugggauuuggacucaggaccuuuggaagagcagucagugcucuuaaccacugagccaucucuccagccccacuucacuguuuuaaauaauuuuuuuauuagauauuuucuucauuuacauuucaaaugcuaucccgaaaguccccuguacacucccccggcccuacucccgaauccuggcccugguauuccccuguacugggucauauaaucuuugcaagaccaagggccucuucucccaaugauggcugacuaggccaucuucugcuacacgugcagcuagagacacgagcucuggggguaccgguuaguucauauuguuguuccuccuauaggguuacagaccccuucaacuccuuggguacuuucucuagcuccucuauugggggcccuguguuccauccaauagaugacugugagcauccacuuauguguuugccaagcauuggcauagccucacaagagacagcuguaucaggguccugucagcaaaaucuugcuggcauaugcaauagugucugcauuugguggcugauuauggaauggaucccuggguggggcagucucuggauuguccuuccucagcuccaacuuugucuuuguaacuccuuccauggguauuuuguuccccauucuaaguaggaaugaaguauccacacuuuggucuuccuucuucuugguuuucauguguuuugcaaauuguaucuuggguauucuaaguuucugggcuaauauccacuuaucggugagugcauaucauguguguucuuuugugauuggguuaccucacucaggaugauaucuaccagguccauccauuuggcuaagaauuuuauaaauucauuguuuuuaauaacugaguaguaguacuccauaguguaaaugcaccacauuuucuauauccauuccucuguugaaggacaucuggguguucuccagcuucuggcuauuauaaauaaggcugcuaugaacauagugaagcauguguccuuauuaccaucuggauuauaugcccaggagagguauugcuggauccucugguaguacuauguccaguuuucugaggaaccgccagacugauauccagagugguugcacaagcuugcaaucccaccaacaauggaggauuguuccucuuucuccacaucuucgccagcaucugcugucaccugaauuuuuuaucuuagccauucugacuggugugagguggaaucucaggguuguuuugauuugcauuucccugaugauuaaggauguugaacauuuuaccaggugcuucucagccauucgguauuccucaguugagaauucuuuguuuagcucuguacccaauuuuuaaaugggguuauuugauuguucuggaguccaucuucuugaguucuuuguauauauuggauauuaguccccuauuggauuuaggauugguaaagauucuuucccaaucuguugguggccuuucugucuuauugacagugucuuuugccuuauauaagcuuugcaauuuuaugaggucccauuugucacuucucgaucuuacagcacaaaccauugcuguucuguucaggaauuuuuccccugugcccauaucuucgaggcuuucccccacuuucuccucuauaaguuuuagugucucugguuuuauguggaguuccuugauccacuuagacuuuagcuuuguacaaggaaauaagaauggauuaauucacauucuucuacaugauaaccuccaguugaguaagcaccauuuguugaaaauacuaucuuuuuuccacuggaugguuuuagaucccuugucaaagaucaagugaccauagguguguggguucauuucugggucuucaauucuauuccauugaucuaccugucugucacuguaccaguaccacgcaguuuuuaucacaauugaggucaggcauggugauuccaccagacguucuuuuauuguugagaauaguuuuugcuauccuagguuuuuuguuuguuuguuugguuuuguuuuucgagacaggguuucucuguguagcccuggcuguccuggaacuuacucuguagaccaggcuggccuugaacucagaaauuugccugccucugcugggauuaaaggcgugugccgccaugcccgguugcuauccuagguuuuuuguuauuccagaugaauuugcaaauugcccuuucuaauucuaugaagaauugaguuggaauuuugauggggauuacauugaaucuguagauugcuuucggcaaaauagccauuuuuacuauauuaaucuugccaaucugcgcauuccuuuaauccccacacuugggagguagaagcaggcgaauuucugaguucuaggccagccuggucugcagagugaguuccaggacagccggggcuacacagaaaaacccugucuggaaaaaacaaaaacaaaacaaacaaacaaaaauccugccaauccaugagcaugggagaucuuuccaucuucugggaucuucgauuucuuucuucagagacuugaaguucuuaucauauagaucuuucacuuccguaguuagagucacaccaagguauuuuauauuauuugugacuauugugaagggugguguuucccuaauuucuuucucauccuguuuaucuuuguguagagaaaggccacugauuuguuuaauuuuauaucgagcuacuacacugaagcuguuuaucagguuuaggagaucuuugguagaauuuuuagggucauuuauauauacugucauaucaucugcaaauagugauauuuugacuucuuccuuuccaauuuguauccccuugaucuccuuuuguugucgaauugcucuggcuaggaucuucaaguacuauauugaauagguagggagaaagugggcauccuugucuagucccugauuuuagugggauugcuucaaguuucucuccacuuaguuugauguuggcuacuaguuuaguguguauugcuuuuauuauguuuagguaugggccuugaauuccugaucuucccaaacuuuuaucaugaagggguguuggauuuugucaaaugcuuucucugcaucuaacgagaugaucauguguuuuuugucuuugcguuuguuuauauaguggguuauguugauggauuuccauacauuaaaccaucucugcaucccugggaugaagccuacuugaucaugauggaugauuguuuugauguguucuaggauuagguuugugaggauuuuauuauuuuugcaucuauauucauaagggaaauuguucugaaguucucuuucuuuguugggucuuuaugugguuuaugugucagaguaauuguggcuucauagaaugaauuggguagagugccuuugaauaguuugaggagaacuggaauuaggucuucuuugaaggucugauagaauucuguacuaaacccaucugguccugugcuuuuuuuuuuuuuuuuuuuuuuuuugguugggagacuauuaaugacuacuucuauuucuuuaggggaaauuggacuguuuagaucguuaaucugauccugauuuaacuuuggcaccuggaaucugccuaggaaauuguccauuucauccagguuuuccaguuuuguugaguauagccuuuuguaguaggaucugaugauguuuuguauuuccucagguucuguuguuaugucuccuuuuucauuuuugauuuuguuaauuaggauacuguccugugcccucuaguuagucuggcuaaggguuucucugucuuguugauuuuucucaaagaaccagcuccugauuugguugauucuuuguauaguucuuuuuguuuccacuugguugauuucagcccuaaguuugauuauuuccugccuucuacuccucuugggugaauuugcuuccuuuuuuccuagagcuuuuuggguguguuguaaggcugcuagugugugcucucucuaguuucuuuuuggcgacauucagagcuaugaguuuuccucuuaggaauacuuucauugugucccauaaguuuggguaugcuguggcuucguuuucauuaaauucuaaaaagucuuuaaucucuuucuuuauuucuuccuugaccaagguaucauugaguagaguguuguucagcuuccccaugaauguugccuauuauuuauguuguuauuaaagaucagcauuaguccaugaugaucugauaggaugcaugggacaauuucaauauuuuuguuuuuguugaaggccuguuuugugacugauuauauggucaguuuuggaggagguaccaugaggugcugagaagaagguauaucauuuuguuuuaggauaaaauguucuguagacaucuguuacauucauuuguuucauaacuucuguuaguuucacuguguuaaguuucuguuuccauugaugagagugggguguuaaaguauccuacuauuauugugugaggugcaaugugugcuuugagcuuuacuaaaguuuccuuaaugaauguggcugaccuugcauuuggagcauagauauucagaauugagaguucaucuuggaagauuuuaccuuugaugaguaugaagugccccuccuugucuuuuuugauaacuuuggguuggaagucgauuuuauucgauauuagaauggcuacuccagcuuguuucuucggaccguuugcuuggaaacuuguuuuccagccuuuuacucugagguagugucuaucuuuguccccgagguggguuuccuguaagcagcaacauguuggguacuguuuacauagccagucuguuagucugucuuuuuauuggggaauugaguuuauugauauuaagagauauuaaggaaaaguaauuguugcuuccuguuauuuuuguuguuaagaguugggauucuguucgugaggcuaucuccuuuuagguuuguugaaagauugcuuucuugcuuuuucuagggcauaauuuuucucuuuguguuggauuuucccuuuauuauccuuugaaggguuggauucuugggaagauauugugugaauuugguuuuaucauggaauacuuugguuucuccaucuaugguaauugagaguuuugcuggguauuguaggccuggcuggcauuuguguucucuuagagucuguauaacaucuguccaggaucuucuggcuuucauagucucuggugagaagucugguguaauucuaauaggucugccuuuauauguuaauugacccuuuucccuuccuuacugcuuuuaacauucugucuuuauuuagugcauuuguucugauuauuauguaucgggagaaauuucuuuccugguccagucuauuuggaguucuguaggcuucuuguauguucauggucaucucuuucuuuaggaaaguuuucuucuauaauuuuguugaagauauuuacuggcccuuuacguugggaaucuuuacucuauucuauaccuauuauucuuagguuuggccuucucauuguguccuggauuuccuggcuguuuuggguuaggagcuuuuugcuuuuuuguuuucuuugacuguuguguccauguuuucuauggaaucuucugcuccugagauucucucuuccaucucuuguauucuguugcugauucucgaaucuauguuuucugauuuuauucccccuaggauuucuaucuccagaguugccucccuuuggguuuucuuuaauuauuucuacuuccauuuuuagaucuuggaugguuuuguuuaacuccaucaccuguuugguuguguuuuccuguaauucuuuaaggacuucuaccuguuuagcaguguucuccucuauuucuuucuuuaagugaguuauuaaugcccuucuuaaaauccucuaccagcaucaugagacaugauuuuaaauccgaaucuugcuuuucagguguguugggguauccaggacucgcuguggugggcguacuggguucugaugaugccuaguggucuugguuucuguuaguaagauucuuauguuugccuuucaccaucugguagucucugguguuagauguucuagcuaucucugccuggagauuguuccuccugugauucuguuagucucugucagcacuccugggaguccaacucucuacugagucccaguggucagaguauucucugcaggcaagcucuucucuugcagggaaaguacacagaagucuggagcucagauccaccuccucaguuccuggggucagagcacucccuguaggccaacucuccucugguggggaaggugcccaggggucuuggucucagcuccgccuccuagcugaggaugaaggccagaagguacccuguccaagaagcucaguugcuucugcugcucacaugcuuuccugcauacacugaucucagugaucccaagauccuggguguguuagggugcuugcggcauguagagaccuguggggacuuugggaccgucggcugaguuugcaccuaagauggcacggagcucuacaguucauuucuuaaguaugugccacauugcaaguaaaagccaggguauuguguauacuuuugaccaagagauagaaaauaauuuaucgaguaaugcccaggaucauuuaaguuuuuaaucguauuaaaauguuacguacuaaggcugcagagauggcucauuggguaaaucacuugucgcacaguuuuuagaaccagaauuuauguucuuacucccaaguaaacacugguggacuguaauucuaacauucagaagacagacaugauucugagaacaagcuagcuggcuacacuagaagaauuggcaaacuuuggguuuaagugagugagaaacugugccuguuugagguauaugguagagagcaguuaaggaagauauaccacaucaaccuccugccuucauccauauaugugugaacaccauacccaugaauaaauaauaagggaccaaacuaaagcuaaauuuagucuuauuuaaauuuaaaagcaaaauuuagauguacuuuucauuaacucuaggcuuuugucuugcuagguuuuuuuuuuuuuuuuuuccagcagcaaucaaccaaagcaguuguagucuuuuucuugaaaaccccuaauucuuguguuccuguuacaacucugauuugaaucaucucacuuuaacacuucucagcuuuggcuucagcaacagcaucugguaaauguuuuuagucucaguuuauagaaaugaagucagguaugacacauucuagagggcuggaggaagaauugagaugaacacacaguuguuuacccuuaagguuaauggauucugccuuugaguagagauguauuuaaagguguuaagaauuuauauucuuuggugcucagcuuucaggagaaugaugcuugaagagacacauuaaaguuucugaccuuuaaguucaugcaguugguggcucugagauagccaggucuugcagaguagaggcuguccucuuugaguauacagccacuucuccuaggccuguuuauuuugacuguuguguucuauucuuuuuaagacaaaagcaaagacuggaagcuauuguaauucacauaggcuucaugagccaauggguacaacugaguguggggguacaacugauucuuccaucugugacuuguggcaguacuugguuggugauguuuugugccuuagucgccuaucaggaauuugugaccuaugcaucuuccauuggaauuggaaggagccuuuauggcuaggguucccgaagaacacugacuugguguaaggagaucuauauagcugccuuaggugucauuacuucucucacuggcaaccuaaucuacaggcuguugggacuacacucucaaauuauguugcagaugauguguucucaaaaacuuguggaguuuugccacccagcuugguaauccuguaaugccaacagcacuugaaaacagcccgauuuccuaaguguaucuugcuaagauuuuguugaaauuaacuguaaguuggagagcucccaagccuucuggauguguaauaagaaaagaggaaacuuuacuucuuaaacuaucugaacucugacuuaggaaaucugcugaaauuuucagguuuuuaaugacuuagauguuagaauauagaggaugucuaguguuaaaaucaagagugauaauaagccagucauuuguggguaccaguauucugcuuuacugcucgaguuuugcagucaguucaucucaccagcauugggcaguaauaaaggcagauuaagcacacauacuuguauuuucgcacacauaaccuaggcuggcagauuccaaagccacagccuauauggcuguuggcauggucugaugacuauuccuaacuugcugaggugcccuguguggagagacugcucagagauaaauaaauacaggucagcuuuagcuacaggcugcccugcucuccuggucccugcaaguuugaaggcccugugaagcaaggacagagguguaacugguugguuugccuuggguuuuaugaccugaauuacaaaucaccucagcgcaauuggcuuucugaucuuuauuucacaaaugccuauaaguuaagauuauuugccuacauuggugacuguaccagcuugugaucugcccuugagauguuucugcagugugcuuauguuuaacaguuccuuucagucuuagauuuggguuccucugcuauauuaauuacaacauacuagggugaggcuaucuaggagauauuacaaaugguaagauaagguuguucuuuacacuugcccucuuauauagauacugacuuggaagucuuugaggaccucagauugguugauugugaauuucaauacucaguauggauaacuagagagaaggcacagaauacaaaagggagggaggacagugcauagaguauguaucaagcauauuguuuaugcuaggauggaaaauauuuuguguaugcauaugccaggcaaguggguaaauauuaagaggacagcuugcaggacaguaugguccuggggauugaccauuuacuuggaauuaggcugacaguuucaagucugcuacuuuaagaagggacaagggcugguugcagauggauagauguaugagaguccaguuuauaaaaaugauggccacuggaagcaguagggauucaauucaaugugaaguguccuuggcaguaucaauagcacucuaucagaaucuccccaagaguacuaaaagguggguaaagugauguucccgauucugaguugggcugcucauggagaauguacucaggugcuggagaauauuuuucuccauuguugguaggaauuagaaguuacugcacaguugauucuaguuuagacaaaucuaaguucuccauggagaaaugguaaagaacuggugggagauuuaggaguaaaagcugauccuauagcaucagucuaaaggcugauuauuaucaagugggguaguguacuauauuucccccaaggugaguaaaaaaaguugaaacuguguaggaaacauuuuaucuuuaucuugcauuguauugguuauguuucacauuugaacacacauuugaauauaugaaauacauuuaggauaggaaugaugguauaguuucauaaaauaucuaguccuauuaaucacauuauaaauguuagagaugauugaacuuucaguagucaaaaguuaaauuaugggcuggagagauggcucaguggguaagagcaccgacugcccuuccaaagguccugaguucaaaucccagcaaccacaugguggcucacaaccauccguaacaagaucugaugcccucuucuggagugucugaagacagcuacacuguacuuacauauaauaaauaaauaaaucuuuuuuaaaaaguuaaauuauaugcaugaccuacaagggccuuaaaugggccuaguauuguguggaauuuugucauguuagugaaaagauauggugugcugaaugacuugagguaucccaugcguugauuuguagacuagcaaccugugcugacaucucucauuccauuuucuucauuuacauuuuguaaagucauuaaaaaauuggcaauuuuugauuuguacuuagaaacacuuauguaaaauuucuacauuuuaaugugauauguauaaacaauucuauagaaugugcacacugugaaguaccaacuaaauacagaaugguauuccauagaguccuugauuggugacuccaacaucagaagcauuacaaauuguguuuugaaguagcaccauacacuuauaaauaauaaucauauuaucacauuauuuccauauuaacaauaccauaacgauuugguaagcauuuacugucaaauauucuauuuauuuucuauauauuuuauuaucuuuaaauuuuacagcagccaugucaggaaaguaauuugccuccauuuugcaggcuaggaaauucaagauuaguaaggaagguaugagcugagcuucaaggcuuggaacccgggguacuuuguaaauuuagauaauucuucccaaauucccuuguaaaaagaaaguccuauguccuuuuaucuucacacuuaccaguguuagcuuuuccaaguguuaagugaagaauuucuaaaacuuacaggcaacuagugagauugcauugcuuuucuuaccuuuuagcuaaacucuucucauuuuucugggaauuuccuaagcuuguucucugcugugucuucuuuugaguuugucugacuauuauguagguccaaugcucuguuucaaccuuugaugacuuuagaagguaaagaacgacaacagucucuuauacuuguuuuucucaacguuuuuucaagaacaauaauaguugaaugauuuuggaugaaaugucuaaauauauuuuacauacauaccauagagugaguuuauuuccauguagaaagugagaaugugugaaauaccuauagacacccacagauuguuucugucagugucuuguccuguuaccaaccccagaaaguagaauugaccaguucucucuuauuucaucuucagguuugccugcaaugagacuuuacucucuacacuuaaagaacauucuuucugagcugcugugaauaaauuuggaaugauuuugucuauuuucaacuaauggagaacuagcuguaacuugaacaaggauuacuguacuggacaacuucagaacauugcucacaaugucaucaaacaggagucagaauccucauggacugaagcagauuggucuugaccagaucugggaugaccucagagcuggaauucagcagguguauaccagacaaagcauggcaaaguccagauacauggaacucuacacguauccucuugcuugagcuguaguuggugugucuaggguuggauuauuuuguguuaugguguuugaauuauuaggaauguuaugucauauuuccuucuuuguuuaccuauaauaaaauucuaaguucauuuuuauaucucuuuuucagcagagguauuuuggcuagauagauauuuaagguggugcuggcuaguaaccccagauguuuguguguguguguguguguauguguguguagcacucauggaggacaauuugaaagaaucacuuccuccugacaucacauugugggucucaggguugaacuuaggucuuuaggcuuggcagcaagcacuucuaccugcugagguucuuaccaacauuauccuccccccacucccgccccaccauaucauuagcuucuauguauguagauuuagccaacuauagauugaaaauauuugaacaaaaaagucucuuuauuaaacauguagacccuuuuggucauuauucucugagcuuguaacaguuguuguguagcauuuguguagaauuaagcauuuuaaguaauccagagaugguuuaaaguauagugugaagaugcagguaaauuauauacaaauucauuguuauauuuuaucauguaauaguuuagauuucccuugggagguccuguaaugauuuacaccauuguuuaguuacuuuucacuguucuguugccacuaugagaaaccaugaccaaggcaacucagaaaagacauuuaauugggagcuuucuuagaguuaguuucagagggugcguccagcaggcaggcaggcagguaucuugcuggagcaguaacugagagcuuacaucucauacacaucuugggggcagaggggcuaauggggagaacauugagcucuugaaaccucagagcccauuauucccagugacuaaucuccaaauaggccacaucuucuaauuggaaacaguucuuccaacugugaaucaaauaugagccuaugauagccauucucauucaaacuaccacaccuguaaacacgaagaaguaacuauauaaaauuuagguccuuagcaauaauacccauauuucaaagugcucaguggcuaaauaauaaaauauauuguagaaaguucugugggcaguauuguccuaaguggguuuaaaugcucauuguggcugcuaucauguuacaggagaauaagguaguuguaucacagucugguccacaaaguccuaaaauauuuucuauccauccuuaccuaugcaaaaacugcuuaccaguucagaaugacacaccuagaacaaaagcuugaauauuaugauccuauuugcauuacucaguucuaagagaauaugguaauuaacuuuucuguuugcucuaacaaagcagcuuaaggaaauaagaguuuauauguguuuauaguucacagguacaguucaucacagcagggaagauguggagguagagucagggugauuaggaguucaaggacauccuuaacauagcaaggucaaggccagccuaaacuucuugagaccuucuuuuuauuuuauuuuauuuuuuuaaaaaugaagaucuaaagcucagcuaacugaauggagcagauugauacugauccgagaagcagcucuacugugggcacugugauggcaggagugugcggcugcuggcagcaguguccacaggaagcagugugaugaguguucgugcuucucuugcuccucacucuucugucuaaaggugcuaugcugcccaugagcugguacugcucauccaaaguggaucuuccuccucagcuaauccccuuuuagaauucucccacagguacccaccagagaugcuucuuguagguaauccugaguccucuggccacaguggagauuaaccaucacaaaaagcaauuuuauuggguuuugguucauaauguauaugaaggacuaugcuagcucuuguaaaaguuauaagguuuuaaaaggcauaauuccugcuauuauaacauucuuuaagauuuauuuuuauauacuguguauuuguguuuuaccuacauguauguaaugugcaccacaucugugcuuccugaggaggccuaaagagagcaccuguucuccuggaacuggaauuauggauacagugcuagaaacuaaaacacugguccucugcaggagcuacaaguauucuauaccacugagcugucuagccucuaauuuguaguuucuugauucuguacaaauauaaaauuaaaauuagaauuuaccagucaggcuuggugacucaggucuaugauuccaucagcucuaaggaggaagagucagggucaucaggaggucaagaacauccucaacauagcgagguccagacaggccuaaacucuuugagaccuucuuuaaaaaaggaggaggaggaggaggaagaagaggaagaagaagaggaggaggaggaagaagaggaagaagaggaggaggaagaagaggaggaggaagaggaagaagaugaagaagaagaggaggaggaagaagaggaggagaaggaagaagaagaagaggcggaagaggaagaagaggaagaagaaggaagaggaggaaaagaagaagaagaaauaauaauaauaaagcucagcuaacuuaauggagcaaauugauacugauccagaacguuuaguugcucauuuaauugguaugugaguuuaaaacuuuaguauauaucaguacuuaucaaaacagguuauauaacauuuaaaauacuuuaauuuuagaauacuuaaauuaacuuauaaauaaaugucuauuauauaucuaauauaugugucuaauaugcauccauaauauaaauguauuuuuauacuuaaaugcauuuauucuguuuacaaccaccuguaaccagcuccagagaauuggauaucccuauccuucucagguaaucccacacauacacacacauacucacacacacagacauaaucaaaaauaaaaaaaaaaaagcuuaaaagcaaaaacaacuuuggguugacaagauaguucaguuaauaaaggcccuugcuaccaagccucacaaccugcguuaagucccuggauccuacaugguggaaguuaagaacuaagcuugccucugaccucuacaggcaugcuggggcaugugugccaucucuccaucaccuccacuaaaacaaacaaacaauuaaaauaugggucuaccaguaugaugguguaauaccuuuaaucucagcauagaggcagaggcaggcggaucucucuugaguucaaggccaaccuggucagguuuauacaguguuacacagagaaacccugucucagaaaauaaaaagcaaaaacaaaaaauuaaagcuuggggcuagagaaaugacuuagugguuaagagcacuuuuugcacuucagauaaccugaguucaguuccaagcacauauauugggcagcucacacagccuguauauccagcuucaggggaccccagcaccuuccucuuaccuucuuggucacacacauaaaaauaaugcagucuuuaaaagaaaauucgaaaguaguaacagcuuaguugaaguauuaacacacuuaaaauuuuucagcauauuuaguuuuauaacuaucagugucugcauuuaguguguguauauaaaauuuuuguuuaguuauaugaguaaggguuuuaggguguuuuacuugcauguauuguguuagaugcccuggagguggaauuacagucaccugugaagugccauggauguuggagauuaaauccagguccgauuacagaaaguguguuuaaccacugaacuaacucuccagugcccuuaggauauuuuccuuaccccugaaagauucaauuaggaauugaaucuccacacccccaugccccuucucuggcagucacugaucuaguuucuuugaauuuguguguucuagacuuauccuguaaacauuuauacaguauauggcuuugugucugguaucuuucacuuagcauaaugguuguaagcgucuuccuuucuuucaugacugguuuguauggacguuuuacauugugcauauccauucgucagugauguaugucuuuuguuauuuccuuguauuuguguuagauacuuuguuaugaacaucguguacuaguuguugagugaccguauguucacucauucucuugaguagguagguaccugugagagaaauugcugagucauagauagauauguuggguacuuuuaaggaaaaugggaguuuuugccaaaugaguggauagaguaucucccaggcuuuugcuugcuaugacugacuuguggcuggcuugcuuguaauagaacuaaaaggcugauuucagugguaaagcaguuuucaguugguaacauuuucagaaacccaugugguugaguuuuuguuauucuucacaaaagcagaccagcauuacuuuggugaccaaggacacuucauuacuaaucuaucuauuuuuuuguuuguuugcuugcuuguuuuaauuuaaaaauacuuuguuuuuugagauggacucauuauaauagcccagacuagcuuuaaacaugauucuccugccucagccuaccaagugcuaggauuugucuuacagguuauuauagguaccuggcccuaggaaauuauuuuaguugguuguuuaauuuguguaaguaugugcgugcaugauauggggaagagaacuucaugaagauacuucuuuccgucuacacucauguggguucucaggucaaauucagguugacaggcuuuuguguaagcuucagcagcccaaaauuucuuaguauguaauuuucacuaaauuagauagguuuuuuuuuuuuuuuggcagauuauuuuugcuuugguagggcugugaggaaguagaaacuuucuaugcuuaagaaauuacugaauucucuuauucuguagauaauuuauugcuauuuugauaucugaaaaguuuuagcuuugggcccuuguuuucaccuugagugucauguguguguguguguauucacaauagucacaauggaguacuuuuuuauagaaaacuaugaagucuuuucuagguagugaguaaauaauacuuauuacauaauguaaucuugguucucuucuuaggguuauuucauauaaugcccuauacugggcugaagaaauuuuuaguuuuaaaaaauccuaauguaaagaauuuaaaaagcauucaaaguuuauuuuccaacaaagaacaucagcaggcacugggcuuauaaaagugcuuauccauagaacauauucccagaaggagccacugcucuguacuuggcugcuucagguugaacagauacuguuguguacacuuuccauucuagaagaaagaggguagcuuagcaaagaguuguuuuuaauacuagagucagguggaacaaucaagaagcuugaguaacauccacauuucaagaaaguccuuugauagagaggagaaagaucccucacucaugaguugggccuuucuucaugagacccucagcaacauuucauugucuacuuaauacuacauguacaaaagguaauuaaaauaaaggaaucaaaagaacaucuugacuaucugcuguuucugucagcccagcaacucuuagguuucagacuggccuggggcuugguagagugcuugcuugucuaggugcacacacuucugauuuugaggugcacacgcugcuuuuuuugaggcaggguuuuucuguguagcccuggcuguccuggaacucacuguuguuuuuguuuuuuuaaaaaaaacaguugucuuccuuucuuuguauguuuucaguauaaacaugcacuuaaagauauauauauauauauauauauauauauauauauauauauauauauuugguaucaguauacuccacagaaauuacugacauguaaaugauuaauugagugguucaguuuguuuguucuuuauuaguauauguaugguauauuucuacuuucuuuuaaaacuuaaaugcauggucuauauauucagauuaaacauuauaaaauggguuuugguaugaugcucagagguuaagaacacuggccacucuugugagcaccacaugguagcucacaaccaccuggagcucuaguucuagagaccaaguaccaucuucugucuucuucagacacgaggcagagacuuguugggcauauaaaccuucagguacucagaacuaccuucaaauagcuguugcugaggaugacccuaacuuuccaagugaugcugacauuccagguguucaggaccauugcuguugcuuuaagaggcaguucucugaugaggaaauacugcuguuggguguuuuauuaguuguuugaccuucugucuguaguauacuucggucauguuuguuuacaguuuuuaccuuguguugauuuaaauuauguuuuuagggugcuagguauuaaccuaggaccuugauaggcaagcaagugcucuaccacugagcuacauauaucuccccagcccaaauaaauuugcucaagauaguaacucuccuugaagguaguuuuacuuuaacauguucagauuuucagcuuagauauuggugauuuuguuuggaaaggugaucuccagcuugagaacagguaagugacaauuucugcaucuucauuuuauucuuuuaguuuauauauuuuuguugauucauuugugauauauauuugaauuauccuuaaugucauuuauuaaguaaucuuuuacgcacugauuuuggaagaaucuauacaguauguccuuaaauacaguagaagaguaugucuucauuguguguccuguuuaaugcucccccugucugacagcaguaguugucauaaagguuauaacagaggcagugcucucuuugccuuugucuuccccauccucaaguucuaucaugcuaauacguagaggcagcugguucagcuuuucauuucuguuccuguaauuucuaugccucuguuucacagugguguauugacccgaugcuguuguccaguuguauacaucugugacucuauuguuguaucaagcuaucacuguucugcaugcccuuugcuuuguauuuuugaguaagucuacuucugagucaucugaaaauaauguuucaguuauuucgguauuuauaguguguacuucuggcuauguuauuuguugccaaguaucauugacuuugauuaguacuggcuuuuguuuuuccaaaaccaaauacugcaauugcuuuuuuccuugaaauuugcaaccuuucuaaccuguuggaauuuuuaggacuguuucuacaaaaucagucauguuaggcaaucuuauaggucugggguuuuucuugauauucuuucaagaauguuccaucuguuuuucaggcuugugggcauccuugugaauggacuugcugucuuuuuuuuuuucuuucuuucaauugagcuaauuuuuauuauauucaacacaauauauauuuuuauaccaaucauaaaaauggcggacauauuauuagaugaacauaaauagauaaagucuuuuuguuuguuuuguuuuuaguagagcuuuaaaaucuuggcucuuacugugguacaaacccaaaauaagaacaauuuuuagacauuggaguucauuguaauaaggcuguacuucagugccccucacaucaccaaagaauuuuacuuccauaguagcuaagcuaagaguugacaguccugcugcaccaaggaauguauuguaggcaugauuacuuggcuacauauuuccugcuauggucaaagcuauuugacuugagugauugucaucauucucagccuacagggaacagguuacauucauuuaagaaaugguguguguauuaagauggucuauccaugaagucauucaucaacugcuucaaugaacaaugguucugcuuggagggaggcauagacauuaggugaggguaagauucugcuucauuggcugugaugauuuuaaaagcauucaucucagaaaaagaguaacuuauaagguccucuacuucaaaauugauacaacaauuauaaauaucaagcaaaacauucagucucacucuuaauuuguucucuuacaagccaccucccaaauuaauugucuacauuucuuuuggcuguauaaauaauuuugaaauaagcuguucugaaaaccauaguauacuguaaaaacaucaaacaauccuacuaauagagaggcugagauaggaaaagcaugauuucaagaccauucuauggucuacagcaagaaacugucacauacaaacaaacaaaguguauauggguuguacaauauuggaccuauuucuacaauuaccaaauuagagagaccacuggaugacagccaacaaauuucuaauucuucauauuuuugaauuucaauugauuaggauauguugguaauauuaacuuucuuauuaagagauauuaaggaaaagugauuguuacuuucugauauuuuguugauagagguggaauuauguuuguguggguuuguugaaagaugacuuuucuugcuuuuucuaggguguaguuucacuccuuguguugguguuuuccaucuauuauccuuugcagggcuggauuuguggaaagauauuauguaaauuugguuuugucauggaauaucuugguuucuccaucuaugguaauugagaguuuugcuagguauaguagucuggguuggcauuuguguucucuuagagucuguacaagauuugcccaggaucuucuaucuuucauagucucuggugagaagucugguguaauucugauaggccugccuuuguauguuucuugaccuuuuuuccuuacugcuuuuaaaauuuuguuuaguacauuugguguuuugauuauuaugugaaaggaggaauuucuuuucugguccagucuauuuggaguucuguaggcuucuuguauguucauggucaucucucucuuuagguuagggaaguuuucaucuauaaucuuguugaagauauuuacuggcccuuuaaguugggaaucuuuauucuauaccuauuauccuuagguuuggucuucucauuguguccuggauuuccuggauguuuuggguuaggagcuuuuugcuuuuuguguuuugacuguugugucaauguuuucuaugguaucuuuugcaccuuagauucucucuucugucucuuguauucuguuggugaugcuugcaucuaugacuacugaucucuuuccuaaguuuucugacucacgggcugucucccuuugauuucuuuauugguucuaguuccauuuuuagagugaagauucccaacuuuaggugguuuuguucguguccuuugccuguuugauuguguuuuccuguaauucuuuaagggauuuuuguguuuccuuuuuaagggcuucagguuauuuaucuuuguucuccuguauuucuuugagggaguuauuuaugucugucuuaaaguccucuaucaccagcaugaucuuuucugcugugaugauguauccaggacuugcuauggugggagaauuggguucugaugaugccaaguaaccuugguuucuguugcuuauguuaugcuugcuucccaccaucugguuaucucuagugcuaccugcccuggcuaugucugacuggagcuuguccuuccugugacccugguuaugucagaacuccucagagucaagcugucucugggauccugagauccuggugugacuaagcuccugggcuccugggaucuuuggagcgccugggaguggagcuugcucuggguguugugggacuggcuguggaguuugcacccaaggucugcacagggaaccagcccagaccagaaggaaccugugccacuggucugguggaguuccugcgugcgggguccagcuggucccaguuguucccuguguugggacagauccuccucaccucugauccugugcucgggcuugcugucuuuuaacuuuaccagcauuuuccacuuuaguuuuauugggaaucuauugcuauauaaacagaaggaaauauguuuauguuaauuacuguuacgucuaugguauguguuacuuuccuuaacuuucuccaagucauguuuauaacuacuguacuagugugcaucaguccaaccaagcccggggugcuggagucccuccuuccaagucaaaaaaggggcagacuccugggggagcucaguuuguuggcuuggaguuauacaagcgauugaaggaauuuuugaagaauuauuugacaaaucuucuuaagguaagaugucucgaugguauaagcauauaaaaauguccauuuuguucacuuuuuucuuacgugcaaugauuuuuuugugacugccaucucugucauauuugcugcuuuagauuaaaauugugcuuacacuggguuagcucuugcuagauccauauccuaugaguuaggggcucauuagcucaaaccauugcuuaggcaaaggugagucuuuuuccuuucauuuuuuuucaaaauaggguuucucuaugcagccuuggcuguccuggaacucaauuugucuuggaacucagacccaccugccuccugaguguugugauuuaaggcguacaccaccacuaauggugaaaucuuuuaccuuagcuucugccuuugguuuuuaguaguuuguucuguaacaaaggaaguggguugccuuacacucagccaucaggugaucagguagcuuccucaccugguauuguguauaugaugucuucagucuacaaagguauuuuuacuccuaccugggaaaguucucagucucuucuauguauacaguucauuuuucuuuuaaaauuuauauagcuguuauacaauauuuucugcaugauauaaaacucuuguuuucuuaauuauuuuacaagcuaaguggaaacacauucuaacagacuguaguugacucauaacuaauguaucaguuucauguucuuaaacauguguccuuugacuuuacagcacuugguaaauaaauaagucuuguaagcaaagucuguucuguuuuuaguagcuacuucaucagcaacauacuuguuuuuuauaucaaaaauagaccaauuuauguuuucaaauucauuucauuuaaauacacaaaacauuugguugucucugggugugaccagguauuuacauagaugguugggucacuugaauguuauugcuuguagaauuacaagucugcuggacuuuggcuuuccacaugaagacaacuucuugguauacuuagcacagcaucuaugaauaguagugcagugucuuuaaaggguaggacacacuuuggaauugucauuaauaucuaagaacuuuuuucaagucaauccuauucaaauaaaaacuagugaguuuuaaaguaggaauaauuuggauaacuuccaguuuucuuucugaggcuuuguuaaagaagaaauguuguauuguuguuauguuguuuuuguuacaaaaauacaacaaauacuaaaauuaagaugaauaguuuuguaaucuuacaaauuugugaaacacuucauauuuuuaaaaaaugaguauacuuuuauuauaauuuguuaaucagauagauugauuuaaaauaaaaaacugggaagauaucaaacagagaugcuuuggagguagauucccuaauaagaagaaauugcuuaaaaacuuaaaaaaaaaaaaaaaaacaggacauggaaguacauacccuggaauuccagcacuggccuguaaucuuagcuuucuggauguggaggaacagaaguuacaggucauccucagcuacacugugaguguaaggcuagccuuggaaagcaugagauccaaggaguggguggguaugugcuugggcuacacaacugaguuuaaggccagccugagcaacuuauugagacccugucuuaaauuaaaaguagaguauugagcauuugacccuagcacccuucagucacuaguacugaagaaaaagcauaaaagaaaguaaaagcaccuucccauuuugaaagcuuaggguacacucuacgacugcauauaccuauucaacccaugaaaaguucugguuuaauuggauaaugaaagaccuuuuuaguguucuugugagaauuuuccauuagcuuguuucuguacauagcaauugacccaucuguaacugcaugcauuuguacauuuugaugcaguagcuuuuccaguaaguuuuagcuugauuaugugacaaacuauucauauuaaagucuuagugaacuuguuuuuaggauggagaagauuuaauggaugagaguguccugaaguucuacacucagcagugggaagauuaccgauucuccagcaaagugcugaauggaaucugugccuaccucaauagacauuggguucgccgugaaugugaugaaggacgaaaaggaauauaugaaaucuauucaguaagauuuuuuuuuaagaauaaauaaauaaccucuaaaaauguugugacaagaaaguagagaggugagaaauuagaacuauaaaauaaacauaguuaaauaguuuuguguuuacuuuuaaagugucuccaauuaauugggcaauuauuacgcuuugcaucgaacugcuugaguuuuagcacuagaauccuagaugcuggcaguugcuagcaaaucagguaccuuaucugaggauuaagcuccuaaccugggcauucauauacuuuuuuggucugagaguucuguauuugagagaggaccuugaauuaauuuuuuucuuaguccucaagguuuuuguuuuaggcuuucugguuucucaaaaguaugacugcuaaauguguauuaucagugucaccugggaacaugauagagauguauauucuuagaccaccuucuagacuuggagacuuuagagaugagccaauggugggggcagguagcucaguuaacacaguacuuuucuagugucuaugaaguccuggguccagucuucuguuuuguuuauguuaaguauuaugguacacauaccuguaaucccagcacuuggaugucaaggcaagggaauaauagguuuacauauuagccaacuugggcuaaaugagcccugucuaaauaaauaaauaguccacagaguuggggguguuagcuuagucaauaaaguauuugcuuuguaaacaagaaccuaagucccccaggaccuguguaaaaaagcaugauauugauguuuguaaucacagugcugggaggcagacacaaacagauacuuggagcucauuggccacacagcauaucauucugacaaguacaggccuauagguagaugguuccugacagcaaagguuguccccugggugcuauaugcacacacacauacauucaugcucacacacauuaaauaaaugagcaaacaaacacuucuccagguaaggagagucaguucuagagaaguugagggaggauuaauugaaaacauuauagucugcucauggaugugugucagauuaaaaucuuuuggggucaguuuuauuaaaaugucaguuucuaauguugugccauaauagcauuauuuuuguugcuuugcuuuuacaaaauuagagaaaaacuagcccagguucaagacuucuagcacucacggagcucaguuucuguaccccaguuguacuuuauaguacuguauaguuauauagguuuuuauuuuggcuuuuguuuguuugaaacaagguagcuucugaccuggaacuucacuuuguagaccagccucauaccugucucugacucucaagugcuaggauucaugguguguaccauugugcccaguuaguuacaugguuucuaauaguucuuugaaguuuuuguauuuuucuuuucuuuaauauauuuuaacugacaauuauauguuuauucuguugaacauguuuugaauucuguccaucauagaaugguuggugugcuucccuugugucagaauuugcagaauggcacucagugugguagauuuccuuuuggaaacugcuugaccugauguuccguguguaucucuauagugguaucacagcuccuaaaggccaucccugcuuuuucacuuuccauguucuugguucaacaguuaaacaaguuuaguaaaaaguaccaagauacuuuguuucucaagauugagcaagacauaaggcacaggucuuuuaaucccaguuccggggaggcagaggcagaggcagggauguaucugaguucaaggccagccuguacuauauaaugacacuuugucucaaauacauaaguaaauaguagacaagagucagccacuuucauuacuuuuaaauuuuacuuucaaauccuacacuuucuguuaucaaauaguguagccacuguuuggaaaugcagccauaaauucuagcagaggaaacccugaucaagucauuugcuaguuugugucaaaguucgguggaaacaugugguuuuuguuaauagcccagugucuagcaaaugauacuguuuugucauguaguucaaggucaagacaaaugauaaggcuuuuacuuuaaaaaaaaaaacaaaaaaaaaacaaaaaaaaaaaacaaaaacucuuuucuaaauuguuuuuccccuuuuuaauuagagaaagauguugguuugcuuccaagucucccagaggauaaaagcugauuucauuguauguugaagugcuacuggcaaaacuuguuucuguuacccuauugugagguuucuuugcuuugccuucuauagcuucugucuucuuuugcuuguugguuuuauuccuuugaagugauaaaucauccagagucagccuagguccauccaaaggugggguugcuaauuuagaaaguagguacaacaaaauaauuuuuuaaaguagggauucuguuagaagcugauacuauagccugauguuuucacugcugccuuacuccaguuuugagggcugaagaggcagggaggaaaguuugcuuuucucuagacagugagguugagucgucaguaccuuugcacaccacaaagcaagagucuuaauaaugcugggccuagugcugcaccccuuuaaccccagcucuuggauacagaagcagguagaucucagugaaucuaugcugguuuuuaagcugauacaaaugucagaacuacagagggaaaaacagacccaaaaaaugccuuaaauauugauuuuuauaguauuuauuuuauuggagacacuacuuggaaaacacuuuccauagacuaaauuugcauauuuuuuacaagcuuaauuuuauuucuaguuggagaggagauuggagaggaaguaaaauaagacuaagacauuuauguuuaauuucuugacaguuuauguguuaaagugccguaaauuucaauuguguuuuauuuaacuuucuaauaccucucccaacagacgucuaaaaaucauacauaaauucuaacuuuuuucuuucagagaucauuuuuacaguaauuaaucaguauaacacuugaaagaaguuuagaaauggaaacgagagcaugauaauuauacauucgagugaaaaugcaucucccgggcuggggaagauagcuuaguaagaaugcuugaguucagauaccuagcaccuauauaaaagccaugagcuugagcuuacugcugcuggucucucagugagagaguuugucucaagggaauaggguggagagugauagacacaggaaguucucaccuugucuccagccaccuguuugugcaucuucacaugcucaugugagcauguaccauguacacacaaaugugcguuucacacauagucuccugaagacacaaaggacaguggguguucuuaauuuauguacaagaaacugcauuuaaaaugcacaaucaagauuggaagauuuuuauaauuucuaaaauguaucuugauauguuaggaaacugagaguaacuagaauuaguuuuagcagguguuucuggucaaaacugauuggauccagggaauucauuuauagauagaaucuaugcugguuuuuaagcugauacaaaugucagccuuaacagcauuuucuuucugaacuuuguuguuaaauugugagaagguaaacaucuauacaaagugauuaacuuaagagagcagcucugacuucauugugauauuauguuuuuacuaaguuaucuaaagauuuugguaaaauaaagaauucagguuauugucugugacaaguuucaaggauauucaauacaucuuuuccccuuuuucauccagcuugcauuggugacauggagagauuguuuguucaggccauugaauaaacagguaucuacuaugggauauguguguguuuccuuaaaaaaaaaaaaagcuuuccauuuugaucuugucuccucaagccuuuugacuaucucaagaguauuuguugggcuuagucuguaaagugcuugcuauguaagcaugaggacaugggguagauccccagugccacguauagugcguauagugaugcccacuagugauccuagcacugcaaagguagggucagguagauccuuagugcuuccugaccagggccaagcuugccaccugaaugagcuccaugccagugagagacugucuuaaagacacagugaauucuuccuggcaaacaguucuugaaggugcccuuggucuaugucuacacaugcauguacccaucccccuaaaauauuuguuacuuuguauuauuuaguggcuuuaaauguuuaaaggauauauaagauacauugugagcuauaauauaccuuuuguguguucuuaaagguaacaaaugcuguuuuaaaguugauugaaaaggaaagaaauggagaaaccaucaauacaagacugauuaguggaguuguacaaucuuaugguaaauaauuugccuuuauuauaauagugcucuaauauucauuuuaaaauauuuauuaaagauucucaggaauguuaguucaucuuuaagguacuuuuaaauaguaauuuuacaaaucguaaaaaauauuuaaucuuuguacuuuaaggaaauuuugugaaaaaaauuuaauuauauuucuuuugcuguuuucaugaggaauuacuaauauauaauuguuuuuugagcuaaauaauaaccagaaaacuauaucaacuugaaaaauuugagauugagacacugauuaaaugaugcguuauugaagcuuaggugaguuggcauuucugugaaaguuuacaaugcaauauuuauaucacuuuuggaaauguaaacuuucucuaacuaaacuuguaauuuugaaguguuccuggcacaaguaaggauuauuugcugcuauacaucuuggaguuuauucuuuuuguguuuucauuuauuggcacaagcauacuucaauacuaguaaauaauaguuaccuuacaacccaccauuucacauugaucuuuuaaguguaacuuaaacugacugcuacaucaaaguauugucuguaaaauauaacaagaaauacgguaauugaaauauaguucauauuuauuucuaguggaauuggggcugaaugaagaugaugcauuugcaaagggcccuacguuaacaguguauaaagaauccuuugaaucucaauuuuuggcugacacagagagauuuuauaccagagaaaguacugaauucuuacagcagaacccaguuacugaauauaugaaaaagguaagcuuaaacauaguauguaaaguggauauaaguuaaauaguugucacucuuccagugaguucuuggcauuucagugcuccucaccagucaggcuugucacugcugucacaccaugucagcaggccuagcucauagaacucuccaggggacuuuuauacauugagaaucaugagugaguguuccccugcacauccaaagagauguauucauagcugcaugccuuccagguuuuugcauugucuucccuugaaguguggcccucaggauuuuaugucagugagaaaauaagcaaauaguccuagauuugcuauuuuuugcuuuugcuguuuuucuccuaaaauauucccuaagagucauaguuuaacccuucaaguuuauauuaggaagaaggauauaaaucugacuuaggagaagauccaagguggaggcaaggauucuaacuugcucuuuacuacaugaugcuuccaugaacuucuaauaggauuuuucuuugcucucuuucuuagaaauucaggaauucuggauauugggucugaggaaugacuaugucaagagauggcaagcuuucugcuauauaguaccagccaguaaauaaucuuuaggcuuuucauccuaagauuucuucugucauuguucaccucuaauguuaagaaacaaaagcagucauggagauauagaaauaagcaggaaacaggugcagcaggauuuugccagcagauuguauauauaguuugguaacccucucaucuguauguguacacacacacacacacacacacacacacacacacacacauauauauauauauauauuuuuuuuuacuuuuggguuuuuugagacaggguuuaucuguauagcucuggcuguccuggaacucacuguguagaccaggcuggccucaaacucagaaauccaccugccucugccucccaagugcuggaauuaaaggcaugcaccaccacugcccagcuuguauuaaauuuuuaagagucgaggucauaccaagucuaauaccuacuuugcccucucuuaggcaggaaauggacugccaagucauuuccguguuuaaagaaagaaaauauaagcucaaccacucugcuucugacauauagagagaaagccaugcccagcuugugguguucacagugcauuuucguauggugcacugaauauaagugggccuucuaaguuugaaauugaaagucaguuacacauuuuugauaucucaaaauucaacagaaguagaacuagucgguuguauaugcgggauagugguaguucuuuauaguagaucuuugugucuguuuuguauaugacugagaccuaaccagcuccuuaaggguauuugaaacauaaucuguuuugaauccugguauuguucauuacuuaauuuuguaguaugacuguaggcuuuauaagcaggucuuuuacugaacucuuuuaaaacuuuuuuuuuugcacuuauuuuguaugaguguguacauauaugugugucuuuguguguacauguacaauguaugugugccauguuagcauauguauguguauauguucuuuuaccauauaggcaccagggauugaguuuaggucaucaggguuagcaguaaauauccuuaacacuacugagccauuuugccaguccaguagagauuuuuuucuuaaauuauaucuuuaaaguggaaucuuccccaacauugcacaccacuauggugccagccugcccuuuguagacaacguuaugauuuguugugguguaugcugcccauggagauaggaggaguaguaguaguaccucaacauaaggagaacaacuuuuaggacagagcugcaugcacacucuaaacacagaaaucugauuuuuaaaguuuuacaacuucgaaaauaauagugucugguggguggguguuugcaaucuaaccucuccucagccuccaggaagcucucuaaaagcauuaaaaguuugguccugaccaacuuagaagucuuaucaaacaugacuucucaucuuauucaggaaauccacaauucaggcucuaaaaaccaaacaauauagagauaaucuuauaucgcuguaucuugaacugggccaccaguuuucaagguuaaagaaugaccuuaagccaggcaugguggcacacaacuuuaaucccagcacuugggaggcagagacagguggauuucugaguucgaggccagccuggucuacaaagugaguuccaggacagccagagcuacaacacagagaaauccugucucgaaaaacaaacaaacaaaaacaacaacaacaaaaaagaaugaccuuaaccguuccguuccuuaguuuccucaccugugaaaggagaauaauaauaucaggugauagugagaauuuagugagcuuuacuuuuaaaaaacuauauaagcauugaaugucuguauuaaaggcuuuauaaaaaguguagcaaagcaaacauaauggagggcuuugaccuuacaugugcauaccucauagucuccagccugugccugggcagguauaggaccaccagaaaaaaguugacaauuucaguaacuugaggaaaaauuacauuuauauuaaaacaaucaaguagaauucaacaucucaggaaugauuuugagguaaagauuagcuuucaggaaauauugugcuuuuaauggccaauuugggcuagauauuacaauccccagaggucucuuuugaguuuacugucaucaggugggaguauuuuagucuaaacaguugauaaugguuggcccauacaaaaaugcuuuugauaacugaauagcuacaaacacuuuauuaacagcuauaucaacacuuuaaaaaucaaugucaugugauugagacuaaucugacuuaaaaacaacaaacaaaaaugaacauguuugaauauuuuaaauuccuaaucuuuuuauuauuuaaaaauaaaacaugagcucaaaagauugcucagcaguuaagaguggguguuacucuugcagaggaccugggguugauuuccaauguuagaucagucaucuguaaucacaguucugaaagacccacaauccuccucuugucucugugugacuucaugcacauacuguacaugcagucaaaacauucacauaaaaaaaagagagaaagaaaauaccucauuucauuaauuuuuaccaaccuuucaguucugauuuuuuauuccuuuuuguuucuaauggaguuaaucagggucauuuucaagaaccuuaggguacuuagucauuuaaauaugguccugguguuccauggucuacaugagacagcaaugguaaagauaccugcugucacaaauuaguucccaguuacuacuuguuuuuuuuuugcuacuuuuuuuuuuuuuuuuuuuuugguuuuuuugagacaggguuucucuguauagcucuggcuguccuggaauucacuuuguagaccaggcuggccuugaacucagaaauccaccugccucugccucccgagugcuaggaucaaaggugugcgccaccacgcccggugggaccugcuacuucuuuucugcuuggccccugcaaggaagcucuguaaacucacuauaguccgcaucccuguggagaauucacaaggacaucaaagccuacccucucuucugagaaggaguaguuuuguuuuccugaccaagaugauauauguucucccaaaaacagauugacuuaaaagaagaagaaugauaguaucuuggguauucuaagaaagaagaccaacauguggacacuucauuccuccuuagaauagggaacaaaauacccauggaaggaguuacagagacauaguuuggagcuaagaugaaaggauccagagacuaccgcacccggggauccaucccauaaucagccaccaaccccagacacuauugcagggacccugacauagcucucucguaggaggcuaugccagugccuggcaaauacagaaguggauacucacagucaucuauaggaugaaacacagggccccccaauggaggagcuagagaaaucacccaaggaacugaagggaucugcaacccuacagguggaacaacaauaugaacuaaccaguaccccuagagcuccuaucucuagcugcauauguagcagaagauggccuagucugccaucauugggaagagaggucccuaguucuuacaaacuuuauaugccccaauacaggggaacaccagggccaagaagugggagugaguggguaggggagcaggguggggggaggguauagggaacuuucaggauagcauuuaaaauguaaauaaagaaaauaucuaauaaaauaaaauaaaaauaaacagcuacuaaacagaaaaaaagaagaaugauaguucauuaucugauuuuacuuaccagaccagaauguugcuguggguuuuuggggggcgugggggcuuguuuugcuuuguuuuguuuaaacuuacacauuaaugauuuggaauauuuuaguggauaauauuuuguuuaucaaguguacuaugaauuaccuugauauuugaguuucuuacuagaaauauauuaacuucuaacauuuugugguuuuuuugugacuuaucuguuccucauuccagcuuuuuuggauauacuuacugcuuuguuagaggucauucuguguuuaggauauggacuuggugauuaauacacaguuuacuguuuaagcuuacuuugcaugauaagcuuucugcugaguaugagugugcuauggcucaagcugcuuuccugugauugaauaaccacucgugaucacauuuaaugguccaagcucuccuagucgguuuucuggguauugaauguuuauuuaauucuaauaguaauucuccaaauuugaaaagucuguguggagaguaaauacaacucuugucuucucuuauucagaucaucugaguaauucaagacuuaacugcaguuucuuccuuguucugaugucugcagugacccuacccccacauguuucuggugacagauucuaaaauauacugucuuucuugaguuucuguuguguuaaauugucuguuagccccucuuucuuggaaagaaauucaagaaguugagacucugcgguguccaagugggcuuuagaaguguguuuuuagugcuugacaagggaaggcugcuguguucgaccauccuuccuuuuuuuccuuuuuuuuuuuuuuacuccuuauuacugauuauuauuucugaauggucauuucuaggaucauauugguaugacccuugacuucaaacagcuuucagaccaaaguagagcguccuaauccaguguucgcaugcugaagaagaccuguagguuuuucccacagggguggggaauauugccuucaagaugugaaauaccauuuacccaaagaaaaaugauaggaagacauuugaacuguuaauuaugauaauguucuuaaggcacuuaaaggacuagagcuuguauuucagaaagaguagaauagaccagugacuuuauaauaugguuggcagucacccuacagucuaaaguccuauuucucuuuucuuaaucaugcuuuacuggaauauuugugaauuuaauuuguuguucacauacuaguucuuuaaaagugaagcaagccauucauugguuuacuuugauugaauuuucuacaggcugaagcucguuugcuugaggaacagcggagaguucagguuuaccuccacgagagcacacaagaugaacuagcacggaaaugugagcagguccucauugaaaaacacuuggaaauuuuucacacagaguuucagaauuuauuggaugcugacaagaaugaaggugaauauaauuuguuccauacacuucuguugguauuaccaauggugggcagauuguuuuguuuuuuauguuugaguauuccuccuucuauccuuuuaaaagaugaaaagauguuuuuguuuuguuuuuaguucccuuauuuguuccucggugcuggugggagcuguuagugauucagucacauuguuuugggauuuaggacuuuccaucuuuaccauaaauugaaaacauaugaaaugaaaaauuugaggauuccuuuugugacuuauaguugaaagagguaucuauauuaaguuuauuuuuuaggcaaauauuuuaguaccuuuugggggcauaaauagcuuaucaagauuuuagaaagcauucagugcuuuuccucaaugguacauuagcagauucuugugguaaaggggaaauauaauuuuaauaaccugaccccguuguugauuuuaacaaaguacaccagaucuagaagaugguuuccuauuucacaguguuuuucacuugauauaaguacuuaaugaacagaauaaguaugcacaguugguuuccaugcauacaauugguuccuuuuuuucuuucagauuugggccgcauguauaaucuuguaucuagaauucaggauggccuaggagaauugaaaaaacuacuagagacacauauucauaaucagggucuugcagcaauugagaaguguggagaagcugcucuaaauguaaguaggaccugacugaaaagcaauugagcccauuauuuucacaugccaacugcagguguguguggugaaucuuuguacaguuuuaccgauacagagaaccuguuuugacuuuuuuuuguuuuuguuuuuuuuuuguuuuuuucaagacaggguuucucuguauagcccuggcuguccuggaauucacuuuguagaccaggcuggccuugaacucagaaaucccccugccucugccucccgagugcugggauuaaaggcauguggcaccacgccuggcucuguuuugacuuuugaaaguagaauguugacaaaauccuuaaauuauucuagcauugccucccuuccagcccccuuuaagauggauuucauuauguagcccaugcuugaauuuacagagauccaucuacugccucuuuacuucugccuccuuaaagauuugcaccaccacaccuagcucucuccagcaccuuuuuaaguauugauagucuccuuuuuaauuuuugucuucuuuuaguguuucugucugaaugcauguaugucugaggaggucagaauagagagggucucagcgcuccuggaaccggaguuaugaaugguugugagccauuguuuaggugcuggggacugaacccugacacucuggaagagcauccagugaucuuaacugccucuagccucucuguuuuuguuuuguuuuguuuuaauguuuuuuuacuuuguuuguucauuuauauuuuuucacuauguuaaaaaauggcuuuguguuuauggguguggugcccacagaagccagauuuguugugagucacccaauuugcaugcugagaaauaaacucuggucuucugcaagaacaauacauguucuuaacugaugagccaucacuuaaccuaaauuugugaaugauaggucuguaaccuugggagaacaagaauaguuuagauuuuucuuguagaacaaaacuacacacaagcacagaaaaacauacaauaaucuuuuaaaucuagcaugacaaaacucauuuuauauccaggauacucuuuuuuuuuuuuuuuuuuuuuuuuuuuuugcaacaaaaggaagaguuuaauuauucuauaagggaacuccuuauggaagcaauucauucccaaauuaguuuuuauuccacaucaaacuaaauucuuauguaaacuguguuguacagugacaagaacuaaagugaccccccuguugguucaaccuugucucucacuguccauccuuugucagaugggccaugaauucaaggccauccuggacuaccuagugcauucuagaccuagugaguucuagguuagagaguaagacccuaucccaaaaaacaaacuacaaaccuagaucuuagaucuuaggcaaagcaaguguuuggagcuaaaaggagcagaaauugcaauaaggagaauagauagugucucucucucuuuuuuuuuaaaaaaaaaaaacaguuuauauuuauuagguuggccgggauauuuggcauaggauagugucucuuaaauuacugguguuugucucugcuuuucaugcuuuaagcuacaugcauucuuauuucugcuaauugacagagaagaaaaggucuauuaaacguguaaaucuguacuauguagugugugggaccuuauguuuauuucccuuuucuccucccccccccccauuuaauaucaaaguuaguuuuauagcuaggcaugguaguaaucgccuuuauaucuagcacccaggaggccaagacagguggaucucugugaguuugagaccagccugguccacauagugagucacaagaaagccaggucuguguagacccuauuuguaccaaugaaugauuuuuauauuccugaacacacaugggguggcuugguggcugauaaaggaauuucaggauuaaacauuuagugggugugcuacaaacaguugucucuuuuucugcaguugaugguuuguggucaaggcauguguuucugaaacuuuggcuuuauguugagguagaugauuuauauggacacaaaguuacucaaauggccaaguacuuaaggaaagcagucauacuuuugucccuagaugauuguaugauguguuuucuucuuccugggaacaaacuauaauuucuuuucccuaauuuccaaaaaguuaauuauccagaguguucaggaagaaccuauguauccuguaguaguuguguugauaaugguuaacuguuucauuacagaguuuaacaaguuaacaguuaaacaaacuuaacaauuggcucucguugucccugacccaaugaaaaauacagauucaaacuuugcucuucaagguggcuccaggcuuagguugaaagcauuguuuagaucuauuagaggcccauuuuacacacaugaagaguaagauguuucuuuaaaagccuaaagaaucccaauuuaucucuuuugacaguauucuugaaaaguacugggucagaauuugggaucacagcugauccucagaaguggugucuaagucuuacuauacagcuccucuuaucucagccucccacgucauccuacuauaugggcauaugccucacugccucaaucaggccuuuuugaagaccaguguugguuuucuugugugugcauuggaacuggggguguguacauauguguguaccagugcauguagaggucauaauucauuguugaauguagucuucaguuacuuuccaccuaggcaaagagagaucccacauagcccuucagugacuaugaauaagcacagucuaaagaaauaagucaggauuuaaggagauacuagaaagauuggagauagcugagcagauguugugagaacuuggaagcauguuaauuaugucaacucuacuugacggacacaaggaaagcugcuaagcauauuauuauuaauaaccauguaauugacaagacuagauuuuuauucaaaacauugcuacaguauagaaagugaaacuaaugagaggcuguaagcacuuuguuaaaacaagaugaaaugauagugaggggaauugaucacuuuguggcuuaggaaguauggauccccaugauuucugaaggucaggccgugcaagcuugcugggauuuuugucuagauuguuaaaagugucagucauggaugguauaacagcuucagaaucacggacauggaaugagagagaucccuugggaacugagaggagcuguguuucuaaugcacaaaaacaaaaaccucucauauguuguuauggguguggaccagauuuaacacuauuauguucauuuuguuuuaaaccucaacuuuuuuucucaaagccaggcauaguugcgcauauuuguaacucuaccauucaggaggcagaggcagagugaggaagaucagaccuaaggccacccuugacuauauaguacauaggagacuagccugggccaugagacccugccucaaaacaaagaaaaauauguuugauuuggaggacccauaguggaaugaagaaacugaccccccaaaauugucugagcuccauacugguguuguggcacuccucuuccauaccuacgcaugucauaaauacacacuguaauaaggagcuuucuaaaucuacuuuucuggggcuugauaucugguacauuguucuugucaaccauacucuacugggucuuuauuaugaggaaucuagaaucaaucugaaggcuacuuuauucuuugcuaagcauugcaucuccacgugggaauuuuuucuaggcauuuacugagaaauuugauuccaaauccugaaucugagggaaauuuuaaaaagccagagaaacgguuacaauucuucuagcacauaacaauaaauauagagucaauacugauauccaagacucuguaaauugccacaaagagcaagcgaacaggugugugggggugaagcuaaggucaguacuuuaggagccacagagagaggugggaacacgugguaagggaucucaccucucaauaaaugggaguuuaucgccucucuacugcuaagcuugagucacuguaaaauaaaaaaaaguaccggaauguuuguguguguguguguguguguguguguguguguguguguguacgcgcgcgcgcgccucugucugucuaucucuauaucuauauauauauuuaccuuguaugaauccucugagucauaguccaaaauaacaggcuuuauaaguaaugugaguguuuaaaguugacaagcaguugguuccuuucaaggaugcuaacgucccuaugggagcuggugacccuagugcuuaugcauuuccugugguuggacgcucacuguugcuagaacccuuuguaaacccaaugaccauggaagucauaagggaagagaauaugaaugguugcagugauuugaugugagaucagaaaugaguuuaaaaccugaguuugccaaaguaauaugggcuuuaauggcaaaccaaaauuaagucaagcaaagggaaaaaaugcauuucuuaaaaaagaagagcccauaugaagcaaggugcaugcuugacuuguaggugcucucggaugcuuucuuuagaguggugccaucucugcaacauacaggaguaguugucaggagacagggaccagauuaucugauuguaucagguaaagaccaucuuuccaucucagugaaauuauaucaucauacuauauacuuuuucauaauaauuuugcaucuauuuauuauauuuuuaaacaaggcaucccugaguguauagaaaauuauuauaucauaaaauucugguuuuauucauuguuaauuuaaaaaauuuuaccaaaaauacgaaguaauuaguauuuaggguuucuguuuucucauuccugaguugugcaagacagugugucaggaacuggggucuggacacagugguggcagcaggggaaggucauaaguuuaugguaagcuuggacuauauugaggaaugcuguuucaaaaauaucagcagugaaauugucaggaauuuagaggcauugccagaauauuugcuuucugugcaccugaagcuccugguuuaggaagggcuagucaagcgccuuccugccucucuguguccauuggcugggucuuucuauuuugaaagcugaagagaacaugccagacucaggagucaucucccugaguccuuucuugacucagcugccacaacuuuaguaagaaguguaacuuaaguuuaauuauauaaaauggacauuaaaaauuauaccugccacacauuauggguccuuggcuggcaaauagugacugcuacuugaccauugauauugauuccuucuccauccauuuccuguaucuaccaguacuguccccuuuagcaucuuccgauauuuucuuuugucugaagggucccugucgcccacaccccgaguucccagugcuugucccugaccuuggccacacaguuuccauuguguguccccaucuguguucagaccugucguuugauaaaaacuaauuucaugaucuuuucaaguuuuuuuuuaaggaauuuaauuuuuaauuugaagaauuauuuuguuuuacauggaaacauaauguccuguguguuuuagugauggaaccaaaaguauuucugaucauauuaacuucuuugaagauguaguuaaaacuuguagaacguuuuacagcagcaugaaauguguguuuuuaauuguuuguuuuggcuuucccucuaccuaaggaccccaagauguaugugcagacagugcuggauguucauaaaaaauacaaugcccuggugaugucagcauucaacaacgaugcuggcuucguagcugcucuugauaagguaaguaugucacugagaugccuauugaguauguagguacaggacaccuuuaacuaacugucuuuuauauacacaggcuuguggucgcuucauaaacaacaaugcgguuaccaaaauggcccagucauccaguaaauccccugagcugcuugcucgguacugugacuccuugcugaagaaaagguacugaccugguauuauauuuuccuaggacccuauuuaaacuugaguuuaauacaaggggucaguaguugcauuacauuuacuuguauugcacuacauuguugaaaccugcaucaacucccacuggcuuucugaacagucggagaaaacugaauacuacaauauggauuauguguuggucuacauuugacagagcuguuguguagcucaggcuagccucaaaacucccagcaguccuccuacccacagcuuuccacauacuggguauauagagcacaccaccaaauucagccaugugacuauuuuaaaguuuuguucuuauuuggucauuuguuggugcuacauacacuucauuuucaagucaccaucuacucaccugacauuuuccuaaucuucuuagcuguauucagagcuagaagcaagcuguauaauuaggcuuggcugccuccucuucguuauguucccuuagcuucucuccccgucacaguuucauuccugcaauguucaagguuugccucugucccacaaaccacaucaccaaaugcuaugaagggggcauagguccccaaauuuuacugauucugaugucaauauauuuuauaaagcucucuaaggcuaagaaaauacccacaauguaaacaaugacaguuuaacucucagagccugagcaauggaucagcuguuaaagacacuugcuguuccuguagaggaccuggguuuacuuccuaguauccaauugggcagcucacaaacaucuguaauuccaguuccagggaaucugaugccuucuauuggccugcauagguuccuguguguauauguggugcucauacagacaagcaggcauacacacauacacauaaacccuuuuuauuuuuuaaguuaacaagucaucaucagugagcuggaaaauaauuguacaaaagguaggccaugcagcaucuucagacugugggcguagaucaguagcaaaaccgaaacagcucacuauugggagaauuguguuaccugcuuuguacgugguggggaaacauuggguaaggucacuugcuaucucagauuguagggagcaauuguaagaaugcagcucacuuacugauauuuaaauggguugucuugaagggaaacuucauaauauuauaauuaacuucugucaguuuucaucuuagauauccuaguggcuauuuuguaaucucuuccaugaugggguacaaugugaggcugccagauugccuuaggagaggaaagugaccuccccuagcucaccagcugaucugagaacucauuauuaaauacuugaagccacgugggauacugcuaguuuggcagagugguaugugugcaugucugcuugcuuguuuguaaacaccuugcccuuuuaaauuucaguuccaagaacccagaagaggcagaacuagaagacacccucaaucaagugguaagguguuucauggccacacccauugcccuuuguaaggcucuuuuuauauugggccugaaauaugcaaagucauaaguauuuugauuucgaauuuaugguuuuacuccuaaauuuuacuuuuaauguugguacuucgcuucuuuuuuguuuuaaauuuucaaagauuauuuuauuguaugcauaugaguguuuugccuguguacauguauguauauguacuacaugugugcuugugccugaggaagucagaaggguguucuaucuccuggaacuagagaugguugugagccaccaugugcuaggaauggaacucagguccucugcaagaacagcaaguacccuaauccucugagccauuucuccagccuuaguacuuugcuucuugcuacuaagucuaguccagucaacugggauuuaaggaauggauggcgcuauuuauugugaacauuucagggugaguuugugccagguuagaacauaggcccacccaaaaccaagcagcuccuggagguagcuagagacaaaugggcuugugaguuaguuucacuaagguguucuuucccuggcuuugccagaugguggucuucaaguacaucgaggacaaagauguauuucagaaguucuaugcaaagaugcuugccaagagacugguacaucaaaacagugcgagugacgaugcugaagcaagcaugaucuccaaguuaaagguacuauucuuuuccuggagaaucccaauuuccucaggguuuauugacuugguucgugcagugugagaccugcuuuccagccaggccuccggugcuuuccuuccucugccacccuguuuaggguucuucuguuccauguagcccuuccuuggccaggcucugcucaccuuugccacauccucaccugcuucccacacauccagccuuguuggcucugugugaaugcuuagugguuuucuuagcucagacugccaaaacaaaauaccaugggccaggaaacuuaggcaaagaaaugaacucuccauucuggggacucagaagucuuaaaaaucuagaucuuguuuuugaagcaggcucuccuggcucucagucaaccacuguuuggcccauuacucacaggguaacauccucuuaaagaggcacccuacacucaugaacgcacaaggacucaucuucagauaccuccacaccagagguuuaaacuucagcaggcacauucuaaaaaaagacaguuuagugguagaauaagggacuagcagauuauuugggcuauuggaaggguuuggcuugagggucauugacagcccaggcuagccucuuccugcugaguacggugcuuucagaugugcaacauuccaccuguuucuaaauuauuuccuaucguaaucucuuuaaauugcagcuuuaaaugcugcaauauguuuacugcauauugaagacccaauuguccaacuuuuaauggucuuuuagaacauaaaacuuuaaucuguauauauuuaugccauaagauaugacuaaaucuuaguaauagcuucaaagaacuuaagaaaaaauauauuguauugugauuucucuaaaaaucccuuauaugcauugcauacauucauguuucuauacaaauuaaugagacaguugccuggguuuauuucagcaagcuugugguuuugaguacacuuccaaacuucagcgaauguuucaagacauugguguaagcaaagaucugaaugaacaguucaaaaaacaccugacgaauucagaaccgcuggacugugaguacugagugcucauagcagggcucuuugggcucuugguagcagaugagagaagugacauaauacggagugagggugguaaauggggucagaguuuccaagacuuagaagcaggcguuuccuuccaagugcucucuccuccuccugacacccagaugggaugguggcagcuuugcugagugagaccagucaggucugccucgcucugugcugauccaugggcuuguugugccuuugaaccugaguuugaauacauuucuuucuucucucucuuacuuguuuuugaagaaaguuggagaauuuuauucuucccaaaucaaaauugcugucaucauuaagcuuguauugcuaauggacaucuacguuaucugugaaaaugaaaguguccuaauuaauagguuccagaagucucuacugucggucuugacaguaguacaugguacacaaguugugguggagguagugcuuugcucuugugcuuuccauuuucuuguauuugggucuguuaaaucaaucauuccuggucaccauccauugcuugugcaugcugaacuucauauccagaaggggaaaaaauaaaauugaucaaggcagaucagcuuagaaacucuauauugacaguaaaguggaaaaccauugcccuggaggacaacaguugcuagguucuucaaccuuugguuugaaguuuugaucuaggacaucucacuguguauguguagccuacuagacuuguaaugaauuuuuaaaucuuuugacuauuucuuguguguguguguguguguguguguguguguguguaacaauagaauuuuaaaauuuguagaguaauuaaauguguuccuucccacaguggacuucaguauucagguccugaguucuggaucguggcccuuucagcagucuugcacguuugccuugccgucagagguaaggauaguuuugguuuuguuucuuggucucuuucagcuggcaagagggaaaagggcugccugaccuuagugugcugaccgaagugcuguguaagcagucagugcacuguuuguggggaaugugaaaugggccuguguuaaauagcgaaaggcucucuguugcagcaaacaguguugacuuauucccgacaagcagagucucacugguuacaugguaaacucuugauguaccuacugggcaugagguagaaaccugcuuugguacucacucugcagucuuaaaguguucacgagacgguccccggcauuuguaguucacuucucuguaagcacugauuuuguucucagaacuuggggcagggacuuuuauuuagaaaugcugacuguagaauggaaagccauggaugccgcauagugcuguucuuucaucuaguuggagcgcaguuaucagcgauuuacagcuuucuacgccagccgucacaguggcagaaaauugacaugguuguaucaacuguccaaaggggaacuagucacuaacugcuucaaaaacagauacacuuugcagguaaaaucuuuuuauuuggguaaaauauuugaguacuaauugaugauaagacaacuuauagaaacccaauuagauagcucaugcagugggaugcaguucauucucugacaaagccauguagggaguaaagcaugcuugucaugggcaggugagcugaacucauuuucucugacuauagaugcaagucacuuccuuacucugagccucagguuucuccuccacugaguuagcaguguuugcuuacaccauagaagugaucuuugauagguuugguagguuugcaugacaugcuggggugacaaauuuaaaagaugacauuucacucucuaguuccagucagagcucucugcagccucacagugauaagacucccuagcacgucuagcagugugcagugccuaguaauaacagcuaugggcugauugcauuucuacaaaagcugggguccaguuaacugugguucaaagucuagguuccuucuacucucacuucuguacucaguguguuucacaaguaaaacuuacuucauuccuugaaaaggucucaguagugagcugguaaugguaauuaaacuguagaguaugugacgaaaacuacucacuaguuuaaccuuuguacuuccacauugauaaguuaauuaaguaaccauuauaccugguguggaggucucuggcaacuuaaacauacacauaauguauaaaugguaugcauccccaaaauaauuuuuguucuacuaugcauaaaaauuaaacuuauaauuaaugucucuauaccugguguauguuuauauuauagguaugcucauauauuuaugcuuauauaggguacauuucaggagaaaaaugagucuuuucaguguuugaaagguaucuuuaagaaaaauguccauuccccugguugugacauuuuguauucccucuccuuuuuugccucugaagaaugcuuuucaugaaagcagguuguaccuuucccauguuuucacauuuccucuuucuuuccucuggaccacgaaggcguccacauuucagauggcaauccugcuucaguauaacacagaagacgccuauacugugcagcaguugacugacagcacucagauuaaaaugguauuuccacuguuugguacucacgcuauacucucaagcugccucuucuuuguucauugggauguuguggaaagggggagaggacauggguuucuuuggcuuacuagauguuagcagcauggagaaaaaaguaaaagcaguaaacucugaccaaggcaccagaagaccaggccagauagauccacagagagcauuucacuggggugucugacaccuuggaugccaacaggaccacugaguucucaugguugagucagagaaguuuauauaaugggcaagguucacuugagccaaaaguuaaccugacuagucucaaacuugugugaggagcauccagcacauuccugguacuggugguacuaaggucuaggguguaaagcuccaugugccacuaucacgacuuuauaacuuuauaguauuuaagcaaauuguuuuggagaaaacauggguucucaggcaggcaugguggccagcaccugugauggugguggccaguuccagcuguguccuuauaaaccuuuaugccaguuucauaaggguguuaagaaaugcucucuuuugucagcauuauaaggacagugugagaugcucuauuuuuuuuaaggguuucucuguguagcccuggcuauccaggaacucucuuuguaauccaugcuggcuaugaacucagagagaucugccugacucuaccucccaugugcuaggcuuaauggugugugcuaccaccacugucccuugaaaugcuguuuuaaacccagucagucacugucugucucugucucuaucucuguguguguguguguguguguguguguguguguguguguguguguguguguagauauauguacuuguuuguauucacguguuggagacuagaaguagaugucacuguggugcacaugucauucuuucuuugaagcagcgucugucagugaaucuggagcuuauccauucagcuaggcugcacagcaguaagacuuggggauucacucauuuauuccccauagcacuccagacaaggcugagcuuucacgugagugcugggaagcagauaaaagauuuuuuaacuuuccucauucacuuuauuuuuuguuugguugggauuuucuguugcuguuguugaaauagucaccuguacucuaggaugaccucagauucacugaguagguagagaaugccuuaaacuaacuuacuguccugucuuuguacauacaucuguguaucugugauagauuacuggcaugcuccacacccguuuuuaugcagugcaggagauugaauccagggccuugggcaugcuagccaaguacuccaccaguuaagaaguggucccugcccccauuuaauuuuuuaguugacauguguacuuacugauggguacacugcuguacaugcauuuuuuuuuuuuaaauuucaaugaaaccuacuuuuuuuuuuuuuuuuuugcuggcugguuggaaggguugacaggucugccucucuagucucugcuuggccuucuccucgaugccacaccaaucuuucuacuucuuuguauuacuagaauuaccuuaugggucuuuagcugcccuccuccagaccccagugcauagcugucacuucucugacagcaugggagccuugguuaagagugcaggugagaaaguuaaguccccaugccaugaggcuugaugguucuggaaaucaccagagcagcuaauaacuacagaggucauaugaugcacugaauugccaacuaaagccaaguuggcagcaagucagcugccuccaagucucagcauguucaugaaugcagugcaacuuugguucugcugaagcuccuuacugcuucguucgcauguucagggguguaguuuacugguagaacacuugccuggcacacaaagccuuggguuugauccacagcaccacauaaaugucuuaugaaccuucagacaucgaagaagugaaucauuuccuguagguuucauugaagaagcaggccauauauuguguccaguguuugugggaaacugcauuauuauugccuuugaauagugggugcuucaggccauaaagaacaagccaugucacuuucucugacuaguucugcuuugaggugaugaccauuucugugaggcugggccucugggacaggcacuguaaagaaguauucuuccuccuugcuuaccaucuuucucugauugcaggacauuuuggcacaaguccuacagauuuuacugaagucgaaauugcugguauguuuguauacuuuguguugagcuagaagacacccuuucccuaggaugugccuaguaacaguuauuuucuucuaggucuuagaagaugaaaaugccaauguugaugagguggaauugaagccagacaccuuaauaaaguuauaucuugguuauaaaaaguaagaaaaaucuaacauguagcugcuggucuuauccccuggcacuggccuacuucaggaucggcacgagccaggggaacuggacucugcuuuuaaugcugaguuugauuuucuuuaucuugaaaauaagucuugaguggcucauauggcauguuuagaccuuuauaucaaguuauuuugguguuauuacaauucacuaaauugaggggucaagugucacuucagucaucccucugugguaaaauuacauagcauugguggaggggcaguucgcagguagcaguagaaaugaugagaaaugauauagaagagaugggugugaaccaccugcccaguccagggaugcaaaacguguaguugaaagacaggaagcagacuuuucaaugaccuguuuccucuguuaucuugacaguaagaaauugaggguuaauaucaauguaccaaugaaaacugaacagaagcaggaacaagaaacuacacacaaaaauauagaggaagaccgcaaacuacugauucaggugacugaaccaugucugcacuguacacuuagggaaacgugcuggccuuguaugugcucaaacgcugccagaaugacaguucggugauggccaaagaugacaaugccugaagccagcacuuggugucugagggaugaaguauuuuauguuccaaacaaaaguagucuaaucuucuugccuaaguauugggaagcagguaauauguggcagauuaaagaaacaggagauuggggggaaggggaccuucuauuccuuuagagauccauuuuuucuuuauucuuuagugcuuuauaguuggccaaaauuagccccuccaaaauauuuaagauuuacauuuaguguauaugcauguuuugucuauauguagucacauauagauaggguucauguaugcuacugguguccccagaggccaggaaaggaugcugcaucucuuugguugugagcuacuccauagguccugggaacugaaaccagguccucuggaagaccucagugcucuuaaaccacugcaccaucaaucuagccccuuagacaaaacauuuuaauggauaaagcugauggauagagcugauugcuuguacccucccugaccuguaggauaguuguuacccuagcauggaaguugaguaugaggugguacaggcugccuugaacuuucaugcucagcuguuaaaccucuaagcauguguuuuucuuguugauugcauaggcggccaucgugagaaucaugaaaaugaggaagguccugaaacaccagcaguuacuuggugaaguccucacucagcucuccuccagguucaaaccucgggucccggugaucaagguacaggaauuacagagcaugguuaggaaacuuguagcagaaggauuaauggcuguuucaugaaaaugggaacuggcuuacucauucauacaaaaaacuucaacaaaggaaagucagcuaacuucauucuugaaguaaauauaagaggcauaugugucauaaauauacuuuuauaauugauauucugaugaggaguacgucacaggcauccaagaagucacauguuccuccccuauccuauguuucucuggcaaugagcuagcuguccugcagccuuggcugauuuugccuggugggaagugguguacaguguucucuauugagaacccaccuggcaguaugaggggacucauuggggcugcauuguugggaaauacuuguccauuucugcuuccgagcaggaacauacuccccuguaucuaggggacuaaugaucucauuugccaaguuuucugauggcaauaacucagcagaccuuuccuuuucugaaacgacuuggguaagccacagccauuggagaacccagggauggcgaugcauggugaguccucaguggucaggagcuauuagcaccaugcuagcauguucuucaaguucugacucacccauccugugcuccugaccugugacagcagaguccugcccagaagcagccaggcuuuguuaaaaagggagauuguggccuagaugugcuagagcccuugccuucuuaaugcacagggcaguuuggagugggugggggugcagucacccacagguguugcugaagguucagguggguucaggacaauagacagguugaauuugcuuccugcugagcucaguggaggguaacuguggugagggugacagaccucuuuccugaugguuauuuucauuucucucccccuuuaacucccucuucuuccuaaaacaaugcccagaaaugcauugauauucucaucgaaaaagaauauuuggagcgagucgauggugagaaggacaccuacaguuacuuggcuuaacccaucuagcagggucugcaugacccacaagcagauaguuccagugaauaaaauggaaacaacucaaguucauagcagccagccugccgccauuuggaccuucauuuuuaaagcugagaccacaguucccaccagcugguuucaggcuacagcaggacugcucaggacugacugacacauuucagucuguaaacagacgccaaugccauuuacccuaacucacagacagaggggaaccgaaccuuccaugcugaggcugcaugcuaccgcacuuaaaucaauacauuggcucccugguuaacagcugucgucugaggcagcacacgagagcgagucugaauggacccacguguaaucugcuaugaaaaccauuuguauaguguguuucauuuuuuuaaugugugaaaauaaagaaaauuaaaggauuucuguacaaguugcauuugguuuuguuuuaaguuuuucuaauuucuauauguaaauaaaagauuuaaugauugugcaaguguau

SEQ ID NO: 2959 - RNA, 65209 nt, Mus musculus
auuuaggcaaacacuaugccaguauguuuauugguuauuaaauauucauagcaagcuggaaaaacaaagcaaaguuguguuuucccacuagauauagucuuucuagaaucagucggugauguucuaggacaagugauucaacaacaaguucaaguauucuuuauucaaauuugaaaaauguaccauacugcauuauugcaaaaacucacugguacaaaacacuuugcagcuggugagaaggcaauaaaaaguugauuuuaaaacauuacuauaaauuacuguuacaguacuuugcaaauucagaauuucaaacugcauuuccguuuucuaaauugcccacaguacucaagguuccugaagcuaaggcagcuguuucagagagaaggggaagagguaguagaugucaagggauuuccauuucucguucgaugcccacauacuucagggcaucagccuggcuguaucugaaacaauaugaacaagaagugacaaccuauccaacaucaggaaaaccaagccugcugauagagugaauuaugucucuaacauacacacacccgacuggcuuuacauagacagcugcauacaugaaggggaggcaugcaucugucacugguaaccuaccugcuaguuauaauagccugugcuagaagcauuccccacacccucccugugccccugcagcacgcugcucugaauggcaacuccacacugucaugucugggucuaaugcuacaaaagcaaaaccaugacuuguaaagaaugcuaaugccaaagaauaaccccccauugagagugcugacucagaaagauaccaagacaggcucuugagggucccacuacuagagaagcuggacagguuugcuucuaacccuggccauuuagaacaagcaugggauaaagccacaggauccuauuccaguuccacagguuucaguugguucucucuagcuaugcagcuaaaacugguuacacauagcgagguuccccccgccccauuucaacaacuuaaguuucuggguagaauggauauuaaacuauaaggauucuuuaacuaauacucuuuacuggaucacauuuaaaugacuguuugguuccacagagccagguggcucuaugaauaaauccacacugccagccugauccuuccaauggaguugaacacagucaaugguugugaguagcuuccuuagaaagaacccagugaccacagggugauguuaacaauuaaaacaaugaagauguaaauguucuaccaauaaagauauauaugcugcaccaaugagaaggugcuguagaauacagauguguacgcauagauuaagccccaggggucucugucaguuauaucaauagcagggugcuagaugcagcuuucugcauagguuuuguuaauuuuuuucaaaucaacauuguauaauuaauacaugagaacuucacugaggaaacauauaacucucuacuagugcccacagcaaauagugacuggucaguuaaaagaaugcacccuccaaugauggcagaccugucaaaaaacuuacaaacagccuuugacccaagccccauaguuucagaagggaaaaccuuuguguauuuuaccaaccuguaaucaaaaaacaacucuucaccagucuggauagcccucuuagcaaagaugccuauccuguggucaccauuaaccaucauaacugcaaagagaaacauuggcagcagugagcaggaagacaggccauagagguuaacuaacuguuucacguaaguacuccagagguacugaaguuugcugucacuuggcuggaaaaauggaacuguugcaucaaacugucaauuccaacuuaaaagcuuaccuuuugcauagcaguuuggauuuacugaaugauuagcaaaacgaauuuuguugcccuuucggguugcauccaccacaaaaucuaaagugaaaaacauagauaauccagugacuuauuuucagucauagaccaagguuauuauggcuuuagaaauauacuuccucaggauucgacuuaaggaaauaaagcauucaacuucauccaauauaaaaaaaugucauuuggaagaaaaugcucuucuagauuaaagugaauccuugguuguuaaauauagcucuuaaacgccaugauuuuucaguuauauacugcugagcaaaacauggcuuaaaagauguaaucuagccaaauuucucugggcaucaagaggugggcauguugacauuugauauuauaauauuucuauggaacauuuucaaaaaagaaaaaaaaaagguuuuuuuuugguccagcugaaaguuugucuggaugugugugagcacacccacuuacacagggcccuccacagacacaggcugcagcagcugcugcuuuucucacaauauauggcaacaucaucaggccacaagaugcuuucaaaaugcucaaccucucaggucagacacugaagagguggacagaaacuacucagcccacaaguuccaggggacaugaggcaagccacagcagugggagacaauguccacucauagccagagcaugaggcaggcccaucugcaagugguugggacucuagauuguuuccuguacacagccuuucugcucacugggacuuccccucuccuuacaagugagcaacacaccccugaagcuaggccugcugguaaauaccaggagcuguucuugcagacacgugcccuugguucuggaaucuugcugaccucuaauuugaaaaccuugccuuacagcucagaacauaccauuguucaaguugaacagaaagcugcacauguauuugucauacacuuuuccucuucugucugcuucauccugagaaauaaucuauaaggaagacacaggaggagauuguacuggaguaaguggucaagacuguuagaacacaaaaaagccaauuaagagaauuuuggucccucaaggcuaucaaagaguagcuaaauugucuucucuauuuagcagauauacaguaaagaaguuaugggggaaagugcuugugcacgcaaggacaccuugugggagguauuacucucuuuccaccauguguguccugagauuaaacucaggucaucaacucugcagcaggugccuucacccacugaacugucacaccaguccaaauaacacuuuuaagaacuccaaaucagagagauuucuauguccuaagcaacaugucuagagaaagugacaauaauauugucuuucugcugaguaaaaaauguaaacugugacuuucuaaagcuuuguuuuuuccuagcccuacaacuaaaacagccaaacuaauaaaaauauugucucaggguccccaucagcucacuggccaaguaaguaggagcaaauauacacagcaaaacucuugaucccgaaccccuuguucuccagguaauaaaagccaaacaugacuagaacuaaaaguaaucuugcuaguuacuauguaaaccaaaacuucuaauacaaauaaguucaggcuaaaggucauuuauuauuaaucuauucuaaacuuggccuuguccagugaaaucuauccaaaacaaugcaagcugcuacuauaaacaagucaacuggaaugcacgaguaugucuuaccuccccacaguauucugagaugaauucauuuuucuguacaggaucuuugauaaagaugccccagccugccacaucagacggugccagcaguaagugcuagagaguaagcagucacauuagaacugaucgcaaguuagcagaguuaaaccucagaccaccugaggggaaucacuagacccccaaguguaucugacagauauaaaaaaaguugcugagugucuggaaaacuauuaaaguaauauuucuaaggaaaauucaagauaaagauccucuuacaggaaagacaagcaagccucuccaucugaggucaugguacugcagcaagggagacguguggaucagcuucucucacuucuguuccaucuuguccuggaacucacuuucagucaucacccuccaaaaggcucaggugccccagcuuguggacugacccccaagaggcaacugaauugugaggcuaugaacaacugaagagcggucucaugacagacucaauuuguuggcauuacugggaggugaugcacucagugagugggagugggacgaagucguuccugacaauguaucucuuguucuugagccuuccuggguucccucugccuccugugugcuguggauugagcuacuauugcccaccacaugcucucugccucacuaugcacaggccaggccaggagcaagagaagcaagugaccaugugcugaaaccaacagccaaaaucuuaucuucuuuacaguuuuucucaacauuucauuuuuguauguguauguauaguguauacaugugugagcacaugugcaggucagucagcaacuucagguaccagaucuaugcucgccacucuacuucuuuggagacagggucuccuucccugaaucuggagcuguuucguuucaguuagacuggcuggcagugaagucccaggccuagcagucugucccacagccagaccuccaacacugagguuauuaguacaugaccacacuugguuucuaauggggcugcugaucauaugaaugucaggcuugcacagcaagaucuuucuuuacucuuaguuuuaagaccugucacuaugaggcccaugucacuaugcccuuaaacaugggcaucccaacauacugaaaccaacugaaggugagcauaccaaccacucuccccucgacguuucuguuucccaaaguacauucuuuuauuuguuagagcccuuagcacauucuaguucuuuacugguauuuauuccucuaaagacccugccauuuccuccacagcuuuccucuagaaacuucucaugauaacacaaaaaacauccuuauuaugaaggauaugaugauucaucaauccuacagaaggccaagaugacaaggaccaaauaugauaacuuuucuuuuuuacuuagauuuuuguuuuguuuugucugugugucuuucgugauagagugucucuguguaguucuggcuguccuggaauucacuggcuggucucaaauucacagaaauuggcucugacuccugaguacuaggauuaaaggugugugccgccacuacuuggcaacauaguaacucuucaucauggaucuuuaucaugcuucacucaagaccauucuugugaucuuuaaaggucauccaagcuuuucugagccacucuugucaaguaaacuucccaaucacccuccugaucggaaacaaaauuagcuaaacaaugggaacaagcaagugcuaagaacuauaugcacaguguucuauuucugagagcuaaaauaugccacagagaaggcacgucagcaugagcauuccugcccacucugugaacaagcggaaggaagggaacauagauccuacaguggcaaauauggcuucaggauacagacgagauguaggucucagcaaauaugccaaaggaaacugaagcaggggucugaugaccuaaaugaauaugcagccaccuaaaguaaaaugauucgagagcucagcuaaucuagaucagauuuuccaugaacaguggugguucaaagagacagggaagaaaaaagaaagccacgagaagcugaaaguuccaccuaaggcagaauuucaaagagggucuacaguagagugaugaggcuggagagaugauuaaaggcacuagccacucccgaaaaggaccuggguuuaguucucauacagugcuaacaaccaucuguaaaucuaguuccagggaauuuaauacccucuucuaaacuguggguaucagacauguauuaagugcacauacauacagguaaaacacucauacacauauaaauauaccuuuaaaaauaaaaauaauagggugcuaucaacuaugugauagcucaugagaugugccuacacugcccacagggcagaagugguaguauggggagggcagggacagcaagaccccagauuguguuucuugcuccauuacuugcaauuucuuuuuaaaaacaauucauggcaugcuaugauacagguauggaaggcaccuuaaggaguuaguugucuacuuguaccaugugagccaucucaucagauagugugucaugugaaucuggguuuccuuacuuguaauaugcaguaagcauucaaaccguguuucuacauuagacaguuaauaauauaacuauuguuacuaaaaggauuaguuaaagauacugaaucaucuggugucuuuugcuuagugauuacucccuggcugcuacauuuaaaaucaccuaugugcaauucgcaggcuucaaauacauaacugcuaggugguucauuuuaaggcuuugagguugguagggaacugucuugugauacaguucacauauaugcuccgaccucacuaagucucuagaguucugguaacacaggcauguaccacacaccuggccuguuuuaaaggucgcuaaagaacaagaacaaagccuauagaacguugcuggaggaaauugcaucuuguacuguacauagaaagcauccuuuaaaaaccaccaugagaaaguacauuuguaucagcguaucagaauacaaaucagcaucuuuuuuuucuauugaggagacacaaccucguuguggaacaaaacaaaaacaaaaaauugagccaacuuuuaaaauaauuccuauuucaagucugauaacauuaauggcuacuucucagaacccuggguuuaucuuacuacccaguaauuacggcacuuauuuuauagaaaauuuaagauugcauuaggucuuuuuguggcaccuccuaggugugucaguguguuaagacaaagcugaauaucugcucucuagccaccagcugucagaaagucacggaaggagaugaugaaugcuaacuuuauacaucccagaaguucauaaccacagaaguacuguuggugcucugaguguacagcaggauuauguagccugaaucagugguggagauacugucacuccauguguuguuguacaauuccaacaccacuauacagcucugacgaaauagcacacuaagaaaaacaaagagauccugggcauauauccagaagaugucccaaccgguaagaaagacacaugcuccacuauguucauagcagccuuauguauaauagccagaagcuggaaagaacccagaugccccucaacagaggaauggauacagaaaaugugguacauuuacacaauggaguacuacucagcuauuaaaaggaaugaauuuaugaaauuccuaggcaaaugguuggaccuggagggcaucauccugagugagauaacacaaucacaaaagaacucaaaugauauguacucacugauaaguagauauuagcccagaaacuuaguauacccgagauauaacagacaauuuguaaaacacaugaaacugaagaaguggacacuuugugccuucuuagaauuggaaacaaucacccauggaaggaguuacagagacaaaguuuggagcucagacaaaaggauggaccaucuagagaccgccauauccagggagccaucccauaaucagccuccaaacgcugacaccauugcauacacuagcaagauuuuguugaaaggacccagauguagcugucucuugugagacuaugccagggccuagcaaacacagaaguggaugcucacagucagcuauuggauggaucacagggcucccaauggaggagcuagagaaaguacccaaggagcuaaagggaucugcaacccuguaggugcaacaacauuaugaacuaaccaguaccccggagcucuugacucuagcugcauaugaaucaaaagauggccuagucggccaucacuggaaagagaggcccauuggacacgcaaacuguauaugcuccaguacaggggaacgccagggccaaaaagugggaauggguggguaggagaguuggggguggguaugggggacuuuugggauagcauuggaaauguaauugaggaaaauacguaauaaaaaaaaauuaaaaagaaaagaaaaacaaagggaagucugaagaacaugcugaacauuuggccaagagaaugaaggaagccaaagagaaacggcaggaacagaacgccaaaagagguagacuaucuucacugcgagcuuuuacuuagaagucugaggccagccaaaaauaagucuuuaagaauaauaaaugacaccaugccugaccuaaagcuuuacuacagagcaauugugauaaaaacugcaugguacugguauagcgacagacaaguagaccaauggaacagaauugaagacccugagaugaacccacacaccuauggucacuugaucuuugacaagggagcuaaaaccauccaguggaagaaagacagcauuuucaacaaauggugcuggcacaacuggcgguuaucauguagaagaaugcgaauugauccauuccuaucuccuuguacuaaggucaaaucuaaguggaucaaggaacuucacauaaaaccagagacacugaaacuuacagaggagaaaguagggaaaagccucgaagauauggguacaggggaaaaauuccugaauagaacagcaauggcuugugcuguaagauugagaaucgauaaaugggaccucauaaaguugcaaagcuucugcaaggcaaaagacaccgucaacaagacaaaaagaccaccaacagauugggaaaggaucuuuaccuauccuaaaucagauaggggacuaauauccaauauauauaaagaacucaagaggguggaccccagaaaaaucaaauaaccucauuaaaaaauggggcucagaacugaacaaagaauucugaccugaggaauacugaauggcagagaagcaccugaaaaaauguucaacauccuuaaucaucagggaaaugcaacucaaaacaacccugagauucuaucucacaccagucagaauggcuaagaucaaaaauucaggugacagcagaugcuggcgaggauguggagaaagaggaacacuccuucauuguuggugggaugcaagcuuguacaaccacucuggaaaucaguuuggcgguuccucagaaaauuggacauaauacuaccggaagauccagcaauaccucuccugggcauauauccagaagaugucccaaccgguaagaaggacacaugcuccacuauguucauagcagccuuauuuauaauagccagaagcuggaaagaacccagaugccccucaacagaggaauggauacagaaaaugugguacauuuacacaauggaguacuacucagcuauuaaaaggaaugaauuuaugaaauuucuaggcaaauggauggaccuggagggcaucauccugagugagguaacccaaucacaaaggaacucacacaauauguacucacugauaaguggauauuagcccaaaaacuuaggauacccaagauauaagauacaauuuguuaaacacaugaaccucaagaagaacgaagaccaaaguguggacacugugucucuucuuagaauugggaacaaaacacccauggaaagaguuaaagagauaaaguuuggagcugugacgaaaggauggaccaucuaaagacugccauauccagggauccaucacauaaucagcuuccaaaugcugacaccauugcauacacuagcaagauuuugcugaaaggacccagauauagcugucucuugugagacuaugccagggccuagcaaacacagaaguggaugcucacagucagcuauuggauggaucacagggcccccaauggaggaucuagagaauguacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacuugcaaacuuuauaugccccaguacaggggaacgccagggccaaaaagugggaguggguggguaggggagugggggggguguguauuggggacuuuuuggauagcauuggaaauguaaaugaggaaaauaccuaauaaaaaaauuaauucaaaaaaaaaaaggauaauaaaugaucagaacuuaaaucugagagacacacuccugcaauauccagacaauacuugauugacuacuuugcuuucaucacgcacauuuaagagucacuuuuauuuguucccagagagaaucucugagacuaucaguaaacauccaucuucuggaggaugaggaugaagucuaguugcugguagugugcuuaccuagcaugcaccaagcccuggguuuacuccacagcaccauauaaaaucaggcauguaccuaccuguacuccagcacuccggagguagagguagaggcaggagggucagaaauucaaguucguuuucagcuacagaguaagucugaagacagcagaacuuaacacaagacagugacauaaaaccaacaaaguuuccagauauaacuguuauuuaccuuuuuagagccccgcugaaugcuacaguucuuacaggauacauuuuuacugucccaauggucagcagcuccacacgugagacagaggucagggucacacucucggacagccagguagcauggacacuguuugguguugcauugugcuuugcaccgacauccaggaaagcgguuuugaccuuuagggauaaauguaucaucaccaccauacccaagaaucacccucaucauccacauccuuuccaggaaggcagucaaggucuugcugagcacacgagucacucacuuaaacccuuaccaccuuuccuuacuauuccaucguaacaaggaagcaggaaaccacaaacaugaagcugauaggacugagaaagaucacugcugguuuugcuguccauuucauauuuguuaaauagcacauggauuuaaagcccuacgguuaauuaaucagguaaagggaagucuuggacugaaugguauccaugacccuaaaucaugccaguaaaccugcgguucucaaccugugggucuuaaccccguuggcaaaacaucccuccaaaugcauauacauuaugauucauaacuguagcaaaauuaugaaaucauuuaacaaaaaucauuuuacagaugggggucaccacaauaugaacuguauuaaagggucacagcauuaggaagguugagaaccacuauaauaaagcauauuucuaauccauucuuugguauccacacucuguacagcuuucuuaagugauuaugaaaaccuacugcgcccuuaccuacuucccuucauucugaaaaccaaaacccacuuaacucucacuauuucugacacccacaaaaggaguggguagcuacuucuagauucgccuuacagucuaugccucuuuacuguacuucaaaugaccaaagaggaaaaacagaaaaauccaauccauuacuacaacugccuaacuugugcaugagcauacacagucacauugcccaagaggcugacuagacauuagcacaguacagggcucaagaaauacuuguaaaauaagcagcuuuccuaaagcaagcaauaagagcacucccaguccuuaugucuugauuuaaaccaccauuuucagcugcugaccaaaagccuauucaguucucaugcaauugcaccaaagcaacaaauacuuacacucugaacuacauugacaaaacuuuucacaaaaauuuugugcuaucacacaagggcacgaacugucacaaggcugccguggauggucacaggguugauaguuguaaacaugguuagaggagccgucugaguaaagauaacagcacgcagccaaugaauccagggagaugggaaaugaucaucacaauuaacaagacauucuuccccacuaccucuggaacauccuugacuggcugccuuuacugaaguauacaacacuccuguggagaaaaaaaaaaucaccucccacccccaagagcuuaaacacuuggugccacauuucagccccacuucugcuucucucugacucgcuccguccaguucacuucacugcagaucaacagacacaguucauuuaaacugauuugcuaaguaaaaaucaaaucagaagaaccaaaacuucauccaguuucuauucuaaaacaaaugaggacaacagacguuugggggcugauaaugagguuagaugggaggaugcugacccuuuuucaguuguaucuuucugcagugugcagcccacaaccuguaaaagauagaaaaaguucugugugagauacaacaacuggcuacaacucugaguccuguuuaaaugagccuggcugugcaauucaugcaccagugcugaaaagccaaggcuggcuuuauacucccuagucucuaugggcuugccaguucagacugacucaagaaccuacucacucaggauacugugucaugcccggaagccuggcaaggaaauucuuguccauauugccugguuaagacuauaaagccuugugcauaccuacugauuuagucccgucugaauuauauggauaccaauacuuucuacaauuuucagcaucacuaacuacucaguugaauugcaugguaagaaacuguucaaccaaaaacucagaagcauauaguaaagccuaaguuucuaugccccucaacagaggaauggauacagaaaaugugguacauuuauacaauggaguacuacucagcuauuaaaaacaaugaauuuaugaaauucugggacaaauggagguaacuggaguauaucauccuuaguuagguaacccaaucacaaaagaaguuauuagauacacacucacugauaaguggauagauauuagcccaaaaacauagaauacccaagauacaauuugcaaaacacaagaaaaucaagaagcuagagaaaguacccaaggagcugaaggggucugccacccuauagguggaacaacgauaugaacuaaccaguaccccggagcucgugucucuagcugcauauguaucaaaagauggccuagucggccaucacugggaagagaggccccuugguauuacaaaccuuauaugccccaguacaggggaacaccagggccaagaagugggaguggguggguaggggagcaggguggggagaggguauagggaacuuucgggauagcauuugaaauguauauaaagaaaauaucuaauacaaaaaaaaaaguacuucagcacauucaaugugccuauacaaaauuuuuggagcauaaucuaacugcauccuuacccacuuaacuacacuucucauuuuaaaacacaguggguugagguaggaggguccuguacaguuauucacuauaagucuuugugagagguaauauccagacuugaaggaggcucacuucaaauaucagaauguaauggcacaugcuuagaaaauccagacuccuagacuaaaagccacagcuaaacacuggcccagggagcacagcagaagcacaucuuauauccacaccaaaaagaaacauuucuguagcuuuacugcaguauguuuuucucaauccaaauccaaugugguugguaaaacaaaauuucuaugacuugauaugucaacuauacugaaguggcuguauauaaaaacuaacagcagccauaagggagaaaugagauuucuauacaucuauaacagcuguuuagaaccuuuuauaucauuauucaagugaaaacugacugauguucuuaggaaagcccugccugcagauccugccucacugcuucucuaagggcuccccagcagacucaccgauguuuccuuuucuucuuucuuggaggagugucuacauccucagugggaacaggugcuaugauacuggacuccuugacucuaaacucauacaccuacaugagaggcagaguaauaaggacacugugguuuaauggaaacauuccaugcuuuugcaaacuggagaaauguuuuugucucucccaucacacugccaguauauggaguagggcaagguacacaguagaaaucacuauuguuccaucacauugggaauguagcuauauuuaaagucuggccaaaguucacucuauguacauguaucacacccaaauugaauucuaaacuaaagaauuucugaaacacggcuaaagaauaauacugauuuaauuuucuuaagaggaggggaaauuaauucuuuucagaagaugaacagaaugaaaucaagauucucuaugucuggauaaugagcacauguuauuccuguguuuaaaccucugaaaacauaugcuuaccugucuacauguuuuggucccaauuagccuagcaauggcacaaaaguuaucguaguaaguaccaaugaggacucuaaacauggaggcuucagcaccacuccacuccacauucucaggagguucaauauuuggcuucaucuuuauugguguuugacaccgagaauuugcuucuagaaaaccaaauguuaacacuagucaagaaaugacaaagggacuggggagaugguucacugggucaaagcucuuaucaugcaagcaugaggaccagagggcagguuuucucaaccacauaaaaaucagacacauaguauaagcauguuaucccagugcuccuacaaggaaaucagagacagagacaggagacucuccagaagaucacaggccaacuagucuaguauauguaauggagaaauaaccaaaaggucuugucucaaacaagauggacagguaaggacccauacucaggauguuauucuuugacauucauauguacaccaauggcauauguguguauacugacacauaugcaaagacgacugaucaauacgaacaaguaaaauucaagguaggcuaaggaaaagcagaaggcacuuaauuguauuuuagaauuaguaagguuagaaucaacaucacaaagauccuaucacacuugccaaagaacccagaaguucugcucccuuuaucagacuuaucaaauacacacaaauauuaucuuuuaugguauuguuuagaguugaaagaacuaaaauucaaccaauaaaauauaaacucagcaguaguacuuguuuucuuucuaacugaaacuauucauuggucuuuaagauuaaaacagaacuuucuuaguuccaucauccuccaucaaagaaagauggaacaggggaagaggguacaaacagcaagaacaauuggaucagagcuuccagcaacccagacagaugagaauaacagaaggugcacuugggagacagcacaaacaauucagcuaugccuuacugagagaacucuccaaucuuagccacaaaaggggagaaaggcaaggguccuggagagaacacucggagcacccugcucauacagagaaccugagauugguucccagcacucgugccuggcagcucacaccugccucuaaccccagcuuucuguaccuacacacauuagauagucuuaacccuuagaaagguaaacuuacaaagcaauaauaacccaacaacccagcuguaagauaugucuuaccagaggagcuggacgucucaucuuuuuucucuucuucuucuuuaucauuguucucucccccaguuucagucccugcuucucugucacugucuguauccuuugacuccagcacacugauggugggggugcugggucugcuacuguuauucggaagucuuccucuucugcggcccccugggcguuuagguggugucuuuauacgcucagcaguaagagcagcagcaaacuccuuagcucccuccuguaaaaugaaaaauagaggcaucagaguaaaguucuaaauauuuugguggaauagaguaagacgacauugcauaacacaaguugcucaagacucuacacaguguccauuaucagucauuagauagcaacacaccuaucuauuuuccaucugcuuuugauacuuucaagauuccaaaaauauaaaaauagauucaauauuuuguuccaaugaugcaaaaucaggcaagacaguucuacauggugaguuuguaaaauuaaauuaaaauauaguaaaugaaaauauauuucaaaaaauaaagguauuuuucucuacauauacauacaguacguuuaaaagagaauaucaaaagacauauugaaguguauuaagucagacuuccuauuucaaggcuuaaaauaauacauaccucuuuaaagguacuauuuaaagaaaacaagaacacaaaacauauacaugcaugacuuagucacuucugaucuuacuauuaaaacauccaauuauuuuuuccugugaaggaugcaaagccacaggaagauaugaaagaacuuugagguacaagauuaggguuacauuuugcauucggaaguaccacaauccaaucucagaaaguauaaaacaaugguuagagcaugguuuauaagagaccacagaaacauuuuagaugagccaauaaaguucugccuuauaaagaauauaaaacagugcucaggaauuccuuuauuuuuauuuuuauuuuuauuuuuuuaguggagcaaagagcaaaguuugaaaggagccaacaguuuuauacuucacucuacaaaaaccaaauugcuuaaaaauaggauaccuucuguaggugccauucauugaaucuucuguccaaaauccaacaggcaauauauacccacuuaguuccuagguaggaguggcuugguucaaagaggggaaaugguaaaaaauaagauaguacccguaaaaaaacaacuuuccugccucauauuuuccuaaucccuuacuccuaaucaccaucacuuaaaaaaagaaaaccuguuuaggaccuaugguacaccuuaaacuauaaguggccuaaagcauucacagaagggauacguccaugauaagacuuaagaacgucugcauaagacuacaaguuucugguguuuaagugggcuaucuguaccucauacucucuuaaacuuuguggagagucuuugauccuaagaaccgugaaacguugcugaagaaauaacacagauaaacagagaguaauacaagauuaauagacuacacugugcaggacacagcucugaaagaaacaaggauaagaacacugccugucauauggccaauguaaauaugaauccagacagcauuacugcuggcuuuaccaccuccaccaaaauucuuaagagcccuccagaguaacaaagcacugaaucucaccagaugcugguaacacugugguccacaaggcuuguuguccaaagcuguuucuguguucuuccucuuauauguguuggguguugcauggaaggcuguaaaauaagcacaaaguaccugaauauggcuauaaaaaguuuacuuuuucauuuccccagagccauuggaaaauccaguaucucccacauauguaguuuacuuucuacagcuucccccaucucucacaggguacccuccacucugccuccaaccuccaagaaaggugacgacaugguaaacucuggaaugauucauaauucuuauuuucccuaugcaaguaugaucuaugggaauaaaguaugacuauagacauuuacuugagucuuuaguaucuccaacaagugaaaaauauuggaaaaaaaaaaaacacaacagacuuucuaauuuuacaaaaauauucuggcaucuacaauuucccugucuagggaggcuuuuuauguuuuugguuuuugaacuuuggggguggggguggggaggaggggugagauagaagggugguaucuuucccaggcuggcuuuaaacucauagcaauacucuagccuugcccccugagaacuacaauuauagauguguaucaccacauccagcucugacauaauuacuugauuucuagcugaaggaucaacuuacuaaacaugaacuagaaaaugguucugcuuauaaaauuucuagaacaaagaagcuucaauaucuggaacucaauucuaggguguguuaaccaguuguuuucucacacaauggaaaaagucaaugcuuaaaacuaacuauucaagucgggcgugguggugcacgccuuuaaucccagcacgagaggcagaggcaggcggauuuccgaguucgaggccagccuggucuacagagugaguuccaggacagccagggauacacagagaaacccugucucaaacccccucuccccaaaaaaaccaaacaacaacaacaaaaaaaccuaacuauucaaaauuauacaaugggaaaaugaccuuaauuuggcuaaaaaauaggugauauucacagaacuauguaggguuuuggugguuuuaaaaaggccuuuuucauaaaggcuccacucuuuaucuucuccauuuaaguacaagagauccaauccugggccuagcucagcaaaggcucaagcacugagcuaaaaucccaagcugucuccucacaaaaaaaacauuuuaacaaucauaccuuuuuuaaacaacgguugugggguuuguuguuuugguuuaagguuuuguuguuguuguuuuguuuguuuguuuguuuguuuguuuguugagacaggaauucucuguguuguauggccuggcuauccugaaagucacucuauacacuagcuggccuucaacucagagauacaccugccucugccucccaaaugcugggauuaaaggugugagccaccauauccaacaguuuuugcauacauacaaaguuuugcuacauaagccuagacuggcaaucaucuugccucugcagaaauaauguaaaauuauguauauauaguaacaccacauauccaacuucaacaaguugacuucuacauucacaccauggcacacauaugccuacauguaugcccacagacaaagucaaucacucaaccaaugucauuaauaaaggcccaaagacagagaaaagauaccuaaaacuaagaaacagaccuaggagcugggaugcuggcuccgugaauaaauaaauacauugauaauaagcaaugaaagaaguacgauaucucaaagcagggaaugauuugaacuccauaaaugauacuaagacauuuagauaacuuugugaaugaggaaaaguuagauccauguucauaccauaauaaguucuaaacaggaagauacacaaguauauguguuuuuuaaaaccgagaaguaggugugauggggaggcucccaggauaccaggaaaggcgcuagccaucaaguuucuccaccugaguuuaauaccuagacuguggaaacuuguccugaccuccacaagagcaccacagcaagcauauccuucaaccuccaaaacaaauaaauuaaagaaaagcuuagaaaguguauguggggaggggagcuuuauagucuuaaaggugguggaagccaugugauuucuuuuuaaaaaauuaaacuauacuuaaggacguuuuauugaacaaacuuuaaauaauucauuucaagggaacuuaucucgggguggggaauuacuucaguaaggaaaguguucacauaggcaggaggaccugaccucugauccucacaccucuguaaaacagagugugguaggaggcauccaagagcagaagggaagcagagauggggagguucccagaagcucacugucccaucaaccuacgcaaaaagcugagcucccaguucacuguaagaucuuagcucaacaaauaaggcagagaaggauaaaugacaaacagaaccuuucaaaugucauauggaagccuaccuauuaccauaaaagcccccaccacacacccaaaaaacaccucacacagaauuaaucuagaguuacucuauaauguggcaacaaugccucuagaaaacccacagguuuacaaaucaaaagccaagugcugggaauacguuaccucuuuuggaguuguugaccagugagaucccauaggcccccaaacauuauaagcuuuugccaaugcuauugauaagaccucuuacugaagacaucacauacuugggucauagaacaugaagguaucaggcuggcacugaacugaauacuucaucccuaucagcuagcauuccuagugcugaaaggugcuaugcacacuaaugagggagaaaagaaaucacuaacuagccuuccuaccuuccuagcugugaaugaugcaagaugaaguaaaaaaaaaaacuggccuggcaagaucugcacugcugcaguaguaccaugaacaucaugagaguagacaaccacuuucugauuggauuuaagucccacucuacaagaugauaccuauaucuggcaucauuguugagccaagaaucuguagcuagacaaggcauggauggacccuagggauggagagagccuaauaguauuauuccgcuaaauagacauaguauuaaaucaauugcuaauaacaccauuauacccacaaguuaaugcauuucuuaaucguuacaagagaagcuucuauuugcaguacauggugauuaauauaaagacccacaacuggucaacgugcagagaauaggagacugaagaaugucuaggccuaaugggaaaucuauaucacgugcugcuggguguuugcggcacaugcauuuaaucccagcacucuggaggcagaggcagaguuugaggccauuggucuacagagcuuguuccaggaaagccaagguuauagacaaagaaaccggaguggggggauggggguuggaggguugggggguggaaugacugauacuauuuauucacugcaaauuuuaggaauggggauguggcuuacugggaguauaugggauguauuuuagaguguucagggaugggggugugucuuaaugggagagugugcagggauggggcuguggcuauauagucuagugugugcccagcagaggcaaggcccuggguucaaucucuaacacuacagaaaacaaacaaacccacacaccagccuguagagaauuccaacuuuagugggauauggugguaugcuccuguaauuuuagagcucaagaaguugaggcaggagaaucaaaaggaucaugaaaaucaacaguucaaggcuagccucagcuacauacggaguaugagacacuauuucaaaaaacacaaaacaaauuccaguuaccuggaaauuuuaccaagaaaccucauuuucuagaaaugccaaaggaaaaaaauuaguuuucauacugacauuaaggauauuuuauguuugcuuguuuugaaauaugaaguacuuauaaaacaauuauuugaaggaucaaaaugaaacaaaaauauuuuaacacuaggcaaguaauuguuuguguaaaugccuuuucaccaauucauuaacuuaacaaaauuuguucauaaauaucuguaauacugcucugcgcuccuucacuguaauaacuucaucauaaaacagccuuguaaagagucacugagcuucaaguuaaugggaagcagcgaauggaauaaaauguguacaaaagaugucagaggaauccucagaauguaaaagucucaguacagggacgugacauauuucucaauccucacucuaagauuggccgguacauuuugguugugguaacugacagcaaguugcuuuacuacagauuucaacaacaaagauagaaaaugaaaacguacaauaacugcacuuacgauguaggaagcagucauacuuaaaacaucgucgacagaagagcguaugaaaugaaugcaagcuuugcucccucugaacagauuuggcauuugguccaucgauguuuggaguacauucaggaggcagagcaccugggagcugcugcuccgugaguucuuuauaucugacaucagacaaacaaacaaacaauauaaguaaaacacaaagaaaaaucacuuucuugaaaguuucuaaaagguuuccaaggguuugauuuuucuuaaaaguuuaucuuaucuaaaacucaaugaaaaauauccaaccuacaauaaucuuugcugacacuaagaaucaaucauguauuaugcauaggaaacaagaaucaagcucauuaauacaacugagguacacugcagaagaggcuauuaacauuaguuuggauaaacuauaaaaaucucuuccagcguccagaauauacuaguauaaacuguacacagacaaauaacaugcaugaauucucauauauauacucaauaugaacuaaaaauuuccuaauauacaguacaaguguguauaugugugugugugugugagagagagagagaauacuuaaaauaauaagccaagaugauaagauucacgacuguaccaaauuaaaaagaaaaaaaucuuacuuuucuuucaguucuucugcggugcccuuaucuggaaacauugaggaaauggcuucaaauauuuuaucagcaggaaauuuccgaggugggcaaguuucuuuaucuaaacagugaauugugauaagggaagagauggaagaaacaaguuucaauuucauuuucucuguaucacagcaucucaacaaagcugauuuucuaagaacuuguccccuuugguucacuuuuggggggcuguugggaagggaguaaucuuugagacugcguagucuuaauuggccugcaacuaaguagaccagcuugacuuccagccucugaugauuacuuuauuauuauuuuuguauguacauguaugugugcucaugugcaccugagugaagacacauggugugcacaccagugugcacgugugagggucaggaaagaacuuuugcgagucagugcucuccuuccucuuuggaacuaagaaauugaaaucaggucaagacuugcucagcaagcacucuuauccacugauccaucucgguagccaacuuuucugucuuauugucucugacucccaagugcuaguaugaccaggaugacgcacuaacacuggcuuggggggagguuugccuaguuuagcccaagauggcauaaaacucguuauguagcuaaggaugaccuugaacuucugacucuccagcuuucacuuucaagcacugagauuacaggugucaccaaacccuguauuacuuacuucuaauggaaaagccugucaaauacuagaaagacaaauauaaaauucaaguaugagauguuaagaguacaggaagacagaucccccaaauuuggauuauuugaaacuaauagcuuugugucagagcugaccauuaauccacuuucagaucuguccaucacauggaagaacuuagcaaucacuuauugacuccuaagguguguuucuguuauaaagaauacaugucuuuugaugcaauuccucccacccccccccccaaacucugcuaugcugucuuaacaguaagcuugcuaaauacaagacagcauuauggacucucuacuauuugggguagacugcuuucuagcaacaacuaacaaguguagagacaauagcacagcucucaggucagaccuaggucaucaacuuggggcucagauucuacuuuuucccaauauagcuaucuuaaguuucuuagccuuuaaccucccuaaacccauuuccaauauauaauggagcugauaauaauauauacauuguaaagcuguggaaggauaagcugguauauaaguauauuaguauacaacuuauauaagauacaugauauuauuauaaagauaauuaugauaauugaucagcaaagugcaaaaaaggauuauguccuuuuccuaggcaaaggaaacaaagaagcucuaguggagaaugaaaugcugcagaaaauauauuugaucauacacuuaacaaaaaggggguaguuuaauuauacccauacauggguggcuuuuacauuauuuacauguauuaauuagaugguguauguaugccaccguguacugaugugaagaucaggggcaacucagcagagucaguucuuuucuucuauagagugggcuccagggaucaaacucgauuuaucaagcuuggugguaagcaccuuuacccaccgagucaucuuaccagccugauagguuuuuuuuaaaagaauuauauaaagcugaaacaaaaaacuaguauuaaacauaccaucucgauuauccucuagaucuuucuguuuuucuucucuuucaucuggaucaucuccaucaucgucaucaucaucaucauuauauugaccaagagcauuuaccaacuccacaaaaauuucaucauuuauaaauccacauucuaaaagccaaaugucagaaacagagggaaaaagauaaugacaagauuauguauauguuuucuaaucuggaagaauagugaaggccuaucagcacuguaaccuaaggggcagguaaggauagucaagaucaauuucacagccagcaaagaaaacagcauuuaccuucaacaucuguugcuuucucaggaaucaacccucuccagcugauccaggguauauuacucccuuaauccauaaggaccuguaguuuuagcuuccucccaaucugugucacugacugaccacuucaaaccuguuuugcauuaugauaugaccacaucuccguuugcucagauaucaagagagccuccuguucagaaaccugaauccaggauucuguuaacuuaauuucacgggcucuggcugcccugaggaaggcauuguugaguagaaagccuuucugaagcacaugccccauaaacagaucuuuaaacuuaguuuuacuauugaaagcuuaccaaaaaacacacacucuauuccuauaaaaucuauguguuguuucugcuguaguuuauaaccaguuacugaugauuaccaaguggcaaauaagauccucaaauggaaaaacuaaagaaauacuaaaaauguaugccuuuaagcccagacuagcucuuaagauuuuuuaugaacucuauuaagaaacccuucuaugacagucugaaugaaaaugauguuaugggcccacagggaguggcaugauuaggaagugugguagcguugggguagguguagccuugcuaaaggaagugugucaguggaggcaggcuuugaggucuuaggugcuuaagccagacccaguggcuguugggguuagccuugugaccuguggauucagaaccugaguucuaugcccugguccagacuacaaccugaucuuggggcauugcaguaacacagguacugcaaagaauacuccccaauaauaacugauugaucaauaaauggcuggguuuaugacugggcauagaaaagguaggacuuauaaccaagaaagauuucuagagagacccggaggaagaaggaaaagaugagagagaagcugguccugaggacacacaugguacagagcaaguugaguaaaaugcaaacuaaaguacacggggccugucguuuguauauagaagagcucagaaucugccaaauauaggauuacagccuguaaauaaauaugaacuguuucugugucaauuacuugggaauuacaugaacaaaaaugaggcagaaaccuccaauagauauuaaggauuaaaggggggcacagcgacaccccagaaaauuuuuauugauuaaguguaacucucucuuccugcugucugccauccagauauagaacucuaggcuccuucuccagcaccauacuugccugcgggccaccacgcuuacugccacgaugauaauggacuaaacuuuuuugggggggguuuuuuugguuuuuuuuguuuuguuuuguuuuuguuuuuucaagacaggguuucucuguauagcccuggcuguccuggaacucacuuuguagaccaggcuggccuugaauucagaaauccgccugccucugccuccugagugcugggauuaaaggcgugcgccaacaccgcccggcuggacuaaauaaacaucucaacaguuagcaagccccaaucaaaugcuuuccuuuuuaagagcugccacugucauggcaacaagaaaacccucagacccucaacuaaagagaauauacacauagcucaccucugucaccaugcacuuuuccaucauaauuuuuuauuaguucuucaaugaaagugccauccugauccagaacuucaucccccauauaaggaauguuauguaaaacaguuucgucuuccaccugagagagagagagagagagagagagagagggcgagagagagagggagagagagagagagagagagaaagaaggaaaaagagaaaaagaaaggaagaaagaaagaaaaguuaaaaccagauguauucuaauuuuuaaacuagacuuuaagcauuuauuuaaaacuugaaggcccgagagauggcucagcagguaaagaccaugcuugacaaccagaacucaaucccugggacccaugugguaggcagagaacuaacuccccacaugcuguccucugaccccuauaauuugucaugauaaacacaaacacauacauacauacguguguguguguguguguguguguguguguguguguguguguguguguguguguguguagaguuacauaggacacauacacauaaaacuuaaaacuuaagcccucggugugagacuuaaaugugauacacuugcccagcauucuaaacacugaguuuaauuccugguaccacacaaaaaaaguuaaugagauaacuaaaaccaguauuuuccaugaguacuugucuuuauccagaucuguagagaaaacuguaacuacacuuaaucuaagaaaggaaacugcugcagguuacaugagaccucaaguguaagacauuccgauugcagauacuaaaauggaagguaccuguaauagaaccgaugauauguggcuuauccaaauaaacuacaaauacucaucaacaaagaguuuguaaaaaacuuuauuuggugaucuaacaauuaaaauauuugauacaauaagaaucuagugauacucuggagaucugaaugagaaacacccucuauaggcuuauguauuugaacaguugguuccuaguugguagcaccguuuagaagguuuagcaaguacaaccuugcuuggggaaguaugucacuggauaacauuugaagauuccauggcucacucaagucagcauccccaacuccccacucuguuuagugauucaguuacaaugggauucuuagcuucaugcuccuccagccaccacgccucuggcugccaugguaauucuuaucccccuggaaccauaagcccaaauaaacucuuccuucuauaaguugccuuggucuuggugauuuaucacaacaaggggaaaaaaaacugauacuaauauaaaagacuaucaauggucuuaucauucuaugccaaaaggauuuauacuuguaaaaucaaaauacucuacagcaacagaaacuauuucaguaauuuggugaacaagucauacaucaaagcugauuaugcuagugaacaagacaggcaaaucuacaucaaagcgugacaaccaacugggaaaagccaaucaaagaaaauguagagagacuagaauaucugagaacacaaaggacaaaaaccaaucaucuaaggaagaaaacuauacaaccaaguacaugacaguaacaauacaaaagacuagaugguccugaagcauguguccaaaaaccuaaguuagggcaggcuuaaucgaaaaagcccuugaacaaggcauugguuaaauguuuuagaaacguuuuagaacauuaacuaugaaaaacagaacauaaugacaaagacucacuggaggacaaagacaacauuucaaguauuacaagccuuggaucagacuaugauaacaaucaacaggaaaggacacacuagaaaaagccaugaaacacauagguggccaucaggcaacuaagaaauaggaagauuaaauuauuucaaaucaucacuagucagcaaauuuugaguuuguuaucaaaaauuuaaauaaagaaagaaacaaguauugagacaaaagcaaagugugaguaauaaaaggaaaauguagaguuuaacauauauauuguucagguucagaguauacauaugugacugcuauggguucaauuuauuuuguucuauuuuuauuaguuaaagaucuaacacaugucugagguguuuuugagacagccauggaggcugacauuugagagcagaacaagcaaaagcuacauuacuuacauaccauaaaauucuguuguaagggcgaccaagaguacauuauaggcaccgaggcgacugcauucagggucuuuaacgggaugacuugugcuggaaaauccaagucacuggugacugaacacuaaaacagaacacaaauaauaaaaacuuccucuuacaaaucaaaagaucaaccuuaagcuaugguuggucaucauacugugaacagaugcuguaacucuggauauaauuuuuaugaugcaaagguucauaaaauccaaaaagaauccucuuuucucuaaggugucuccuuagacauucuccaucuuuugcaagcuuuuaauccccuccagccuuucucauacuuaccaguaacaguuaaaaaucaaaaacuauauucauauuagccucagaagccugaucuguagcacguuuucucuaaacacuugaguuuauuuuuaauucugaucacucaagcacauagauuagaauauauuauauauaccaaauguguccuaagauuaugaauuacauugaucuuauuucuuuguuuguugagaugggguccuguuauugaauuuaaucuguagaccaggauguccucaaauucacaauucuccugccucagccuaaaagaugcugugaaugcuaagauuacaggcagauaucacuaugguauaucuaaaccuuaucuuuucucuugcuuuuuaaaaaugucauauuuuauauauuaucaaauaauggauuaagaguaacagaugaguuucaauugcaaaaacauuuuaaucagcuuuauagcaucuaacuguucacauguaaggcacuauauuaagcacaguaaauguuuuaucauaguuauuaugacucuaguugaaggcacuuaccccacuuugcaaugaaaaaacuacaguaaagaaaggacaaggaguuugcucaagaucauacauggaauauacacagcaagccugauucugcucacugcucugacccagugccaugauacuucaucucuauaacacaccuucuuucccuuaaaauucauuuuguauuauuuaucauaauaaugauuuaaugcuaaauuucuggggccucaaaaagagacagaauuugaccuccaccaacagacagaacuguguuaauuaaugcauauaucgaggaacagcuucucucuagaggaagaaacugcaggcucugccagggggcaaagguagcugugggcuaugaggcuugagugaggaaauugcuguagccuuggucacuccuguaaucucuccuuccugaaacuguuagcccaaggcaagacagacuacccaacuguaaucucacaggaauucugucucacaacugaggcacucuaucagacuucagggcacacuauucuuccuguaucacagaggaaaaaacugcuaauuacacugugacauaaugccuucuuaccacagugacuuaaacaaaaaaauguugguuaaaaauuguuaacauuuuugcaacuuugauucuaaugugguaaaaauucgugcccugauaaccacauugcuuucuauccugaugaggaauccagcuuuucuuaagaguucuauucucaaaugucaagccuccauggcugucucaaaaauaccucagauauguacugaugaucuuuaauaaaaauagaacaaaauaaauugaacucauggcagucacauauguacacacgauauacagagucagugucugagauuuauguaggguguuuccaagucagcaagacugggacuggaugaggugagauuacucgcacacaggccacauaagccuacauguguacucaugugucccucauguguggucacauuccacauagcagauacuauaagccuucaguucuacauagcugcucggguacucugaccaucacagugcacacugcacacaaagaugacuccuuccuaacagaagugaaagugacagacaaaguuguuccaaagaacaaagauagugaugucuacuuagguguuuuccaacaaggcaaaggaaaaauaacaauaccaaaagcucaaagucaaguaaauaaggugugaauggcuuauuaauguucucuuuccuacuaacuggcuucacucacagauccucaucccuccauuugcuaguccaauaacuacaggaaccaacauuuauugauuacaugcuguguuucaaucaccaugcuaaguaacugcuuauauucauaaucauaaguaguucuuguuaucaccuuaugacauaacuuuaacaucacaauccacaaaugggacuggaggccagaaauuaaaucuuccuaggaagauaguuaacuuagaaggcaggacuaaaaacuaagucuaauuguaacauccaagaacuuccucaguuuacugugcuuuaguucuugcucucagaagcucacagggaagagucacuauagagccuuauaguaucugcuauguggaaugugaccacacccaguaaggucacaggguuaucaccaacaacucuccucuuacucuaucccuagcacauuuuccuuuccuucaaccugacuagguaaauuuaaguaugaaaugauuuuaauuacucaauaaagcaucacauauuauccaauaaucuuaaauauaaaacaauuuucauuucuuaaaaaaguuauuaacuuuuguuuuauauuuggugggaauaaauuaauucuacauagaagcugucuuuauagcuuagagggacagacugguucuccagcccugacuuaccuguguuaguauaugaauccaaggucauguguaagucagacagaaaauauucuuuucaaccacuagcuaaggggaugacugauuugcagaaucaauauauacuaaaugaaagcuggaaacucacagaagcacagaaaacaggaagucacgggcuauagcacaaaugacacccccagucuaauaucuccaccccauuucugauauccaccacuucaaaguucugagucauccacaagucaacaagggaugaaacgcaagcucuguaaggggaagagcaucugaggugaaagguaggauuuuuaccuuucuaccucaaaacaauauucagcagugucuuaaaacauauguuuauggugucaacagacuauguuuguggcagaaaguucaguuccuuccgagcugaggacaccuauguggagaaugaagcugagcucucugcagcaccucuggauccuaccccacacagucucuagccaugcuacaaccauaccguccucacuugugaaaugauacugaaaugccacagccaaugcagguaaaacaaguugggaaugcuauguguugacuuacagaaaauuauacaaaacucccaguuacuuagcaacuuuacuuccuuugaacguguuucgcucucaacucuuuaaauacucauauugcucaaaacagugcaaaagcuguuguugaccucaccagagcauuuuugcccgcucaguuauaccucuagguggccuacuuuagcaacuuaaauuucuaauucuaauuccaauuucaggaucacagauaauuuaacagugguaaagaaaaccaaguuaccaaggacggcacacugucagagaaacacagcugacuggaaaguaacaagcuuccucugaggcuggggacucacaccacccagcugguacaacaggcgacuguguggcuggagaggaagccaagucaaaaguaguaguuguaggaguacacaaccaaacugagacucuuggcagaagacugguuccaaguaaaaacugugcuauggaaaaucguacagggagagcaggugaguggccugcagggaagggagaaaaauuaacacacccuacuaugugccaagcaccauguuagagacuuuaccaaaguugacuuuaaaauucucuacuaccuuaugagguaaauauuccccauuuuaggcaggacaucccaaaggacaauaguaacagccaccccaccucugaaugauccuuagcaugaaggcaguuaaacccagcuucaaaaaaguccacgggaguuauaucacaccagcuccuggguggugugaucauacauucuugaauacucacuggcucauucaguuaguucacacugagacaccaugaacugucauuauuuucaaacauacuccuauuuccuauuucuccauaugagaacaaagaagaaacagaaagccauagcccgggaagagacugugagugaaaggcaucagcuacugucaacucagggaagcaucagcccaggggagagugaggaggagacaucagcugucaucaaccucaaagggaagcugaagacuacuuccgagacuaccuuacuuuuuccucaggacuuaaggaaagaaagggaacaaaauccaaguuuuuaauuagcuaggccuuaugguaagggcaauauacauacuuaaauucaagaccgcuuuuuggugaagcaagaaggaaaaaaaaaggaaugaguuaagcagcauguauugaggaagcucaacagcaaacaugguuucauaaccaguuugaagggcagaggaagaagacugaaggggacacucuugagaaaaagugucucucacaagagggucagaaauaaaaacaagaaugggccuaacaucuucacgcaaguauuuaaugaaaccuagggaauaaacuaggaauaaaucuauuccagauuguaaacugcuuccauuuuugauauuacacauuuaugucaaaaaaccauuacauacuggagucucccuuguaacaaaaggcuauuaucuuggauuucacuuucaucuaauaucacuuucacacuucuuccuagcagaaauguacaagcauuucugugugugugugugugugugugugugugugugugugugugugugugugucugugucugugucugugucugugucugugucuguguaugcaugcugagggaggggaguauuuuuguuguuauuuugcuuugagguagagucucucuguguagcccuggcuggcagggaauuuucuauugagaccagacuggcuucaaucuuacaacaauccuacugccuuggcuuccugaguaaugagauuauauguagcuuuucaggaggacuagugugaugccuaaucuaaucuuaguuguaaacuucacuacauguagaauuaacuaaaacccaaagggcuagguaugccugugagagauuuuuuucuuuauuaaaucauuucaagugagaagacccacuucucacccugaccuucagggugugaagacagauacaucuuuacccaaaucuuuugagaaggaagaucuaccuuuaaucuaaauaaacaucuucugcuggaagccuauauaaaggacauggaagaagggaacuuguucucugccugcuugcccuggaucuugaguccuucacuggcauuagagcauacuucuucgggauucaggcauacacuaaugaccagcuaaaacaucaggcuucaaugacuuaacaacuucuagauucuuguaccuuccauuuguaaauagccauuguuggaauagcuggaccacagccuguaaaacauucuaauaaaucuccuggauggauggaaccauccauccauccauccauccauccauccauccauccauccaucgaguucuagagaacucugacagauuuugguacuagaagugguucuagagcaacaaaaauauaaggaugaaacuaaguaucuuucuaaaauaggcaucucacuuugucaauacuaguuacugaagccuuucauguaagcucagagaguccugaaugaugaaagcccauuauguguacuauuuuacaaauuaaggagacaaauacauuugauuauccugauucaccaaaugugagaggcaauggauuuggugacucuguauauaaaacuuuggacaauuuguggaaaaauaaggaaaaggaugacacuggucaguugaccuuagcaucacuagauaaacugacaaugggaaagaaugagcuucacgauaaaauuaaucaacuucuaucaucucagaauuuagugaacucaccaaugaacucagcaauaaaaauaaaacugaccaacuguagguuuagucuaaagcaguggcuuucaaccugugggucguaacuccuuuggggaaucacauaucagauacauaucagauauuuacauuacaauucauaacagcagcacaauuacacuuaugaaguagcaaugcaauaauuuuauaguuaugguuuagcacaacaugaggaaguauauuaagagccgcaguuuuaagaagauugagaaccacugacaacaaagguuucuaaguaugcccuggaagagaucuucucucuagcagccauagagcucaaguuacagaaaaucaaaccaaagcccccauuauaaauaagacugaauaaauuacaaauaaaauucaggucccagccucagaggguguuaaaauuaagggcauuacugguaaagaauaggauccuauacuugauaugcagauauguaggaggacccuauugaagcugagaacauugaacccucagauucucaagaguaugcuguguaagaccuaauccuccugggaagucccagaagacaugaccuucaccaguccuguaagaccaaaaauggugagggguaccagcccauuugaagagcuuuguuguuguagcccuuuuccuugugucagaccuagggucugaagcacugcuguucaguugaaugaacuuaauucagugggucuaauuggacccugaggucgcauggggcuaaguagcagcacugaaucaacaaagacaaugugacuguaguuaugguuugggcagcacagauaaaacuauguccauaaugaccuaaccuuuaauagguaacacagaaaaucugauuuuuacggugguaugacucauauggaccuuugguacugucuaaucauauuauuccaggcaugaaacauucuaggaaaccuauugcauuuuuguuugauccauauaagcagaaaaauucucaaacuaagaaagccuauaauuggaucaugggaaaagaaaucagcccauaagccaauuucuagacuugagccaguuugccaaaccaaaacgccuugaaugaggggacugccagguuccccugaagaaagaccuugauaaaauacccaaaaguuucacuguuaaccguucucaaguccuuucccagagggcccuacagccuuugacaggguuaacuguacacuggaggaaaggaaacaaucagacuucccaggaucuacuggauacugguuaugaauugucacugguuccaagagaccccaagaagcauuguagccuuccaauuaaguagggcccuaugaaggucaggugguuaauggaguuuuggcugaaguccaacucacaguagguacaguacauccccugaacucauccuuugguuauuuccccagucccagauauauaauugaaauagauauucuuagaagcuggcaggaugcccacugguucccugaccuauguagugagggcuauugugguuagaaaggguaaauggaagucuuuuauuagaguugccucugccagagagaacagcuaaucaaaaacaguaucccuggaagacugcagaaauuaguaccaccaucaaggacuugaaaagaaacagaaguagugguucccaccacaauucccuccaacuccccuaucuggccagugcagaagacagacagacaugaagaaugacaguugacuaucuaaaacuacacugguaguaacucugauugugcugcuguaccaauguccuuaucugagcagauuaacacauuuccugguauacggcauacagcuauugauccaacaauuaacuuuuucaguaccugucuguuccuaagccccagcagaagcaauaggcuuucaguuggcaagaccagcaguauaccuuuacaguuuuccuugagggaaucuaucaccucuccaacccugagucauaacuuacuucuaagggaucuugaucaucugucucuuuugcagaguaucauaugguucacuaaauuggcaacauuaugcugacuggaccaaaugagcaggaaguagcaaccacuuucaacuuguugguaacacaugugaaucaaagaaugggaaauaaauucagccaaaauucaaaggccuucuaccucaguaaaauacuuagacgcccacucuuaugggacauaaagagauauucuuucuaagauaaagaauaaguuauuguaucuggccccuuccaccaccaagaaagaagcacaauguuuagugagccuauauggauucuggagacacuuggguguguuaguccagccuauauaccaagugacucagaaaacugcuagcuuugaguggggccuggaacaggaaaaggcucuuuaacagguccaggcuguugugugcagacuacacuaccauuuggaccauaugauguagcagagcugaugauacuuugaggugucaguggcaaauagggaugcuguuuggaaaauuggggccucuauaggugaaucacagaagacacuuuggagcaagggucuaccaucaucugagagacaaguauccucccuuugagagacagcucucggacugcuuggacuuugguggaaaccgaacauuugacaaugugacaccaaguuacaagacaacccaagcugcccaucacgagcuagguauuaucuuacugaccauaccaugaaauagaacaugcacaguagcaauccauuauccaauagaaacaguauacauaugaucaggccugagcagguccugaaagcacaaacaaguuacccaagaaguuguucaaaugccuaagguuucuauuccuguuacaaugcuaccugcucccaaacauacauguguauauauaaccucauaugacuaacuaagagaagaaaagacuagggccugcuuuacugauguucugcauauuaugcaagcaccaaccagaaguggacaguugcagcaugacaacuucuuucuggaacaacccugaaagucaccagugaaaggaaaucuucacuaagggcagaacuucaggcaguacacauggcguuuugaauaggagaaugugugauuauucacugauucauguuuguagacauugaauugauugaacagucagggacuuggaaaaaccaugauuaaaagauuuuaagaaaaacaucuggggacuaaguauguagagagauuucuccaaaugggugaagaaugugaagauacuuggugucccauguaaauacucaucaaaaguugacuucagcuggaggagcucaauaaucaaguggauaaagccucuuuuccuagccaucucugucacuacccaaugggcacauaaacaaagaggccaugguggcagagauggggaugauacgugagcuugaaaacacagacugccauucaccaaucgugaacuggcuauagcugcugcuaagugccagaucugcaaccaauacugaggcccagauauggcacuguucccugagauaccaguuaacaaccugguagcagacugacuacauugaaccacaucuuccauagaaauaauaacacuuugucccuaguggaauagauacuuauacugguugugaauuuggcuuuccuguguguaaugcuucuuccaaaacuaucaucuguggacuuacagaaugccauagccaccaucuugguauuucauacaguauugaaucuggccaagggacucaugucauaccugcgaaguauaacagugagccuaagaucauagaauccacuagucuuaccauguucccuacuauccugaagcaguuggcucaaaagaaagauggaauggucuuaugaaaacacaguuacaacacuaauuaguugucagcacccuuggaaggcuggggcagguguucucuagaagaugcuauaugcuuugaaucagcauccaacauaugguacaucuucucccagagcaaggaucccugugucuagaaaccaaggaguggaaaagggaauaguuccacucacuaucaugccuagugacccacuaggaaaauguuugcuucuuguucccaugaccuuaaauucugcuggucuaggaauucugguuucagagaggggaacauucuugccaagagccacaacaaacaucccauugaucuggaagcucagacguccccuaggccucuuugagcuucugaugcccuuaaaccaacagguuaagaaaggaguaacagugucaggaggggucacugauucagacuaaaaaaaagaaauuggauugcuucuccaugacagagguaaggaagaguaugucuggagagcaggagagauccuucagggcaucucuuggagcuacuacacucucuugguguuaacacugacugugguuaagguccauggaaaaacccacuaaggugcuugcugaauauggaggaaacacagaauggguaacagagaaagguaauuauaaauaccagcuaaguggcagccugaccaguucagccaccaacuauaugcccagauccagggcuuuguguuaaccaagcccaacaucuacgccaucucugaacugccagagagaaugaagggacuggugaagugguaauuucugccuuuguuggagacucaaguguguccagugauguuuuucuaaaagcugucuuaugaggauguuuugcugaagcagacaugugagaggauguuuugcugaagcagacacgugguauuuuucuggaagcuaucugguaaaagggcaugugauguuuugcuggagugggcacuugagaggacacauguuuuagaaagaguauaaauauaacccaacagacaguggacgacacucuggcauugguucuccuugcuggucuucacugggcuucccagacacuggucuuugcugaugaugcuauugccuuggugcgccuugcuuucuuccaugaucuucgcuuguugugcuucauagagacaagugcaccaaagaacuucuggugguguucuggcugcuucuuguagcuucggcagacucaugccaauuggcagagccuggugguuucuucuggacugagccacugguugaugugcauuugauguuucucuagugaacuugucuguagacaacgaagauuggaauagucccaagaaacuguuccaaacagguccaugucccccuuguccuauuagccauuuuccuccucuaccuuuggucaguugggcuauaaauuuuuauauuuaaaaaauaaaagccugauccuauagauccaaagcuccaggaucuccaugacacaggacaaaaccaggauaucugagagagguccuaguaagaauccaguauucacaauauagcagaagccagacaccuugaaccagaccaaugacucauugcaaugaacauuugcaaguaaagauggguaggcaaaaggguguacugugggacacacuuugauacacuacaguuucccuauuuuuuuccuuuuggugaggacguuacaaagauggaggacagguauaaagggauaggaagaugggugggguugggguacaugacuugaaauuuacaaaggaucaauuaaaaauauaaacaaaugaauaaauaaaugucagcuaaggccacauaaccaguuacagagauaagaauuauaauuuacgggcuggugagauggcucaguggguaagagcacccgacugcucuuccgaaggucuggaguucaaaucccagcaaccacaugguggcucacaaccauccauaaugagaucugacuccucuucuggagugucugaagauagcuacaguguacuuacauauaaauaaauaaauuuuaaaaaauaauaauaauuauaauuuacguaaguguuucugauauauuuuuguuuagacuauaaagauauuuguguuuucuuuccucaauuuaucaugaaauguagcaucaauuaagagacuaccaguggacauuauuuuuaagugugagauccuaaaagaaugucccucaaggaacauugccaccuauucuaaguuuauaauguguuuguauagaagauaguuauaucauguuaaguguaaauaugaccugguuauuguuuucauuuggaaauuaagcaugauaucaaaagauaugauugugugccagguugauaagagauggacuuaugauuauuagucuaggcugucaaguugacuacacuugaaauuaacuaaaacccaaauggcuaggccuacccaugagaaauuuuuuuucauaaguaaauuaucugaagugggagaccugcuucuaaucuggaucuuugggguagaaagauucaucuuugaucuaggccauaccgucugcuggcuuccuauacauggaagaaggaagcuuguucucugcuugauuauucuugcucucacuggcaaguccauucuuucacuggcaugagagccuacuucuuuagcacuccagcauauacuaaagaccagauaagacagccuccuggacugaacaacuacuagauucuugggccuucuguugguggauagucauugcuguacuagcuggaccauagccuguaagucauuauaaucacucuguaccuuuacauagacaaacagacugauucauucuucaaguucuguuccucuagagaacccuaaccaauauaauuaggcuccuuaacacucuucuuugcauccucuucagaagcuugacccuaaaugauggggaucauaaacaaugauccuaauccuaugauaaaacccaagacaaucugacuaggccauaaggguaaaauauacccaaaauuacaugcuauucugcuaaaaaccaguuuuguuaaaacacuggagaucacaaagccaguacuaagacauaaacuacaaaauacucaaaaagcuaggugugauggcaggugccuauaguccuaucacuugauagacaggggaauaaggacuucaaggguucaaggugagcccagacuaugaaacccuaucucaaaacauaaaucuaaaucaugggggugggagguggggaguggggggugggaguggagaguguuaaauuaaaacacucagaagagaagaaagcaggaagggggcagaggauagacaaugggacaccaaggcauauguaugugcagucuuacguaucuacaucaauaauagugucauggaaagaaaacuaaaccguuacuacaacuaaaaggaaagacuaaaugacgaacacaauauuaugugaguucacacuaucugcaaguuacggcagcaaaucuauuucaaaaacugaaugaaacagagcaacagagacuaaacacagacaaggcugucauaaccauagagugagcuacauuuagauucuggcacaggagauccuguagugucagcagcuucugcuaauuuugccaacagauaguuaagugcucuuuacuguugacugacuagucaacauaguauugaagcaacuagacagcuaaacaaaaaaaguucacccuaccuccacacaguuuaugccaugaaaauuccuauggguuaacuaguucauagacuacaaaaccaaaaacagaaaacuaaaagauguguauuuuauaauccagaagacuuucuaagcccuugaggaacauaaaaauaaaaaauuuaaaguauaaccaaauauaucagagauaacaugaaaaugugaagaauaaaaaaaacuaaaccccaaucuaacuugggccaaaugccaaaauaaguucaaaacaaaaagaagguggaaagauggcucagugguuaagagcacuggcuacucuuuaaggauuaauuccagguuuaauucccagaaccugcaugguggucuacaacuauccaaacuccagaccaggguauccaacacccucuucugaccuccauggacaccaggcacacaagugaugaacagacauauaugcaagcaaaauacccauaaacauaaaauaaaaauuuuaaaacacccaauaguaugcauacacacacacacacacacacacacacacacacacacacacacacacacacgggagggagggagggagggagggagggagggagggagggagggagggaggaaggaaggaaggaaggaaggaaggaaggaaggaaggaaggaaggaaggaaggaaggaaauuaggaaguuuauaauggagccuaaagugaucucuagaugguuaagaucacugacuguucuugcagaagaccuuguuucagcuuucaucacccacaugguaucuuacaagucucuguaacuccaauuccauccucuucuugauuucucagguacgaggcacacauaugcaaacacacaugcagacaaaacacucaagcucacugaguuaaggcaaacugcaacacaacuuguaucuaucacucuaacaauauccuguguaaaaaggcauuuccauaaagagcuagugggagggagacagaugagagggcccguuuccccugggacagucagcaguugguaagcacugauuacacauauguuuaaaaucacuauuagugggccuguaggauuguucugaggguaaaaaucaaaccugcuaccaugccuuaguaugcaugguggaaagagcuaacgcccacauacacacacaaaaauaaaugaauaaauaaauacauaaauaaaauguaaaaaaaaucuaaggugcauucuuucaaaaaaugacauuaaguuguuuauuuccuguaagaagcagacagcuagaaauaagaaaauuugacuuccuaauucucagcuguuggacaauucuuggcugccuugacuauaaugauuuaccccuuaaugcuagcaccaggugucuacgucacaccuuggacaucuuaaaaugacugcagcaugaucauagcugacagcccucgcuucugaaggcagccagggcuguuuugagauaguaucaaacuuuuugccaucacaagccuggaugaaguccagaugacacugcaaccagcuucaccuaggccagacagggaucacuuucccaagucaucuagccaaagggacuacucugacugugacuaaauacaaggcuagauacuacugguacccuauacaaaccuccauuaacaccagucauaguuaagaggcaaggcugauugguccaaaauaaaugcaugagacugauccaaacagccuuucuucagcuaugccagcaggcuauuaaagcucagugagugggcuagaagauacucuccugcgccuucuucccuguuauugcaacauuaagcccaaugaaagcuucucucaaauggucuuuccuugcccagugguucaagcuucacuggaaacauagagaaaguaugagaccagagcagugaagcagcaggggcagggacugccucagucacguggcugagcuguagggacuguugggacuaagggcauacacuaccacacuaguuuuaaaacuuugaguucucaaaaauuacaagaaaucugcuacuauauugaacuuacggauguuucagaggacugaaauguugcuaaaugacaauguuuggggaauagaguauacugacaccuuagcuacacuaggauuuuuuuucuuuacaaauuguaaccagaacuuucucuugacacucaccuaaguaaugugcauuacaaggcaauaagccaugcaaucacguacuuauuuacauguaaaauagaccuagguuuuucuuuagcaaaaaugguuauauucuauuauuuuaauagaacuuuauuuuuuuaaucacuuguaaauaucaauaagcaaauaauuuuaaucaccucaaauauuacuaggaagagcaagccuacacauauuaaaaguuuaaaaacucuucaugaauauaaaaaucauuauauacaucuaaugcuauuucuauugcaaacaacucuacacuucaauacuuaccaaaauucucuuuucauaagacacagaugcuuacaaauacaucuuauuauacaagaaguauaccuggcauguuguuaucaugucauuuaggcauuaccugagcaaggcauucacgguauuaaaaaaaaauuuuuuuuaacauaaaaauaauucagggcaagcaugguaccaugcacuuuuaauuccagcacucaaaccucagaagcagauggaucucugaagccagucuggucaacaauagugaguuccaggccagcuagagcuacauggugagauccuaucucaaaacaagcaacaacaaauuacugaaggaaagaaaaaacaccuuauaguuuuuagugugugugugugugggggggggggauugacagauguacaagaaauacacuaagaacaucaaggguaauaccaauuucuucacuaaaccuagaaaaaaacggcuaaaaaaaaaugaagguucucaaguuuuucuaguuguuaagacaaagcaagucacuuggaaacuauauucugauaaacagccacaugauagcaauacgguauguauucuuuaguguugcuuaaugacauauugauguuggguaauucuuuaaaagauuaacugaagaccaaagaaaaugaaugcauaauauaucacugucuucaagucagaaauauuuuuuuaaacagagaaaggaauuaaagagauggcucaagcauauuaaaagccuuuaugguucuuacagaagaccuaaacucagcucccaggauccaugucagguggcucauaacagccuguaacuucaacuucaagggaucuaucugaugaccucuuguugccuccccaggcacuguacuuacaugcacagucacacacacacacacacacacacacacacacacacagagaauugaaaauaaaaaccuuuuaaaaagaaggaaauauauucugaauuaaaauucuguggccaagauugcuaagauuauuucugaaccucaauaacaaggaaguaugcuuaaaaagcuccacaaggacaaaaucugaacucuuuagucuuuaucaaaauuacuaagauaaaauauucaaaacguauacaucuacaagcaacuuaaauggacucagcaggguguguguguguguggaugggggaauaauuaaagaacuccugaauuuaagagggaauggggaggaggaauggaaaccauguaaagacaguacuccugaaugaaauacucaaaauguuuaaaaagacagcagacuaaacuuuaaaaguacuugcugcucuaauagaggaccgaguucagcuccuagcaccuacaagguagcuuauaacuaugcauaacuccaguuaugggaaaucuaauaucuucuucucaucucuuuagauacaaggcaugcacauaguccauucacauacauguagacaaauacucauauacauaaaauaaggauuuuuaaaagaucggggguuucacuauuauaaccaugaauuugaaauuacaaauauuuguaaaauuauaagucagacuuuaaagacuugucaccuaaaaacuauaaagaacuaggaacuuuuccaaaucauguauucuuaccaagaccauaucaccaugaacaucaccaaagucaccauguauauaguauuaucugugaaaaugccacugaaucaucacagaagccuuugaagccugugugucacacaaccuccacaagccucaggugacagcaaauuauggcuuguuuauuauaauacuguuauauauuaaaaugcucguugaaauaauuacuuuagaauaaaaagguuaucuccauguuuaugcauucaugaauaaucuaugauaguauaaucuuaauuccaaaucacuugcuuuuccuugaauuuacacucaacacccuuuaucauaucuuucuauauaaaaaaaggcaccuaaacagaaauguucaaaccagaauccuaauaaguagcucucuucuauuuagaucucugccauucucuaccaucuugcuggcaguauguuuugaugcgauacuuaauaauaaacucuaccauaagacuuuuguuugagaugauaauuacauuucucccuucccuuacuagaggauuuuauuuuauuuuucaccuuucuuugaaaauaaauuaucugauggugacuaagaucucccucacacagaaaauguaacuguagaaaacaccaaucuuggaacacugaauuuuuuaaaauucucagucuuuaaacaaaauggauaauaaaaaacuuucuuagaucauaaauauaaaaagaaauauuucuuaaacauggcuaauuuuuauuuaggagacagggaggaaagcaacugugaauuagaaagccuggcucuaaauaauacuaaucugagcauuuuagagauuugaucucaaaguuuguuuuaagucuaguaugccuaaauagccaaaauauacccugaaacacaccaagcuguuaaaggaauuauuguagugugguaaggcugccacugauacacacugaaacaaguagcaaugaaagagagacauccugaagucugugaauucuucucaauaagcaauaaacauuacaauaaguagaaagcaaauguguugagaauuguugcaacacuguguuaaccaaccucccuagucccgcgcaaugagcucacagaagucaugaugugcacaggcuguauccuccgcugcuuccacucuugguuuaagguuucaguucuuuccaaaauuuucugacgauuggaacuaaacauagucuuuuaaaaacaaaggagaaauuguucauuguuacaauauguagcaucuuuaaagccgguuaaaaucuagugacucaccagaaguaccaugaccauguccucaaauguacacagauucacacaagauacuacaauucuccacacucuaauaauaaauacaaaaacauuacuccuacuugcuuguaaauaaagggaaacaagaaauuauuuccauccucucuuuguuuaacuuuguauuucagaaaucacaaugacuuuagaaacacaaagccauaaaacaaaugccuuuguguuucaguccugaguuuauacaagcacugcaaagguauacugaaaagacugauuucccagcaggcugaguaauccuuaauuuaaauguuaccauuaaugagcaugauuuuuuuucauuuuuugagaaagaauccauguaucccaggaugaucuugagcuuauuuuuuauuacauuguugauucaugugccugugcauuacauacuacagcgcuucuauagcuaucugucagaggacuuguggggccugguucucuccuuccaccaugaaggucccacggaucaaaaucaggucaucagauuuaacagcaagugcuuuuaccugaugagccucucaucaguccagucuugaacuucggguccuucugcuucuaccuccccaagugcuggcauuagaggcacccagcacagcaccaaacagucaugauguaauuuuaacuaagacaaaucaagaaccaucgcuuucaggucucagucgacuuuacuguaaacaugaccuugacugaaaauguaccauuucgaaguaaaucuauuuaacuuggggguagaaggaauucguuucaauuauauaugcauuuuuaugaaauuaccuuuacuucaucagcucuucugaaccucuugagcugucucagucucauguacucugauuuuacacgcuuccgccaacaaaccggucccuucucagauuucuucccagucuggcccaugauuauucuaaaagcaaugauuucauauuauaaucacuuaucuaaccagcuugaauaugaucuuuuaaucccaagcaaacugauaucaacaaaacauuuuuacuguugauauuuguagagaaaagcccauguacucuguauaguuaaauccuggaaaugugucacugagugauuuuauuuaauuuuuguuugguugguuuuuuuguuuuucaagacagaguuucucaguguagcccuggcuguccuggaacucacuccauaacaggcuggccucaaacucaaagauccaccugccucugccucccaagugccacugugcccagcuuuuaaaacauauuuuuauuuauaaacacauacuuuuaucuguaaaucuuaaauaguagaagguuuacauauaugugaucucauuaugggaauuauguauacuauaccacaagcuaguuuuuacugcaauaagggcucacauuuuuagaguaaaaacuaaguuuuugauuauuuaaaaguuauuugaaguaaaaacuuuuaaguuuuuaauuauuaaaaagcuauaauaggggcuggagagauggcucggugauuaagagcauuggcugcucuuccagaugacccagggccaacuuccagcacccacauggcaguucaaauccuccuuuaacucaaggggauuaaacucuuuuaacucuaggggauuggacaccaccaucuggccuccauaggcaucaggcgcccaaguggugcagacauaauauguaggcaaaacacccauauauacaaaaucaaauaaaauacauagaauacauuuuuuaaaacacuguuauagaagcaauguacaacugaaugauaauacaccuuauccccauguccacagacuucacauguauggguucaaaccucuuaacaaaaauauuaagugggaaaaaacuaaaacuagaaaaaaaccaacagcaaaaccugaguuuguuucaguccuaguacuaugcucacucaauacaauaaaugaaggguaagcacacacugcuguagucccagccauuccacauauccccagccaauucccaacacuuggagcacugucuaccccacaccuccuucucacaccguaacaggacuauaacaggcaccucuacggugaauauguacaaguuuauugucauuuuuccuaaacaguauuauacaacaaacagugcagcaacuauuuacauagcaucuccauuguauuaauuaaucuaaguauaauacagauaguuggagcauaaagauguucacagguuaugucaauuaccuugccauuuuauauaaggaauccauggauuuuugguauccaaggggcuacuccaaccacucccucuaaauagcaagggaccccucuaguuguaaaagguacaagugaaaagguuccguuuacacauuaagaguagaaaguguacaguaggauaguaaggauaaaucagggaccggcaguuguggaacacaccuuugauucuagcacuuggagacaggaacagacugauccaagaguuuaaggccagccuggucuacagauuaaguuccaagacagccaagacuacacagagaaacccugcuuugaaaaacaaaacaaaggauaaaccacucuauacacacacacacacacacacacacacacacacacacacaaaggcacaccuaaucacauuucucacuucaaauacugugauggggucuuuacuucuugugccacuuuuugucacaugugggguuuuguagcaagaggaaagagaaaugcagcaaauacaaagcaaaugccuucugccuuuaguugcagacuccaugagccaauuauaagcaaauaaauaugggaacuggcuaucguucaccagacauacaacacaaacuagagccugcaccuuaagucuaaaucaguguucuuuucuuauacaaguauuagggucauauugucucuucaagagauuacaaggacauuucugucuagcuauacuaaauguuaugaauuuucauuaucucaggagcaauaggaaaccagaguguugagucaaagggaaggugaggugauuuauauucugaaaagacgaagcuggcagccagauagaaacaggagaggagauaggagaauugaaagaguaacgguguguccggguuagauggcacuacagagcagucucuaaaggagaugauacuagcuuuagaccacacuggagaccagagagaaaaguggucacuuagaucccagaaacuuaggugggauaggcuggaggaagucacuagagacaugccuuucaauguaaugcuuucuuuucaggagcucaacuguucucucagcuuccugucuaccagaaggugaacaccugacuccuucacaauucccaaaucccacuacugucauaguaaaacuuaaaaaucacaauuuucacuguacuccacccccacuguaaauucuucacuaucaagaacagguuuuacauuuuuaaaaucccagagccugccucuguguaaauaauggacuuaaaagcaaugaaagcuuauuaguaauuuaaacugagagagagagggagggagagggagagagagggacagagagagagagagaacgcaaaaccuguaucucauuaacacaucauuuguaaaguuuagcucuuccuuuuaggaagguaagaaaaagaggccauccuggacuaucucuacgcagaauccagaaagaaaaggaaaagugaaaaagggaaagggggaaggaaggaggaaggaaagggggaagagaagggaaaaaccaaagaaagaaguaugcaaacuccuaagaaaccaaccgaguaugaaucucagggacuugggauccugguugagcugucuuagucagaacacuugggcccuaccaucaagcaaauaaaaucaguuucaguaacuacuccaucauaugagcaaaaaaaagacauagaaacucuggcccaccccacccccagccuccaacacacaccauacuaguuuagauuagcuuuucuaagaaucauaggugguagaaaagacaagacacuuuaaguucucugaacuuaaagguuauuguguuaccauauagaaugucucuuucuaaagcauuucauccuucaauuuguccuaauggauaaagcuggguagggcacugucuuagucaggguggaaaggguuuauucagcuuacacuuccacacugcuguucaucaccaaaggaagucaggacuggaacugaagcaggagcugaugcagaggccauggagggauguuacucacuggcuucuuuccuggcuugcucaucuugcuuucuuacuaccagcucagagaugguaccacucacuaggggcccuccccacuuaaucacuaauugagaaaaugccccacagcuggaacucauggagacacuuccccaacugaagcuccuuucucugugauaaugcuagccuaugucaaaaugacacacaaagccagccaguacaggcacccaauaaauaauuugaaauuuucuuuucuagaauaucuauaaugcaauuuuuacuucuuuagcugauaaauuacccaaguacugaauaccacuaagcucaaacuagccaauuuauucuuuuaaauuuguguacucauuuaagguuuuguuucuugagauaggaucucacuauguagcccagguaaaccucaaacuugccacagccuugccacagucuugccacagccucaaaaaugcuggauuacagguaugaaccauaagacauagcuauaucaacuauuuucuuuuuuaauggugcuaaagauuaaagcaagaggcuucauguacacuaaguacauuacuauugaacuacacuacuaauuuugaauuguuuaaaacacuaguucaaguaccagcaagauggcucaggggguaacaguguuugcuaaugaccugacaaugaaugaaccuuaauuaaacuauugccuccaucagauugcuguaggcaaaucugugaggcauuuucuugauuaaugcuuuaagugagaguucagcacacugugggaaguaggggugaagguuuugggagggugguggggggagaccauuuaagaccuauuauguacccaaacugcuuaccugccuuuaagagaacauggaggcaacagaugaaccucaaggacauuauacuaagcaaaacaagucaaucacagaacagauacagucuaucucuagucauacaaaguaucacaaguauuagguugauacaaagguaauuucaguuuuuacauuguugaaauuugucccuuauuccuggaacacauuguuaaauaaaugugguucuguuaugcaucaauuuaauguguauuucuugcuuuaagucuuuuccuaugacuuacuacuccuugcuguuuuggauuuauucuguacuacaugaaacgauguuaggcaaaaugcauauucaagagauuuucuuauucaaguucaaaaugggucauaaaguaacaaagacagcuggaaaccucaacacacauuuaaccuaguaacugcuuaagagugaaccaggaaguggagguucaacaaguuuugcaaaggagauggaaucuggaaggaaugaaauaacuggccaugggaugcugggaaagccaaaugagaacaauuaucuaagcaccucuuacaacuaccugagaagcugccauagggacucaauguagaccuggagcauccaagucauccugcaucugagacaaguuggaaacauucauuaaugugcugaugaaaaguccaaagaccauuauuuugaacuacucuccucucuuagucuauacaacacuguuccauuucuccaccugacugugaaaugcaaaugggacuauguacaacaaccaugaugaccagcuucaugguugaacaaaaaagcuccaaaguaaugcccaaagccaagagguuaugguccauuacagcuuucugaauccuggaaaaaaauccuuacaaccgagaugugggcucaacaaaucaaugauaugcaucaaaaaauacaacacuugcagccagcauggccaacagaaaggggccauuuuuuucuucgcaguagcaccugacugcacaucgcacaaccaauacuucaaaaguucaacaaauugggcuacaaaguuuuauaugauccaccauauucaccugaucuuucauucaccaacuaucacuucuucaaguaucucaacaacuucuugcagaaaacaaacuuccacagccagcaggauacagaaaauacuuuccaaauguuugucaaaucauggaguguagcaaugcaacauucugaaaauugcucuucuaucuaagaggcaaacuuuuacucacacccagaguuaauaauacaucuugaagucacucaagacuuaagacugcuaaccuacuguguacacaaauuguuuaccugccuuuaagagaacaauguaacaaccaaccuuacuugucuuggauuucccauguaaucagcuuuuacaaccuaagcuaagguacagcuggaauaguuauguacucuucuuccaugccccugacccagaguaaugcaugucuaucacuuccugagagcagcaaauaccaaaguuaaaaacagcuuccuaaaaucuacaaaaagguugcaagcaacuuggugauaaacaaugguguuuguuaucuagaugagucgggaucuguuggagucagugacuuaauccccuguaaaacucugucaaagauuucuuaaaaauuucccauuccuuccucccucaugugaugcuuccgguacauuucaauaaauacagagcagagcucuuuguuaaggacauaugcaaaugauacaacagacacacacagcucacacaaccacacagaagaagaaaaaaacacacagaggaaagaaaaccacacacagucaugcaagagacaaacacugggacagaguccacaagauagcccuucaggcagguacagauucagacucgagaaauagaggaugcccggaagacacaggaaguaugaaguagaauaacuacccucuugguuaaacaacuccaagaggaagugcuuuuauuucuuuccuuaaugagggacacugaugaauuauuggcaacucagagcuaaucgcuaaugcauuauaauccacacaauggagcacaguguuuguuuguuuuauguacaacagaaagaaugaaacuuaucuguauuccaagcaugguggugcauaccuuuaaucucagcacucaggaggcagaggcagagagaucucugaguuucaggccacccuggucuuacauagcuagaacuaucucaaaaaagaaaaagaaaaagaaagaaagagagcgagagcgggagagagagagagagagagagagagagagagaagaaaaagagaaaaaaauguaugugcuggggaaaaaguguugauuuaaugguucuuaacuuugauuaauaaauguguuugaaccuaguuauaaugauuuaaaauucagcccaaaacacaauucuuuucacaucaaaagucaaaaccaucacagaaauaaaaaguaaaaaaguacuucccagggggcuggugaaauggcucaguggguaagagcacccgacugcucuuccgaagguccgaaguuuaaaucccagcaaccacaugguggcucacaaccaucuguaacaugaucugacucccucuucuggagugucugaagacagcuacaguguacuuacauauaauaaauaaaucuuuaaaaaaaaaaaaaaguacuucccaaagcuuguggacaacagauaaaaguucuagugaucuauuauauucaucaaugagaauacacuuaacauuacugaacaauacacuuuaaaauaguaaauacauaggcuggacagauggcucaacuguuaagaguaauuacugcuccugcaaaggacccaaguucaguuaccaacauaucagguggcucauaacugccuggaauacaaacuccuggggaaugugauguuucuggucccugcagacacaaucaagcauguauauauuccccacacagacauguacauauacuuaauuaaaaccaaucuuuuuuuuuuaaaugguaaacauagcaggauguggugggacaugucuuuaaucccagcacucaggaggcagaggcagguggaucucuaugaguucuagaccagucugaucuacaaaguuaguuccagggcuguuacacagagagagaaacccuauccaaaaaacaaaaacaaaaauaacgacgacaaaaaacaugucuauuauuccagcacucugaaggcagagaggcaggaaaaucagucuguuugaguccaccuaacauauacagugaccgcugaggauaacuugauacaguuugguuucuauguauguaugaauguuugguuucuacuuggucacuagguaaauuuacagcaucaucaguuuguuuccuuacccaugcuccccauuuuuuuucaaucaguaggauuucuaaaacuuucuggcuuuaaucaacagucaaguucuucaaggaaauucuuguaauaaccaauaaaauaaguuagcacaacucacuuugugauagaaaauagcuucaggaggaagggcacuauuuacugauuugauccuuuuugcugaggcuaccuagauccucuucuucaacacacccaaaaagaugacagacuaugccaagaaguaaggcugauuccugggcccuaacaacuuugccagccagcagcaaaagccagaagacaccaccauacccuccacugagcaggccaaacugguugacaguaugccuggcagcaggcgaugauugagccucugccagggcagaugaacauggcuagcccaacaaacccaguauaggcaggcccucaauaaaggcggauuaacuucuuauugucccuagucucaccagugcaauggugggggauaguuauucuggagaauaugggaguucaggagccuuuggacauccuggauguguaucaccuagucaucauugcucugaguuuuaaacagaggccagugacccacaagaaagcacaggccuagauugagagacuucuagccagcuguggaugcaucaugggccaaggggacuagauauuuucaguaaaguaccaugugucucaauuguuuaaaacuguuggucauagauuaaauaauuuuaaaaaugaaaauaaaauaaaaugauuucaggucaauacgaaccuguccucccauauacaaagccucuuuccaagcucuagcaaaaagauaaacuuuuuugaagaggguaaagugaaggaacuggaauugagaaaaacaacugagcaaugucucuaaacugaagagccuucuaauucaauuggaauagggaaagagguuuuggaccacaggcuaaacagacucuugacauguuaaaaugguuagauauuccagaaagagagcuaucauuaucucauggcaaucuuuuuauuccuuagguaucucauagaagcuauauuuccuguaaacaaguaauaagacagacugggugacugcgugacugacugacugauggagauaaacaaugguuauuuuguacauuacaccaaaucgagcuuuacaaauuucguaaauuguagucauggcaaaauuaagcucaacaauaguauaaccaccuacugauguaguagcuccauuacacaagagggaaaggcaauacaucuuaaaaaaaaaaaaaaaacuaaaaagucuuguggaacaaaauuagguguugcaaaagaacagacugguauuuuauagagugaaaauaguauaccaaaaucaaauacuuaaaaaggaugaaauuuaaggucaccugggcuacauaguauuucuaggccagacaauacuuuagaguaagacguuaccuuagaaaaacugcauguauuuauaugugcuaugugugugaaaugccugcagagacgaacgagggcguuggcucugcugggacuggacuuacagcuuaguucuuagcuggauauaggugcugggaauugaacacagguccucuagaagagcagcgaguguucuuaacugcugaggcaucucucuaacucagcccuaagauaaagacuaccaauaccaacgucaguguagauugggaagacuauagcuccugugcagcuuccacuggaacugaaacugucaacauaaauggcacaaccacucuugagaaagcuugacaaucucuuauaaagugaaaugaauauuuaucacaugacagagcaauucaacuuggaggcagcuauucaagaaaaacuaaaauguagguauaaaagaucuacguagacaaacaguaacugcuuuaauaaccaaaaacuaaaaacaguuccauuuauccauugacacaaauaaaggggaaaaaaaccauagaauauucauauaacagaaugcuacuuugaaauaacuaguguaaguuacaacauagauauacaucaaaaacauguuggaugaaagaagccagucacaaaagaacacuucuuuucucuucuguccauguaaauuccugagcaggagaaaucugaucaguaguugagggaugaugaugagauagaugauggcaguauuacauugugaaugaggugguuacugcagguguauacauuugccaaacuucucaagcuguaccuuucaaacccgcacauuguacauaaaccacagaucgguaaaguggaacuguuuuuuuuuuuuuuuuuuuuuuuuuuuuuuaaagauuuauuuauuuauuauauguaaguacacuguagcugucuucagacacuccagaagagggagucagaucuugauaaagaugguugugagccaccaugugguugcugggauuugaacucuggaccuucggaagagcagucgggugcucuuacccacugagccaucucaccagcccccaaaguggaacuguuaacugaaaacugaaugcuuuucuaggaagcaauguaucaauacuaaaggcuugggaauaugcaucacuuugaaaaggaaacucuccuuauagaaagcuauccugcaaaugaucaaaauacaccugggaagcagggugccaagauggcucagccagcaaggcuccugcugcacaugccuggcagccugaguccaaucaccaaaacccacagaaagguggauggaaaguacugacucuauauguuguucuuugaccuccacauacacaccaugaaacacacacacagggagagagggagagaggcagaaagggggagaagggaagagggaagagggagagaggguuuuuuuaaaaaauuaaaaacaaaggagauacaaggaugaucacuucaucuggagaccaucagagaaacagagggcaagauuaaugagccacauuuauaagcuggaauacuguccauuccucuuuacaaaggcagcaagugcuggcaagagcaacaaguuuuccugaaaaaagcuacaugguaagucuuuuauggcuggcagaggauacauaauuuuuuuucuugaagaaguagcagucuuuuacuacucucuuaaaaaauauauuaauauucuuaauuuguagacccuaaauaaaacaaccuguaggcuggggguguagcacugugggcacugugguagcaaaccgaaaguaucagauuggauucccuauguuacccuaaacaaacaagaagugggaagaaaucagaacuuuaaaaccaaaacccaacauccaaaugcccaaauucuccuuucucuaccagcuccucucuccagcccuugucauuuuuuuuuccacauuaaaaaauaaaaaaaaguagcugggcauguugggauauaacucuaauaaucucagcacuugggagaagaggcaaaagaaccaggaguucaaggcuagcuagcuagccugagcuacaugaggcccuguuucaaaaaaaugaaaacaggccagacaugguaguacaugucucuaaccccagcacucugaaagcagaagcagaaacaggcagauagaacucuguguucaaggucagccuggucaaagaguuagcuauaggauagccagggccauacaaagauacccuguuucaaaaaaagaaagaaaaagaaagaaagaaagaaagaaagaaagaaagaaagaaagaaagaaagaaagaaagaaagaaagaaagaaagaaagaaaagagaaaagaaaaacacagaagucaugagauuccaucacuagcugaggagcaauuggcaacuaaugguugcuagagaaagaagucaguuuucuucaguugcguagauacugguuaaguuuuccaugcucaguaaaucccacauccaugcccaugugaucaacucuaaucaagcucaauaagcaauaaaaggaggcagaaacauuaugagaccagccugcuugauauagcaaauuuugagccggcaagguuuauaguaugaaaucuaucucaaaaaaauaaauaaaaugcauccagacaugcauucaaccuugcagcccaccuagguccuauaacauauugcaacagggccaagcgggauaaguguagcuuucacagucauuaaggaaauuauucuuuguaacagauggagaacauuuuagaaggccacaccaggucaaaaugcagagaacaaguaagagaucauguggugcucagccccaaucgauacaucuacaauacaacuucugugccuaagguucagggaauauaucagaagagggggcagaaaaaaaauuuaagagccagaaaaugaagaaaucugcuaugaaauucugucuccuagaagugacaaggaagcuucuucacccaugaugaacucaacaauacagcugccuaaacaagacccaaagaagugcaauaccaauaaacauacuaacauugaagaagaaaaccuuauggggcccaccccuaaacaaagaacuacaggcaauuauagauugcugagagugggagaaaaagucuucccaagggacgaguacccuaacuggguauccacuaacaagugaucagcccugaaaucauguacauacaaguaacacuaaauggaccgaaugggcuguauuuauauauuucgguaaauacauacacaacaauaacaaaggaagugaccggaaacauggaggaguaaaugggagaaacuagggagagggaaggaaaaaugugauuauauuucuaugcuuaaaaauuaagaaaaaaaaauaauaaaagauaugagcuggaaauauggcuuagcaauuaagagagcuugcugcucuuccagaggaucugagcugcauucucaguaccuucauggcagcucacaaaaacagcacagcuguaaacuccaguuccaagggaucugaggaaggucuucuggcuuccaccaguuccagacagaaacauuguacauagacauacauacaagcaaagacccaaacauauaaaauaaaaauaaaugcaucuuaaaaauaaauacaaaguuguuucuggcuuaugucacuuagcacaagguccuccaaguccaugcaaguuguauagcauguaucagaauuucacuccuuuuauaucacaauaucuuacuauacauaugcuuucacugcauuuuguuuucaucugcugauaaaugaaguaaaaagugaaguaauauaucacauuuuuaaaaaauauaugucaaacaguagaugcuuuaauaucacagucagaaacugcuuaaugacaggauuacauuacaccuggaguguacuuauacaaacugagauagcaacaaugucauuuaagcaauaaucuuauaguacuucauuauacagugccugaguucacugugcagaaauuccuuaucucacuucauuucugcuauacuuuugugucacagagguauauucacaagguauauaacuaugugaccauuuuagaacucuaucagcuucaugggcugaagagauggcucaucaguuaugagugcuugguauucaaucaugagaaccuguauucugaucaaugcccagauagcagccagguaucuuggaaaucacaguaauuccagcucaaagggauuggaaacccaauucuggcuuccuguacacacgcaugcacauguacucacacaugcaagcaaauaaauauuuuuuuaaguuuuuacuauguggggguggggugaaggaguaggugggggaguagcugggggagguggucuagaaaucaaaggacaacuuacuagagucaaacaguucucucuaccuugaagguucagggugaaucaaacuuaggucaucagacuugguggcaaguacuuuuuuuugcccacugagcuaucuugacagccuaauuuuaaaaaaaaaaaaaaauuguaauagaaaaaaauguaucaggucuaacuucuauaacuuuugagauacuauuagauuugucucuacuuuugacauuaagaaagaaugaagagcccugcaugguggcgcacgccuuuaaucccaaacaggcagauuucugaguuuaagaccagccuagucuacaaagugaguuccaggacagccagggcuauacagagaaacccugucucagaaaaaaacaacaacaacaacaacaaaaaaaaaacaaaaaaaagaaugaagaucagguuacagaacugcacagcaguguacaggaccauagaagaaugaugaagaacaacccaauaagugacuuauaauuagucauugcuuccuucaauuuuagcuucaaaaccuaccugaaauuacaacaagguauccuucaguuaaaagucuugccaccuucaagccaaauauaguggcacaugccuaucaucuuagcuacucaggaggcuaagauaggaauaucaugaaaaacuaauaguuugagacaguuaugaacaacacagcaagaucuacuucaaaaaagaaaaaaagaaaagcagaaccuggugguacacauuuauaaaacuagcacucaaaagacuaaacaggaggaccucaaauccaggucagccacagcuacaaauaaagaccuagucucaaaaaaagaaaguaaguuugggcuagcauuugaaauguaaaugaagaaaauaucuaauaaaaaauugaaaagaaagaaagaaagaaagaaagaaagaaagaaagaaagaaaggaaggaaggaaggaaggaaggaaggaaggaaggaaggaaggaaggaaggaaagaaggcaggcagguauaguggccuauccuagcacucaaaagccaagugagguaggauaggacugccucaaauuuaaggccugucugggcuacauaguaaauucaagacuaaucugaguuacauagcaagugagggaggaagaccuagccugucugcuuugccaauuuucuuuauuauugaggaagaauaugugaacccaugcaugaacacauaagauagcuuuuuuggggagucgguucucucuuccccuguaccagguuccaggaaucaaacuuggguuucauaguaagcaguuuuauuuauaucucacuguuuuccaaauuucucugucaauuuauuucacuguaucuuuccaauuuccuuaaaucacuugguuauuaacuauucucuggaaacuaccaaccuaaguguuaggcaaccaaucaaaaauaggacagaaacuuugucccacaacacuuagacagugugaagcauaaacaagugaacaauuugauacaugcaauaauauaaguaugaacaaaacucugugagugucugagacuucugggacaacaucucuaaaauaaagcacauacucugauggaccuuucucugaauuuaaugaauuguuccuuucuacccauguuccaccguaaagauucuaccaaccuauaacuacuauggaauguacugaaaaauucaccaucuacacugacauaaagacuucaaagcuaaucuauaaaccauuucuauagcccauaaaucauuuuaucagcagagaaauuuuccuuuguucguuuuuuuaaggcaaaucaacuuucuucauuauuauuuaaaggcuaguaauaaaauaaaucuaaacuucuugagcauaugacuucaaaggauaaaggacaaccuaaagcaaaugaauuuuggugugauuuggaaaaucugacuaaaaccuuuacauagccaacacaaaaauaaucacauguauccaugcaaaagaauaucaguaccaaaaagaacacuucuagcuacacaugucaacaaguggcuuuuucuaucccuauuuagacuucuuaaacauuucucauuucuaccgaaacauaaggcaauauuuucaaccaauucuucagagaguuaaggaaauauauguggcaaguacaaaacagcaaaugucaacuacaggaaaaaaucacauauucaggcaaaacugaauuguuaaauucuaaacuaauuuucuaccaaaauucuauacaacuagcucaccucauaaugaaugagauuaucaauaggauuuuaauguaaacauaaaccuuaugcuacaaucucaacauuuagagcugcaccuggaaugucuauucuacgaugcuccugcaaaucagaaacaacagaaauuugacacugcauuucuuugucuccauucauaugaaaccguaaauuagcagauguacuuuaggucuucauuagaugaaacagugcaacaagagucuguucuuuugguuuuuuuuuguuuuuuuuuuuaagaaauauauucaaaacccaucaaaauuagaauauaggaugcaauuuuccuaaguuuuccuaaugcaauuuucauucucuaguacaccucuccaaagagaaaaggcaggauucuuuucguuuaagaccagaauccaauccguuuccaacuugagaauacaagaacaggaaauuaaauauaaccuaaauauuuccacauucuucuaaguaaaauugacuuuuauuccugaauaugaauucacugcuaauauucauuaauaaaaaguaauugaaaauacauuuuuaaaucgccaaaaauauaaacuacauucaacugugacagcauuaguauuuuucaaauguuuuaugugccauuaaaaacccauagaauuaaacugauaacgacuuuccugaaacugaaaaggcguuguagcguuguuguacgguauuuuaaauaucaaagacaaauuuuuacuucagaugaauuuagauucuacagauccuguuaauaagcaaaguaaguuucuuugaauugugacaagaauacacucgaauuucuuaggcaacaaaugccuuuucugacucaccaaagcuauuguucacgggaaacgugacccacuaaaaagaaacugucaauucuacagcguaaacccacauuucucguggguauuuuauuucgaucaucuagucuuuaacaaccuaccccuggagauuuggggaauaaucacugaguaaaugacaguugauuucguuagcaccugucaccauucucaaaagcacacaaguuggccaaaacagauuuuguuuuucuuucagguuuugguccuuuagaaaguagaacucacaagacauucaccaaguuuuccgaaagcccgugcuuucucaauuucucccauuuucaaaaaguagcccugaagcauacgaucuggugcgugcaaggggggcuguauaaugaagugagagaaggaaacacagcuggacucuuccaucgaacuuagcacaaagccagucgaggacacuagcagcccgaggcagugggagacucccggcucucggggaaaugucagccgcagggcuaagggaguucccacauugugcacgcagucccgccuuagcaaggcccggcguuagccggucgcccccagcagggccaggcaaggacgagcccugcccacucgcgcucgcgucgcgccuccccacgcccccacccgcgcggcgggagccccgagugucgcguccuccccuccccuuccgagacacagucuguccuuugucugagugcagacucucgacucggucccaccaacuuguguguaagucccguccuacccgggcgcucccgccucccagccacacaaagaagacuugaggcucagcgcugccggccccgaucggccacaggaacgcccccagccccggccaggcgggaccaggcuccgggacagaagcccccacucccggcccccgcccgcccgcgucugccggaauccacaguucacucgugggaccgcggggaccgccacacaccucacgaccgcucagaaagcuguccccuagcccucccuccgcgccuacaaaagcggcgcucgagugagacccgcuugggcgaugccgaagacuggccaggcacccgcgcggaggucccgcgaucgccgccgccgccgccgccgccccggggcgcguuccagaucccugacugccgaccaccggcggccgacggcgcggacuaccuucgucccgcgcgccagcccgcgccucucccgcgcgucgcccccaacccgccgccaccgccaccgccgccgccgggacuccacugccuucgaugucccacugggugucggacgcgaccggaccgagcgccaaacgcagcaacccaaucgccaucgcuuuuauuuggcccccccagcacuaucaagcgccucuccgauuggaggaugcgagagggcgcccguccaaucagagggccgaacgggcugggagccuucggagcgagcuccagcccugggagcgcgaggcucaccagcgcgugcgcgagugacagggcucgcucugaggaacgcggcuugcuggguggaagcaccacagucgcugucuuuguucuuuugccaacgugcgguaccucucaggaaagccauggacaggcaggcggaggccgggcacuuggcgggacccgaagcccgcua

SEQ ID NO: 2960 - RNA, 65209 nt, Mus musculus
uagcgggcuucgggucccgccaagugcccggccuccgccugccuguccauggcuuuccugagagguaccgcacguuggcaaaagaacaaagacagcgacuguggugcuuccacccagcaagccgcguuccucagagcgagcccugucacucgcgcacgcgcuggugagccucgcgcucccagggcuggagcucgcuccgaaggcucccagcccguucggcccucugauuggacgggcgcccucucgcauccuccaaucggagaggcgcuugauagugcugggggggccaaauaaaagcgauggcgauuggguugcugcguuuggcgcucgguccggucgcguccgacacccagugggacaucgaaggcaguggagucccggcggcggcgguggcgguggcggcggguugggggcgacgcgcgggagaggcgcgggcuggcgcgcgggacgaagguaguccgcgccgucggccgccgguggucggcagucagggaucuggaacgcgccccggggcggcggcggcggcggcggcgaucgcgggaccuccgcgcgggugccuggccagucuucggcaucgcccaagcgggucucacucgagcgccgcuuuuguaggcgcggagggagggcuaggggacagcuuucugagcggucgugagguguguggcgguccccgcggucccacgagugaacuguggauuccggcagacgcgggcgggcgggggccgggagugggggcuucugucccggagccuggucccgccuggccggggcugggggcguuccuguggccgaucggggccggcagcgcugagccucaagucuucuuuguguggcugggaggcgggagcgcccggguaggacgggacuuacacacaaguuggugggaccgagucgagagucugcacucagacaaaggacagacugugucucggaaggggaggggaggacgcgacacucggggcucccgccgcgcgggugggggcguggggaggcgcgacgcgagcgcgagugggcagggcucguccuugccuggcccugcugggggcgaccggcuaacgccgggccuugcuaaggcgggacugcgugcacaaugugggaacucccuuagcccugcggcugacauuuccccgagagccgggagucucccacugccucgggcugcuaguguccucgacuggcuuugugcuaaguucgauggaagaguccagcuguguuuccuucucucacuucauuauacagccccccuugcacgcaccagaucguaugcuucagggcuacuuuuugaaaaugggagaaauugagaaagcacgggcuuucggaaaacuuggugaaugucuugugaguucuacuuucuaaaggaccaaaaccugaaagaaaaacaaaaucuguuuuggccaacuugugugcuuuugagaauggugacaggugcuaacgaaaucaacugucauuuacucagugauuauuccccaaaucuccagggguagguuguuaaagacuagaugaucgaaauaaaauacccacgagaaauguggguuuacgcuguagaauugacaguuucuuuuuagugggucacguuucccgugaacaauagcuuuggugagucagaaaaggcauuuguugccuaagaaauucgaguguauucuugucacaauucaaagaaacuuacuuugcuuauuaacaggaucuguagaaucuaaauucaucugaaguaaaaauuugucuuugauauuuaaaauaccguacaacaacgcuacaacgccuuuucaguuucaggaaagucguuaucaguuuaauucuauggguuuuuaauggcacauaaaacauuugaaaaauacuaaugcugucacaguugaauguaguuuauauuuuuggcgauuuaaaaauguauuuucaauuacuuuuuauuaaugaauauuagcagugaauucauauucaggaauaaaagucaauuuuacuuagaagaauguggaaauauuuagguuauauuuaauuuccuguucuuguauucucaaguuggaaacggauuggauucuggucuuaaacgaaaagaauccugccuuuucucuuuggagagguguacuagagaaugaaaauugcauuaggaaaacuuaggaaaauugcauccuauauucuaauuuugauggguuuugaauauauuucuuaaaaaaaaaaacaaaaaaaaaccaaaagaacagacucuuguugcacuguuucaucuaaugaagaccuaaaguacaucugcuaauuuacgguuucauaugaauggagacaaagaaaugcagugucaaauuucuguuguuucugauuugcaggagcaucguagaauagacauuccaggugcagcucuaaauguugagauuguagcauaagguuuauguuuacauuaaaauccuauugauaaucucauucauuaugaggugagcuaguuguauagaauuuugguagaaaauuaguuuagaauuuaacaauucaguuuugccugaauaugugauuuuuuccuguaguugacauuugcuguuuuguacuugccacauauauuuccuuaacucucugaagaauugguugaaaauauugccuuauguuucgguagaaaugagaaauguuuaagaagucuaaauagggauagaaaaagccacuuguugacauguguagcuagaaguguucuuuuugguacugauauucuuuugcauggauacaugugauuauuuuuguguuggcuauguaaagguuuuagucagauuuuccaaaucacaccaaaauucauuugcuuuagguuguccuuuauccuuugaagucauaugcucaagaaguuuagauuuauuuuauuacuagccuuuaaauaauaaugaagaaaguugauuugccuuaaaaaaacgaacaaaggaaaauuucucugcugauaaaaugauuuaugggcuauagaaaugguuuauagauuagcuuugaagucuuuaugucaguguagauggugaauuuuucaguacauuccauaguaguuauagguugguagaaucuuuacgguggaacauggguagaaaggaacaauucauuaaauucagagaaagguccaucagaguaugugcuuuauuuuagagauguugucccagaagucucagacacucacagaguuuuguucauacuuauauuauugcauguaucaaauuguucacuuguuuaugcuucacacugucuaaguguugugggacaaaguuucuguccuauuuuugauugguugccuaacacuuagguugguaguuuccagagaauaguuaauaaccaagugauuuaaggaaauuggaaagauacagugaaauaaauugacagagaaauuuggaaaacagugagauauaaauaaaacugcuuacuaugaaacccaaguuugauuccuggaaccugguacaggggaagagagaaccgacuccccaaaaaagcuaucuuauguguucaugcauggguucacauauucuuccucaauaauaaagaaaauuggcaaagcagacaggcuaggucuuccucccucacuugcuauguaacucagauuagucuugaauuuacuauguagcccagacaggccuuaaauuugaggcaguccuauccuaccucacuuggcuuuugagugcuaggauaggccacuauaccugccugccuucuuuccuuccuuccuuccuuccuuccuuccuuccuuccuuccuuccuuccuuccuuucuuucuuucuuucuuucuuucuuucuuucuuucuuucuuuucaauuuuuuauuagauauuuucuucauuuacauuucaaaugcuagcccaaacuuacuuucuuuuuuugagacuaggucuuuauuuguagcuguggcugaccuggauuugagguccuccuguuuagucuuuugagugcuaguuuuauaaauguguaccaccagguucugcuuuucuuuuuuucuuuuuugaaguagaucuugcuguguuguucauaacugucucaaacuauuaguuuuucaugauauuccuaucuuagccuccugaguagcuaagaugauaggcaugugccacuauauuuggcuugaagguggcaagacuuuuaacugaaggauaccuuguuguaauuucagguagguuuugaagcuaaaauugaaggaagcaaugacuaauuauaagucacuuauuggguuguucuucaucauucuucuaugguccuguacacugcugugcaguucuguaaccugaucuucauucuuuuuuuuguuuuuuuuuuguuguuguuguuguuguuuuuuucugagacaggguuucucuguauagcccuggcuguccuggaacucacuuuguagacuaggcuggucuuaaacucagaaaucugccuguuugggauuaaaggcgugcgccaccaugcagggcucuucauucuuucuuaaugucaaaaguagagacaaaucuaauaguaucucaaaaguuauagaaguuagaccugauacauuuuuuucuauuacaauuuuuuuuuuuuuuuaaaauuaggcugucaagauagcucagugggcaaaaaaaaguacuugccaccaagucugaugaccuaaguuugauucacccugaaccuucaagguagagagaacuguuugacucuaguaaguuguccuuugauuucuagaccaccucccccagcuacucccccaccuacuccuucaccccacccccacauaguaaaaacuuaaaaaaauauuuauuugcuugcaugugugaguacaugugcaugcguguguacaggaagccagaauuggguuuccaaucccuuugagcuggaauuacugugauuuccaagauaccuggcugcuaucugggcauugaucagaauacagguucucaugauugaauaccaagcacucauaacugaugagccaucucuucagcccaugaagcugauagaguucuaaaauggucacauaguuauauaccuugugaauauaccucugugacacaaaaguauagcagaaaugaagugagauaaggaauuucugcacagugaacucaggcacuguauaaugaaguacuauaagauuauugcuuaaaugacauuguugcuaucucaguuuguauaaguacacuccagguguaauguaauccugucauuaagcaguuucugacugugauauuaaagcaucuacuguuugacauauauuuuuuaaaaaugugauauauuacuucacuuuuuacuucauuuaucagcagaugaaaacaaaaugcagugaaagcauauguauaguaagauauugugauauaaaaggagugaaauucugauacaugcuauacaacuugcauggacuuggaggaccuugugcuaagugacauaagccagaaacaacuuuguauuuauuuuuaagaugcauuuauuuuuauuuuauauguuugggucuuugcuuguauguaugucuauguacaauguuucugucuggaacugguggaagccagaagaccuuccucagaucccuuggaacuggaguuuacagcugugcuguuuuugugagcugccaugaagguacugagaaugcagcucagauccucuggaagagcagcaagcucucuuaauugcuaagccauauuuccagcucauaucuuuuauuauuuuuuuuucuuaauuuuuaagcauagaaauauaaucacauuuuuccuucccucucccuaguuucucccauuuacuccuccauguuuccggucacuuccuuuguuauuguuguguauguauuuaccgaaauauauaaauacagcccauucgguccauuuaguguuacuuguauguacaugauuucagggcugaucacuuguuaguggauacccaguuaggguacucgucccuugggaagacuuuuucucccacucucagcaaucuauaauugccuguaguucuuuguuuaggggugggccccauaagguuuucuucuucaauguuaguauguuuauugguauugcacuucuuugggucuuguuuaggcagcuguauuguugaguucaucaugggugaagaagcuuccuugucacuucuaggagacagaauuucauagcagauuucuucauuuucuggcucuuaaauuuuuuuucugcccccucuucugauauauucccugaaccuuaggcacagaaguuguauuguagauguaucgauuggggcugagcaccacaugaucucuuacuuguucucugcauuuugaccugguguggccuucuaaaauguucuccaucuguuacaaagaauaauuuccuuaaugacugugaaagcuacacuuaucccgcuuggcccuguugcaauauguuauaggaccuaggugggcugcaagguugaaugcaugucuggaugcauuuuauuuauuuuuuugagauagauuucauacuauaaaccuugccggcucaaaauuugcuauaucaagcaggcuggucucauaauguuucugccuccuuuuauugcuuauugagcuugauuagaguugaucacaugggcauggaugugggauuuacugagcauggaaaacuuaaccaguaucuacgcaacugaagaaaacugacuucuuucucuagcaaccauuaguugccaauugcuccucagcuagugauggaaucucaugacuucuguguuuuucuuuucucuuuucuuucuuucuuucuuucuuucuuucuuucuuucuuucuuucuuucuuucuuucuuucuuucuuucuuucuuucuuuuucuuucuuuuuuugaaacaggguaucuuuguauggcccuggcuauccuauagcuaacucuuugaccaggcugaccuugaacacagaguucuaucugccuguuucugcuucugcuuucagagugcugggguuagagacauguacuaccaugucuggccuguuuucauuuuuuugaaacagggccucauguagcucaggcuagcuagcuagccuugaacuccugguucuuuugccucuucucccaagugcugagauuauuagaguuauaucccaacaugcccagcuacuuuuuuuuauuuuuuaauguggaaaaaaaaaugacaagggcuggagagaggagcugguagagaaaggagaauuugggcauuuggauguuggguuuugguuuuaaaguucugauuucuucccacuucuuguuuguuuaggguaacauagggaauccaaucugauacuuucgguuugcuaccacagugcccacagugcuacacccccagccuacagguuguuuuauuuagggucuacaaauuaagaauauuaauauauuuuuuaagagaguaguaaaagacugcuacuucuucaagaaaaaaaauuauguauccucugccagccauaaaagacuuaccauguagcuuuuuucaggaaaacuuguugcucuugccagcacuugcugccuuuguaaagaggaauggacaguauuccagcuuauaaauguggcucauuaaucuugcccucuguuucucugauggucuccagaugaagugaucauccuuguaucuccuuuguuuuuaauuuuuuaaaaaaacccucucucccucuucccucuucccuucucccccuuucugccucucucccucucucccuguguguguguuucaugguguguauguggaggucaaagaacaacauauagagucaguacuuuccauccaccuuucuguggguuuuggugauuggacucaggcugccaggcaugugcagcaggagccuugcuggcugagccaucuuggcacccugcuucccagguguauuuugaucauuugcaggauagcuuucuauaaggagaguuuccuuuucaaagugaugcauauucccaagccuuuaguauugauacauugcuuccuagaaaagcauucaguuuucaguuaacaguuccacuuugggggcuggugagauggcucaguggguaagagcacccgacugcucuuccgaagguccagaguucaaaucccagcaaccacaugguggcucacaaccaucuuuaucaagaucugacucccucuucuggagugucugaagacagcuacaguguacuuacauauaauaaauaaauaaaucuuuaaaaaaaaaaaaaaaaaaaaaaaaaaaaaacaguuccacuuuaccgaucugugguuuauguacaaugugcggguuugaaagguacagcuugagaaguuuggcaaauguauacaccugcaguaaccaccucauucacaauguaauacugccaucaucuaucucaucaucaucccucaacuacugaucagauuucuccugcucaggaauuuacauggacagaagagaaaagaaguguucuuuugugacuggcuucuuucauccaacauguuuuugauguauaucuauguuguaacuuacacuaguuauuucaaaguagcauucuguuauaugaauauucuaugguuuuuuuccccuuuauuugugucaauggauaaauggaacuguuuuuaguuuuugguuauuaaagcaguuacuguuugucuacguagaucuuuuauaccuacauuuuaguuuuucuugaauagcugccuccaaguugaauugcucugucaugugauaaauauucauuucacuuuauaagagauugucaagcuuucucaagagugguugugccauuuauguugacaguuucaguuccaguggaagcugcacaggagcuauagucuucccaaucuacacugacguugguauugguagucuuuaucuuagggcugaguuagagagaugccucagcaguuaagaacacucgcugcucuucuagaggaccuguguucaauucccagcaccuauauccagcuaagaacuaagcuguaaguccagucccagcagagccaacgcccucguucgucucugcaggcauuucacacacauagcacauauaaauacaugcaguuuuucuaagguaacgucuuacucuaaaguauugucuggccuagaaauacuauguagcccaggugaccuuaaauuucauccuuuuuaaguauuugauuuugguauacuauuuucacucuauaaaauaccagucuguucuuuugcaacaccuaauuuuguuccacaagacuuuuuaguuuuuuuuuuuuuuuuaagauguauugccuuucccucuuguguaauggagcuacuacaucaguaggugguuauacuauuguugagcuuaauuuugccaugacuacaauuuacgaaauuuguaaagcucgauuugguguaauguacaaaauaaccauuguuuaucuccaucagucagucagucacgcagucacccagucugucuuauuacuuguuuacaggaaauauagcuucuaugagauaccuaaggaauaaaaagauugccaugagauaaugauagcucucuuucuggaauaucuaaccauuuuaacaugucaagagucuguuuagccugugguccaaaaccucuuucccuauuccaauugaauuagaaggcucuucaguuuagagacauugcucaguuguuuuucucaauuccaguuccuucacuuuacccucuucaaaaaaguuuaucuuuuugcuagagcuuggaaagaggcuuuguauaugggaggacagguucguauugaccugaaaucauuuuauuuuauuuucauuuuuaaaauuauuuaaucuaugaccaacaguuuuaaacaauugagacacaugguacuuuacugaaaauaucuaguccccuuggcccaugaugcauccacagcuggcuagaagucucucaaucuaggccugugcuuucuugugggucacuggccucuguuuaaaacucagagcaaugaugacuaggugauacacauccaggauguccaaaggcuccugaacucccauauucuccagaauaacuaucccccaccauugcacuggugagacuagggacaauaagaaguuaauccgccuuuauugagggccugccuauacuggguuuguugggcuagccauguucaucugcccuggcagaggcucaaucaucgccugcugccaggcauacugucaaccaguuuggccugcucaguggaggguaugguggugucuucuggcuuuugcugcuggcuggcaaaguuguuagggcccaggaaucagccuuacuucuuggcauagucugucaucuuuuuggguguguugaagaagaggaucuagguagccucagcaaaaaggaucaaaucaguaaauagugcccuuccuccugaagcuauuuucuaucacaaagugaguugugcuaacuuauuuuauugguuauuacaagaauuuccuugaagaacuugacuguugauuaaagccagaaaguuuuagaaauccuacugauugaaaaaaaauggggagcauggguaaggaaacaaacugaugaugcuguaaauuuaccuagugaccaaguagaaaccaaacauucauacauacauagaaaccaaacuguaucaaguuauccucagcggucacuguauauguuagguggacucaaacagacugauuuuccugccucucugccuucagagugcuggaauaauagacauguuuuuugucgucguuauuuuuguuuuuguuuuuuggauaggguuucucucucuguguaacagcccuggaacuaacuuuguagaucagacuggucuagaacucauagagauccaccugccucugccuccugagugcugggauuaaagacaugucccaccacauccugcuauguuuaccauuuaaaaaaaaaagauugguuuuaauuaaguauauguacaugucuguguggggaauauauacaugcuugauugugucugcagggaccagaaacaucacauuccccaggaguuuguauuccaggcaguuaugagccaccugauauguugguaacugaacuuggguccuuugcaggagcaguaauuacucuuaacaguugagccaucuguccagccuauguauuuacuauuuuaaaguguauuguucaguaauguuaaguguauucucauugaugaauauaauagaucacuagaacuuuuaucuguuguccacaagcuuugggaaguacuuuuuuuuuuuuuuaaagauuuauuuauuauauguaaguacacuguagcugucuucagacacuccagaagagggagucagaucauguuacagaugguugugagccaccaugugguugcugggauuuaaacuucggaccuucggaagagcagucgggugcucuuacccacugagccauuucaccagcccccugggaaguacuuuuuuacuuuuuauuucugugaugguuuugacuuuugaugugaaaagaauuguguuuugggcugaauuuuaaaucauuauaacuagguucaaacacauuuauuaaucaaaguuaagaaccauuaaaucaacacuuuuuccccagcacauacauuuuuuucucuuuuucuucucucucucucucucucucucucucucucucccgcucucgcucucuuucuuucuuuuucuuuuucuuuuuugagauaguucuagcuauguaagaccaggguggccugaaacucagagaucucucugccucugccuccugagugcugagauuaaagguaugcaccaccaugcuuggaauacagauaaguuucauucuuucuguuguacauaaaacaaacaaacacugugcuccauuguguggauuauaaugcauuagcgauuagcucugaguugccaauaauucaucagugucccucauuaaggaaagaaauaaaagcacuuccucuuggaguuguuuaaccaagaggguaguuauucuacuucauacuuccugugucuuccgggcauccucuauuucucgagucugaaucuguaccugccugaagggcuaucuuguggacucugucccaguguuugucucuugcaugacugugugugguuuucuuuccucuguguguuuuuuucuucuucugugugguugugugagcugugugugucuguuguaucauuugcauauguccuuaacaaagagcucugcucuguauuuauugaaauguaccggaagcaucacaugagggaggaaggaaugggaaauuuuuaagaaaucuuugacagaguuuuacaggggauuaagucacugacuccaacagaucccgacucaucuagauaacaaacaccauuguuuaucaccaaguugcuugcaaccuuuuuguagauuuuaggaagcuguuuuuaacuuugguauuugcugcucucaggaagugauagacaugcauuacucugggucaggggcauggaagaagaguacauaacuauuccagcuguaccuuagcuuagguuguaaaagcugauuacaugggaaauccaagacaaguaagguugguuguuacauuguucucuuaaaggcagguaaacaauuuguguacacaguagguuagcagucuuaagucuugagugacuucaagauguauuauuaacucugggugugaguaaaaguuugccucuuagauagaagagcaauuuucagaauguugcauugcuacacuccaugauuugacaaacauuuggaaaguauuuucuguauccugcuggcuguggaaguuuguuuucugcaagaaguuguugagauacuugaagaagugauaguuggugaaugaaagaucaggugaauaugguggaucauauaaaacuuuguagcccaauuuguugaacuuuugaaguauugguugugcgaugugcagucaggugcuacugcgaagaaaaaaauggccccuuucuguuggccaugcuggcugcaaguguuguauuuuuugaugcauaucauugauuuguugagcccacaucucgguuguaaggauuuuuuuccaggauucagaaagcuguaauggaccauaaccucuuggcuuugggcauuacuuuggagcuuuuuuguucaaccaugaagcuggucaucaugguuguuguacauagucccauuugcauuucacagucagguggagaaauggaacaguguuguauagacuaagagaggagaguaguucaaaauaauggucuuuggacuuuucaucagcacauuaaugaauguuuccaacuugucucagaugcaggaugacuuggaugcuccaggucuacauugagucccuauggcagcuucucagguaguuguaagaggugcuuagauaauuguucucauuuggcuuucccagcaucccauggccaguuauuucauuccuuccagauuccaucuccuuugcaaaacuuguugaaccuccacuuccugguucacucuuaagcaguuacuagguuaaauguguguugagguuuccagcugucuuuguuacuuuaugacccauuuugaacuugaauaagaaaaucucuugaauaugcauuuugccuaacaucguuucauguaguacagaauaaauccaaaacagcaaggaguaguaagucauaggaaaagacuuaaagcaagaaauacacauuaaauugaugcauaacagaaccacauuuauuuaacaauguguuccaggaauaagggacaaauuucaacaauguaaaaacugaaauuaccuuuguaucaaccuaauacuugugauacuuuguaugacuagagauagacuguaucuguucugugauugacuuguuuugcuuaguauaauguccuugagguucaucuguugccuccauguucucuuaaaggcagguaagcaguuuggguacauaauaggucuuaaauggucuccccccaccacccucccaaaaccuucaccccuacuucccacagugugcugaacucucacuuaaagcauuaaucaagaaaaugccucacagauuugccuacagcaaucugauggaggcaauaguuuaauuaagguucauucauugucaggucauuagcaaacacuguuacccccugagccaucuugcugguacuugaacuaguguuuuaaacaauucaaaauuaguaguguaguucaauaguaauguacuuaguguacaugaagccucuugcuuuaaucuuuagcaccauuaaaaaagaaaauaguugauauagcuaugucuuaugguucauaccuguaauccagcauuuuugaggcuguggcaagacuguggcaaggcuguggcaaguuugagguuuaccugggcuacauagugagauccuaucucaagaaacaaaaccuuaaaugaguacacaaauuuaaaagaauaaauuggcuaguuugagcuuagugguauucaguacuuggguaauuuaucagcuaaagaaguaaaaauugcauuauagauauucuagaaaagaaaauuucaaauuauuuauugggugccuguacuggcuggcuuugugugucauuuugacauaggcuagcauuaucacagagaaaggagcuucaguuggggaagugucuccaugaguuccagcuguggggcauuuucucaauuagugauuaaguggggagggccccuagugagugguaccaucucugagcugguaguaagaaagcaagaugagcaagccaggaaagaagccagugaguaacaucccuccauggccucugcaucagcuccugcuucaguuccaguccugacuuccuuuggugaugaacagcaguguggaaguguaagcugaauaaacccuuuccacccugacuaagacagugcccuacccagcuuuauccauuaggacaaauugaaggaugaaaugcuuuagaaagagacauucuauaugguaacacaauaaccuuuaaguucagagaacuuaaagugucuugucuuuucuaccaccuaugauucuuagaaaagcuaaucuaaacuaguaugguguguguuggaggcuggggguggggugggccagaguuucuaugucuuuuuuuugcucauaugauggaguaguuacugaaacugauuuuauuugcuugaugguagggcccaaguguucugacuaagacagcucaaccaggaucccaagucccugagauucauacucgguugguuucuuaggaguuugcauacuucuuucuuugguuuuucccuucucuucccccuuuccuuccuccuuccuucccccuuucccuuuuucacuuuuccuuuucuuucuggauucugcguagagauaguccaggauggccucuuuuucuuaccuuccuaaaaggaagagcuaaacuuuacaaaugauguguuaaugagauacagguuuugcguucucucucucucucugucccucucucucccucucccucccucucucucucaguuuaaauuacuaauaagcuuucauugcuuuuaaguccauuauuuacacagaggcaggcucugggauuuuaaaaauguaaaaccuguucuugauagugaagaauuuacaguggggguggaguacagugaaaauugugauuuuuaaguuuuacuaugacaguagugggauuugggaauugugaaggagucagguguucaccuucugguagacaggaagcugagagaacaguugagcuccugaaaagaaagcauuacauugaaaggcaugucucuagugacuuccuccagccuaucccaccuaaguuucugggaucuaagugaccacuuuucucucuggucuccaguguggucuaaagcuaguaucaucuccuuuagagacugcucuguagugccaucuaacccggacacaccguuacucuuucaauucuccuaucuccucuccuguuucuaucuggcugccagcuucgucuuuucagaauauaaaucaccucaccuucccuuugacucaacacucugguuuccuauugcuccugagauaaugaaaauucauaacauuuaguauagcuagacagaaauguccuuguaaucucuugaagagacaauaugacccuaauacuuguauaagaaaagaacacugauuuagacuuaaggugcaggcucuaguuuguguuguaugucuggugaacgauagccaguucccauauuuauuugcuuauaauuggcucauggagucugcaacuaaaggcagaaggcauuugcuuuguauuugcugcauuucucuuuccucuugcuacaaaaccccacaugugacaaaaaguggcacaagaaguaaagaccccaucacaguauuugaagugagaaaugugauuaggugugccuuuguguguguguguguguguguguguguguguguguguguauagagugguuuauccuuuguuuuguuuuucaaagcaggguuucucuguguagucuuggcugucuuggaacuuaaucuguagaccaggcuggccuuaaacucuuggaucagucuguuccugucuccaagugcuagaaucaaagguguguuccacaacugccggucccugauuuauccuuacuauccuacuguacacuuucuacucuuaauguguaaacggaaccuuuucacuuguaccuuuuacaacuagaggggucccuugcuauuuagagggagugguuggaguagccccuuggauaccaaaaauccauggauuccuuauauaaaauggcaagguaauugacauaaccugugaacaucuuuaugcuccaacuaucuguauuauacuuagauuaauuaauacaauggagaugcuauguaaauaguugcugcacuguuuguuguauaauacuguuuaggaaaaaugacaauaaacuuguacauauucaccguagaggugccuguuauaguccuguuacggugugagaaggaggugugggguagacagugcuccaaguguugggaauuggcuggggauauguggaauggcugggacuacagcagugugugcuuacccuucauuuauuguauugagugagcauaguacuaggacugaaacaaacucagguuuugcuguugguuuuuuucuaguuuuaguuuuuucccacuuaauauuuuuguuaagagguuugaacccauacaugugaagucuguggacauggggauaagguguauuaucauucaguuguacauugcuucuauaacaguguuuuaaaaaauguauucuauguauuuuauuugauuuuguauauauggguguuuugccuacauauuaugucugcaccacuugggcgccugaugccuauggaggccagauggugguguccaauccccuagaguuaaaagaguuuaauccccuugaguuaaaggaggauuugaacugccaugugggugcuggaaguuggcccugggucaucuggaagagcagccaaugcucuuaaucaccgagccaucucuccagccccuauuauagcuuuuuaauaauuaaaaacuuaaaaguuuuuacuucaaauaacuuuuaaauaaucaaaaacuuaguuuuuacucuaaaaaugugagcccuuauugcaguaaaaacuagcuugugguauaguauacauaauucccauaaugagaucacauauauguaaaccuucuacuauuuaagauuuacagauaaaaguauguguuuauaaauaaaaauauguuuuaaaagcugggcacaguggcacuugggaggcagaggcagguggaucuuugaguuugaggccagccuguuauggagugaguuccaggacagccagggcuacacugagaaacucugucuugaaaaacaaaaaaaccaaccaaacaaaaauuaaauaaaaucacucagugacacauuuccaggauuuaacuauacagaguacaugggcuuuucucuacaaauaucaacaguaaaaauguuuuguugauaucaguuugcuugggauuaaaagaucauauucaagcugguuagauaagugauuauaauaugaaaucauugcuuuuagaauaaucaugggccagacugggaagaaaucugagaagggaccgguuuguuggcggaagcguguaaaaucagaguacaugagacugagacagcucaagagguucagaagagcugaugaaguaaagguaauuucauaaaaaugcauauauaauugaaacgaauuccuucuacccccaaguuaaauagauuuacuucgaaaugguacauuuucagucaaggucauguuuacaguaaagucgacugagaccugaaagcgaugguucuugauuugucuuaguuaaaauuacaucaugacuguuuggugcugugcugggugccucuaaugccagcacuuggggagguagaagcagaaggacccgaaguucaagacuggacugaugagaggcucaucagguaaaagcacuugcuguuaaaucugaugaccugauuuugauccgugggaccuucaugguggaaggagagaaccaggccccacaaguccucugacagauagcuauagaagcgcuguaguauguaaugcacaggcacaugaaucaacaauguaauaaaaaauaagcucaagaucauccugggauacauggauucuuucucaaaaaaugaaaaaaaaucaugcucauuaaugguaacauuuaaauuaaggauuacucagccugcugggaaaucagucuuuucaguauaccuuugcagugcuuguauaaacucaggacugaaacacaaaggcauuuguuuuauggcuuuguguuucuaaagucauugugauuucugaaauacaaaguuaaacaaagagaggauggaaauaauuucuuguuucccuuuauuuacaagcaaguaggaguaauguuuuuguauuuauuauuagaguguggagaauuguaguaucuugugugaaucuguguacauuugaggacauggucaugguacuucuggugagucacuagauuuuaaccggcuuuaaagaugcuacauauuguaacaaugaacaauuucuccuuuguuuuuaaaagacuauguuuaguuccaaucgucagaaaauuuuggaaagaacugaaaccuuaaaccaagaguggaagcagcggaggauacagccugugcacaucaugacuucugugagcucauugcgcgggacuagggagguugguuaacacaguguugcaacaauucucaacacauuugcuuucuacuuauuguaauguuuauugcuuauugagaagaauucacagacuucaggaugucucucuuucauugcuacuuguuucaguguguaucaguggcagccuuaccacacuacaauaauuccuuuaacagcuugguguguuucaggguauauuuuggcuauuuaggcauacuagacuuaaaacaaacuuugagaucaaaucucuaaaaugcucagauuaguauuauuuagagccaggcuuucuaauucacaguugcuuuccucccugucuccuaaauaaaaauuagccauguuuaagaaauauuucuuuuuauauuuaugaucuaagaaaguuuuuuauuauccauuuuguuuaaagacugagaauuuuaaaaaauucaguguuccaagauugguguuuucuacaguuacauuuucugugugagggagaucuuagucaccaucagauaauuuauuuucaaagaaaggugaaaaauaaaauaaaauccucuaguaagggaagggagaaauguaauuaucaucucaaacaaaagucuuaugguagaguuuauuauuaaguaucgcaucaaaacauacugccagcaagaugguagagaauggcagagaucuaaauagaagagagcuacuuauuaggauucugguuugaacauuucuguuuaggugccuuuuuuuauauagaaagauaugauaaaggguguugaguguaaauucaaggaaaagcaagugauuuggaauuaagauuauacuaucauagauuauucaugaaugcauaaacauggagauaaccuuuuuauucuaaaguaauuauuucaacgagcauuuuaauauauaacaguauuauaauaaacaagccauaauuugcugucaccugaggcuuguggagguugugugacacacaggcuucaaaggcuucugugaugauucaguggcauuuucacagauaauacuauauacauggugacuuuggugauguucauggugauauggucuugguaagaauacaugauuuggaaaaguuccuaguucuuuauaguuuuuaggugacaagucuuuaaagucugacuuauaauuuuacaaauauuuguaauuucaaauucaugguuauaauagugaaacccccgaucuuuuaaaaauccuuauuuuauguauaugaguauuugucuacauguaugugaauggacuaugugcaugccuuguaucuaaagagaugagaagaagauauuagauuucccauaacuggaguuaugcauaguuauaagcuaccuuguaggugcuaggagcugaacucgguccucuauuagagcagcaaguacuuuuaaaguuuagucugcugucuuuuuaaacauuuugaguauuucauucaggaguacugucuuuacaugguuuccauuccuccuccccauucccucuuaaauucaggaguucuuuaauuauucccccauccacacacacacacacccugcugaguccauuuaaguugcuuguagauguauacguuuugaauauuuuaucuuaguaauuuugauaaagacuaaagaguucagauuuuguccuuguggagcuuuuuaagcauacuuccuuguuauugagguucagaaauaaucuuagcaaucuuggccacagaauuuuaauucagaauauauuuccuucuuuuuaaaagguuuuuauuuucaauucucugugugugugugugugugugugugugugugugugugacugugcauguaaguacagugccuggggaggcaacaagaggucaucagauagaucccuugaaguugaaguuacaggcuguuaugagccaccugacauggauccugggagcugaguuuaggucuucuguaagaaccauaaaggcuuuuaauaugcuugagccaucucuuuaauuccuuucucuguuuaaaaaaauauuucugacuugaagacagugauauauuaugcauucauuuucuuuggucuucaguuaaucuuuuaaagaauuacccaacaucaauaugucauuaagcaacacuaaagaauacauaccguauugcuaucauguggcuguuuaucagaauauaguuuccaagugacuugcuuugucuuaacaacuagaaaaacuugagaaccuucauuuuuuuuuagccguuuuuuucuagguuuagugaagaaauugguauuacccuugauguucuuaguguauuucuuguacaucugucaaucccccccccccacacacacacacacuaaaaacuauaagguguuuuuucuuuccuucaguaauuuguuguugcuuguuuugagauaggaucucaccauguagcucuagcuggccuggaacucacuauuguugaccagacuggcuucagagauccaucugcuucugagguuugagugcuggaauuaaaagugcaugguaccaugcuugcccugaauuauuuuuauguuaaaaaaaauuuuuuuuuaauaccgugaaugccuugcucagguaaugccuaaaugacaugauaacaacaugccagguauacuucuuguauaauaagauguauuuguaagcaucugugucuuaugaaaagagaauuuugguaaguauugaaguguagaguuguuugcaauagaaauagcauuagauguauauaaugauuuuuauauucaugaagaguuuuuaaacuuuuaauauguguaggcuugcucuuccuaguaauauuugaggugauuaaaauuauuugcuuauugauauuuacaagugauuaaaaaaauaaaguucuauuaaaauaauagaauauaaccauuuuugcuaaagaaaaaccuaggucuauuuuacauguaaauaaguacgugauugcauggcuuauugccuuguaaugcacauuacuuaggugagugucaagagaaaguucugguuacaauuuguaaagaaaaaaaauccuaguguagcuaaggugucaguauacucuauuccccaaacauugucauuuagcaacauuucaguccucugaaacauccguaaguucaauauaguagcagauuucuuguaauuuuugagaacucaaaguuuuaaaacuagugugguaguguaugcccuuagucccaacagucccuacagcucagccacgugacugaggcagucccugccccugcugcuucacugcucuggucucauacuuucucuauguuuccagugaagcuugaaccacugggcaaggaaagaccauuugagagaagcuuucauugggcuuaauguugcaauaacagggaagaaggcgcaggagaguaucuucuagcccacucacugagcuuuaauagccugcuggcauagcugaagaaaggcuguuuggaucagucucaugcauuuauuuuggaccaaucagccuugccucuuaacuaugacugguguuaauggagguuuguauaggguaccaguaguaucuagccuuguauuuagucacagucagaguagucccuuuggcuagaugacuugggaaagugaucccugucuggccuaggugaagcugguugcagugucaucuggacuucauccaggcuugugauggcaaaaaguuugauacuaucucaaaacagcccuggcugccuucagaagcgagggcugucagcuaugaucaugcugcagucauuuuaagauguccaaggugugacguagacaccuggugcuagcauuaagggguaaaucauuauagucaaggcagccaagaauuguccaacagcugagaauuaggaagucaaauuuucuuauuucuagcugucugcuucuuacaggaaauaaacaacuuaaugucauuuuuugaaagaaugcaccuuagauuuuuuuuacauuuuauuuauguauuuauuuauucauuuauuuuuguguguguaugugggcguuagcucuuuccaccaugcauacuaaggcaugguagcagguuugauuuuuacccucagaacaauccuacaggcccacuaauagugauuuuaaacauauguguaaucagugcuuaccaacugcugacugucccaggggaaacgggcccucucaucugucucccucccacuagcucuuuauggaaaugccuuuuuacacaggauauuguuagagugauagauacaaguuguguugcaguuugccuuaacucagugagcuugaguguuuugucugcauguguguuugcauaugugugccucguaccugagaaaucaagaagaggauggaauuggaguuacagagacuuguaagauaccaugugggugaugaaagcugaaacaaggucuucugcaagaacagucagugaucuuaaccaucuagagaucacuuuaggcuccauuauaaacuuccuaauuuccuuccuuccuuccuuccuuccuuccuuccuuccuuccuuccuuccuuccuuccuuccucccucccucccucccucccucccucccucccucccucccucccucccguguguguguguguguguguguguguguguguguguguguguguguguguaugcauacuauuggguguuuuaaaauuuuuauuuuauguuuauggguauuuugcuugcauauaugucuguucaucacuugugugccugguguccauggaggucagaagaggguguuggauacccuggucuggaguuuggauaguuguagaccaccaugcagguucugggaauuaaaccuggaauuaauccuuaaagaguagccagugcucuuaaccacugagccaucuuuccaccuucuuuuuguuuugaacuuauuuuggcauuuggcccaaguuagauugggguuuaguuuuuuuuauucuucacauuuucauguuaucucugauauauuugguuauacuuuaaauuuuuuauuuuuauguuccucaagggcuuagaaagucuucuggauuauaaaauacacaucuuuuaguuuucuguuuuugguuuuguagucuaugaacuaguuaacccauaggaauuuucauggcauaaacuguguggagguagggugaacuuuuuuuguuuagcugucuaguugcuucaauacuauguugacuagucagucaacaguaaagagcacuuaacuaucuguuggcaaaauuagcagaagcugcugacacuacaggaucuccugugccagaaucuaaauguagcucacucuaugguuaugacagccuugucuguguuuagucucuguugcucuguuucauucaguuuuugaaauagauuugcugccguaacuugcagauagugugaacucacauaauauuguguucgucauuuagucuuuccuuuuaguuguaguaacgguuuaguuuucuuuccaugacacuauuauugauguagauacguaagacugcacauacauaugccuuggugucccauugucuauccucugcccccuuccugcuuucuucucuucugaguguuuuaauuuaacacucuccacucccaccccccacuccccaccucccacccccaugauuuagauuuauguuuugagauaggguuucauagucugggcucaccuugaacccuugaaguccuuauuccccugucuaucaagugauaggacuauaggcaccugccaucacaccuagcuuuuugaguauuuuguaguuuaugucuuaguacuggcuuugugaucuccaguguuuuaacaaaacugguuuuuagcagaauagcauguaauuuuggguauauuuuacccuuauggccuagucagauugucuuggguuuuaucauaggauuaggaucauuguuuaugauccccaucauuuagggucaagcuucugaagaggaugcaaagaagaguguuaaggagccuaauuauauugguuaggguucucuagaggaacagaacuugaagaaugaaucagucuguuugucuauguaaagguacagagugauuauaaugacuuacaggcuaugguccagcuaguacagcaaugacuauccaccaacagaaggcccaagaaucuaguaguuguucaguccaggaggcugucuuaucuggucuuuaguauaugcuggagugcuaaagaaguaggcucucaugccagugaaagaauggacuugccagugagagcaagaauaaucaagcagagaacaagcuuccuucuuccauguauaggaagccagcagacgguauggccuagaucaaagaugaaucuuucuaccccaaagauccagauuagaagcaggucucccacuucagauaauuuacuuaugaaaaaaaauuucucauggguaggccuagccauuuggguuuuaguuaauuucaaguguagucaacuugacagccuagacuaauaaucauaaguccaucucuuaucaaccuggcacacaaucauaucuuuugauaucaugcuuaauuuccaaaugaaaacaauaaccaggucauauuuacacuuaacaugauauaacuaucuucuauacaaacacauuauaaacuuagaauagguggcaauguuccuugagggacauucuuuuaggaucucacacuuaaaaauaauguccacugguagucucuuaauugaugcuacauuucaugauaaauugaggaaagaaaacacaaauaucuuuauagucuaaacaaaaauauaucagaaacacuuacguaaauuauaauuauuauuauuuuuuaaaauuuauuuauuuauauguaaguacacuguagcuaucuucagacacuccagaagaggagucagaucucauuauggaugguugugagccaccaugugguugcugggauuugaacuccagaccuucggaagagcagucgggugcucuuacccacugagccaucucaccagcccguaaauuauaauucuuaucucuguaacugguuauguggccuuagcugacauuuauuuauucauuuguuuauauuuuuaauugauccuuuguaaauuucaagucauguaccccaaccccacccaucuuccuaucccuuuauaccuguccuccaucuuuguaacguccucaccaaaaggaaaaaaauagggaaacuguaguguaucaaagugugucccacaguacacccuuuugccuacccaucuuuacuugcaaauguucauugcaaugagucauuggucugguucaaggugucuggcuucugcuauauugugaauacuggauucuuacuaggaccucucucagauauccugguuuuguccugugucauggagauccuggagcuuuggaucuauaggaucaggcuuuuauuuuuuaaauauaaaaauuuauagcccaacugaccaaagguagaggaggaaaauggcuaauaggacaagggggacauggaccuguuuggaacaguuucuugggacuauuccaaucuucguugucuacagacaaguucacuagagaaacaucaaaugcacaucaaccaguggcucaguccagaagaaaccaccaggcucugccaauuggcaugagucugccgaagcuacaagaagcagccagaacaccaccagaaguucuuuggugcacuugucucuaugaagcacaacaagcgaagaucauggaagaaagcaaggcgcaccaaggcaauagcaucaucagcaaagaccagugucugggaagcccagugaagaccagcaaggagaaccaaugccagagugucguccacugucuguuggguuauauuuauacucuuucuaaaacauguguccucucaagugcccacuccagcaaaacaucacaugcccuuuuaccagauagcuuccagaaaaauaccacgugucugcuucagcaaaacauccucucacaugucugcuucagcaaaacauccucauaagacagcuuuuagaaaaacaucacuggacacacuugagucuccaacaaaggcagaaauuaccacuucaccagucccuucauucucucuggcaguucagagauggcguagauguugggcuugguuaacacaaagcccuggaucugggcauauaguugguggcugaacuggucaggcugccacuuagcugguauuuauaauuaccuuucucuguuacccauucuguguuuccuccauauucagcaagcaccuuaguggguuuuuccauggaccuuaaccacagucaguguuaacaccaagagaguguaguagcuccaagagaugcccugaaggaucucuccugcucuccagacauacucuuccuuaccucugucauggagaagcaauccaauuucuuuuuuuuagucugaaucagugaccccuccugacacuguuacuccuuucuuaaccuguugguuuaagggcaucagaagcucaaagaggccuaggggacgucugagcuuccagaucaaugggauguuuguuguggcucuuggcaagaauguuccccucucugaaaccagaauuccuagaccagcagaauuuaaggucaugggaacaagaagcaaacauuuuccuagugggucacuaggcaugauagugaguggaacuauucccuuuuccacuccuugguuucuagacacagggauccuugcucugggagaagauguaccauauguuggaugcugauucaaagcauauagcaucuucuagagaacaccugccccagccuuccaagggugcugacaacuaauuaguguuguaacuguguuuucauaagaccauuccaucuuucuuuugagccaacugcuucaggauaguagggaacaugguaagacuaguggauucuaugaucuuaggcucacuguuauacuucgcagguaugacaugagucccuuggccagauucaauacuguaugaaauaccaagaugguggcuauggcauucuguaaguccacagaugauaguuuuggaagaagcauuacacacaggaaagccaaauucacaaccaguauaaguaucuauuccacuagggacaaaguguuauuauuucuauggaagaugugguucaauguagucagucugcuaccagguuguuaacugguaucucagggaacagugccauaucugggccucaguauugguugcagaucuggcacuuagcagcagcuauagccaguucacgauuggugaauggcagucuguguuuucaagcucacguaucauccccaucucugccaccauggccucuuuguuuaugugcccauuggguagugacagagauggcuaggaaaagaggcuuuauccacuugauuauugagcuccuccagcugaagucaacuuuugaugaguauuuacaugggacaccaaguaucuucacauucuucacccauuuggagaaaucucucuacauacuuaguccccagauguuuuucuuaaaaucuuuuaaucaugguuuuuccaagucccugacuguucaaucaauucaaugucuacaaacaugaaucagugaauaaucacacauucuccuauucaaaacgccauguguacugccugaaguucugcccuuagugaagauuuccuuucacuggugacuuucaggguuguuccagaaagaaguugucaugcugcaacuguccacuucugguuggugcuugcauaauaugcagaacaucaguaaagcaggcccuagucuuuucuucucuuaguuagucauaugagguuauauauacacauguauguuugggagcagguagcauuguaacaggaauagaaaccuuaggcauuugaacaacuucuuggguaacuuguuugugcuuucaggaccugcucaggccugaucauauguauacuguuucuauuggauaauggauugcuacugugcauguucuauuucaugguauggucaguaagauaauaccuagcucgugaugggcagcuuggguugucuuguaacuuggugucacauugucaaauguucgguuuccaccaaaguccaagcaguccgagagcugucucucaaagggaggauacuugucucucagaugaugguagacccuugcuccaaagugucuucugugauucaccuauagaggccccaauuuuccaaacagcaucccuauuugccacugacaccucaaaguaucaucagcucugcuacaucauaugguccaaaugguaguguagucugcacacaacagccuggaccuguuaaagagccuuuuccuguuccaggccccacucaaagcuagcaguuuucugagucacuugguauauaggcuggacuaacacacccaagugucuccagaauccauauaggcucacuaaacauugugcuucuuucuuggugguggaaggggccagauacaauaacuuauucuuuaucuuagaaagaauaucucuuuaugucccauaagagugggcgucuaaguauuuuacugagguagaaggccuuugaauuuuggcugaauuuauuucccauucuuugauucacauguguuaccaacaaguugaaagugguugcuacuuccugcucauuugguccagucagcauaauguugccaauuuagugaaccauaugauacucugcaaaagagacagaugaucaagaucccuuagaaguaaguuaugacucaggguuggagaggugauagauucccucaaggaaaacuguaaagguauacugcuggucuugccaacugaaagccuauugcuucugcuggggcuuaggaacagacagguacugaaaaaguuaauuguuggaucaauagcuguaugccguauaccaggaaauguguuaaucugcucagauaaggacauugguacagcagcacaaucagaguuacuaccaguguaguuuuagauagucaacugucauucuucaugucugucugucuucugcacuggccagauaggggaguuggagggaauuguggugggaaccacuacuucuguuucuuuucaaguccuugauggugguacuaauuucugcagucuuccagggauacuguuuuugauuagcuguucucucuggcagaggcaacucuaauaaaagacuuccauuuacccuuucuaaccacaauagcccucacuacauaggucagggaaccagugggcauccugccagcuucuaagaauaucuauuucaauuauauaucugggacuggggaaauaaccaaaggaugaguucaggggauguacuguaccuacugugaguuggacuucagccaaaacuccauuaaccaccugaccuucauagggcccuacuuaauuggaaggcuacaaugcuucuuggggucucuuggaaccagugacaauucauaaccaguauccaguagauccugggaagucugauuguuuccuuuccuccaguguacaguuaacccugucaaaggcuguagggcccucugggaaaggacuugagaacgguuaacagugaaacuuuuggguauuuuaucaaggucuuucuucaggggaaccuggcaguccccucauucaaggcguuuugguuuggcaaacuggcucaagucuagaaauuggcuuaugggcugauuucuuuucccaugauccaauuauaggcuuucuuaguuugagaauuuuucugcuuauauggaucaaacaaaaaugcaauagguuuccuagaauguuucaugccuggaauaauaugauuagacaguaccaaagguccauaugagucauaccaccguaaaaaucagauuuucuguguuaccuauuaaagguuaggucauuauggacauaguuuuaucugugcugcccaaaccauaacuacagucacauugucuuuguugauucagugcugcuacuuagccccaugcgaccucaggguccaauuagacccacugaauuaaguucauucaacugaacagcagugcuucagacccuaggucugacacaaggaaaagggcuacaacaacaaagcucuucaaaugggcugguaccccucaccauuuuuggucuuacaggacuggugaaggucaugucuucugggacuucccaggaggauuaggucuuacacagcauacucuugagaaucugaggguucaauguucucagcuucaauaggguccuccuacauaucugcauaucaaguauaggauccuauucuuuaccaguaaugcccuuaauuuuaacacccucugaggcugggaccugaauuuuauuuguaauuuauucagucuuauuuauaaugggggcuuugguuugauuuucuguaacuugagcucuauggcugcuagagagaagaucucuuccagggcauacuuagaaaccuuuguugucagugguucucaaucuucuuaaaacugcggcucuuaauauacuuccucauguugugcuaaaccauaacuauaaaauuauugcauugcuacuucauaaguguaauugugcugcuguuaugaauuguaauguaaauaucugauauguaucugauaugugauuccccaaaggaguuacgacccacagguugaaagccacugcuuuagacuaaaccuacaguuggucaguuuuauuuuuauugcugaguucauuggugaguucacuaaauucugagaugauagaaguugauuaauuuuaucgugaagcucauucuuucccauugucaguuuaucuagugaugcuaaggucaacugaccagugucauccuuuuccuuauuuuuccacaaauuguccaaaguuuuauauacagagucaccaaauccauugccucucacauuuggugaaucaggauaaucaaauguauuugucuccuuaauuuguaaaauaguacacauaaugggcuuucaucauucaggacucucugagcuuacaugaaaggcuucaguaacuaguauugacaaagugagaugccuauuuuagaaagauacuuaguuucauccuuauauuuuuguugcucuagaaccacuucuaguaccaaaaucugucagaguucucuagaacucgauggauggauggauggauggauggauggauggauggauggaugguuccauccauccaggagauuuauuagaauguuuuacaggcugugguccagcuauuccaacaauggcuauuuacaaauggaagguacaagaaucuagaaguuguuaagucauugaagccugauguuuuagcuggucauuaguguaugccugaaucccgaagaaguaugcucuaaugccagugaaggacucaagauccagggcaagcaggcagagaacaaguucccuucuuccauguccuuuauauaggcuuccagcagaagauguuuauuuagauuaaagguagaucuuccuucucaaaagauuuggguaaagauguaucugucuucacacccugaaggucagggugagaagugggucuucucacuugaaaugauuuaauaaagaaaaaaaucucucacaggcauaccuagcccuuuggguuuuaguuaauucuacauguagugaaguuuacaacuaagauuagauuaggcaucacacuaguccuccugaaaagcuacauauaaucucauuacucaggaagccaaggcaguaggauuguuguaagauugaagccagucuggucucaauagaaaauucccugccagccagggcuacacagagagacucuaccucaaagcaaaauaacaacaaaaauacuccccucccucagcaugcauacacagacacagacacagacacagacacagacacagacacacacacacacacacacacacacacacacacacacacacacacacagaaaugcuuguacauuucugcuaggaagaagugugaaagugauauuagaugaaagugaaauccaagauaauagccuuuuguuacaagggagacuccaguauguaaugguuuuuugacauaaauguguaauaucaaaaauggaagcaguuuacaaucuggaauagauuuauuccuaguuuauucccuagguuucauuaaauacuugcgugaagauguuaggcccauucuuguuuuuauuucugacccucuugugagagacacuuuuucucaagaguguccccuucagucuucuuccucugcccuucaaacugguuaugaaaccauguuugcuguugagcuuccucaauacaugcugcuuaacucauuccuuuuuuuuuccuucuugcuucaccaaaaagcggucuugaauuuaaguauguauauugcccuuaccauaaggccuagcuaauuaaaaacuuggauuuuguucccuuucuuuccuuaaguccugaggaaaaaguaagguagucucggaaguagucuucagcuucccuuugagguugaugacagcugaugucuccuccucacucuccccugggcugaugcuucccugaguugacaguagcugaugccuuucacucacagucucuucccgggcuauggcuuucuguuucuucuuuguucucauauggagaaauaggaaauaggaguauguuugaaaauaaugacaguucauggugucucagugugaacuaacugaaugagccagugaguauucaagaauguaugaucacaccacccaggagcuggugugauauaacucccguggacuuuuuugaagcuggguuuaacugccuucaugcuaaggaucauucagaggugggguggcuguuacuauuguccuuugggauguccugccuaaaauggggaauauuuaccucauaagguaguagagaauuuuaaagucaacuuugguaaagucucuaacauggugcuuggcacauaguaggguguguuaauuuuucucccuucccugcaggccacucaccugcucucccuguacgauuuuccauagcacaguuuuuacuuggaaccagucuucugccaagagucucaguuugguuguguacuccuacaacuacuacuuuugacuuggcuuccucuccagccacacagucgccuguuguaccagcuggguggugugaguccccagccucagaggaagcuuguuacuuuccagucagcuguguuucucugacagugugccguccuugguaacuugguuuucuuuaccacuguuaaauuaucugugauccugaaauuggaauuagaauuagaaauuuaaguugcuaaaguaggccaccuagagguauaacugagcgggcaaaaaugcucuggugaggucaacaacagcuuuugcacuguuuugagcaauaugaguauuuaaagaguugagagcgaaacacguucaaaggaaguaaaguugcuaaguaacugggaguuuuguauaauuuucuguaagucaacacauagcauucccaacuuguuuuaccugcauuggcuguggcauuucaguaucauuucacaagugaggacgguaugguuguagcauggcuagagacugugugggguaggauccagaggugcugcagagagcucagcuucauucuccacauagguguccucagcucggaaggaacugaacuuucugccacaaacauagucuguugacaccauaaacauauguuuuaagacacugcugaauauuguuuugagguagaaagguaaaaauccuaccuuucaccucagaugcucuuccccuuacagagcuugcguuucaucccuuguugacuuguggaugacucagaacuuugaagugguggauaucagaaaugggguggagauauuagacugggggugucauuugugcuauagcccgugacuuccuguuuucugugcuucugugaguuuccagcuuucauuuaguauauauugauucugcaaaucagucauccccuuagcuagugguugaaaagaauauuuucugucugacuuacacaugaccuuggauucauauacuaacacagguaagucagggcuggagaaccagucugucccucuaagcuauaaagacagcuucuauguagaauuaauuuauucccaccaaauauaaaacaaaaguuaauaacuuuuuuaagaaaugaaaauuguuuuauauuuaagauuauuggauaauaugugaugcuuuauugaguaauuaaaaucauuucauacuuaaauuuaccuagucagguugaaggaaaggaaaaugugcuagggauagaguaagaggagaguuguuggugauaacccugugaccuuacuggguguggucacauuccacauagcagauacuauaaggcucuauagugacucuucccugugagcuucugagagcaagaacuaaagcacaguaaacugaggaaguucuuggauguuacaauuagacuuaguuuuuaguccugccuucuaaguuaacuaucuuccuaggaagauuuaauuucuggccuccagucccauuuguggauugugauguuaaaguuaugucauaaggugauaacaagaacuacuuaugauuaugaauauaagcaguuacuuagcauggugauugaaacacagcauguaaucaauaaauguugguuccuguaguuauuggacuagcaaauggagggaugaggaucugugagugaagccaguuaguaggaaagagaacauuaauaagccauucacaccuuauuuacuugacuuugagcuuuugguauuguuauuuuuccuuugccuuguuggaaaacaccuaaguagacaucacuaucuuuguucuuuggaacaacuuugucugucacuuucacuucuguuaggaaggagucaucuuugugugcagugugcacugugauggucagaguacccgagcagcuauguagaacugaaggcuuauaguaucugcuauguggaaugugaccacacaugagggacacaugaguacacauguaggcuuauguggccugugugcgaguaaucucaccucauccagucccagucuugcugacuuggaaacacccuacauaaaucucagacacugacucuguauaucguguguacauaugugacugccaugaguucaauuuauuuuguucuauuuuuauuaaagaucaucaguacauaucugagguauuuuugagacagccauggaggcuugacauuugagaauagaacucuuaagaaaagcuggauuccucaucaggauagaaagcaaugugguuaucagggcacgaauuuuuaccacauuagaaucaaaguugcaaaaauguuaacaauuuuuaaccaacauuuuuuuguuuaagucacugugguaagaaggcauuaugucacaguguaauuagcaguuuuuuccucugugauacaggaagaauagugugcccugaagucugauagagugccucaguugugagacagaauuccugugagauuacaguuggguagucugucuugccuugggcuaacaguuucaggaaggagagauuacaggagugaccaaggcuacagcaauuuccucacucaagccucauagcccacagcuaccuuugcccccuggcagagccugcaguuucuuccucuagagagaagcuguuccucgauauaugcauuaauuaacacaguucugucuguugguggaggucaaauucugucucuuuuugaggccccagaaauuuagcauuaaaucauuauuaugauaaauaauacaaaaugaauuuuaagggaaagaagguguguuauagagaugaaguaucauggcacugggucagagcagugagcagaaucaggcuugcuguguauauuccauguaugaucuugagcaaacuccuuguccuuucuuuacuguaguuuuuucauugcaaagugggguaagugccuucaacuagagucauaauaacuaugauaaaacauuuacugugcuuaauauagugccuuacaugugaacaguuagaugcuauaaagcugauuaaaauguuuuugcaauugaaacucaucuguuacucuuaauccauuauuugauaauauauaaaauaugacauuuuuaaaaagcaagagaaaagauaagguuuagauauaccauagugauaucugccuguaaucuuagcauucacagcaucuuuuaggcugaggcaggagaauugugaauuugaggacauccuggucuacagauuaaauucaauaacaggaccccaucucaacaaacaaagaaauaagaucaauguaauucauaaucuuaggacacauuugguauauauaauauauucuaaucuaugugcuugagugaucagaauuaaaaauaaacucaaguguuuagagaaaacgugcuacagaucaggcuucugaggcuaauaugaauauaguuuuugauuuuuaacuguuacugguaaguaugagaaaggcuggaggggauuaaaagcuugcaaaagauggagaaugucuaaggagacaccuuagagaaaagaggauucuuuuuggauuuuaugaaccuuugcaucauaaaaauuauauccagaguuacagcaucuguucacaguaugaugaccaaccauagcuuaagguugaucuuuugauuuguaagaggaaguuuuuauuauuuguguucuguuuuaguguucagucaccagugacuuggauuuuccagcacaagucaucccguuaaagacccugaaugcagucgccucggugccuauaauguacucuuggucgcccuuacaacagaauuuuaugguauguaaguaauguagcuuuugcuuguucugcucucaaaugucagccuccauggcugucucaaaaacaccucagacauguguuagaucuuuaacuaauaaaaauagaacaaaauaaauugaacccauagcagucacauauguauacucugaaccugaacaauauauauguuaaacucuacauuuuccuuuuauuacucacacuuugcuuuugucucaauacuuguuucuuucuuuauuuaaauuuuugauaacaaacucaaaauuugcugacuagugaugauuugaaauaauuuaaucuuccuauuucuuaguugccugauggccaccuauguguuucauggcuuuuucuaguguguccuuuccuguugauuguuaucauagucugauccaaggcuuguaauacuugaaauguugucuuuguccuccagugagucuuugucauuauguucuguuuuucauaguuaauguucuaaaacguuucuaaaacauuuaaccaaugccuuguucaagggcuuuuucgauuaagccugcccuaacuuagguuuuuggacacaugcuucaggaccaucuagucuuuuguauuguuacugucauguacuugguuguauaguuuucuuccuuagaugauugguuuuuguccuuuguguucucagauauucuagucucucuacauuuucuuugauuggcuuuucccaguugguugucacgcuuugauguagauuugccugucuuguucacuagcauaaucagcuuugauguaugacuuguucaccaaauuacugaaauaguuucuguugcuguagaguauuuugauuuuacaaguauaaauccuuuuggcauagaaugauaagaccauugauagucuuuuauauuaguaucaguuuuuuuuccccuuguugugauaaaucaccaagaccaaggcaacuuauagaaggaagaguuuauuugggcuuaugguuccagggggauaagaauuaccauggcagccagaggcgugguggcuggaggagcaugaagcuaagaaucccauuguaacugaaucacuaaacagaguggggaguuggggaugcugacuugagugagccauggaaucuucaaauguuauccagugacauacuuccccaagcaagguuguacuugcuaaaccuucuaaacggugcuaccaacuaggaaccaacuguucaaauacauaagccuauagaggguguuucucauucagaucuccagaguaucacuagauucuuauuguaucaaauauuuuaauuguuagaucaccaaauaaaguuuuuuacaaacucuuuguugaugaguauuuguaguuuauuuggauaagccacauaucaucgguucuauuacagguaccuuccauuuuaguaucugcaaucggaaugucuuacacuugaggucucauguaaccugcagcaguuuccuuucuuagauuaaguguaguuacaguuuucucuacagaucuggauaaagacaaguacucauggaaaauacugguuuuaguuaucucauuaacuuuuuuugugugguaccaggaauuaaacucaguguuuagaaugcugggcaaguguaucacauuuaagucucacaccgagggcuuaaguuuuaaguuuuauguguauguguccuauguaacucuacacacacacacacacacacacacacacacacacacacacacacacacacacacacacguauguauguauguguuuguguuuaucaugacaaauuauaggggucagaggacagcauguggggaguuaguucucugccuaccacaugggucccagggauugaguucugguugucaagcauggucuuuaccugcugagccaucucucgggccuucaaguuuuaaauaaaugcuuaaagucuaguuuaaaaauuagaauacaucugguuuuaacuuuucuuucuuucuuccuuucuuuuucucuuuuuccuucuuucucucucucucucucucucucccucucucucucgcccucucucucucucucucucucucucucucagguggaagacgaaacuguuuuacauaacauuccuuauaugggggaugaaguucuggaucaggauggcacuuucauugaagaacuaauaaaaaauuaugauggaaaagugcauggugacagaggugagcuauguguauauucucuuuaguugagggucugaggguuuucuuguugccaugacaguggcagcucuuaaaaaggaaagcauuugauuggggcuugcuaacuguugagauguuuauuuaguccagccgggcgguguuggcgcacgccuuuaaucccagcacucaggaggcagaggcaggcggauuucugaauucaaggccagccuggucuacaaagugaguuccaggacagccagggcuauacagagaaacccugucuugaaaaaacaaaaacaaaacaaaacaaaaaaaaccaaaaaaaccccccccaaaaaaguuuaguccauuaucaucguggcaguaagcgugguggcccgcaggcaaguauggugcuggagaaggagccuagaguucuauaucuggauggcagacagcaggaagagagaguuacacuuaaucaauaaaaauuuucuggggugucgcugugccccccuuuaauccuuaauaucuauuggagguuucugccucauuuuuguucauguaauucccaaguaauugacacagaaacaguucauauuuauuuacaggcuguaauccuauauuuggcagauucugagcucuucuauauacaaacgacaggccccguguacuuuaguuugcauuuuacucaacuugcucuguaccauguguguccucaggaccagcuucucucucaucuuuuccuucuuccuccgggucucucuagaaaucuuucuugguuauaaguccuaccuuuucuaugcccagucauaaacccagccauuuauugaucaaucaguuauuauuggggaguauucuuugcaguaccuguguuacugcaaugccccaagaucagguuguagucuggaccagggcauagaacucagguucugaauccacaggucacaaggcuaaccccaacagccacugggucuggcuuaagcaccuaagaccucaaagccugccuccacugacacacuuccuuuagcaaggcuacaccuaccccaacgcuaccacacuuccuaaucaugccacucccugugggcccauaacaucauuuucauucagacugucauagaaggguuucuuaauagaguucauaaaaaaucuuaagagcuagucugggcuuaaaggcauacauuuuuaguauuucuuuaguuuuuccauuugaggaucuuauuugccacuugguaaucaucaguaacugguuauaaacuacagcagaaacaacacauagauuuuauaggaauagaguguguguuuuuugguaagcuuucaauaguaaaacuaaguuuaaagaucuguuuauggggcaugugcuucagaaaggcuuucuacucaacaaugccuuccucagggcagccagagcccgugaaauuaaguuaacagaauccuggauucagguuucugaacaggaggcucucuugauaucugagcaaacggagauguggucauaucauaaugcaaaacagguuugaaguggucagucagugacacagauugggaggaagcuaaaacuacagguccuuauggauuaagggaguaauauacccuggaucagcuggagaggguugauuccugagaaagcaacagauguugaagguaaaugcuguuuucuuugcuggcugugaaauugaucuugacuauccuuaccugccccuuagguuacagugcugauaggccuucacuauucuuccagauuagaaaacauauacauaaucuugucauuaucuuuuucccucuguuucugacauuuggcuuuuagaauguggauuuauaaaugaugaaauuuuuguggaguugguaaaugcucuuggucaauauaaugaugaugaugaugacgaugauggagaugauccagaugaaagagaagaaaaacagaaagaucuagaggauaaucgagaugguauguuuaauacuaguuuuuuguuucagcuuuauauaauucuuuuaaaaaaaaccuaucaggcugguaagaugacucgguggguaaaggugcuuaccaccaagcuugauaaaucgaguuugaucccuggagcccacucuauagaagaaaagaacugacucugcugaguugccccugaucuucacaucaguacacgguggcauacauacaccaucuaauuaauacauguaaauaauguaaaagccacccauguauggguauaauuaaacuacccccuuuuuguuaaguguaugaucaaauauauuuucugcagcauuucauucuccacuagagcuucuuuguuuccuuugccuaggaaaaggacauaauccuuuuuugcacuuugcugaucaauuaucauaauuaucuuuauaauaauaucauguaucuuauauaaguuguauacuaauauacuuauauaccagcuuauccuuccacagcuuuacaauguauauauuauuaucagcuccauuauauauuggaaauggguuuagggagguuaaaggcuaagaaacuuaagauagcuauauugggaaaaaguagaaucugagccccaaguugaugaccuaggucugaccugagagcugugcuauugucucuacacuuguuaguuguugcuagaaagcagucuaccccaaauaguagagaguccauaaugcugucuuguauuuagcaagcuuacuguuaagacagcauagcagaguuugggggggggggugggaggaauugcaucaaaagacauguauucuuuauaacagaaacacaccuuaggagucaauaagugauugcuaaguucuuccaugugauggacagaucugaaaguggauuaauggucagcucugacacaaagcuauuaguuucaaauaauccaaauuugggggaucugucuuccuguacucuuaacaucucauacuugaauuuuauauuugucuuucuaguauuugacaggcuuuuccauuagaaguaaguaauacaggguuuggugacaccuguaaucucagugcuugaaagugaaagcuggagagucagaaguucaaggucauccuuagcuacauaacgaguuuuaugccaucuugggcuaaacuaggcaaaccuccccccaagccaguguuagugcgucauccuggucauacuagcacuugggagucagagacaauaagacagaaaaguuggcuaccgagauggaucaguggauaagagugcuugcugagcaagucuugaccugauuucaauuucuuaguuccaaagaggaaggagagcacugacucgcaaaaguucuuuccugacccucacacgugcacacuggugugcacaccaugugucuucacucaggugcacaugagcacacauacauguacauacaaaaauaauaauaaaguaaucaucagaggcuggaagucaagcuggucuacuuaguugcaggccaauuaagacuacgcagucucaaagauuacucccuucccaacagccccccaaaagugaaccaaaggggacaaguucuuagaaaaucagcuuuguugagaugcugugauacagagaaaaugaaauugaaacuuguuucuuccaucucuucccuuaucacaauucacuguuuagauaaagaaacuugcccaccucggaaauuuccugcugauaaaauauuugaagccauuuccucaauguuuccagauaagggcaccgcagaagaacugaaagaaaaguaagauuuuuuucuuuuuaauuugguacagucgugaaucuuaucaucuuggcuuauuauuuuaaguauucucucucucucucacacacacacacacauauacacacuuguacuguauauuaggaaauuuuuaguucauauugaguauauauaugagaauucaugcauguuauuugucuguguacaguuuauacuaguauauucuggacgcuggaagagauuuuuauaguuuauccaaacuaauguuaauagccucuucugcaguguaccucaguuguauuaaugagcuugauucuuguuuccuaugcauaauacaugauugauucuuagugucagcaaagauuauuguagguuggauauuuuucauugaguuuuagauaagauaaacuuuuaagaaaaaucaaacccuuggaaaccuuuuagaaacuuucaagaaagugauuuuucuuuguguuuuacuuauauuguuuguuuguuugucugaugucagauauaaagaacucacggagcagcagcucccaggugcucugccuccugaauguacuccaaacaucgauggaccaaaugccaaaucuguucagagggagcaaagcuugcauucauuucauacgcucuucugucgacgauguuuuaaguaugacugcuuccuacaucguaagugcaguuauuguacguuuucauuuucuaucuuuguuguugaaaucuguaguaaagcaacuugcugucaguuaccacaaccaaaauguaccggccaaucuuagagugaggauugagaaauaugucacgucccuguacugagacuuuuacauucugaggauuccucugacaucuuuuguacacauuuuauuccauucgcugcuucccauuaacuugaagcucagugacucuuuacaaggcuguuuuaugaugaaguuauuacagugaaggagcgcagagcaguauuacagauauuuaugaacaaauuuuguuaaguuaaugaauuggugaaaaggcauuuacacaaacaauuacuugccuaguguuaaaauauuuuuguuucauuuugauccuucaaauaauuguuuuauaaguacuucauauuucaaaacaagcaaacauaaaauauccuuaaugucaguaugaaaacuaauuuuuuuccuuuggcauuucuagaaaaugagguuucuugguaaaauuuccagguaacuggaauuuguuuuguguuuuuugaaauagugucucauacuccguauguagcugaggcuagccuugaacuguugauuuucaugauccuuuugauucuccugccucaacuucuugagcucuaaaauuacaggagcauaccaccauaucccacuaaaguuggaauucucuacaggcugguguguggguuuguuuguuuucuguaguguuagagauugaacccagggccuugccucugcugggcacacacuagacuauauagccacagccccaucccugcacacucucccauuaagacacacccccaucccugaacacucuaaaauacaucccauauacucccaguaagccacauccccauuccuaaaauuugcagugaauaaauaguaucagucauuccaccccccaacccuccaacccccauccccccacuccgguuucuuugucuauaaccuuggcuuuccuggaacaagcucuguagaccaauggccucaaacucugccucugccuccagagugcugggauuaaaugcaugugccgcaaacacccagcagcacgugauauagauuucccauuaggccuagacauucuucagucuccuauucucugcacguugaccaguugugggucuuuauauuaaucaccauguacugcaaauagaagcuucucuuguaacgauuaagaaaugcauuaacuuguggguauaaugguguuauuagcaauugauuuaauacuaugucuauuuagcggaauaauacuauuaggcucucuccaucccuaggguccauccaugccuugucuagcuacagauucuuggcucaacaaugaugccagauauagguaucaucuuguagagugggacuuaaauccaaucagaaagugguugucuacucucaugauguucaugguacuacugcagcagugcagaucuugccaggccaguuuuuuuuuuuacuucaucuugcaucauucacagcuaggaagguaggaaggcuaguuagugauuucuuuucucccucauuagugugcauagcaccuuucagcacuaggaaugcuagcugauagggaugaaguauucaguucagugccagccugauaccuucauguucuaugacccaaguaugugaugucuucaguaagaggucuuaucaauagcauuggcaaaagcuuauaauguuugggggccuaugggaucucacuggucaacaacuccaaaagagguaacguauucccagcacuuggcuuuugauuuguaaaccuguggguuuucuagaggcauuguugccacauuauagaguaacucuagauuaauucugugugagguguuuuuuggguguguggugggggcuuuuaugguaauagguaggcuuccauaugacauuugaaagguucuguuugucauuuauccuucucugccuuauuuguugagcuaagaucuuacagugaacugggagcucagcuuuuugcguagguugaugggacagugagcuucugggaaccuccccaucucugcuucccuucugcucuuggaugccuccuaccacacucuguuuuacagaggugugaggaucagaggucagguccuccugccuaugugaacacuuuccuuacugaaguaauuccccaccccgagauaaguucccuugaaaugaauuauuuaaaguuuguucaauaaaacguccuuaaguauaguuuaauuuuuuaaaaagaaaucacauggcuuccaccaccuuuaagacuauaaagcuccccuccccacauacacuuucuaagcuuuucuuuaauuuauuuguuuuggagguugaaggauaugcuugcuguggugcucuuguggaggucaggacaaguuuccacagucuagguauuaaacucagguggagaaacuugauggcuagcgccuuuccugguauccugggagccuccccaucacaccuacuucucgguuuuaaaaaacacauauacuuguguaucuuccuguuuagaacuuauuaugguaugaacauggaucuaacuuuuccucauucacaaaguuaucuaaaugucuuaguaucauuuauggaguucaaaucauucccugcuuugagauaucguacuucuuucauugcuuauuaucaauguauuuauuuauucacggagccagcaucccagcuccuaggucuguuucuuaguuuuagguaucuuuucucugucuuugggccuuuauuaaugacauugguugagugauugacuuugucugugggcauacauguaggcauaugugugccauggugugaauguagaagucaacuuguugaaguuggauaugugguguuacuauauauacauaauuuuacauuauuucugcagaggcaagaugauugccagucuaggcuuauguagcaaaacuuuguauguaugcaaaaacuguuggauaugguggcucacaccuuuaaucccagcauuugggaggcagaggcagguguaucucugaguugaaggccagcuaguguauagagugacuuucaggauagccaggccauacaacacagagaauuccugucucaacaaacaaacaaacaaacaaacaaacaaaacaacaacaacaaaaccuuaaaccaaaacaacaaaccccacaaccguuguuuaaaaaagguaugauuguuaaaauguuuuuuuugugaggagacagcuugggauuuuagcucagugcuugagccuuugcugagcuaggcccaggauuggaucucuuguacuuaaauggagaagauaaagaguggagccuuuaugaaaaaggccuuuuuaaaaccaccaaaacccuacauaguucugugaauaucaccuauuuuuuagccaaauuaaggucauuuucccauuguauaauuuugaauaguuagguuuuuuuguuguuguuguuugguuuuuuuggggagaggggguuugagacaggguuucucuguguaucccuggcuguccuggaacucacucuguagaccaggcuggccucgaacucggaaauccgccugccucugccucucgugcugggauuaaaggcgugcaccaccacgcccgacuugaauaguuaguuuuaagcauugacuuuuuccauugugugagaaaacaacugguuaacacacccuagaauugaguuccagauauugaagcuucuuuguucuagaaauuuuauaagcagaaccauuuucuaguucauguuuaguaaguugauccuucagcuagaaaucaaguaauuaugucagagcuggauguggugauacacaucuauaauuguaguucucagggggcaaggcuagaguauugcuaugaguuuaaagccagccugggaaagauaccacccuucuaucucaccccuccuccccacccccacccccaaaguucaaaaaccaaaaacauaaaaagccucccuagacagggaaauuguagaugccagaauauuuuuguaaaauuagaaagucuguuguguuuuuuuuuuuuccaauauuuuucacuuguuggagauacuaaagacucaaguaaaugucuauagucauacuuuauucccauagaucauacuugcauagggaaaauaagaauuaugaaucauuccagaguuuaccaugucgucaccuuucuuggagguuggaggcagaguggaggguacccugugagagaugggggaagcuguagaaaguaaacuacauaugugggagauacuggauuuuccaauggcucuggggaaaugaaaaaguaaacuuuuuauagccauauucagguacuuugugcuuauuuuacagccuuccaugcaacacccaacacauauaagaggaagaacacagaaacagcuuuggacaacaagccuuguggaccacaguguuaccagcaucuggugagauucagugcuuuguuacucuggagggcucuuaagaauuuugguggaggugguaaagccagcaguaaugcugucuggauucauauuuacauuggccauaugacaggcaguguucuuauccuuguuucuuucagagcuguguccugcacaguguagucuauuaaucuuguauuacucucuguuuaucuguguuauuucuucagcaacguuucacgguucuuaggaucaaagacucuccacaaaguuuaagagaguaugagguacagauagcccacuuaaacaccagaaacuuguagucuuaugcagacguucuuaagucuuaucauggacguaucccuucugugaaugcuuuaggccacuuauaguuuaagguguaccauagguccuaaacagguuuucuuuuuuuaagugauggugauuaggaguaagggauuaggaaaauaugaggcaggaaaguuguuuuuuuacggguacuaucuuauuuuuuaccauuuccccucuuugaaccaagccacuccuaccuaggaacuaaguggguauauauugccuguuggauuuuggacagaagauucaaugaauggcaccuacagaagguauccuauuuuuaagcaauuugguuuuuguagagugaaguauaaaacuguuggcuccuuucaaacuuugcucuuugcuccacuaaaaaaauaaaaauaaaaauaaaaauaaaggaauuccugagcacuguuuuauauucuuuauaaggcagaacuuuauuggcucaucuaaaauguuucuguggucucuuauaaaccaugcucuaaccauuguuuuauacuuucugagauuggauugugguacuuccgaaugcaaaauguaacccuaaucuuguaccucaaaguucuuucauaucuuccuguggcuuugcauccuucacaggaaaaaauaauuggauguuuuaauaguaagaucagaagugacuaagucaugcauguauauguuuuguguucuuguuuucuuuaaauaguaccuuuaaagagguauguauuauuuuaagccuugaaauaggaagucugacuuaauacacuucaauaugucuuuugauauucucuuuuaaacguacuguauguauauguagagaaaaauaccuuuauuuuuugaaauauauuuucauuuacuauauuuuaauuuaauuuuacaaacucaccauguagaacugucuugccugauuuugcaucauuggaacaaaauauugaaucuauuuuuauauuuuuggaaucuugaaaguaucaaaagcagauggaaaauagauagguguguugcuaucuaaugacugauaauggacacuguguagagucuugagcaacuuguguuaugcaaugucgucuuacucuauuccaccaaaauauuuagaacuuuacucugaugccucuauuuuucauuuuacaggagggagcuaaggaguuugcugcugcucuuacugcugagcguauaaagacaccaccuaaacgcccagggggccgcagaagaggaagacuuccgaauaacaguagcagacccagcacccccaccaucagugugcuggagucaaaggauacagacagugacagagaagcagggacugaaacugggggagagaacaaugauaaagaagaagaagagaaaaaagaugagacguccagcuccucugguaagacauaucuuacagcuggguuguuggguuauuauugcuuuguaaguuuaccuuucuaaggguuaagacuaucuaauguguguagguacagaaagcugggguuagaggcaggugugagcugccaggcacgagugcugggaaccaaucucagguucucuguaugagcagggugcuccgaguguucucuccaggacccuugccuuucuccccuuuuguggcuaagauuggagaguucucucaguaaggcauagcugaauuguuugugcugucucccaagugcaccuucuguuauucucaucugucuggguugcuggaagcucugauccaauuguucuugcuguuuguacccucuuccccuguuccaucuuucuuugauggaggaugauggaacuaagaaaguucuguuuuaaucuuaaagaccaaugaauaguuucaguuagaaagaaaacaaguacuacugcugaguuuauauuuuauugguugaauuuuaguucuuucaacucuaaacaauaccauaaaagauaauauuuguguguauuugauaagucugauaaagggagcagaacuucuggguucuuuggcaagugugauaggaucuuugugauguugauucuaaccuuacuaauucuaaaauacaauuaagugccuucugcuuuuccuuagccuaccuugaauuuuacuuguucguauugaucagucgucuuugcauaugugucaguauacacacauaugccauugguguacauaugaaugucaaagaauaacauccugaguauggguccuuaccuguccaucuuguuugagacaagaccuuuugguuauuucuccauuacauauacuagacuaguuggccugugaucuucuggagagucuccugucucugucucugauuuccuuguaggagcacugggauaacaugcuuauacuaugugucugauuuuuaugugguugagaaaaccugcccucugguccucaugcuugcaugauaagagcuuugacccagugaaccaucuccccagucccuuugucauuucuugacuaguguuaacauuugguuuucuagaagcaaauucucggugucaaacaccaauaaagaugaagccaaauauugaaccuccugagaauguggaguggaguggugcugaagccuccauguuuagaguccucauugguacuuacuacgauaacuuuugugccauugcuaggcuaauugggaccaaaacauguagacagguaagcauauguuuucagagguuuaaacacaggaauaacaugugcucauuauccagacauagagaaucuugauuucauucuguucaucuucugaaaagaauuaauuuccccuccucuuaagaaaauuaaaucaguauuauucuuuagccguguuucagaaauucuuuaguuuagaauucaauuugggugugauacauguacauagagugaacuuuggccagacuuuaaauauagcuacauucccaaugugauggaacaauagugauuucuacuguguaccuugcccuacuccauauacuggcagugugaugggagagacaaaaacauuucuccaguuugcaaaagcauggaauguuuccauuaaaccacaguguccuuauuacucugccucucauguagguguaugaguuuagagucaaggaguccaguaucauagcaccuguucccacugaggauguagacacuccuccaagaaagaagaaaaggaaacaucggugagucugcuggggagcccuuagagaagcagugaggcaggaucugcaggcagggcuuuccuaagaacaucagucaguuuucacuugaauaaugauauaaaagguucuaaacagcuguuauagauguauagaaaucucauuucucccuuauggcugcuguuaguuuuuauauacagccacuucaguauaguugacauaucaagucauagaaauuuuguuuuaccaaccacauuggauuuggauugagaaaaacauacugcaguaaagcuacagaaauguuucuuuuugguguggauauaagaugugcuucugcugugcucccugggccaguguuuagcuguggcuuuuagucuaggagucuggauuuucuaagcaugugccauuacauucugauauuugaagugagccuccuucaagucuggauauuaccucucacaaagacuuauagugaauaacuguacaggacccuccuaccucaacccacuguguuuuaaaaugagaaguguaguuaaguggguaaggaugcaguuagauuaugcuccaaaaauuuuguauaggcacauugaaugugcugaaguacuuuuuuuuuuguauuagauauuuucuuuauauacauuucaaaugcuaucccgaaaguucccuauacccucuccccacccugcuccccuacccacccacucccacuucuuggcccugguguuccccuguacuggggcauauaagguuuguaauaccaaggggccucucuucccagugauggccgacuaggccaucuuuugauacauaugcagcuagagacacgagcuccgggguacugguuaguucauaucguuguuccaccuauaggguggcagaccccuucagcuccuuggguacuuucucuagcuucuugauuuucuuguguuuugcaaauuguaucuuggguauucuauguuuuugggcuaauaucuauccacuuaucagugaguguguaucuaauaacuucuuuugugauuggguuaccuaacuaaggaugauauacuccaguuaccuccauuugucccagaauuucauaaauucauuguuuuuaauagcugaguaguacuccauuguauaaauguaccacauuuucuguauccauuccucuguugaggggcauagaaacuuaggcuuuacuauaugcuucugaguuuuugguugaacaguuucuuaccaugcaauucaacugaguaguuagugaugcugaaaauuguagaaaguauugguauccauauaauucagacgggacuaaaucaguagguaugcacaaggcuuuauagucuuaaccaggcaauauggacaagaauuuccuugccaggcuuccgggcaugacacaguauccugagugaguagguucuugagucagucugaacuggcaagcccauagagacuagggaguauaaagccagccuuggcuuuucagcacuggugcaugaauugcacagccaggcucauuuaaacaggacucagaguuguagccaguuguuguaucucacacagaacuuuuucuaucuuuuacagguugugggcugcacacugcagaaagauacaacugaaaaagggucagcauccucccaucuaaccucauuaucagcccccaaacgucuguuguccucauuuguuuuagaauagaaacuggaugaaguuuugguucuucugauuugauuuuuacuuagcaaaucaguuuaaaugaacugugucuguugaucugcagugaagugaacuggacggagcgagucagagagaagcagaaguggggcugaaauguggcaccaaguguuuaagcucuugggggugggaggugauuuuuuuuuucuccacaggaguguuguauacuucaguaaaggcagccagucaaggauguuccagagguaguggggaagaaugucuuguuaauugugaugaucauuucccaucucccuggauucauuggcugcgugcuguuaucuuuacucagacggcuccucuaaccauguuuacaacuaucaacccugugaccauccacggcagccuugugacaguucgugcccuugugugauagcacaaaauuuuugugaaaaguuuugucaauguaguucagaguguaaguauuuguugcuuuggugcaauugcaugagaacugaauaggcuuuuggucagcagcugaaaauggugguuuaaaucaagacauaaggacugggagugcucuuauugcuugcuuuaggaaagcugcuuauuuuacaaguauuucuugagcccuguacugugcuaaugucuagucagccucuugggcaaugugacuguguaugcucaugcacaaguuaggcaguuguaguaauggauuggauuuuucuguuuuuccucuuuggucauuugaaguacaguaaagaggcauagacuguaaggcgaaucuagaaguagcuacccacuccuuuugugggugucagaaauagugagaguuaaguggguuuugguuuucagaaugaagggaaguagguaagggcgcaguagguuuucauaaucacuuaagaaagcuguacagaguguggauaccaaagaauggauuagaaauaugcuuuauuauagugguucucaaccuuccuaaugcugugacccuuuaauacaguucauauuguggugacccccaucuguaaaaugauuuuuguuaaaugauuucauaauuuugcuacaguuaugaaucauaauguauaugcauuuggagggauguuuugccaacgggguuaagacccacagguugagaaccgcagguuuacuggcaugauuuagggucauggauaccauucaguccaagacuucccuuuaccugauuaauuaaccguagggcuuuaaauccaugugcuauuuaacaaauaugaaauggacagcaaaaccagcagugaucuuucucaguccuaucagcuucauguuugugguuuccugcuuccuuguuacgauggaauaguaaggaaaggugguaaggguuuaagugagugacucgugugcucagcaagaccuugacugccuuccuggaaaggauguggaugaugagggugauucuuggguaugguggugaugauacauuuaucccuaaaggucaaaaccgcuuuccuggaugucggugcaaagcacaaugcaacaccaaacaguguccaugcuaccuggcuguccgagagugugacccugaccucugucucacguguggagcugcugaccauugggacaguaaaaauguauccuguaagaacuguagcauucagcggggcucuaaaaagguaaauaacaguuauaucuggaaacuuuguugguuuuaugucacugucuuguguuaaguucugcugucuucagacuuacucuguagcugaaaacgaacuugaauuucugacccuccugccucuaccucuaccuccggagugcuggaguacagguagguacaugccugauuuuauauggugcuguggaguaaacccagggcuuggugcaugcuagguaagcacacuaccagcaacuagacuucauccucauccuccagaagauggauguuuacugauagucucagagauucucucugggaacaaauaaaagugacucuuaaaugugcgugaugaaagcaaaguagucaaucaaguauugucuggauauugcaggagugugucucucagauuuaaguucugaucauuuauuauccuuuuuuuuuuugaauuaauuuuuuuauuagguauuuuccucauuuacauuuccaaugcuauccaaaaaguccccaauacacaccccccccacuccccuacccacccacucccacuuuuuggcccuggcguuccccuguacuggggcauauaaaguuugcaaguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacauucucuagauccuccauugggggcccugugauccauccaauagcugacugugagcauccacuucuguguuugcuaggcccuggcauagucucacaagagacagcuauaucuggguccuuucagcaaaaucuugcuaguguaugcaauggugucagcauuuggaagcugauuaugugauggaucccuggauauggcagucuuuagaugguccauccuuucgucacagcuccaaacuuuaucucuuuaacucuuuccauggguguuuuguucccaauucuaagaagagacacaguguccacacuuuggucuucguucuucuugagguucauguguuuaacaaauuguaucuuauaucuuggguauccuaaguuuuugggcuaauauccacuuaucagugaguacauauugugugaguuccuuugugauuggguuaccucacucaggaugaugcccuccagguccauccauuugccuagaaauuucauaaauucauuccuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguccuucuuaccgguugggacaucuucuggauauaugcccaggagagguauugcuggaucuuccgguaguauuauguccaauuuucugaggaaccgccaaacugauuuccagagugguuguacaagcuugcaucccaccaacaaugaaggaguguuccucuuucuccacauccucgccagcaucugcugucaccugaauuuuugaucuuagccauucugacuggugugagauagaaucucaggguuguuuugaguugcauuucccugaugauuaaggauguugaacauuuuuucaggugcuucucugccauucaguauuccucaggucagaauucuuuguucaguucugagccccauuuuuuaaugagguuauuugauuuuucugggguccacccucuugaguucuuuauauauauuggauauuaguccccuaucugauuuaggauagguaaagauccuuucccaaucuguugguggucuuuuugucuuguugacggugucuuuugccuugcagaagcuuugcaacuuuaugaggucccauuuaucgauucucaaucuuacagcacaagccauugcuguucuauucaggaauuuuuccccuguacccauaucuucgaggcuuuucccuacuuucuccucuguaaguuucagugucucugguuuuaugugaaguuccuugauccacuuagauuugaccuuaguacaaggagauaggaauggaucaauucgcauucuucuacaugauaaccgccaguugugccagcaccauuuguugaaaaugcugucuuucuuccacuggaugguuuuagcucccuugucaaagaucaagugaccauagguguguggguucaucucagggucuucaauucuguuccauuggucuacuugucugucgcuauaccaguaccaugcaguuuuuaucacaauugcucuguaguaaagcuuuaggucaggcauggugucauuuauuauucuuaaagacuuauuuuuggcuggccucagacuucuaaguaaaagcucgcagugaagauagucuaccucuuuuggcguucuguuccugccguuucucuuuggcuuccuucauucucuuggccaaauguucagcauguucuucagacuucccuuuguuuuucuuuucuuuuuaauuuuuuuuuauuacguauuuuccucaauuacauuuccaaugcuaucccaaaagucccccauacccacccccaacucuccuacccacccauucccacuuuuuggcccuggcguuccccuguacuggagcauauacaguuugcguguccaaugggccucucuuuccagugauggccgacuaggccaucuuuugauucauaugcagcuagagucaagagcuccgggguacugguuaguucauaauguuguugcaccuacaggguugcagaucccuuuagcuccuuggguacuuucucuagcuccuccauugggagcccugugauccauccaauagcugacugugagcauccacuucuguguuugcuaggcccuggcauagucucacaagagacagcuacaucuggguccuuucaacaaaaucuugcuaguguaugcaauggugucagcguuuggaggcugauuaugggauggcucccuggauauggcggucucuagaugguccauccuuuugucugagcuccaaacuuugucucuguaacuccuuccaugggugauuguuuccaauucuaagaaggcacaaaguguccacuucuucaguuucauguguuuuacaaauugucuguuauaucucggguauacuaaguuucugggcuaauaucuacuuaucagugaguacauaucauuugaguucuuuugugauuguguuaucucacucaggaugaugcccuccagguccaaccauuugccuaggaauuucauaaauucauuccuuuuaauagcugaguaguacuccauuguguaaauguaccacauuuucuguauccauuccucuguugaggggcaucuggguucuuuccagcuucuggcuauuauacauaaggcugcuaugaacauaguggagcaugugucuuucuuaccgguugggacaucuucuggauauaugcccaggaucucuuuguuuuucuuagugugcuauuucgucagagcuguauagugguguuggaauuguacaacaacacauggagugacaguaucuccaccacugauucaggcuacauaauccugcuguacacucagagcaccaacaguacuucugugguuaugaacuucugggauguauaaaguuagcauucaucaucuccuuccgugacuuucugacagcugguggcuagagagcagauauucagcuuugucuuaacacacugacacaccuaggaggugccacaaaaagaccuaaugcaaucuuaaauuuucuauaaaauaagugccguaauuacuggguaguaagauaaacccaggguucugagaaguagccauuaauguuaucagacuugaaauaggaauuauuuuaaaaguuggcucaauuuuuuguuuuuguuuuguuccacaacgagguugugucuccucaauagaaaaaaaagaugcugauuuguauucugauacgcugauacaaauguacuuucucauggugguuuuuaaaggaugcuuucuauguacaguacaagaugcaauuuccuccagcaacguucuauaggcuuuguucuuguucuuuagcgaccuuuaaaacaggccaggugugugguacaugccuguguuaccagaacucuagagacuuagugaggucggagcauauaugugaacuguaucacaagacaguucccuaccaaccucaaagccuuaaaaugaaccaccuagcaguuauguauuugaagccugcgaauugcacauaggugauuuuaaauguagcagccagggaguaaucacuaagcaaaagacaccagaugauucaguaucuuuaacuaauccuuuuaguaacaauaguuauauuauuaacugucuaauguagaaacacgguuugaaugcuuacugcauauuacaaguaaggaaacccagauucacaugacacacuaucugaugagauggcucacaugguacaaguagacaacuaacuccuuaaggugccuuccauaccuguaucauagcaugccaugaauuguuuuuaaaaagaaauugcaaguaauggagcaagaaacacaaucuggggucuugcugucccugcccuccccauacuaccacuucugcccugugggcaguguaggcacaucucaugagcuaucacauaguugauagcacccuauuauuuuuauuuuuaaagguauauuuauauguguaugaguguuuuaccuguauguaugugcacuuaauacaugucugauacccacaguuuagaagaggguauuaaauucccuggaacuagauuuacagaugguuguuagcacuguaugagaacuaaacccagguccuuuucgggaguggcuagugccuuuaaucaucucuccagccucaucacucuacuguagacccucuuugaaauucugccuuagguggaacuuucagcuucucguggcuuucuuuuuucuucccugucucuuugaaccaccacuguucauggaaaaucugaucuagauuagcugagcucucgaaucauuuuacuuuagguggcugcauauucauuuaggucaucagaccccugcuucaguuuccuuuggcauauuugcugagaccuacaucucgucuguauccugaagccauauuugccacuguaggaucuauguucccuuccuuccgcuuguucacagagugggcaggaaugcucaugcugacgugccuucucuguggcauauuuuagcucucagaaauagaacacugugcauauaguucuuagcacuugcuuguucccauuguuuagcuaauuuuguuuccgaucaggagggugauugggaaguuuacuugacaagaguggcucagaaaagcuuggaugaccuuuaaagaucacaagaauggucuugagugaagcaugauaaagauccaugaugaagaguuacuauguugccaaguaguggcggcacacaccuuuaauccuaguacucaggagucagagccaauuucugugaauuugagaccagccagugaauuccaggacagccagaacuacacagagacacucuaucacgaaagacacacagacaaaacaaaacaaaaaucuaaguaaaaaagaaaaguuaucauauuugguccuugucaucuuggccuucuguaggauugaugaaucaucauauccuucauaauaaggauguuuuuuguguuaucaugagaaguuucuagaggaaagcuguggaggaaauggcagggucuuuagaggaauaaauaccaguaaagaacuagaaugugcuaagggcucuaacaaauaaaagaauguacuuugggaaacagaaacgucgaggggagagugguugguaugcucaccuucaguugguuucaguauguugggaugcccauguuuaagggcauagugacaugggccucauagugacaggucuuaaaacuaagaguaaagaaagaucuugcugugcaagccugacauucauaugaucagcagccccauuagaaaccaaguguggucauguacuaauaaccucaguguuggaggucuggcugugggacagacugcuaggccugggacuucacugccagccagucuaacugaaacgaaacagcuccagauucagggaaggagacccugucuccaaagaaguagaguggcgagcauagaucugguaccugaaguugcugacugaccugcacaugugcucacacauguauacacuauacauacacauacaaaaaugaaauguugagaaaaacuguaaagaagauaagauuuuggcuguugguuucagcacauggucacuugcuucucuugcuccuggccuggccugugcauagugaggcagagagcauguggugggcaauaguagcucaauccacagcacacaggaggcagagggaacccaggaaggcucaagaacaagagauacauugucaggaacgacuucgucccacucccacucacugagugcaucaccucccaguaaugccaacaaauugagucugucaugagaccgcucuucaguuguucauagccucacaauucaguugccucuugggggucaguccacaagcuggggcaccugagccuuuuggagggugaugacugaaagugaguuccaggacaagauggaacagaagugagagaagcugauccacacgucucccuugcugcaguaccaugaccucagauggagaggcuugcuugucuuuccuguaagaggaucuuuaucuugaauuuuccuuagaaauauuacuuuaauaguuuuccagacacucagcaacuuuuuuuauaucugucagauacacuugggggucuagugauuccccucagguggucugagguuuaacucugcuaacuugcgaucaguucuaaugugacugcuuacucucuagcacuuacugcuggcaccgucugauguggcaggcuggggcaucuuuaucaaagauccuguacagaaaaaugaauucaucucagaauacuguggggagguaagacauacucgugcauuccaguugacuuguuuauaguagcagcuugcauuguuuuggauagauuucacuggacaaggccaaguuuagaauagauuaauaauaaaugaccuuuagccugaacuuauuuguauuagaaguuuugguuuacauaguaacuagcaagauuacuuuuaguucuagucauguuuggcuuuuauuaccuggagaacaagggguucgggaucaagaguuuugcuguguauauuugcuccuacuuacuuggccagugagcugauggggacccugagacaauauuuuuauuaguuuggcuguuuuaguuguagggcuaggaaaaaacaaagcuuuagaaagucacaguuuacauuuuuuacucagcagaaagacaauauuauugucacuuucucuagacauguugcuuaggacauagaaaucucucugauuuggaguucuuaaaaguguuauuuggacuggugugacaguucagugggugaaggcaccugcugcagaguugaugaccugaguuuaaucucaggacacacaugguggaaagagaguaauaccucccacaagguguccuugcgugcacaagcacuuucccccauaacuucuuuacuguauaucugcuaaauagagaagacaauuuagcuacucuuugauagccuugagggaccaaaauucucuuaauuggcuuuuuuguguucuaacagucuugaccacuuacuccaguacaaucuccuccugugucuuccuuauagauuauuucucaggaugaagcagacagaagaggaaaaguguaugacaaauacaugugcagcuuucuguucaacuugaacaaugguauguucugagcuguaaggcaagguuuucaaauuagaggucagcaagauuccagaaccaagggcacgugucugcaagaacagcuccugguauuuaccagcaggccuagcuucagggguguguugcucacuuguaaggagaggggaagucccagugagcagaaaggcuguguacaggaaacaaucuagagucccaaccacuugcagaugggccugccucaugcucuggcuaugaguggacauugucucccacugcuguggcuugccucauguccccuggaacuugugggcugaguaguuucuguccaccucuucagugucugaccugagagguugagcauuuugaaagcaucuuguggccugaugauguugccauauauugugagaaaagcagcagcugcugcagccugugucuguggagggcccuguguaagugggugugcucacacacauccagacaaacuuucagcuggaccaaaaaaaaaccuuuuuuuuuucuuuuuugaaaauguuccauagaaauauuauaauaucaaaugucaacaugcccaccucuugaugcccagagaaauuuggcuagauuacaucuuuuaagccauguuuugcucagcaguauauaacugaaaaaucauggcguuuaagagcuauauuuaacaaccaaggauucacuuuaaucuagaagagcauuuucuuccaaaugacauuuuuuuauauuggaugaaguugaaugcuuuauuuccuuaagucgaauccugaggaaguauauuucuaaagccauaauaaccuuggucuaugacugaaaauaagucacuggauuaucuauguuuuucacuuuagauuuugugguggaugcaacccgaaagggcaacaaaauucguuuugcuaaucauucaguaaauccaaacugcuaugcaaaagguaagcuuuuaaguuggaauugacaguuugaugcaacaguuccauuuuuccagccaagugacagcaaacuucaguaccucuggaguacuuacgugaaacaguuaguuaaccucuauggccugucuuccugcucacugcugccaauguuucucuuugcaguuaugaugguuaauggugaccacaggauaggcaucuuugcuaagagggcuauccagacuggugaagaguuguuuuuugauuacagguugguaaaauacacaaagguuuucccuucugaaacuauggggcuugggucaaaggcuguuuguaaguuuuuugacaggucugccaucauuggagggugcauucuuuuaacugaccagucacuauuugcugugggcacuaguagagaguuauauguuuccucagugaaguucucauguauuaauuauacaauguugauuugaaaaaaauuaacaaaaccuaugcagaaagcugcaucuagcacccugcuauugauauaacugacagagaccccuggggcuuaaucuaugcguacacaucuguauucuacagcaccuucucauuggugcagcauauauaucuuuauugguagaacauuuacaucuucauuguuuuaauuguuaacaucacccuguggucacuggguucuuucuaaggaagcuacucacaaccauugacuguguucaacuccauuggaaggaucaggcuggcaguguggauuuauucauagagccaccuggcucuguggaaccaaacagucauuuaaaugugauccaguaaagaguauuaguuaaagaauccuuauaguuuaauauccauucuacccagaaacuuaaguuguugaaauggggcggggggaaccucgcuauguguaaccaguuuuagcugcauagcuagagagaaccaacugaaaccuguggaacuggaauaggauccuguggcuuuaucccaugcuuguucuaaauggccaggguuagaagcaaaccuguccagcuucucuaguagugggacccucaagagccugucuugguaucuuucugagucagcacucucaaugggggguuauucuuuggcauuagcauucuuuacaagucaugguuuugcuuuuguagcauuagacccagacaugacaguguggaguugccauucagagcagcgugcugcaggggcacagggaggguguggggaaugcuucuagcacaggcuauuauaacuagcagguagguuaccagugacagaugcaugccuccccuucauguaugcagcugucuauguaaagccagucggguguguguauguuagagacauaauucacucuaucagcaggcuugguuuuccugauguuggauagguugucacuucuuguucauauuguuucagauacagccaggcugaugcccugaaguaugugggcaucgaacgagaaauggaaaucccuugacaucuacuaccucuuccccuucucucugaaacagcugccuuagcuucaggaaccuugaguacugugggcaauuuagaaaacggaaaugcaguuugaaauucugaauuugcaaaguacuguaacaguaauuuauaguaauguuuuaaaaucaacuuuuuauugccuucucaccagcugcaaaguguuuuguaccagugaguuuuugcaauaaugcaguaugguacauuuuucaaauuugaauaaagaauacuugaacuuguuguugaaucacuuguccuagaacaucaccgacugauucuagaaagacuauaucuagugggaaaacacaacuuugcuuuguuuuuccagcuugcuaugaauauuuaauaaccaauaaacauacuggcauaguguuugccuaaau

SEQ ID NO: 2961 - RNA, 2340 nt, Mus musculus
cgugcgcgagugacagggcucgcucugaggaacgcggcuugcuggguggaagcaccacagucgcugucuuuguucuuuugccaacgugcgguaccucucaggaaagccauggacaggcaggcggaggccgggcacuuggcgggacccgaagcccgcuaugggcaggaggcggggaggucgggauggcgggaaccggccggggggcgggccagcucuuggcgggaaugggcgcugagugguucucgggagggggaggggaggagacgggcgggcgccugagccaaguuugaaauaguucaaaacucggguugguaacggucuuaaccgcccucuucuccggcgugccauacugggcccgggguccaacacuuuuguuggcgccacugaaaggaaggcgugugaccggccccacaggggauucaaugcggggcggcccucgcuccucacggagagcaccaguaggcagauaaaguuagugcgguuccuuucggcaccuuggaggcuuuggcuagcaaaacuggugccuaauccccugacgacggaagaaaaggcgaccagauuucucugaaaggccuuccaagcugcguuuaugguucuuagcacuuaucaagguuucaaguuguuuauuaacaacuuuugagagcaaauagcucaccccauguuuucucagcaaaguguaaggaguuugcaacauuugucaauggcaucuugggagucaaccuuucuccccgaggaauagaaaugagcugcuuauacaguacgcagcccaacccccacucccuguucaguuaucuggcaaugaggugaauaaugguauuucaaauuuacuuuuaauaagaugcaucugaauggcaaaaucccacagaccugugaaaacagguucaauagugaagaguucagacugagaauuuguaacacucuggaaguuauguaucuguauuggucgugguucucuagaggaacagguugaaugaaugaaugaauaaaugaauguauucauuccuucacugauagaauggauagagaacugagaaugaauauguauauagauuuucagaauauauagaaagaaggaauauauacauaauccuucacuggcauuagagcacacaucuucuggcuuccuucagccaaagacacccaggcuuguagacucaagaacuagcggauucuuggguuuuccguugguaaacaguaauuguuggacuagcuggaccuacagccuguaagccacucuaauaaacuaguguguguguauguaagcggaaaauucaagaauccacuaguucaguucauaagcugggaugccuucagcugaacuucauuauacaccugaaauucgguauacauuauacauuggcacaaaugccaauaaaggaaugggcuugccaaguagagugaggacaagcaggugcagcuucccaccuuaaaagaucuggauuaaaagucaaaugauuuaguuaagaaaaaagccaucguggguguacccuuaguuuuuaguuaauucuuggguuuuaguuaauacccuauguagucaacuugacaaccaagaauagccagagaaaaauacacucauguucaaauaaaaauauauauaaaagaaaaauaugaguuacucaagagugcucuauaaugugacaaacuagcagucaacaauauacuaacuuguccugguaaaaaagcuauccaacuacaucaacaacuuauacgugcuuuuuuuuuuuucuuuuuuuucaguaaacaauuuagacuugagguaacugcuuaucuugaacuuuguguuacuauuuuaaauguccuuuaauauuaaguauugauaacauuuuuauagaaaaaucaaggaauuuacauuaguauauauauggagcuucuaaagaaauccaagaguuguaaugaaaauuguuagguguuuagaagcaagaaauguuaaauauuuaaacaaaacugguuuaagaaaagaacauuuuagccagcuucagaaaaagcacaagaccuagaauggauggggcaacaaaaguacuccaaauagacauguacaaucuacauagaaaacauaauuggagcugagaauucuuauuuaaaagagugagcagaacuaagugcuucuacauuaaguauguacuuuuuuaaauauaaagucuagguuggaauaguaaagcugaaugaguaccagugaaucagcauugccuuaauucugugaugacauuaaccaacuacaaaagauaguuaggguauagugaugggcagaaaaaaauggaauaaccugacuuugcaaauaaguugauuauguagagaggauuugauauuuugcaacaguguuuaugaaggccaggaaaauga

SEQ ID NO: 2962 - RNA, 1585 nt, Mus musculus
ugagggcagcuacgaggucugcaagagaucugcugggaacucucgcccugccucaauagguaaggcaaaauaaggaaacugagucaagagccugcucugacagaaacguagggugggaggcaguaccucugaaaacuggaaguguccuggggucccaaggcuugugagucagggagccuggccuguugggguggggccuggcaugugcccugcaaggguaguucuaggguggaaauaaagagucacaucagcaggugucaccagcuaggaucugagccuucugugaggcucugugcguguaaaauccccuuuaugggugauuuuuccuuuuagcucccuccccauauuacucaugguuucuuacccacuguggaacugagacagugacauuuuaaaacaauuaaauauguauuaugagaauaaggacaaagagagagauuaccuacacuucgguguuaugcacauuaaaaacugccagaauaacacgaaguuauauccuguaaaaaaggguguuucccuugaagauguggguuggaccuggguguuuuugucaggcaugaauuaagcccgaaacaaaaauaugaaacagaguucacacauaaaccuuucucaggacguuuuuuugucuugguuguuguuuaucuauuuauuuuagaauuguggaauugggaaaguggcucugagaugggacauuugaagacauauacaaguuccuagucuaaacacacacacacaucuuauugagaaauuuugguaaaguuuuuccacugagucaaaauaaagcaguucacugaaaauauuucuuagguuuuuccuaguaaguaaauguucucccugugauuucaaagacagcgaauuagugggggaaggggggggggaggcccagguggcuuccuaaaccucuacuguaaugaacggggagaguggaaaugggucauuaggguugcacugggaauuucagaaacgugagagaaacccuaaauauaaguuaacauuuaaaauuuguccuagauaaaaugauaguaccagggcuacagagauggcucagccauugcaguugcuugcugcucuuucagaggaccagaguucaguucccaucaagcaacuugcaaugacuugcaacaucagcucccaaggaucugacacccucuucuggaccucacuugcaaauauccacagacacauacacauaacugcaaauaagaaaaggcggaucucugaguucgaggccagccuggucuacagagugagcuccaggacagccaaggcuacacagagaaacccugucuugaaaaaaccaaaaauaaauaaauaaauaaauaaauaaauaaauaaauaaauaaacaaacaaacaaacaaauaaauaaauaaauaaauaaaauuaaaguacuggcucugcagagaacccagauucuauuucaagcacccauguggcagcucacgauuguccauaacuccaguuauacgagauccaacgccuucuucuggucaccucagguacugcauacuuguagaacccaaacauucauaccagcauccauacacauaaaauaauaaaacuuuuacaaauuaaauaaugguacca

SEQ ID NO: 2963 - RNA, 7304 nt, Mus musculus
ccuuggacuuccacucacagcugcgacugaacaauuguugggaauugggcugccgacuguaagucaucaauaaauuccuuuacuaucuagagacuauccauaaauucugugacucuagagaacccuaacuaauacaauauguuauauucacauaaauuauccaaucuagaguauucuguuaaaguggcauaagacacacuaaaaaauaauauauauauauauauauauauauauauauauauauauauauauauauauauauauauaucuuguauuuuaucaguugccccuaucuuagucuggauauggugccacguggcuuuaauccagccuuuggggugcagcagcagacugaucucugaauuccaggucuggucuguaaagcaguuuccuacuuagcaaagacaaucaaucaauuaaauuaacacaaaacucuuuacuuuccagaguuagcauauuauauucugggggggcugaauaauauuauggcaauggccacucacuguuuuacagacaucauuauccauuuugcuaucaagucuaaagggauuaugcucucccaacuguuauaaauuaggcacuuugucaacucuccuuucaccaacucagaggcagcagcuuaaggcaucaucugcuaccugcaaagcacaaggaguuucuacuguccuagaagauguguauuuuuccuaugaggucucccccaccccaagugucucucuuugucuuugucuuucucuguuuccccccaccccacacucucucauguuuccacauggagacagccuuucacucucccucuuccuccaauuauccuguugugguagaucuguauguauagcaugaucucuuaugauuucuuagcaacacaccuuggacucggacugccaaagauaccguuucgucacuuuauccuaacaccaacaccugaaaauuucauuguucuuaauuugaccccucuaacaucacacacacacacacacacacacacacacacaccagcaguaaaaagugcuacugaagaagaaguuguuacagaucaugagcuaccaguguggucucucagaaucauaguuucucauuuguccaacuaaccucacuagauugcaaauaauauuaggauauagaaguaacaugaagguaguccauaccuaauaaagaacaauaccguuguaaagauuuuucugacuuuagcuggcacaguuauuuucucacacucacugucauuuguuaguuguuuguggucauacagucaccagccagcuuuccuuuugacauaaucuaagggucuccaccaguuaagagaauuaaaaggcaggaaaaaucuuuggucccacagguagaaucagaguaucuaaaacaccucagauagcagcagacaaaauaaauaguugaagaaagggguuuauuaagaaagauaugaugcgcugggcaugguggcacacgccuuuaaucccggcacuugggaggcagaggcaggcagauuucugaguucaaggccuagccuggucuacaaagugaguuccaggacagucagggcuacacagagaaacccugucucaaaaaaaaaaaaaaaauauauauauauauauauauauacauauauauauauauauauaucccucaggaaugcugcugguggaaaacaagugcuugaaaggccuuugcuuuagguugucaggcuuuugucuuaggaggaugaggaaaaagucagccaccuuggauauccaccaccuuuauuaccuaguugugcccuuacccuaucugccagccuacuaggaagucuguuuaacucuguaaucucuuacuuugucaagcuguauguaugcuuucaagcauaugaaagaggaagaaacaugugggaaguccaacagacucucuuaucuuucacauuguuuuuucuuguacuuaguauguauguguguauacaacuuacagaaguucuccuucuuccaugugaauguggaacggauggggaugaaagucagguugucgggugcaugcauguggguguguacaugugugugugugugugugugugugugugugugucuagaucgacucuauuuucuccuucucuaauauccagucuccaggugccaugauucuagaggagagccauggagcucucugagcuacuuugguuaaauacacguguguagcagucccacugucagcaauaugcaaacauacaguuccaugagcucauuuugagcagacuggggagaguaggaguuaaacagacucccugguaggcaggcagauagagagaggccguggcuagguaauaaagggagcaaauuuccaagguggccagcuucuugcucaaccuccugacuugaaguaaaagucuggcaguuuucuuuucugaccggcagggcccugcugauggccuggaucaccaagcucaaggccagccagaucaggacaugucaaacacaaaacaaucuuauuaucuucgacccucuaggaggggagaaagauccuucagagacuuuaaaacuuucaggccucaagaagagccuggauugucagcuuucugaguccuucuguuuugcaaaggguccuuuucacugaguauuggcuucuucaccccaguaaacuccuuccuucaacuacugauucuguuugagauguuucagauuucucaggggcuaccuguugcguuucagauuuuccugcuuuuaauccuuuaacuggcagagaaaaugaaccugaucaagaccccuagacuauauuauuucuacacuguacaaaagaguucccuggaucugcaauucaagucaaacuuagauuugugacuucaaugaagaaacaaauuucagguuaaaucaguauaaaugacaacuggaggguuuuuugguuuuuuggguuuuguuguguuuuuuuuguuuuuuguuuguuuuuguuuuuugaaggcaguucugcaacuuuauuugacauucagcagguuaguucucauccacauugacugucuguagauuuuuuaaugugguaacaggcacauaaguuaccagcguguagagcuugucuggugaauccucguccucauuacguuuucuggacaaacguacuuggaugugauauggaacauuccuuauucccuaggcccagacggcuuuauugagccuggugucaaugcgcacaucugguguccccauuuccuucaugguagacuuccaaauuucuuugagugcccgaggagcaugcuccuugaagcccacucuauggaugcacuugugaauguugaugguguauucucgggucaccaccucauugauagcagaacggcccuucuucuucucgcccacucuucuuuacgggagccauucuguugggaccaaguuggaaaggcacaacuggagguuuuauuaaggaucuuuuaauacaaacguuaagcacaaguguuagagagauaugcucauuuaaaaaugaaacaaaaaauaaacaaaaaaaaggcauacucaaguguagguuagggcuucuaaagggggggggucucaauccucuuagcauuagccacauaccgcccauuuggaguucucuagacuuauacuuaaaacauuugcuaagaaaccauuuuguuuucuuuucucuaccuuuugauagguaagauuauaagguaguucuaccaauaaaauuauaaucuguuaaagaccagagcuauucagcauuuaguacaugucuuuucccugugucuuagucaggguuucuauuccugcacaaacaucaugaccaagaagcaaauuggggaggaaaggguuuauucagcuuacacuuccauacugcuguucaucaccaaagaagucaggacuggaacucaagcaggucagaaagcaagagcugaugcagaggccauggagugauguucuuuacuggcuugccuccccuggcuugcucagccugcucucuuauagaaccaagacuaccagcccagagauggucucacccacaaggggccuuucccccuugaucacuaauugagaaaaugccuuacagcuggaucucauggaggcauuuccucaacugaagcuccuuucucugugauaacuccagcugugucaaguugacacacaaaaccagccaguacacccuguaaaggagguuucugagaagauucccuagaaaauugcauguuuauaucugggaaggacaagggccuggaacaauuguuaauugugcugaaaucuuugucugugagcaagagacuucaauaacaagcaaagggugagagguuccucucccuucuaauguuuccauacuuuucuuucucaaccucagcaaagacuauuccacaaucuuauuauacagagccuugcuuccagcuuucucaagguugucaaaggccucugggugcgacucagcugugcaagugucucuugcaagugucucugaggcuccccuugguauucccacaagaaacuuagccuucuuucacauuuuucuauauuuucaaacucuugaguugauuuccuuccuccaaaaaagcuuccuuucugaaacauguauuuuuacaguucuguuuuaaaacaugacacuauuuucaacuuuaaauaucucuuaaucuuguuuauuaagucuuauuaaauaguagucuuugacccugcugauauuacuuuaaaauucuuaaauaucuacaaagcuuuucauuuugcucuuuauguuuccuaagugagucaaacauuguagaaauuaaauaaaacaacccuugccuuaaaaaguaccaauaaaaaaaauaaaaagaaaacaaugggcaggaagcuauucauaguuacccagucuccuuccuuuacugucuuaggacauguaaugucuuagucagucaucgcuguuauauaucuguuuauuagucuuggccugugauugauuucaacaaacccuuuuuauuuauuacuuguuuauuugucuuagaggagaacaaucgaguauuuuucuguauccucaaugauaccauaaacauauugccauuuaacuuguacaauuucuaagauuagaaaaauuauauggggagauguaaguuucaaaaaagacuagucaagugcaguagugagaaggggggaaaguguagaacaggaguucaaucuguaacugacugugaacaaucaauugagauaacucacuaccuucggaccagccaaugcccauggucucacgcugaacuaauuaaaggccaaguaccucaucacuuuucagucauggugauuuuucuauuguauguguaaauuacaucauaacauagauauuguguucauauauaaaacucuggaaguaucuggucauuaauaccuuugaugacuaucagccaucaaaacucgaagccgcugauauuugcugagcaucuugggaaagacuugcaaauauaucauuucgucacuagggcguuucuccuggacugcgaaaggcucaguagcugcugaugggccuccuuuguccgguugcuguggguccgccacgauccgucuuccgauagggcggaagcuucacuguccauacccucgugcuuuuuaccccuaaguccuucagcaaaacugugcccuaaaacuaaccauuuucccacguggguagucugcuuccagaacuaccacuacccgcucuuccccaagccccaagugaccaaacccaaacaaaacaggcaagcagccccaccaggccagagcaaggcuaaauacccgggcaacuuugauacuucugaggauuuaagaguugacagggucagaaggcaaaaaacaaggcaaguggaauggggggugggggggagcaaagaagggagagagagagagagagagagagagagagagagagagagagagagagagagagagagagcucuaaaacaucggagauuaauaugaaugcaaaaaguagccaauuggacaguaaggauauucugaagcgagguaggguuguaaugaaacaggcugaaaacugucagauugcaucagccauuccagauagcaacacccuaaagaaggguagugacuccugucauauaaccuaccaacuaggcucuguuguuacagaugcccuuuucccagaaaugucccugggacucuucaaacaccugccucagcccgaagaaaugaaaaagugucucuuagucuauuaggugaugucagcaaacuuaacccauuuccuggagacacaauauccuucaucuuuacuucccucccaggucuccgcugacccuccugagacuuucuaagacccuuguugcuuugcagucagugcuaccuguuugcuuaauagaaccugcugcuucgaagcaggcgcuaauauacuuuuugccugaaaaauggucuuugccucucuugaaccuccauccuaccuaaaaacucaacaaaauugacagggaaaauauaaaugaguuuauaaaaaugacucauucagguagggccuaguggcaguuuccauuuguccaacaucugggggggggggggggaggcagaucucugugaguuugaggccagcauagagacuuucaggccauccagggcuauuuaaugagauuuuuuuuuucaaaauaauaacacaaauagcuuuauuauuauacuauuauuauauauuauugauguguuagaauggugggucacaucucaacagcacacuaggccaagacaguuccacaugggagagauuuuauugggagagagagagacaagguaguggcagaaagagaagaggagagagagagugaggcagggaaggugacaacagaaagaaaagugggaaagagaggaggggcgucuauggaaaaugacuguaaaggugggagcugagcccaaugaauucugggaauaugauggccauugucuugacaacaggucacacugucgccuauguggugucauagguuugggagguccugaugccaacaauuauuauauauaacaauauaauuauauuacauauuauauaacuauauuauauauuauuauacuagauuauuauacuuaagauccauguaguagcaggaaagagcagccuauucuuugcugggcuuucccuggcagggguagcaaagccugcucuacccaucuuccacccuuuugucuaaucuguagcacccuauccucacuggcaccuaaauuccagggagauacagucgcuggcucuucuuccuuugcccaauaccauuuuucacuugcaaagucaguguguuaacagagaaaguagggagucaaagaaaaaaugagcauuuuucucuacuacaguccuucaaagaacuucuccagccuuggaaaucagcuucucugaaugcaggaucuuucaccuguugccccaugaaauacccaagauuacgucucauu

SEQ ID NO: 2964 - RNA, 19017 nt, Mus musculus
aguagauuggaacagauacagagaccccacagccagacaauagcaucuuuaagugagacguccucaucaaaugcguccccucagagcucagggggaaucaccagaacaaaggccucugaaucaacuaagcaaggcacguaugagcucgagacugagacagccggcacaggaccuacacgggccugcaccagguccucuguguauauauuauacccacuagcuuagucuuuuuuaugggacuccugaguagaacaagugggucucugacucuugugccugcucuagggauucuuuuccuccugguggguugcuauguccaaccucaguaugaccguuucugcuucaccuuuuguuacaguagaauuuuggcaaagccauuguaucuggcauggauuccagagcgauggcacccagguuuugaaguaaccuuuuauagucauuguugucuuagguuuaagaaguugcuuuuccugaaugauuuaacacacccuuguguaacuuaguccugagacacuccuggcaaaccaggaagucuugcaugccugagaauuccuuagguaauguguucuucagacaacuccucaaucagguaagggguuuugguauguggaaacugacuugcuaaaagugccuuuugagcaacaauaaagaaacucugcagcaguuaguccaucagaggcugacccucccugcugagaagccucaacucugccuauguauguacguauguguuauauguaagcacacuguagcugucuucagacacaccagaagagggcaucggaucucauuacagaugguugggagccaccaugugguugcugggauuugaacucaggaccucuggaagaguguuugccugaucaugagguguaauucagaacauuugacauuuugucaugcuuaguuguuaucucuuagaagucagcucuuuuguuuuguuuuuugaggcagguuuuucuguguaagccugguuguccuagaacucacucuguagaccaggauggccuugaacucagauccaccugccucugugcugggauuaaagaugugagccaccacacccagcugucuaucaguuauugagguuauuuuaccccaugccuccccccacccucccauuuauuagcagccuaccacaacuuuucuacacaacuuuucuacuuuuuuuuuuuuaacugucuucagacacuccagaagagggagucagaucucguuacagaugguugugagccaccaugugguugcugggauuugaacucuggaccuucggaagaguggucgggugcgcuuacccacugagccaucucaccagcccacaccccgaaguuucuaaggcugucugagaucauuuuauuuuagcagcgggacugguuugaggaaccaguaguggccacacuccauuacuaccugucaucacggugugucagauacuggaauggcuauguccauccagcaucagauacuguucaaccuggacacggacauggcucuaacaucaggcugaaacaacauccuggccaacugucaggggagagugagcccucaacuuggugucaucagcaggaagaaauaaaaaacaaacauaccgauaguuaucuacuuuuaagcuaaacaagaaaauaaaaggcaaacaacaugauuuggcaaagacuuuuaaaguuuaaauuaaaaaaaaaaaaaaaagauucuuaaacagaagauccaaaacuuauuugucugaagagauacugaaguaaauaguuaaaaaaaaaaaaaaaaaaaaagaagacccaaaaugauaaaaauagauguauccuccauaaaaaucugaucuaaacuaucaucaagucacucguggcuauucaguauucagagcaugagguggcauuaacaaaauauaaaaaaaagucaagauccugccauuucacugauggcucacaugcuugguggccaaugcuguccacuagugccuggugccuccaccuucugcacacagccaggccuuuaaagcucuuccuugguccugcuccucuuuguggcauguucaucuauaaacuugcucaaaugcuccagaucucuguugccacccucaaauuuaauuggguucuuuuuguccccacugggagcaaaauagaugguagggaagcccuccaccuuauauuggucguuggugaugucguuggcaguagcauccaucuuggcgaugaccagguccuucuggcccuuguauuucuugccuaggcugguauagauaggcucuagcugcuugcagugcccacaccagggugcauagaauucaaugaggacguccuuuuugggguccaucacaauggcaucaaaggucuuucccaccaccaccuugacuggucccuuguuguucuuggguacuggcugugauuugaugacuggcuuuaguuuuccugccaaaacaaaaagaggaggugucaguacuuaaaaccccauggauccugccacucuaucugaaccaggcacugaggcaaccugaacuaccaggaguuauuagccccacucacagguggggacuuagccccuuuaaaaccuuccccaacaacgggcaauauucuauaauaaaauuaucuucacucucccagucucuacaaaauucagucuaacagagacacugaccaaugcaggagaacuauugagcacacuaggacggagucugaaaaccccguggggaaaacaucaacucugugaugacaaaaacaaguacccaaaauggguaagggccccgguagguaccaaauggccagcaaugagaauuaggugcuuugcucagucaggacaauaaagacuuggagucucauagcaaguguuccucauauucaaaagauuguuucaaagagcucugaaaaguuucuaagucaugcuugccuuuuuuccuaaaaauaaaaccaaaaccuaccaaccaaacuaaaaacaaaugaaagaggaauuaugaggcacagugacacacaacuacaauaacagcauucugagaggcugaggcaggagaaucacaagauugaggccaacaugagauacaguaaggcucugucucaaaaagcaaaaacaaagaacagagagucugucuccauuuucccaaccccaagggacaggagaggaagcgccuagaguaagacucuugagugcgaguggucggcagcaagagacgcuccaggucaaguucucaagucacagagcuuucagcugcaccugacugggaugcaucuggagaugccuccuggaauccuugccuaaccacaaacuguggcuucuuuagacugaugcuacugaaugggcccucauccggcuuuugcuuucaaaguaaauacuagaaaacuugccaaaaugaggaaaaaguaaaccuccuaaugucugaaguaacauuuaaguugucuugguaccgaagaguuugggggguacaucggcacuuuuucagguaacuaagucagaaaauggguuggagagggcuuaggagugaggaggggcagggaguaacaggggaccuaccaggucuuuucuguggacuauggagagugaggaggggcagggagaaacaggggaccuaccaggucuuuucuggggacuauggagagugaggaggggcagggaguaacaggggaccuaccaggucuuuucugugggcuauggagagugaggaggggcagggagaaacaggggaccuaccaggucuuuucuggggcuauggagaggagauuagguggcuuccucuaucaugugcuaccuuauucuuuuuuuuuuuuuccuuuuuuuuuuaaaucauuuauucauucuugauaaaagaguccuuugcuggcucggaagcuucggagugucaccuguccuugugaggcacaaacauguguggcccaacucaccuuuuuuaaaagcugugacaaauucccggagagugucugaaucaaacuccucuggcuccauggcaaacuucuucccgcucucgucuaggauggcugcauugacauccucuccacucucacugagccccagguccuucaccuccguggcauagucuuccucgucagcaauggcgaagguauacucagggaaguccuuggccaccucuaggacuuuguuacgccaaaacugaguagcugaaacagacacaggcugugaacuaaguggcugagcagaagaacuguccugcccuggacugugagauucaagauucugacacugacgcucuccgacaaggcccagacccagaaguaccucgaccagauaggaaaggauuucugguauagcaacacuguguaagcagcuggcuuaaggauagaacuccaacuaagccccaggagaccuggguacuggcaacacagcucugucugagaagccaguucagcaccagaucugcuacaucaucucuaugaagguacuaggcuugacuuuuuuuuuuaucgucuauuuucuuguuuguuuuaauuuuuauuauagaaugcauaguauaauaccucaggauuggcacuguuuucaccuguugagccaacucuuuagcccuagguuugacucuuaacuccccuuuuacuaaaucaggaaggaaaaaggguacuuuauggcucagaacucgaaauccgaugcuagaggcaaaaauaugcccauaccacuaacuuuaaggguucuagaacaagaugucuaaaaaugguagcccccgcccuauaaagguguugguagggucucucaccagcucuguaaucaaagcugaaguccacacuguaguauacaaccaccagggggcguuugcuguaccgcuuagcaucauuagaagucuuacgauggcccaccaggggcaaggcauguuucacuacauaguccuuaauggcugaugcuucuguagagcccugugucaaagacagcauagacuaagagcaagcacaaugaaaagggagcucuagcuaacgugccgucagagucacugucaagcacagauguuugugugagcucacucaccccaucuaaucacaccauuucuucugacuggaacuccaaacccaaugagaaaaagcuuaauggucuuaaacaguaacuauacacauggacugaaccaugcgggcuuuuccauagucaguuaacugagguccacaagagcccugaaaucccuuuuacagaugacaaggugagauacaauugcagcuaauaaauggccaggcaaggcgcugcagcuggccacacgcagccacaccuuuaaccuucagauuguacuagagagcauucagauuguacuagagagcagggaagccucagauuagaauuuagacucaggcgaaagacgugguuggugagcugucacaccgagcccacuuuuuuucucugggggcugugugcugagggcauagcauucacacaaacagcuguacucaacuaggcuccacaauggacuccucuaaugauggccuauaugguucuucagugagauguuucaucaguaucaaggaaacccaaguuugcauggcaccuaaaauauaugucagagugagugucuaaagggacacagaacucagguuuuagagacuggaggucacuagagcucacacuuaaaacucaaggucacucuuagauaguucuuguugagguaacucaagcacuuuauuccauguggaggagggugggauccagggguagaugcuucucacugguucagucugagauguuagggaugcucuaucugcauagggaacguaggucuccaggucuugucccuacaugacugacugucaaggcccucuuaauggggugucguaguuauauauuccaggacagguagagcuugacagggagcuggccccauacccaccauucucaauucugagaucucccaggguaggagguccacuugccccacagggucccauaaagacccagagcuccaacaccaggagccucagcacaauggaccagcaucaucagggaaaaauacaacacucacugauuaggcuccuguucugugcccugaagcuuaagaguggggugagaagcaaaggcugggaaaggagguuugaauacaaaaggaguggaacucuuccacagaauaagaaaaagagguuuggcuuuucuggaugagguguguuaguggggguggguuuuaagauuucgaaagcucuuguaugccaagcccaguuucucugccuaugcgucaggaugggccuugcagcaaccgcuccaaugcuugcugccucuuaccaugcuccacaccaggaugacaauggacuaaaccucuaaaaccacaugcaagcccccaguuaaauacguuccuuuuugagaguugcuuuggucaugaugucucuucauagcaauagaacagugucuaagacagguaugccacacccugugggcaaagaaaauucuccacauuucaaaguccagaugcugugcacguagaauacccaggaacugacauagcagaggacgcuucacgccucugaagagccccccucaccugaacauccaucacguggaaccugggcucauacuuggacuggaacuucucagggugugucagcaccaacuuccccagggagacuuucaggaacuuggcuauuucagggcugaaaguguggugaaacuuguaaucuucucucagguuguuagcugacaaaugaacagaauauauuaaauugauuaaguaacaguuuuaugacccucauuggccaaccaagugccugaaggguaugaaugcuacuguaaauucugaauggacuuuauucauucauucauucauuuaugugugugugugggagggguuguuguuguuuuuucgagacaggguuucucuguacaguccuggcuguccuggaacucacucuguagaccaggcuggccucaaacucagaaaucugccugucucugccucccaagugcugggacuaaaggcguacgacaccacugcccagcuaguagccugcuucaaaguucagcacaaauauaauaucuaagucuuccaucuuagaauuugucagaaauacaaaauaauacauucacagaaauuuagaacuguuuguuuggagcaaauguuuccuccuaucuaugacaaguagcaaacuggaacccaggacgacaguaccucucagagaacaugcaaguaccauauaguccugugacuuuacacugagguuucauaccuagugcccuuuacagagguuucaagcucuugucccgagauuaagaacucugcauuuagccaaaucccuggcuaggcuggacuuucccuuauugggcauugggcuaugcacagucuggucuccagccgagccgaggucugaaccccagaguggugauaauucaccuacauggcacgguagguguucccuuaugcuccuggaacucuggcuccugucgaaguuacggcccccacagcccucacaggagaagcauggcuaguagucauguagacaaugucccaagcuucugaccuucaggcuacacuccuccccaguuauguagcaacaguaaagauaacagcccaccauaagaggggcugcuuggccccaccucacucuaaccucucauccucuccucuccucgcucucacucucuccucucuuucuuacuuucuagccuuuccucuuucucucucuuuccccuuucucuccucuugggcauggccggucucucucucucuuucuaccuucucucuuuucucccugccuuucuacaaugaagcucuaaaaccauagacugucucuguucaucaaggcccgcugcgcuuggacgaugggauaggcuuucucuuaacaagccauuucugaucuccggauggaaggccuuccuguguuccaguaaaggcccagacuaaggacucucuccugugugggaaccucucuccuucagcccucuuucccauagccccggggcgcccccaguugggggcugccccuuguccaucccccacugagugaggucaguggcuuagauguccacccagggcugaguagaaagcgucuggcaguccucccgcaucccccugcccagagaauaggaggaacucuggccggacucacgcuauccccucucccuccucuucccugacccccuuaguucccacauucccuggguaaauucuuccugauuagccaagagcagaugauaguuaacuaaccagugaagacuaaagaaacacgaauuaaacugagcucuucucuaaagugcugacaaagcagcaggcugcucuggguacagcuuacaucuuuaauccuagcaccucggagacagagcuggcagaucucugugaguuugaggccaguguggucuacagaguaaaaccagggcuacacagagguccucucucaaaacaaacaaauaaaucaccagccugaacugaaaguauguacaagcauugcuaugccacggagagaucagcacaaggugacaagugacaugcugaaaggaaacuuagugaugaaguagacuacacuugugcugugugaagggggaaaugaggaaaagguggcacugaggauccuaaaacccacaaacacuggccugauggagccagcgugugagcaguguuaguuaacuagcaagggccaggaccugaauccaggcccaagucagcgcuguucuuucuaggagaggaggaaggcaaacaaccugaauuaaugugauuguguccgguggggagacagugcagcugguuuuucacauuuagcaugugauuauacacggcaccaacuauguaugacagccacaaggaccugacccacagccucagcacaaggcuggaaagcuaauucccacaguuacucccuugguucuuccaucaagcauuugcuacacugauauacucuuauggaagagcauuugcuguuuugguggggcuaagguuugagucuaggaccucaugaauacuaggcaacaacccaaucauuaugcuaauuuuaugcaaaacagccuacuucccccaaagccucaggaguauggcuuacauacucaccagcauccugauacugcaaguaggccgggucaccaucucccugaaagagcccaaugaugaccacaucaucuccauccuucaggaacuccuggaccugcuucagggucaggaucuccuuugagggaggcccagacugcucaaucauguagucaacaaucccuaggagcagagcacaugucugaggaagauccuugcagcugaccacauccucuagcucccagcugugcaagggacagucccuuuccacacacuacgaggaagguagcagccauaccauauuucucucgugggccauuguagucaaaaggccuuccuuugcggaaaauuuucaaagucggguagccagagacaucaaaccucuuagccaggucugucuguucgguggcguccacuuuggcuaagggaauugggggagagcgcuugcugagcuccuuggcagcuuucucauacucaggggcaaguuucuugcaguguccacaccugccaaaaggaaggcaauuccaucaggaauuugucccagcauggguucauguauuagcuaagugaggugcagaggccaauccccaugggcccaaggaacucaguuacacccaccaaaucuuggaaugucuccuaggugagaaugacaagacaggccccacaggcacacuaaauuguuggaacaugagacucuugucguuggcauucacauccaagaggccuguguguguagacaggagcacagcaaacugguagaaagacaaggaaaaaagcaagagagccaccguccuaagaagggagaagauauucuuagaaucuaggggcugucaacaauauaaaucaggaguggcuuauugaggaggugacagcuuaugcuuuuuuggccuuaucuaauaucaaguauagacaaugguaacagacuagcuggauucaggggcugagagaggcaacaauguaaacaaagacagaggacuagaguguaacaaauucuuagccuacaaaccagagcaggagauaaacaggauuugcaacuaggauuaugauuaacagacuguguaggggccaaaguagcagaagaacacaugccuaucugacuggcacccagguuuauuuaaacuuuggcggcacacaaaccaccaaacaaaaaacaaacgauccacagcaugagaccccgaugacuuauaucugcucucaggcccucccaguuaacauaaacacugccuccuccagguccuuaauuaaaggguacauccuacaacaugucaaccaucugcaaguaaaggguaacucucuucuuagguaccaugagguuauaaggugcuuaaugagcuugcuagguccacagcuacacacaacuccugaguggucacuguggagguuggaaugaaaugucugucuccugucucccauuugaaugcuuggucccuacuuggugaugcuguuuggagaagcuuagaggcuguaaccuuguuggaggauguaugucaauagaagugggcuuucaagaguuaaaagauucccaccauuuucuaguuuguucugucugcuucacucugguggguccucagcuuccuaccccugcugccaggccugcacucugccaucauauggucuauuaucucucuggaaccauaaggccacacaaaguccuucuuuuauaagcugucucuguuauucucuuuccucacagcaaauaauaguaacagucauaaaccagaauggguaggugacccacuaguacaaugucaugucucaccgaucaugucaggccucuucuauagcaauguaaggacuggcaucucuuuagcacucaagcugggucacaaaaggugccacuggcuuaucugcaccccaauacacuacguuauuuccuuccuucucccccaguuuguuuucccuuugggcaucccuuuguguugucauuucaucuguacacccaacaaugaacagauauagugguuuuugcugcagaauccagaaagccacaggucuggguucacacgggcccugccugagucagggcagacuagcuccuugcuauguaucagccacagucucugccugcugauucuaacacaacaaccuucuuuuccuugcugacacucagggccucauccaugcagacacuugagggaacuuuuauuuuauuuauuuuuaauuuauuuauuuacuuacuuauuuauuuuuuggagacagggguuaucuguguaauccugucuuuccuggaacuuucucuggaaccauaaggccacacaaauuguguagagcaagcaauuuagucuuuauucuagugacucacccaggcaaaugcugagucggcucaaaagucagagcccguggcaaggaaugaagaauucaccaagaugcugccucagacuauuuccugggaagucaacucccacaguuauauucaucucccuacaagucuuuuuucauccaggggugguaacacaugccugaauuccaggacuugagaaguuaaagcaggagacugcuccaaguuuguaggccaaccuaggcuacauaacaaggccaagaauaaagucacuagaauaaagauuaaauuaugaauuguggaugugagcacugggcaaaagagugguuggggcaagccuuuaaucccaggacuugggaggcagaggcagauggaucucugggaguuugaggccagcuugcacuacacaauuuguguggccuuaugguuccagagaaaguucucaagaaaucaaaaaacagacuggcaagaugguucagcaggugaaagugcuugucacgcaagauugacaacaugaguucaacuccccagaacaaaaauggaaagagagcaaguauuccacaaagcuguucucuuacuaccacccaugcugucucacacacacacacacacacacacacacacacacacagaguaaaguuuaaagugaggacuuguuuccuuccauguacaccccucccaugauuucccuuagucccagacgcuaccuuaaccuugcucuguauuaaccuugcuggcugugcacugcaacccuucaccaaugcuuagcagaauucucaacacucauuaucauaauaucaugaaucugacuguuaacauaccacggggcauagaacuccaccaaaauaaugucugcauuauuuacaacaucgucaaaguuaucuuuagucaaugaaagagugacuucagguggagguguccaaucaggcugggaaacuucucugacuuuggcaacaauuucuaaaaaauaaaacaacagaaaaacaugagacucaauguaugaccaggacggaccucucagcaacugcuccaaugugugcugccucucaccaugcuccccaccaccucugaaacccuaagcaaggaccuuccuuaccaauuaaaugucuuuucuaagaguugccauguucauagucucuucauaggaccagaacaguaacuaugacagauacagauaaaggcgaccauuuguaugcgugagagaauguguguuuucuuuuaaauguauauauaccgguguauggaggccagaggccagaggucaaccuuaagugcuuuuccuuagguaccauuccccaacagcucacauccuggagcucaccuuccuggguccuggagccaucauagucaacggccugucccuucuucaggaucuugauggugggguagccacucacaucaaauuugcuggcuagcauggaugcugagguugcaucgaucuucgcuacagcaaugggaggaucauuauccuucaaaguacuggcaauuuucucauauucuggagcaaacugcuugcaguguccacaccugagaaauuuaagggagaagaaaaagaauuaccuguauccaagagauugaaauccaacaaaacguuaaaaaaacagagguuuucuauagaaagacuuauaguuuagauaccauacacaaaacaaaucgcuuuugcaauuaaaaaaaaaaaacauaaaaucccugauauauaaaacacaaauaaaaccucaaaacugcuaaaaggaucacuuaucuuauagaaaguaaugguuucaaaucacauauuagauaaauaauucgagacuaccucagaagugaaacagagagagcacagaaggaagagaaaagaacagaagggacuaugaaaugcaaaacagcacaagagaagugggaggaauugaacaguucccaugcaugaaagcaugagggguaaaacaggaaaagaauuuguaucugcuuccccagagcucuguacaagagaacaaaaauaagacaagaaaaucacccccuggucagcagccugcaccuggagcugccucugccagccuguucagaaacuaugauuaccauucuauggugggggcugacuaaaggcuaccuaaugccagccgggaggacagucuccaguuuccaacacccugacaucaaguugaaguccuagaguuggugaggugacacagcagguaaaagucacuugccaccaagacuguagaucccaguucuagccccuggauccacaaugguagaaaaaugacuccugcaaguuuuccuuacuuccacaagcaugcuauagcacacacacaaaauaugcaauaauaauaauaauaauaguuaauaauaauaauagcagcagccccaucucaaaaacaaacaaaauguaauaauaaaauaaaguaguaggaaaaaaaauggaagagcuggagcucuugcagucagauccucauuuccccuggggccugcauggccugaggaggcugucagaucgaaguugucggugcuuaccauggugcauagaacuccaguagcacuguaucuuugucagccacaaaguuaucaaaguucccaucauuuaagacccaaacaccauuuucuuccuuaacuuccaagucaucgucauccucuuccucuuccuccucuuccuccucaguggcauuuucuguaucugaaguaucugaccagaagagacccaugcugguuaagaaacccaucacguucuccucuacaacuauaccagaggcccaaacucuuaaaacgcgucaugguggccggauauccuuacccuacaaaucccguuccaccucuguaaacuauauggcuacuuuacauuccaaguaggaacacaucguggccaugccauggagucaaagaccauuguccugcuguuuucuagaaccucaauaaaccuuucccagugacacuuuaccugccuguucccuccaaaugugcagauaucaagauuuacccucugguacauacauaaauucuacuucugaaaaagcugugucauuccacuucauauucuuuaaaaauaucccacagggcugcuccuucaggagacagcuggaggggaagcaugcuuuucuuagaaagccagccuugaguaauacucugagaggaaaagacuaugaaacaaugacaacuuuacagacuuagggagccagccgggcgugguggcacacgccuuuaaucccagcacucgggaggcagaggcaggcugauuucugaguucgaggccagccuggucuacaaagugaguuccaggacagccaaggcuacacagagaaacccugucucgaaaaaaccaaaaacaaaaaaacaaaacaaaacaaaaaaccagacuuagggaaucaaccugcaucaaauacacacaaaaaauuauacuuugcuggaagcaauccccacccccccacccccgccagaaugcaagagaguguuauuguguuaacuuuuaaguuguucuuucuaaacugcaugaaacucugggccucccugaggaguuucuccauggacugccauggcagcaagcagaucuaugugcagcaagcacacuauuccuuucacccggagccagagugugucaaagggccaauucuuuucucaggagcucagucaacaacacugccgguaacuaucugggacugagugcacucaaggccugaaaccugcucccaggauccuggaaccccugagacuuguggaauguaugaaguaacucaauacuggcucuauaacuguggguacauagagaccccccgaguuucacccacaugucccucacacuguucuuccacaaugcugaaguucugggguuaucggguuagcuuugaucauuauuaacggacuuuaccaaucuguaaaaucauucaaaaauccuagcucugccucaucucuacuucucauaucucacucacuucccccacuccacagccuuuucuugccucacucauccuuuccucgacugaggccuacauucuucugauguuagaguaagagaaauagcucuaauaugcccacuuucagaguaaaaaccaagcuggcgugugcuucucuugcccaccgcuaccuccuucugggcaccaucaaaacagguguuaaggacagagaggaaguaaggggacagguucucaggcauucaggaggaacagaguagagaagaugugggucucugauugagcuugacauuugacaguacgaggguaccuauuuauugcaugguuccaugauacauguuauuuggacaacucccuagggaacagaggacaagcuuccucagcaagguuuuguucacaucuuuccagaauguucaggaacugaggauacgggaggacauacauaccacacaaaauacaacaagccucugcucugugacacucaaaaaauggugccuagucuacugacauacuuuuuugaaagaaccagaauuaagucauaauacacaguuuguugauauugauuaaagccaagcggcugcuguuccaggagggcuggugauacaagcuuagucccuuacacucaaucugaauucaccaggcugaauccacucucaaucaugacugacaauccacaccauauauacugguacucacagcaaccaauucuuugggacccucaauauuuaacacuaaauucaucaagcucaaggcugcugguacuucaagagcuuugccuacuacaaccuaacaggaagcaccuacuggccaaugccaggacuucacguauguuacacaaguagcccacuaaucacaguggcuuucuaggagacaaacugaauacuucccacuccacuugaucugcuggaugcaaggaugcauugcaauuucugcccgguggccaccucaucugugcauuuaggaggcuggagagguuagguaggguuuauggucauccacauucauccuggcugcaggcuaucaguucuagucagggacuagagagaaagcacugugaaauuuuauccccucuucaagcuagggaacauggcuaguagaggaagggaauccugauagucuacccaguuacaggaaagacuuaugcauacagugaaaaaguaacccagccuggugguugugggcacaccuuuaaucccagcacucaagaggcagaggcugguggaucucugaguucaaaaccagccuggucuacagagugaguuccaagacagggcuauacagagaacuucuaccucaaaacaaacaaacaaaaaacaacaacagaaacccgaacaaaccuuaaacaaauaaaaagaaaaaaaaaaucagcaaaaaccugaaaccaugcaugcuugguuaucucagauuaaauuuuuaaaauuuuaaugugagauguuauuucugaguguuuauuucuguuuuuaaaguuuuauuuuaaaaauuauguguaaguaggugcauaugagugcagguucccagaggcucuguccuggagcuagaguuacagguaguuguaagcuaucuaauguugguuguuaggaaucaaacucagguccucuggugggacagaacauacucuuaaccacggagccauuuugccagcccucaggauuguuuuguugugauagagaucaaacuuagggucuuccacauuugagauaacugcucucccacggauuuacaucuccauccacuagguuuuuuuuuguuuguuuguuuguuuuuguuuuaacucuaucuacguuccccugauuagacuucacuuuuaaagucaaacauuccagcuuggaaaagcauauccaaaacuuccgaguaccuucugaaagggugcgaucucuuuuggcauaaaccaaaugaaacaucucacauccugucuacaaccaccugaugaugacacugcaucccugaccaggccaggcacugguacuuacuucuucagcaaggccacacuccaccuugccgaggagcuaguauuggcugaacaaacaaucauuaggccaaacucaaacaguaaagagugaacaacaacaacaaaaacagaacaacaacaacaaaaaccagaacguuaacuagugcucaaucaggagagaugauacuuaguauggaccaagcacaaugagugaaacugcauucugccucccuuugcagugcaauaccuugcacaugguagguaacugauauaucacuaaaccacacugccagcccuaccaaaccugagaaccuagccuaagagggcugucuuuggcccagacaccccagggauucuuggguucaccaagagcaaacacucccccagagacagcaccagugacccaaaagauauaccacuggcuagucuaaacaaccuuugaaauccacucacccaggccucucaagaagucacacuuuucacacuuccuggcauuuuaaccccugcccagaggcaggcagagcucuugagcucaaggccagccuggucuacaugaugagcuccaagcuacauaaugagacccccaucuugaacaaacaaacauacaucacccuaaaacugaccacugucucacaaccguguaguuuuuaacacguucuuaaagcauacaccaaacuacacugguucucaaacuuucaugugucccccacaaagccuauucugcuuugaaaagugaaaaauuugcuuaaaaugaagacucugcccucuuucuguuucaauguauuuugggucucuauaagaaaugagcccucagucaguuuggacaaaagugccaagauauacucauagguaggacggauaguuggccccuuucagcagucucuucauuucuacucuuuccuaccugggcaaagacucauaaaucaaugauccacaggaaucuuacucaaccuaggaguauaaaguucacauucccccuccacacuaaacuuuaaaaaugggguuuguuuauauuagacuaaaccuaguaggcaacaaguuagugguuagaagggaaaggugucgaucagacccguucucuaggaacaacguuaacuaguacuuccuauuuucaaaguuuuuauguuuucgguagaggauuucgaagaaagggugcgggcauaacgucuaugaguuacacauacuguuccuacuagaauacaugcaccaccagccucgacuuucaaaacacagugcagcgacuggcaaaaaaaggcgcugaauaaaaugcuuguauacggcagcuccaguuuccauaaaagacgaaaacaaagccugaguuauuucuacuucuugauauagaugcccaguaucugcgacugccucuuccagguccuacuagcggccaucccgccuccguuuucuaaaaccgguuuuggaaacgagaguauucuccagaaaauuuuacucaacaaaggggcaaaucucaguagugaggguaaagagacgagcugcgaaccaggcacucggcacgucccuccguguccuagucucagguaggaacuaaagaggcccacaccccuagauucggcccuacacugaaacuccauuaaguucguugcuaccgggucacuaauuccgcaggggugugagcgaagcacccugucaggccccagcaagguuugcaacccacgcgagcugcuccuccgacccgcccucccgcucaccuucgugugcaucuccggcgcucgcagcagccagcagcugugucagcgccaagagcaggaccaacagccaagcuuuccggagcuucaugauugggugcagagcugggccugcagacaccggccaccgcagagcacucgccgaccucccgagcgacgccggagcgcaccaaagccuccaggaaguucaggccggugauugguuggagguaaggaagccgcggcccguccaauccccgcacgaaucagggcgagagccguggcgccccgccuacaccgccccgccccgcugccugagcccuccg

SEQ ID NO: 2965 - RNA, 19017 nt, Mus musculus
cggagggcucaggcagcggggcggggcgguguaggcggggcgccacggcucucgcccugauucgugcggggauuggacgggccgcggcuuccuuaccuccaaccaaucaccggccugaacuuccuggaggcuuuggugcgcuccggcgucgcucgggaggucggcgagugcucugcgguggccggugucugcaggcccagcucugcacccaaucaugaagcuccggaaagcuuggcuguugguccugcucuuggcgcugacacagcugcuggcugcugcgagcgccggagaugcacacgaaggugagcgggagggcgggucggaggagcagcucgcguggguugcaaaccuugcuggggccugacagggugcuucgcucacaccccugcggaauuagugacccgguagcaacgaacuuaauggaguuucaguguagggccgaaucuaggggugugggccucuuuaguuccuaccugagacuaggacacggagggacgugccgagugccugguucgcagcucgucucuuuacccucacuacugagauuugccccuuuguugaguaaaauuuucuggagaauacucucguuuccaaaaccgguuuuagaaaacggaggcgggauggccgcuaguaggaccuggaagaggcagucgcagauacugggcaucuauaucaagaaguagaaauaacucaggcuuuguuuucgucuuuuauggaaacuggagcugccguauacaagcauuuuauucagcgccuuuuuuugccagucgcugcacuguguuuugaaagucgaggcugguggugcauguauucuaguaggaacaguauguguaacucauagacguuaugcccgcacccuuucuucgaaauccucuaccgaaaacauaaaaacuuugaaaauaggaaguacuaguuaacguuguuccuagagaacgggucugaucgacaccuuucccuucuaaccacuaacuuguugccuacuagguuuagucuaauauaaacaaaccccauuuuuaaaguuuaguguggagggggaaugugaacuuuauacuccuagguugaguaagauuccuguggaucauugauuuaugagucuuugcccagguaggaaagaguagaaaugaagagacugcugaaaggggccaacuauccguccuaccuaugaguauaucuuggcacuuuuguccaaacugacugagggcucauuucuuauagagacccaaaauacauugaaacagaaagagggcagagucuucauuuuaagcaaauuuuucacuuuucaaagcagaauaggcuuugugggggacacaugaaaguuugagaaccaguguaguuugguguaugcuuuaagaacguguuaaaaacuacacgguugugagacaguggucaguuuuagggugauguauguuuguuuguucaagaugggggucucauuauguagcuuggagcucaucauguagaccaggcuggccuugagcucaagagcucugccugccucugggcagggguuaaaaugccaggaagugugaaaagugugacuucuugagaggccugggugaguggauuucaaagguuguuuagacuagccagugguauaucuuuugggucacuggugcugucucugggggaguguuugcucuuggugaacccaagaaucccuggggugucugggccaaagacagcccucuuaggcuagguucucagguuugguagggcuggcagugugguuuagugauauaucaguuaccuaccaugugcaagguauugcacugcaaagggaggcagaaugcaguuucacucauugugcuugguccauacuaaguaucaucucuccugauugagcacuaguuaacguucugguuuuuguuguuguuguucuguuuuuguuguuguuguucacucuuuacuguuugaguuuggccuaaugauuguuuguucagccaauacuagcuccucggcaagguggaguguggccuugcugaagaaguaaguaccagugccuggccuggucagggaugcagugucaucaucaggugguuguagacaggaugugagauguuucauuugguuuaugccaaaagagaucgcacccuuucagaagguacucggaaguuuuggauaugcuuuuccaagcuggaauguuugacuuuaaaagugaagucuaaucaggggaacguagauagaguuaaaacaaaaacaaacaaacaaacaaaaaaaaaccuaguggauggagauguaaauccgugggagagcaguuaucucaaauguggaagacccuaaguuugaucucuaucacaacaaaacaauccugagggcuggcaaaauggcuccgugguuaagaguauguucugucccaccagaggaccugaguuugauuccuaacaaccaacauuagauagcuuacaacuaccuguaacucuagcuccaggacagagccucugggaaccugcacucauaugcaccuacuuacacauaauuuuuaaaauaaaacuuuaaaaacagaaauaaacacucagaaauaacaucucacauuaaaauuuuaaaaauuuaaucugagauaaccaagcaugcaugguuucagguuuuugcugauuuuuuuuuucuuuuuauuuguuuaagguuuguucggguuucuguuguuguuuuuuguuuguuuguuuugagguagaaguucucuguauagcccugucuuggaacucacucuguagaccaggcugguuuugaacucagagauccaccagccucugccucuugagugcugggauuaaaggugugcccacaaccaccaggcuggguuacuuuuucacuguaugcauaagucuuuccuguaacuggguagacuaucaggauucccuuccucuacuagccauguucccuagcuugaagaggggauaaaauuucacagugcuuucucucuagucccugacuagaacugauagccugcagccaggaugaauguggaugaccauaaacccuaccuaaccucuccagccuccuaaaugcacagaugagguggccaccgggcagaaauugcaaugcauccuugcauccagcagaucaaguggagugggaaguauucaguuugucuccuagaaagccacugugauuagugggcuacuuguguaacauacgugaaguccuggcauuggccaguaggugcuuccuguuagguuguaguaggcaaagcucuugaaguaccagcagccuugagcuugaugaauuuaguguuaaauauugagggucccaaagaauugguugcugugaguaccaguauauaugguguggauugucagucaugauugagaguggauucagccuggugaauucagauugaguguaagggacuaagcuuguaucaccagcccuccuggaacagcagccgcuuggcuuuaaucaauaucaacaaacuguguauuaugacuuaauucugguucuuucaaaaaaguaugucaguagacuaggcaccauuuuuugagugucacagagcagaggcuuguuguauuuugugugguauguauguccucccguauccucaguuccugaacauucuggaaagaugugaacaaaaccuugcugaggaagcuuguccucuguucccuagggaguuguccaaauaacauguaucauggaaccaugcaauaaauagguacccucguacugucaaaugucaagcucaaucagagacccacaucuucucuacucuguuccuccugaaugccugagaaccuguccccuuacuuccucucuguccuuaacaccuguuuugauggugcccagaaggagguagcggugggcaagagaagcacacgccagcuugguuuuuacucugaaagugggcauauuagagcuauuucucuuacucuaacaucagaagaauguaggccucagucgaggaaaggaugagugaggcaagaaaaggcuguggagugggggaagugagugagauaugagaaguagagaugaggcagagcuaggauuuuugaaugauuuuacagauugguaaaguccguuaauaaugaucaaagcuaacccgauaaccccagaacuucagcauuguggaagaacagugugagggacaugugggugaaacucggggggucucuauguacccacaguuauagagccaguauugaguuacuucauacauuccacaagucucagggguuccaggauccugggagcagguuucaggccuugagugcacucagucccagauaguuaccggcaguguuguugacugagcuccugagaaaagaauuggcccuuugacacacucuggcuccgggugaaaggaauagugugcuugcugcacauagaucugcuugcugccauggcaguccauggagaaacuccucagggaggcccagaguuucaugcaguuuagaaagaacaacuuaaaaguuaacacaauaacacucucuugcauucuggcggggguggggggguggggauugcuuccagcaaaguauaauuuuuuguguguauuugaugcagguugauucccuaagucugguuuuuuguuuuguuuuguuuuuuuguuuuugguuuuuucgagacaggguuucucuguguagccuuggcuguccuggaacucacuuuguagaccaggcuggccucgaacucagaaaucagccugccucugccucccgagugcugggauuaaaggcgugugccaccacgcccggcuggcucccuaagucuguaaaguugucauuguuucauagucuuuuccucucagaguauuacucaaggcuggcuuucuaagaaaagcaugcuuccccuccagcugucuccugaaggagcagcccugugggauauuuuuaaagaauaugaaguggaaugacacagcuuuuucagaaguagaauuuauguauguaccagaggguaaaucuugauaucugcacauuuggagggaacaggcagguaaagugucacugggaaagguuuauugagguucuagaaaacagcaggacaauggucuuugacuccauggcauggccacgauguguuccuacuuggaauguaaaguagccauauaguuuacagagguggaacgggauuuguaggguaaggauauccggccaccaugacgcguuuuaagaguuugggccucugguauaguuguagaggagaacgugauggguuucuuaaccagcaugggucucuucuggucagauacuucagauacagaaaaugccacugaggaggaagaggaggaagaggaagaggaugacgaugacuuggaaguuaaggaagaaaaugguguuugggucuuaaaugaugggaacuuugauaacuuuguggcugacaaagauacagugcuacuggaguucuaugcaccaugguaagcaccgacaacuucgaucugacagccuccucaggccaugcaggccccaggggaaaugaggaucugacugcaagagcuccagcucuuccauuuuuuuuccuacuacuuuauuuuauuauuacauuuuguuuguuuuugagauggggcugcugcuauuauuauuauuaacuauuauuauuauuauuauugcauauuuugugugugugcuauagcaugcuuguggaaguaaggaaaacuugcaggagucauuuuucuaccauuguggauccaggggcuagaacugggaucuacagucuugguggcaagugacuuuuaccugcugugucaccucaccaacucuaggacuucaacuugaugucaggguguuggaaacuggagacuguccucccggcuggcauuagguagccuuuagucagcccccaccauagaaugguaaucauaguuucugaacaggcuggcagaggcagcuccaggugcaggcugcugaccagggggugauuuucuugucuuauuuuuguucucuuguacagagcucuggggaagcagauacaaauucuuuuccuguuuuaccccucaugcuuucaugcaugggaacuguucaauuccucccacuucucuugugcuguuuugcauuucauagucccuucuguucuuuucucuuccuucugugcucucucuguuucacuucugagguagucucgaauuauuuaucuaauaugugauuugaaaccauuacuuucuauaagauaagugauccuuuuagcaguuuugagguuuuauuuguguuuuauauaucagggauuuuauguuuuuuuuuuuuaauugcaaaagcgauuuguuuuguguaugguaucuaaacuauaagucuuucuauagaaaaccucuguuuuuuuaacguuuuguuggauuucaaucucuuggauacagguaauucuuuuucuucucccuuaaauuucucagguguggacacugcaagcaguuugcuccagaauaugagaaaauugccaguacuuugaaggauaaugauccucccauugcuguagcgaagaucgaugcaaccucagcauccaugcuagccagcaaauuugaugugaguggcuaccccaccaucaagauccugaagaagggacaggccguugacuaugauggcuccaggacccaggaaggugagcuccaggaugugagcuguuggggaaugguaccuaaggaaaagcacuuaagguugaccucuggccucuggccuccauacaccgguauauauacauuuaaaagaaaacacacauucucucacgcauacaaauggucgccuuuaucuguaucugucauaguuacuguucugguccuaugaagagacuaugaacauggcaacucuuagaaaagacauuuaauugguaaggaagguccuugcuuaggguuucagaggugguggggagcauggugagaggcagcacacauuggagcaguugcugagagguccguccuggucauacauugagucucauguuuuucuguuguuuuauuuuuuagaaauuguugccaaagucagagaaguuucccagccugauuggacaccuccaccugaagucacucuuucauugacuaaagauaacuuugacgauguuguaaauaaugcagacauuauuuugguggaguucuaugccccgugguauguuaacagucagauucaugauauuaugauaaugaguguugagaauucugcuaagcauuggugaaggguugcagugcacagccagcaagguuaauacagagcaagguuaagguagcgucugggacuaagggaaaucaugggagggguguacauggaaggaaacaaguccucacuuuaaacuuuacucugugugugugugugugugugugugugugugugugugagacagcaugggugguaguaagagaacagcuuuguggaauacuugcucucuuuccauuuuuguucuggggaguugaacucauguugucaaucuugcgugacaagcacuuucaccugcugaaccaucuugccagucuguuuuuugauuucuugagaacuuucucuggaaccauaaggccacacaaauuguguagugcaagcuggccucaaacucccagagauccaucugccucugccucccaaguccugggauuaaaggcuugccccaaccacucuuuugcccagugcucacauccacaauucauaauuuaaucuuuauucuagugacuuuauucuuggccuuguuauguagccuagguuggccuacaaacuuggagcagucuccugcuuuaacuucucaaguccuggaauucaggcauguguuaccaccccuggaugaaaaaagacuuguagggagaugaauauaacugugggaguugacuucccaggaaauagucugaggcagcaucuuggugaauucuucauuccuugccacgggcucugacuuuugagccgacucagcauuugccugggugagucacuagaauaaagacuaaauugcuugcucuacacaauuuguguggccuuaugguuccagagaaaguuccaggaaagacaggauuacacagauaaccccugucuccaaaaaauaaauaaguaaguaaauaaauaaauuaaaaauaaauaaaauaaaaguucccucaagugucugcauggaugaggcccugagugucagcaaggaaaagaagguuguuguguuagaaucagcaggcagagacuguggcugauacauagcaaggagcuagucugcccugacucaggcagggcccgugugaacccagaccuguggcuuucuggauucugcagcaaaaaccacuauaucuguucauuguuggguguacagaugaaaugacaacacaaagggaugcccaaagggaaaacaaacugggggagaaggaaggaaauaacguaguguauuggggugcagauaagccaguggcaccuuuugugacccagcuugagugcuaaagagaugccaguccuuacauugcuauagaagaggccugacaugaucggugagacaugacauuguacuagugggucaccuacccauucugguuuaugacuguuacuauuauuugcugugaggaaagagaauaacagagacagcuuauaaaagaaggacuuuguguggccuuaugguuccagagagauaauagaccauaugauggcagagugcaggccuggcagcagggguaggaagcugaggacccaccagagugaagcagacagaacaaacuagaaaauggugggaaucuuuuaacucuugaaagcccacuucuauugacauacauccuccaacaagguuacagccucuaagcuucuccaaacagcaucaccaaguagggaccaagcauucaaaugggagacaggagacagacauuucauuccaaccuccacagugaccacucaggaguuguguguagcuguggaccuagcaagcucauuaagcaccuuauaaccucaugguaccuaagaagagaguuacccuuuacuugcagaugguugacauguuguaggauguacccuuuaauuaaggaccuggaggaggcaguguuuauguuaacugggagggccugagagcagauauaagucaucggggucucaugcuguggaucguuuguuuuuuguuuggugguuugugugccgccaaaguuuaaauaaaccugggugccagucagauaggcauguguucuucugcuacuuuggccccuacacagucuguuaaucauaauccuaguugcaaauccuguuuaucuccugcucugguuuguaggcuaagaauuuguuacacucuaguccucugucuuuguuuacauuguugccucucucagccccugaauccagcuagucuguuaccauugucuauacuugauauuagauaaggccaaaaaagcauaagcugucaccuccucaauaagccacuccugauuuauauuguugacagccccuagauucuaagaauaucuucucccuucuuaggacgguggcucucuugcuuuuuuccuugucuuucuaccaguuugcugugcuccugucuacacacacaggccucuuggaugugaaugccaacgacaagagucucauguuccaacaauuuagugugccuguggggccugucuugucauucucaccuaggagacauuccaagauuugguggguguaacugaguuccuugggcccauggggauuggccucugcaccucacuuagcuaauacaugaacccaugcugggacaaauuccugauggaauugccuuccuuuuggcagguguggacacugcaagaaacuugccccugaguaugagaaagcugccaaggagcucagcaagcgcucucccccaauucccuuagccaaaguggacgccaccgaacagacagaccuggcuaagagguuugaugucucuggcuacccgacuuugaaaauuuuccgcaaaggaaggccuuuugacuacaauggcccacgagagaaauaugguauggcugcuaccuuccucguaguguguggaaagggacugucccuugcacagcugggagcuagaggauguggucagcugcaaggaucuuccucagacaugugcucugcuccuagggauuguugacuacaugauugagcagucugggccucccucaaaggagauccugacccugaagcagguccaggaguuccugaaggauggagaugauguggucaucauugggcucuuucagggagauggugacccggccuacuugcaguaucaggaugcuggugaguauguaagccauacuccugaggcuuugggggaaguaggcuguuuugcauaaaauuagcauaaugauuggguuguugccuaguauucaugagguccuagacucaaaccuuagccccaccaaaacagcaaaugcucuuccauaagaguauaucaguguagcaaaugcuugauggaagaaccaagggaguaacugugggaauuagcuuuccagccuugugcugaggcugugggucagguccuuguggcugucauacauaguuggugccguguauaaucacaugcuaaaugugaaaaaccagcugcacugucuccccaccggacacaaucacauuaauucagguuguuugccuuccuccucuccuagaaagaacagcgcugacuugggccuggauucagguccuggcccuugcuaguuaacuaacacugcucacacgcuggcuccaucaggccaguguuuguggguuuuaggauccucagugccaccuuuuccucauuucccccuucacacagcacaaguguagucuacuucaucacuaaguuuccuuucagcaugucacuugucaccuugugcugaucucuccguggcauagcaaugcuuguacauacuuucaguucaggcuggugauuuauuuguuuguuuugagagaggaccucuguguagcccugguuuuacucuguagaccacacuggccucaaacucacagagaucugccagcucugucuccgaggugcuaggauuaaagauguaagcuguacccagagcagccugcugcuuugucagcacuuuagagaagagcucaguuuaauucguguuucuuuagucuucacugguuaguuaacuaucaucugcucuuggcuaaucaggaagaauuuacccagggaaugugggaacuaagggggucagggaagaggagggagaggggauagcgugaguccggccagaguuccuccuauucucugggcagggggaugcgggaggacugccagacgcuuucuacucagcccuggguggacaucuaagccacugaccucacucagugggggauggacaaggggcagcccccaacugggggcgccccggggcuaugggaaagagggcugaaggagagagguucccacacaggagagaguccuuagucugggccuuuacuggaacacaggaaggccuuccauccggagaucagaaauggcuuguuaagagaaagccuaucccaucguccaagcgcagcgggccuugaugaacagagacagucuaugguuuuagagcuucauuguagaaaggcagggagaaaagagagaagguagaaagagagagagagaccggccaugcccaagaggagagaaaggggaaagagagagaaagaggaaaggcuagaaaguaagaaagagaggagagagugagagcgaggagaggagaggaugagagguuagagugagguggggccaagcagccccucuuauggugggcuguuaucuuuacuguugcuacauaacuggggaggaguguagccugaaggucagaagcuugggacauugucuacaugacuacuagccaugcuucuccugugagggcugugggggccguaacuucgacaggagccagaguuccaggagcauaagggaacaccuaccgugccauguaggugaauuaucaccacucugggguucagaccucggcucggcuggagaccagacugugcauagcccaaugcccaauaagggaaaguccagccuagccagggauuuggcuaaaugcagaguucuuaaucucgggacaagagcuugaaaccucuguaaagggcacuagguaugaaaccucaguguaaagucacaggacuauaugguacuugcauguucucugagagguacugucguccuggguuccaguuugcuacuugucauagauaggaggaaacauuugcuccaaacaaacaguucuaaauuucugugaauguauuauuuuguauuucugacaaauucuaagauggaagacuuagauauuauauuugugcugaacuuugaagcaggcuacuagcugggcaguggugucguacgccuuuagucccagcacuugggaggcagagacaggcagauuucugaguuugaggccagccuggucuacagagugaguuccaggacagccaggacuguacagagaaacccugucucgaaaaaacaacaacaaccccucccacacacacacauaaaugaaugaaugaaugaauaaaguccauucagaauuuacaguagcauucauacccuucaggcacuugguuggccaaugagggucauaaaacuguuacuuaaucaauuuaauauauucuguucauuugucagcuaacaaccugagagaagauuacaaguuucaccacacuuucagcccugaaauagccaaguuccugaaagucucccuggggaaguuggugcugacacacccugagaaguuccaguccaaguaugagcccagguuccacgugauggauguucaggugaggggggcucuucagaggcgugaagcguccucugcuaugucaguuccuggguauucuacgugcacagcaucuggacuuugaaauguggagaauuuucuuugcccacaggguguggcauaccugucuuagacacuguucuauugcuaugaagagacaucaugaccaaagcaacucucaaaaaggaacguauuuaacugggggcuugcaugugguuuuagagguuuaguccauugucauccugguguggagcaugguaagaggcagcaagcauuggagcgguugcugcaaggcccauccugacgcauaggcagagaaacugggcuuggcauacaagagcuuucgaaaucuuaaaacccacccccacuaacacaccucauccagaaaagccaaaccucuuuuucuuauucuguggaagaguuccacuccuuuuguauucaaaccuccuuucccagccuuugcuucucaccccacucuuaagcuucagggcacagaacaggagccuaaucagugaguguuguauuuuucccugaugaugcugguccauugugcugaggcuccugguguuggagcucugggucuuuaugggacccuguggggcaaguggaccuccuacccugggagaucucagaauugagaaugguggguauggggccagcucccugucaagcucuaccuguccuggaauauauaacuacgacaccccauuaagagggccuugacagucagucauguagggacaagaccuggagaccuacguucccuaugcagauagagcaucccuaacaucucagacugaaccagugagaagcaucuaccccuggaucccacccuccuccacauggaauaaagugcuugaguuaccucaacaagaacuaucuaagagugaccuugaguuuuaagugugagcucuagugaccuccagucucuaaaaccugaguucugugucccuuuagacacucacucugacauauauuuuaggugccaugcaaacuuggguuuccuugauacugaugaaacaucucacugaagaaccauauaggccaucauuagaggaguccauuguggagccuaguugaguacagcuguuugugugaaugcuaugcccucagcacacagcccccagagaaaaaaagugggcucggugugacagcucaccaaccacgucuuucgccugagucuaaauucuaaucugaggcuucccugcucucuaguacaaucugaaugcucucuaguacaaucugaagguuaaagguguggcugcguguggccagcugcagcgccuugccuggccauuuauuagcugcaauuguaucucaccuugucaucuguaaaagggauuucagggcucuuguggaccucaguuaacugacuauggaaaagcccgcaugguucaguccauguguauaguuacuguuuaagaccauuaagcuuuuucucauuggguuuggaguuccagucagaagaaauggugugauuagauggggugagugagcucacacaaacaucugugcuugacagugacucugacggcacguuagcuagagcucccuuuucauugugcuugcucuuagucuaugcugucuuugacacagggcucuacagaagcaucagccauuaaggacuauguagugaaacaugccuugccccuggugggccaucguaagacuucuaaugaugcuaagcgguacagcaaacgcccccuggugguuguauacuacaguguggacuucagcuuugauuacagagcuggugagagacccuaccaacaccuuuauagggcgggggcuaccauuuuuagacaucuuguucuagaacccuuaaaguuagugguaugggcauauuuuugccucuagcaucggauuucgaguucugagccauaaaguacccuuuuuccuuccugauuuaguaaaaggggaguuaagagucaaaccuagggcuaaagaguuggcucaacaggugaaaacagugccaauccugagguauuauacuaugcauucuauaauaaaaauuaaaacaaacaagaaaauagacgauaaaaaaaaaagucaagccuaguaccuucauagagaugauguagcagaucuggugcugaacuggcuucucagacagagcuguguugccaguacccaggucuccuggggcuuaguuggaguucuauccuuaagccagcugcuuacacaguguugcuauaccagaaauccuuuccuaucuggucgagguacuucugggucugggccuugucggagagcgucagugucagaaucuugaaucucacaguccagggcaggacaguucuucugcucagccacuuaguucacagccugugucuguuucagcuacucaguuuuggcguaacaaaguccuagagguggccaaggacuucccugaguauaccuucgccauugcugacgaggaagacuaugccacggaggugaaggaccuggggcucagugagaguggagaggaugucaaugcagccauccuagacgagagcgggaagaaguuugccauggagccagaggaguuugauucagacacucuccgggaauuugucacagcuuuuaaaaaaggugaguugggccacacauguuugugccucacaaggacaggugacacuccgaagcuuccgagccagcaaaggacucuuuuaucaagaaugaauaaaugauuuaaaaaaaaaaggaaaaaaaaaaaaagaauaagguagcacaugauagaggaagccaccuaaucuccucuccauagccccagaaaagaccugguagguccccuguuucucccugccccuccucacucuccauagcccacagaaaagaccugguagguccccuguuacucccugccccuccucacucuccauaguccccagaaaagaccugguagguccccuguuucucccugccccuccucacucuccauaguccacagaaaagaccugguagguccccuguuacucccugccccuccucacuccuaagcccucuccaacccauuuucugacuuaguuaccugaaaaagugccgauguaccccccaaacucuucgguaccaagacaacuuaaauguuacuucagacauuaggagguuuacuuuuuccucauuuuggcaaguuuucuaguauuuacuuugaaagcaaaagccggaugagggcccauucaguagcaucagucuaaagaagccacaguuugugguuaggcaaggauuccaggaggcaucuccagaugcaucccagucaggugcagcugaaagcucugugacuugagaacuugaccuggagcgucucuugcugccgaccacucgcacucaagagucuuacucuaggcgcuuccucuccugucccuugggguugggaaaauggagacagacucucuguucuuuguuuuugcuuuuugagacagagccuuacuguaucucauguuggccucaaucuugugauucuccugccucagccucucagaaugcuguuauuguaguugugugucacugugccucauaauuccucuuucauuuguuuuuaguuugguugguagguuuugguuuuauuuuuaggaaaaaaggcaagcaugacuuagaaacuuuucagagcucuuugaaacaaucuuuugaauaugaggaacacuugcuaugagacuccaagucuuuauuguccugacugagcaaagcaccuaauucucauugcuggccauuugguaccuaccggggcccuuacccauuuuggguacuuguuuuugucaucacagaguugauguuuuccccacgggguuuucagacuccguccuagugugcucaauaguucuccugcauuggucagugucucuguuagacugaauuuuguagagacugggagagugaagauaauuuuauuauagaauauugcccguuguuggggaagguuuuaaaggggcuaaguccccaccugugaguggggcuaauaacuccugguaguucagguugccucagugccugguucagauagaguggcaggauccaugggguuuuaaguacugacaccuccucuuuuuguuuuggcaggaaaacuaaagccagucaucaaaucacagccaguacccaagaacaacaagggaccagucaaggugguggugggaaagaccuuugaugccauugugauggaccccaaaaaggacguccucauugaauucuaugcacccuggugugggcacugcaagcagcuagagccuaucuauaccagccuaggcaagaaauacaagggccagaaggaccuggucaucgccaagauggaugcuacugccaacgacaucaccaacgaccaauauaagguggagggcuucccuaccaucuauuuugcucccaguggggacaaaaagaacccaauuaaauuugaggguggcaacagagaucuggagcauuugagcaaguuuauagaugaacaugccacaaagaggagcaggaccaaggaagagcuuuaaaggccuggcugugugcagaagguggaggcaccaggcacuaguggacagcauuggccaccaagcaugugagccaucagugaaauggcaggaucuugacuuuuuuuuauauuuuguuaaugccaccucaugcucugaauacugaauagccacgagugacuugaugauaguuuagaucagauuuuuauggaggauacaucuauuuuuaucauuuugggucuucuuuuuuuuuuuuuuuuuuuuuaacuauuuacuucaguaucucuucagacaaauaaguuuuggaucuucuguuuaagaaucuuuuuuuuuuuuuuuuaauuuaaacuuuaaaagucuuugccaaaucauguuguuugccuuuuauuuucuuguuuagcuuaaaaguagauaacuaucgguauguuuguuuuuuauuucuuccugcugaugacaccaaguugagggcucacucuccccugacaguuggccaggauguuguuucagccugauguuagagccauguccguguccagguugaacaguaucugaugcuggauggacauagccauuccaguaucugacacaccgugaugacagguaguaauggaguguggccacuacugguuccucaaaccagucccgcugcuaaaauaaaaugaucucagacagccuuagaaacuucggggugugggcuggugagauggcucaguggguaagcgcacccgaccacucuuccgaagguccagaguucaaaucccagcaaccacaugguggcucacaaccaucuguaacgagaucugacucccucuucuggagugucugaagacaguuaaaaaaaaaaaaguagaaaaguuguguagaaaaguugugguaggcugcuaauaaaugggaggguggggggaggcaugggguaaaauaaccucaauaacugauagacagcugggugugguggcucacaucuuuaaucccagcacagaggcagguggaucugaguucaaggccauccuggucuacagagugaguucuaggacaaccaggcuuacacagaaaaaccugccucaaaaaacaaaacaaaagagcugacuucuaagagauaacaacuaagcaugacaaaaugucaaauguucugaauuacaccucaugaucaggcaaacacucuuccagagguccugaguucaaaucccagcaaccacaugguggcucccaaccaucuguaaugagauccgaugcccucuucuggugugucugaagacagcuacagugugcuuacauauaacacauacguacauacauaggcagaguugaggcuucucagcagggagggucagccucugauggacuaacugcugcagaguuucuuuauuguugcucaaaaggcacuuuuagcaagucaguuuccacauaccaaaaccccuuaccugauugaggaguugucugaagaacacauuaccuaaggaauucucaggcaugcaagacuuccugguuugccaggagugucucaggacuaaguuacacaaggguguguuaaaucauucaggaaaagcaacuucuuaaaccuaagacaacaaugacuauaaaagguuacuucaaaaccugggugccaucgcucuggaauccaugccagauacaauggcuuugccaaaauucuacuguaacaaaaggugaagcagaaacggucauacugagguuggacauagcaacccaccaggaggaaaagaaucccuagagcaggcacaagagucagagacccacuuguucuacucaggagucccauaaaaaagacuaagcuaguggguauaauauauacacagaggaccuggugcaggcccguguagguccugugccggcugucucagucucgagcucauacgugccuugcuuaguugauucagaggccuuuguucuggugauucccccugagcucugaggggacgcauuugaugaggacgucucacuuaaagaugcuauugucuggcuguggggucucuguaucuguuccaaucuacu

SEQ ID NO: 2966 - RNA, 515 nt, Mus musculus
uugaaaaucaaaaccacucuuuccgccaucuuggcaccuguggaggccugcugggaacaggacuucuaacagcaaauaugucuggaaggcuguggugcaaggccauuuuugcuggcuacaagcgaggucuccggaaccaaagagagcacacggcucuucuuaaaauugaaggcguuuaugcccgagaugaaaaggaguucuacuuaggcaaaagaugugcuuauguguauaaagcaaaacacaauacagcaacuccuggagguaaaccaaacaaaaccagagugaucuggggaaaagucacucgggcccacggaaacagcuguaugguucgugccaaauuccgaagccaccuuccugcaaaggccauuggacacagaauccgugugaugcuguacccaucccagauuuaaacuaauggagaguaaauaaauaaaaguagauuugugcucuuguaaaaaaaaaaaaaaagaaaaaagaaaaaaaaaagaaaaaagaaaaaaaaaaaaaaagaaaau

SEQ ID NO: 2967 - RNA, 38675 nt, Mus musculus
cgccugcaguacucgcugcccacaaagcgccagcugaggggcggcugcagccggugcggcguaggcugcucgcuacucagcuccucugcgucccagcgcccccggaagcccgauugccgcgcgaguccugucagagcgagcaacgcgagaccgcuucucgccgucugccgagagcacugagcagccgggccugcgugugguggcgacucccgggacaggaccgggcagcggagggccauggcugaggcgaccgccgcuccgguaagggcgcugauggacgggcgucucugucacccgggccucgggggaggcgagggagcuggggacggcagcgggccuuguggcccgcgugggucugcggcugucguuugccccgcaaggccaccgcggaccgcagcgccgggcgacgccgcgggaccagggucugcaguuucuaaccuacacgcgccgcggugcuccgcgucagcccgcggaacggggaagugggcucgagguguuuuugcaauccaccagccauucuguacagccgcgagagcugucguugcuaggugcggcaggacagucaccugcguggcggggaagguaaaagccaagguguguccuuauggacugcgugaggacagacagccucgcgcgcccgggagggcaggcuguggcgccgcggggaccuuggaaggccgaccgagcgcaggcuuagccaguagugcagucgugcgugugcuuguuugcugcaggccugcagugggcccagccgugcaugcaccagagaugccagggcuaccaggacaacccgcacagucccugcacacagccauuaaggaagaggggauggucguuuaacagaacguucugauuggaaaguauugcuuuuguuugccaccuaagaaggcuuuggucagcucaaagagacuuuuuaaauaagucagaagucaggcaggucugcagaggaguagauaggaaguaaaaaagaaagaagaaaccaggggagcagcggggaggggcggggaauggaguagaggggaauacccuucaaguuuaauuuucccccaacccuuaaaaaagauaguagagcccaugguguaugcuauagguauaugccaugcugaaaacugucacauacuuuuaguucucuaguagucauguuuaggagguuaaaccaugaugguaacaugguggcucacagaggaguuuaaaauaggagaaucagaaauuuuaguauaugcuuggccaaauagccagagugugugucuuuaaaaaaagaaagaaagaaaagaaaaaaguaaaaaaaaaaguaaaaagaaagaggaaauuaauuucaguuaauucagugaaauguuauuuagcucaaaguauaaaaauauuuuaauaguaauauuauaaaacuauuaaugagauuuuaaacacaacacaucucaauugaacugagcacauuuaaaguccucaauaaucacuuggacucagugacuuugguacugaccagggcaagacuguuuuaugaagaagaauuuggaaauacugauauuuuuaauuuuaauuuuaagaaaucuuuuuagggguuauggagagauagcucagcaguuaaaaguaccaguugcucuugcagagggccccgaguugauuccuaacauucacauggugacuaacagcaaucuguaacuuuaauuccaaaguaucugaugcccucuucugacccuugagggcacugggcauguagauguugucacauauuuacaugaaggcaggauacagauacacauaaauaaaucuaaaugauuuaaaaauauuuuuauucuuugaaaauuuaauagaguguauuuugaccauuucacccuacugcuccuaacuccucucagauucacuccucccucccucauaguguccccaguuuuguguccuuuuuaaaaaaugauccaugagguacuucucauauacuccuugguguagggcauccacuggaguuugguugauuuaccaggggccacaaccuuaaaaauuggguuuucucuuccccagaagcuaucaguugucuguaacucugcaguuaugagugggagcucaugccccugucccuuucaaugcuauaguguugacuugcuugauuucaugcaggcggccauagcugauaagaguucaugagugcaguaguccugucaugucccgaagaaacucuuuggauccaguccaacucuggauuucagagucuugcugcccuuuuucuucaauggucacugagccuugggauuugggcacugccucauuucuguugagcacuucauugacaacuuuuuauuacuguugacaguuuuuugcuacugcuaccacuaccaccauuaccacuacuacuacuucuacugggucuucuugagacagagucucaccuauguaacccuaacugaccaauguguagaucaggcuggcuugaacucacagaaguauuucugccucuguaagugcuagaaucaaaugcaugugccaucgcaccagcugucuuuuguuuuguuuuugguuugcuuuuuaguguacuuuauaaguuaggagggcugguauucagaguucaaguggagagacuugcuuuaaauaaaaugaaacaucuuucuuugaaaaagaaagaaagcauuuucuaauaggcuugauguggggaggaguaaaagaguuuaggucuaauuauuucaauuuccuuuuucuauuucuucugaagacaggguuuuucucuguaucccugacugcccuggaacucucucuguagaccaggcugaccuugaacuuacagagauccaccugucucugcccuccuagugcugggaauaacagugugugcuacuaccaccuggccuauuucaguuuacuuacaguaagauaucaugucaucucuggagaguaagggugcuaucuggauaaguuucugcccucccugugugcucccugaaucaguagaugcagcauccaugaccuaagagcucacuuaaaguacaccaucuccuuuucacauucaccgaaugaaaauauguauuuuaacuagauuuggggaagggggggugcggaucaggacuugggguuaaggucuugcuauccguagcccuugcugccuugguacucacucuauagccagacuggacugaaacuuaacagcaguucuucuaacucaguuuccucagugcaaaggacaacuugggggacuugauucucuucuucugacauuuggaucucagagauugagcucagauaaucaggcuuuauuugcuguaagugccuuuaucugcuaagccaccucacuggcugauugcucagcucuuuucuaguuauuguuucacauuaguuugagaguuuguagaagccuggaagguacuagauagugucaagugcccccacugagcacugaccauugguguaugcugacagcaucucacgugguuguguaauuuucuuuuuaggucuaccugacuguagaagcaaacaaaaugugaaugauucagcucauucaaauuagaaagucagcugagcaagugagacuuagagacuggagugacaugggguugaaaguggcugaaguggucaagcagggaagaaagcaaagccauguacaggugguaggccaggagcacauggacucaucauagggcuacaguuauaauuaacagguuggagaccagaugaaaagagaauaagauagugcaugacgugaaaauggaaggcucuggucagagugguuuaucagguucagagaauuaggcuuagucuaacauccuauuuguuguacagauuucuugcuuuuaugauacucuuuguuucaaaguacauuaaacaaugaacaaacagccugugacuuucuuggaaagaaucuaauucaaacauuguuaccagucugaaauuuuccauguauuuuucuagucuguccuuggaguauaagauuaaacaaaccuguuuuaucuucuauuucauaacccuugaauacuugaaaguaguugucauauuuucucuagucuagacacccuuagcuuguuaaauuaugguacaguuguaguguguaagcugaaugauagacagggcuagcguaucaauguguaggagauuuguaagagagcacugaggucagugaaaucagagaauucuugugugcauuugccuuuuccagagauagagaaggcaauaagcaaccucaacuucugggccuuguuuuagaacaaauggaccaggcuagccuuaagaagcuauuauucacuaucuuuccuaauccauccuugaaccaucacaacaguuccuuggcuuuugauaucaacaggcuucagagcaacaagggcggacacaggcacuguaaaugcacuaaagcuauuuuguuuuguguguguggucccccccuccuaccccccuccaccaacaguuucuuuuguguagcccuggcugcccuggaacuugcuccguagagcagaugaccuggaacucgcugaguuccaccugccucugccucacaaauacuggguuagaggugugugccaccacugccugggaguuaaguaguucuuauuugguuguaguuuagaguguggauuccuucuaauucucaaugucuugccccauuuuuccauugcacauagacuucugaaugggacucggaaugccuuacaucccugcagccccuuccucuuccuacaccuccagcagcaaaugaggcacaucugcagacugcagccauuucccuguggacagugguggcugcugugcaggccauagagaggaaaguggagguccacagccggcgacuccuccaucuagaaggcaggacagggacagcagagaagaaacuagcaagcugugaaaagacaguggcagagcuugggaaccagcuggauggcaagugggccgugcuggggaccuugcugcaggaguaugggcugcuucagcggcgguuggagaacuuggagaacuuguugagaaacaggaacuucuggauccugcggcugcccccagguauuaaaggagauaucccaaagguaauacccuacuucugggcuacagcaguacgacucgcucagacacuugcaguaagaaguagucagugacugagauauuucuauuuccucuuaaaauuucuuagguuaguggaacugugaagggguuuuguguuugucuuugagaacuauacuguauuaaugauaucuuucuuuauuauuuauuuuuauuuugagauaguacuguaacccaggcuggccuugaacugcugauuuucugccucuaccucccaagugguagcauggcaggcaugggacaccaguggcucaguacacauggacagugucaaacucccagugagaaaacucuuucuaauccagacuuggcucucuggcaaaugaaguuuuuucccuuaauuucuuucacuuuuacgugcguaggagucacuucucucuuuguuaaacugucacaaucucagugggaaaaaggaguccaauaucauuuaagucagucaauuugaauucuguugacaauuuuggugaaaaguuggagggaagacugugugugggauuauagucaguggcuauuacaaggaccaggcucaucugugagucuaggcugucacagaacaggcaugcugagaugcuagugcucugucuucugaaggaacuaguuuagaaaacaggaaguuuggaugaucacuguuugacaguaauaugccuaguuuccagacauacuuguucacucauaauuuuuuucauagcacagacuuuuaaaaauucuuuaaaaaauuuuuuggguguaggcaugccuuuauuccuagcacucuggaagcagagaagccucuuugugacuuaaaggacaccguugucuacauagugguucugggacagccaggaauaaaaaagaaaaaaaaaaaagaaacccaaagcucauucgcucucucccccccccauaugugugugucugucugucuaucuaucuaucuaucuaucuaucuaucuaucuaucuaucuguggggcauaggauuuugauauguagcccacaccuguccacaauuuagaaucuugccucagccucucaaguaaugggauugcaggcaugagaccuggagucuacaacuauuucuugaauacauuuuugcuuguucuacauguuuuccugaagaaaaaaaaaaccuauaacacauaaaacacauuuaaauaauuuaauaaagguaaagauaggugcuuucuaguguucuguuuccaaauguauaccugagaaggucucacuaagaacccccuagccccacccuaaccacugucuagaacacaggguguuuuuaaaggcagaaacuacauccuggcaucuuggcucagcagcuccaggagagcuuugcagaaguacccaguuuguagcaagcaguuuuaacagaagcuaagauaaguggaggggguucucuauaaucaggcaguuuuaaggaaagcgaagauaguuagcuaggacauuuuuaccuuugguuccuagaauaaaguugcaucauuuuucuauggaaggagaucagauucuaguuaaaccuagaaugacuucaguaaaaauauaaaauggaggaaccucugcacugucuugcuucgucauaauacuucaggagguagaaggaaugaacccuuggcaguguuagguucaagaaauucaaggaagggugaagagccacugacauggagauuguauuguuaguuaugagauggaagagauggcucuagugagcauggauaacaagcgaucaagcuucagagguagaaggaggagugagcagaggaaccucagcaggauacacuggugagguaguaggaaaacaaacagcaaaguaggaggugccacagagcuaaggugccacagagcuaagguggaaaacagcauuucuagcagaguuaugauuugccaguuaccacacugggaggucuagaaagauaaggacagugaacaugacuggcaacauggcugucagaggagaucuugaccuaacuuguuuugaguggcaagauagagguagaagacagaauaccauaguuguagaguaaacagaaaaagaauaaugggacuagaguuucuuuguuuuucuuucuuucuuuuuuucuuagguguaaguauagaacuauuaaaaguaaggggcuggagaacacuggcugcauuucuagaggacccagguucuauucccagcauuuacauggaagcucacaacccguuaagggggaucuguugugguuuccacagguacaaggugugcauauggaacacauacaugcaggugaauaauaugcauuuagaaaaaguuguuuaagaugagaguagaagcuuagaauguacucuaggauuccucagaagcaaguguuguuuuucuccuuaucuuuccagagagaauuuauuaauacugcagcagauguauauauuauaaacauauguacauuauauagagauauauaacuuuuacaugauuaauuuauauaauauauauuauucauguuguuuuuacuuauaguaugguguuuuauuguuauaaaauccuaacauucugguguaagagaugggaacauaaccauuacuagcuuuaguaaaucauacagaguuauccaaggugucauagcaaaggaaauuucaaauucuuuucuucaugaguauuagcuagagucuuauuaaguacaaagaaaugaaggcuugaaguuuaaccagagucaggcaugguaaacacauaccuguaaucccagcauucaggaggcucaggcagaaaauuuuaugcaugaucaaggacagccugaucuacuaauaaguaacaggccaaucauaccaagcacacacacacacacacacuggacagaaauauuguucaauugccagagauugccuagcaugcaugaagcuguggcacuauauaacgcugaauaugauaacacauccauguaauuccaacacccaagagauggagagaagaucagaaguuuaaggucauucuuaucuauacagcaaguguaaagcuagccugugcuaagugagacuaccucaaaaaaaaaaaaaaggagugaaaaggcuuaugccuuuuaauccuagcacuugagaggcagaagcaggcaaaacugggucuugauauaguacuuccuacucuguauuuuauuugcauauuuugggcccuucagauguccuuugguaaucacuuaaauuuaguuuuuauuaauagaauaguaguuaauuuaguuuuagcaguuaaguuagugaaauaccuagagaaauacauaacauuuaacugucuuaaauuccaaaggcauauauaaaauaauacaauuccuuucagguauuucauuaugaaauuaaaauguguuuaguucuauucaaagcauacugaaaauuuggacuggaagauaugguucuguugguagaguguuuaacucgauuguacuaggcccugcuuuuaaugaaugucuccucccucccucccucccucccucccucccucccucccucccuuccuuccuuucuuuauuuuuaaugaguguaguuuuugaaaauuacauuuugucacauggggcacaugcuugccauagcccaugaguagaggucaggacaccacuuucucaggugucaggucucuccuuccaccuuguuuuuaaggcagagucucauuguuucucucagugcacuuucaucuuguuccaggaauccaucucagagugucaggcuuguugcaaacaucagcacuucacacgcugcuccauuuucuuagucuuaagucuaugaacauuuuaagagguuaaagaugcagagacuaaaagguuucagaaugccuguguuaagauugcaguuguuucuaauaucaucaucaucauuauuuuguguaccguuguuuugccuguauauguguguguucacugugcuuggugacuguuggggaccagaagaaggcauuagauccccuggaacuggaguuacaaauaacugcaagcugcuauauaguugcugggaaucaaacuuagauccucuggaagagcagccagugcucuuaaccacugggcuacccuuccccuugcagccguuucucuaaggcuccaagucauagcucuugugucuucuaguagagauguucuuuuucuacuagauacuuucacuguauucucaagucuggaaguguuguguauuuguuacuucauauucucuuuucucuaagacuucuuggugucuuuuucugaccuggauucauauucuggcuucucuucagaucuuaaaucuaaucuggguccauugcuuucuugaccuacuguacgugucuugugcuaggacuaccucuacucauuccuuuauggcaugcaguguguucuagcaccaguauacaucuuuacccauuuguuuccuggaguacauccccaaauuauuaagaaaaggcgcauaggaggcauacuucauauaggaaaucucuuuaauuuaaugugggagugccaaauacaguauuauauaccuguaaucccagugcuuaggagaucgaggcagaaggauugcugugaguacaagacuagucugagcuacauggcaaaaccauaucuacaaaauccaaaacagcaaaacacaaggaaacaacaaaaaugcagaggaauaauaauuuaauaugagauucuucuuuuagcuaguucuaugauuucugugaaaauacuucuuccuuaagagauuuugagacauugcuucauucucucucucuguuugguuuauucaaacaggauuucauuauauauccuuggcaggccugcaauucacuauauagacuauccucaaacucagagacuaaacccaaauuccaucuuuuuuagggucaucccaccucuauuagaaaucugcuuguaaaauguccugucucuguuaccaacuaccuaugaucauaugccuuuuuaaaaacagaaaucauacuuuaguuuuggugcuuagggagaacuuuguauguaguggauauuaagaacugcuuuguaguuguuucuacucugggugccugugaauaauggucucuguagccgccugccaccacacgaacuuggugaacuugguuacugggugggaggccugagcuguaagggaggaaaggugagagaagacagauuucuguucaaagacccaagguuuaccaagagucugugcuuauaaaggggggaggcccauccccugcuucuugauacuuuguugccaaguuguuagcacuagucugccagagcuguuagcacuaggucaauucccugacaauuccacagguuaucagcuaucucaggaauaucucagggagacagguucagccucucagcagguagcagagcagcagagcagcagugcagcagcaggugacagaacaauaaaaccuucuaggucagaaggcuccaccccagguagucucacucacaguggcagcaaagucagaaccagccugcucaaggcugggggaggcuacagucucaaagcauagagcucuagagguuaauuccucaucuuccaacaucuuuucuauuaugucagauaauacuuggcagcuaaauagauacuaguauuuacuuaaugaagucaagaauggugacauagaccuguaaucccaauacucuggagacugagacaugaggaucaugaauuucaggccaacuuaagauauacugugaguuccaggccaggcaggcuauauaaugagaccuuaucugaaauaguaaauaaaacaaauggaacauuauugaauaaggaagcuuuuuuuuguuuuguuuuguuuuuguuuuuuucgagacaggguuucucuguauagcccuggcaguccuggaacucacuuuguagaccaggcuggccucgaacucagaaauccgccugccucugccuccugagugcugggauuaaaggcgugcaccaccacgcccagccagaaucuugacaccagugacucaguguagcucagagguggaguaccucaccuagcacauguaagagccugaggucagcaguggguuuguaaugcaacaaaaccaaaccaaauccaaagacaguaaaaaguccaguggucugggcauggugacaucuaccugucauucuagcacuugagaggugaaguugggggugggggugggggcacgaguuuaaagccagucugggcuguaugagacucugucucaauuacuaaguaaauaaauaauaaaauagaguggaauaacuuguuaagucuucuagaaaguagaauguccagaggcugaagugucagaauuaagagcugaaaaagaauucugcuguucaaguagaaaaucccccaaagaggcugggcuugguggcacaggccuagaaucuaacacuggggagguggcgacaggaacaucgucuuaagcccauccuuggcuacaaagcaaguucuagauuagacugggcugcaaauauuccaucuguaaaaaacaauccaaacaguccuucaaagaccgugagaauaaugaguuuguucucuaaugucuaaaagugucagcuaaauuauaggcuaacugcuugggagaaaaacgcuacaaaacaguauuggaguguugcucagcgguacagcauuuguguggcacaucuaaagcccuaggguuaacaccagguauuacaagaaacaaaaguuagcagugucagacaaaauauccuuuaagucagccaguaaaccauauaaaauuggacaagaauuccauugacucaugaacuuuaaaaaaaaauucaaacuagauacaaaaaaauggagguagcaagaucucaacaugaacuggagagagaagaauaagauccagcaugagcuggagagccagauaaugaaggucucaagucagcuaacgaguacuaccaagcccucucagugcaaaggaagcugagggcuucugugcaccugaguucaggagucugagagcagccuuagcaguauaguaaagccugcauuccugaaaguaaaaacagaucaugaauuaguauguaaaguaagugaaguucaucagaaauuguggcacuuaauuuuacaaaugagaacaaauuugagggcuggagagaugauucaggcguuaaaggcuaggcaugcaacuaaagauguuaagaguuugguuccuaucacucaugacuuucucuccacccuaccccccaaaagaaagaaaaacuagaauuugagaacagauuagucuauuuagagaaaaugaaaauggagcaugauguauggaagcaaucugagaaagaucaaugugaagaaaaauuguugauuuuacagauggcauaagaguuagccagagaggaacuucagaguguuaguuaaacaucaacaaguugcaaacauugaaauacagaaaauggaaaaugcauugaaaauggaagaaaaaaaaaaagaaaauuccgauccaaaacagcaaauaggugguuuguggauuuaggugacaucuuuuuuuuuuuaguuagagaaugaauugcugaauucaaaccaaauauugaaggaaacaguggaagaggagaaaacagggauaauaaaauuuaagaagccaaacuaaaaacauguaaccagaaucuugcgcgcgcucgacucgaccagcaagaacuacgcugcaacaggauccuucugcacacguuuauugggagagcuugauugcagaggcgaaaagacuuuuugcccagagcuggugcugcuuuuauaggccuaggagaggcgugucucauacccugauugguuaugcacuaagccucauuugcauguuccucaucugauuggcugcucucucucaguaccucacugagccucauuaucauaccucauuugcaugucucacauccgauugguuauacucucaguaccuuacagaaccucauuaucaugccugggccaggcaguguuuuugcaaaaaacuuuacugcauauguacacauuggcuguuuguccaaucuuaugcaugguggccagcaguagucagugccacucagcaacggcacauguggcuucccacaucucccccuguuuguuuuaauaaaaugaggcuggacuaggccugugcaauuaugcccauccgccguggcuccuguuuuaggucggacugugcacgaggaaaguugcccgucucuggauaccgcagugcugugugacaauaacugcuaaaugaccuagggcgaacucugcaaaagaggccagccaaaaauugaauuaguggggaaaucaugaucacccuauugaugagcaagggcugaucaaugaucguugagucucucucaucuaaucucaugcugacuaauucuugagcauagauaaccaaauuucaggggaggagccguuuucaauagcuaaaagugccugaguuacaaucaccuugucacguuuuuguuggguucugaauuugcauaccaaccagagcaugaacgccaguccacagcauauggcagcaccaaacaaaaucacucccacccauuccuuaaaguaagaaaaagcagagguaaaccaagagguaaagucuccgagggucacugguuccacucuggucccauuaagguucaggaucugcaucugcagucucgucugcaaccucuccagcuccugcgaccaguucccuuucagguaauuugauaggucuguacuuuuaauaaaagaauuauuaauauacuuauugggaguaaugcacacaugcgauguggaugccacacaacucauuuguaugacauccaucauccguuccauauuauguuguaaaauauccacucucugauucacuaacauuaacccugaggcgauaugagaauccaccuuuugcaggguaagcaaugcuucagaggauuuuucugcuaucugacuuauggugucagcaguaucaauuugaugggccauugcaguuccugcgguaacugcugaugccgcggacacuacaauggcuguaacaauggcagcugugauuccaaaaccucucuuuugccgaauaagacucguuauugggaacuucucuggaucugccucaacaggcacagggacaaagauugguagaugaaccacuaaggcuaagaauuugguuccauuccagcauugcgucaaaaaacaaguaacauuuguacaaucuaaccauucuguauuauuuugaaauucagccaauauaaagaaaaauggaggauugacacaaacuucuacuggagaaguagucauauuaguugucacauuaucuaaaugaguagagguauuggaaagaguggcagaaacauucaauaucucaugaaagguuccagucagcaaugcaaaggcugacagacugguacuagcaccugccucauugcuuaaaauccauggguaauauggccaaauauuuucuuucccuguagcaucuccuuuaucguucauuauagcaaaaucuagugggggugacaaaacaaaacccuuugcuauuucuuuccgaggaaaaauuuuugauugacaaggugaaaaaacuauaggaaaugcgagguccggaugacaccaaggcaugcugcguauagcaguagcauugccaacaggccaucgugaucuuuugggaauggucaccuuucccuuuaucauaauaguggugauguuuauaggugaaauuauauuauuuucaacaucaccugagccugauugcgcuccuugagcaacuugcguuaaagcauuaaacaacacuccagagcucaccuuauuuuggcuaaugggaucugcccaauuagagauaaucuuuuucuuuaaaaauauacaggguguaaaagguuuauccacauuaugcacaaagcauaguguauaauucaaaugaaaacuaguacuauuauacacccguggcucuugaggaguuugucgugcacaaggcgcauccaaauaacauuccguugcaaaaaauaaaggcaagguagaagaauuggaauguaccgguaaagguacuggccaugaucuuacuauggcccacaaagguauacuuaucccggucucaaucaucaggagcaggagaaucaucuugggguucaucuugcucuuucacgguccuugucagucgcgucgggacccaaaguggauuuucuucacccugugggaaaauacaaauagcuccccgggaucugauuaaaauaggauccgggccauaccauuuauuaucaaggacauuuuuccauuugaccauuucauugggcgauugaggccauuguccgugccuuucagcuggugaucuuccagcaucauccaauuuuaaaaaauuaagaguaaauauuguaagggauagagccaucuuuggcgucauagccucuauucccccuuucuguuuuugcaaauauuguuucagagugcgaugggcucucucaauuaugccuuggcccuguggauuauagggcaauccaguaauauguuuuacuugcauuuguuugcaaaauuggcuaaauuuagaagaaguauaugcaggaccauuaucugucuuuaacacuaggggcuugccccaugcagcccaagccucuaagcagugagauaugacaugaacugcuuuuuccccugucaagggagaggcauguaggacaccagaacugguaucgauggauacauguacauauuguaauuucccaaaagaugggauaugcguuacguccauuugccaaacaucuaggggucgcaauccgcgaggauuaacacccacggaaggugcauuaacaaauucuacacauuuaccacaccguaggacaauaucucgggcuucuuuucuugugagcuuaaacuuuugucguaauguagaagcagggacaugauaaaguugaugaaaauuuuuugcacuuucuauagaacuuuguaauagaaaaaccaugucucugguggcugagucagcaauggcauuucccuuaaccauagguccagguaaugauguaugugcucuaauauguuuaauauaaaagggaugcucacgcaucaaaauacaauuuuguauuuucaucaaaauuucagauacaggacuggacuguuuaaaauuuccggcagucucuaaugcuagaaccgcauuaacuacauaaacagaaucagagacaauauuuaugggcauaggaaaucuuuuaaagacuucuaaaaccaccaaacauucuaccaauugaggggcuccugguguaaauugcaaccuuacagccuuuucauugauuacauaacuuccaacuccuguuuuggauccaucuguauaaauaucaauggcucccuuuauagggguauuagccguuaccuuuggaaauauuacuggaugcaauaacauaaaauguaauaacggauguuuaggauaaugauuaucaauuaaaccagaauaacugcaucuaagaauggcccauucaucuauaguagcacacaauauuugcauuugugcgacaguauacgggacaauuaugcuaucaggcauuuuuccaaagugagugauugaaguuuuuaucccuuugugggccauauuugcuaccauggugggauaaugcucuauaguuuuauuaggggauauauguggauguauccauacuaaaggaccauuuugccauaacacagcaguuggcagauugauggugcguaauaugcauaggcacaaagguucuugcucauuuauacgaguuaacugugcuguuuggaucgccuuuuccacuuuccuaagaacaucagaagccucagguguuaauugucucaaugagguaauaugugagucuccuucuaaaauuugaaauaaagguuuuaauuccgaaguagggauccuuaaauaaggucuaauccaauuuauaucuccuaauaauuuuugaaaaucauuuagugucuuuagauggucuuuucuaauacuaaucuuuuguggggugacacaucguaaaguaauaguggcuccuagaaaaugacuaacauuagacugcuguaccuuuucuggugcaauacucaaaccauuauuuuuuaaaguuucauuaagcaagccauaagcuugcuguauacuuucuucuucagguccacagauuacaaugucauccauauagugacaaauuuuuaaggaggggaaaccaucccuaaccgguuguaaagcuuuuccuacauauaacugacauaugguagggcuauuugccauuccuugggguaauacccgccauugguaccuuuuaucagguuccauaugauuaauagaaggcaaggugaaugcaaaucuagguuuaucuuucuuauuuaauggaauugaaaagaaacaauccuuaauaucuacuacuauaauucuccaauccuuagguagagcugagaguagggggagcccucuuuguacaggacccauaacuugcauuugugcauuaauggcucuuaggucauguaacaaucuccauuuaccugacuuuuucuuuacaacaaaaauggggguauuccagggugauugagugggcuccacaugucccagaucuaauuguucuuguacuaauucuuuagcugcuuuuaacuucucagaggguaaaggccauugaggcaccuacaccauguccuccguaugcuacgggaugggcaaaggcucuucaguggccccuagaaaaaacccagcccuuucuugucugccuuuacaguggcuuuaacugguaaaauucuaccuugcaaaauuuuuccaagaccuaguccagguauauaucccauuccuuucaucauuuccuugcuuuucugagaguaaucauuagucaauauaaaguucauagcugauaacacaucucucccccacaaguuuacaggcaaagggaguacguaugguugaaaaagcccuguccuuccuucuuuaucuuuccauuguaaggauuuugcacuuauaguugggguagccucauauccuaauccuuguaagcuaugugaugauugauuaacaggccaagaagcaggccaccacuuacuagauauaaugcuuuuaucugcuccuguauccauuauaccuugaaagguuuuuccuucuauuuguaaagauauguacuuuauuuucaaacauacucuuucuacccuuuguacacugcuuuugcauauuaccuguuuucuuauguuguuuagaauaacuccaaccuuggguuuccaauuuuaagcuaacuuucuguuacaagcaaaaggcugccugccccuuuaaaagcuccauuugcaaucagccuucagcagggcuuuuucagcuguacuugacucccagccacugugcagcuaacuugucauuuuuugcugugcagacugagacugcuuuuuuauuuuucaacaugaaacacagaacaacaaucauucaaucauccaagcaaaaacaaacacgaguugacagacauauagacaauuuggugcaccaaaaaacagaaaauagaacacagauauccuauucgaagcuaaaaauauuuccauaggagccagagaggaagcaggacgucucccguuuuccgucugucccuaggagggcucugaaauagcuuauuuucauuuuuuuuuucuucuaggaauucugcacaguggcugcuucuaauaguugcuccucuuucccugagagcuaucuuuaagccuuugaugaaggcugccucuuuagucaaaguccucgagaggaggguaaauugacuuaauuuuuuguucuucauuuuuuauauuauccuuuauaucuuuauauuauccuuuguaucuuuacauuuuauauuauccuuugugucuuuauauuuuagcuuccuuucuuuuuuucuuuuuauauuucuuaaguuacuuauuuuucugcgcgcgucuucuuuuuccuuucucucuguuucugauaugccuuccugguacuccuacaaagucgcugcccuuccuuaacagcuggucccacacaaacccagcaacaauuaccagacccacugcguaagaaagcauaccucucagagacuuaccuuaauuucuuuauacuuacugguaccaccguuccucagcugaagaguucugaauccacgcaguugaauccuucucagcagucuguuuugcaggaaccuuuauuaacaccgcuccccagcugaagaguucugaauccacgccggauccuucucagcagucuguuuuacgggaaccuuuauuaaccgcuccuuccccgcgaugcaguucugaauccucccuguaguagggggucuucgcucgugccugaagauguuucuugucccggguuucggcaccacuucuugcgcgcgcucgacucgaccagcaagaacuacgcugcaacaggauccuucugcacacguuuauugggagagcuugauugcagaggcgaaaagacuuuuugcccagagcuggugcugcuuuuauaggccuaggagaggcgugucucauacccugauugguuaugcacuaagccucauuugcauguuccucaucugauuggcugcucucucucaguaccucacugagccucauuaucauaccucauuugcaugucucacauccgauugguuauacucucaguaccuuacagaaccucauuaucaugccugggccaggcaguguuuuugcaaaaaacuuuacugcauauguacacauuggcuguuuguccaaucuuaugcaugguggccagcaguagucagugccacucagcaacggcacauguggcuucccacaccagaagucauaaagauaccaaaagaaaaacagauaccauaguucaaagaaaagcacagaaugcuugcuuucuuugcuugcugaaugaaugccauccgagaagaaacagguagucaagcugaagacaaauugcagugacuuguaguggacuaggagagaaaaucuuuucaugaauacaaacugaagagccucaaggagaaagugaaagagacacauaaaaaagaacuagagggauggagagauggcucugugcuuaagagcacuggcugcuucucagaggacccaagguaaaaucaguuccuagcacccacacagugugacucacaacuaccugugacuucugcuucuagaucucgcacccucuucuggccuccaaaggcaccuguauucauguacacauacacauaaauaaaauauaaaucuuaaaaaaaauucaaagccagguguuauggugcacucccagaacuugggaggcagaggcaggcagaucucugugaguucaaggucagucuggucuauauagugaguuccaggacagccagagcuacguagugagacccuguuuuggggaaggaaaaaaaaaaaaaaaagauaaaacauugcauuuaagacuauaaaguuagcaaauggcacauccugaaucuucuuaaaccuaugagaauucugaguggaaagcagaaaguaagauagaggaguaggucuuuggaagacaugcaaaggaaaagauuaggcaaauguacucaaaaaucaaaauccuaggcaagugaauagcaaaugucugugaucuuaguauuagagaggauaaugaaugaggauggagaauuagacgccagccuaaacuauauagcuagacacuguuacaaaaauaaucccagauagucuugaaaaggguacuuacugagcuccuucugcaugcucuugaaaauggcaagaauuucaguggccauggggacuggugcugacaucaaagcuuuucuauuucuagaucuaguauauaagaacagaggcaaaaaucuaaugggaguccuuccacagcaucuucacccacugaagaaacuugcuuuuguauauggguugaccaaauacaacaauuauguaaaacaugaaguuguauugucaaguggcgagauguacuaaagaaaaugugaagcugagcagugguggcacacaccuuuaauccuagcauucaggaggcagaggcaggugaaucucugaguucaaggcuagccuggucuacagagugaguucugggacacaagggcuacacagagaaacccuguuccuccccuaccuaaaaaagauauguggguuuguuuguuuguuuguuuguuuugagauauucacaugcaauaggcugaccuccaaguuauuagauaggaaugagcuugaacuuucugcuucuauguccuuagugcuggaauuacaagaguguaccaccauaauuauguaguucugggauugaaacugaaguuuuauacaugcuagguaaauauucuaccaacugagccuacaccuaggccagguguauacaaguaaaguacagucacuauguggauuauguuuauaaaagcuaagcugcauaagacaucgaaaaggugaagcuuaugacuaagaugacauuuugaaccacauaauucuuaggaaaaggaaaagcaagauuuuacauagauacuaaaagacaaaacaaauauggaauaaaauugauguuuguaaaagcaacagcaagaaagaauaugcaaagcuucaaaaagacuuaggauacauagauaauaauuuaauuuuaguucaauuuaugcuauucuaacauagucuuauuggcuuuuagucaugaggcauggaauguauugcaggacuuucccuguccaaucacauuagggcagugggaggcuugugauuggacagaagggagguggagcaaggaguugagacacacagagagaggucuuaagaggagagagaaccagaauggaggcuggcgugaugauaucaaaagguuagaauaauuggguuaaagcucugucguuaucauuuggcucugaaauuauuguuuuggcaucuuauaaauuguguuauuauugauauauaaauuugauuggcuaauuaagcauuaagaguuuugauucuaccggguaauuagguguugagauggcuaaccaggggugcauggaguguugcaugaaagcaagaggaacucagacccauccgagagaugcccggugggagccauguggccucacagggccggugaguuggcgggcagagagacagagugagugagaucaccuggggcuagcucuagagaguuguugagcauggccuggucccgcugagaguuggcagauucauuuuuuaaauauuucucacaacaggaauguucuugucuuccauaugcaggagaaacugcaucaaggggaaaucuccuuggcaaaagauuagaagaauuagagacaagcacaaaacuagagaaaucagauauuuuaaagaaugaugauuuugaggaauggcagaucaaaacaggugacaugcuaguacagcuugaaguuuuuuguuuuuuuuuuuuuaaagauuuauuuauuuauuauauguaaguacacuguagcuguccucagauacuccagaagagggcaucagauugcauuaaggaugguugugagccaccaugugguugcugggauuugaacucuggaccuucagaagagcagucggguacucuuacccacuaagccaucuccccagccccagcuugaaguuuuaauguguagcacugagaugcuuuuacacuguuuauaaaacagccaacugggccgugguggcucauaccuuuaauuccagcauuugagagguagaggcaggagguuuucugaguucgaggccuggucuacagagugauuuccaggacagccagggcuauacagagaaacccuguaucaaaaaaacaaaggggggaaaaaaaaaaaaaccaaaaaacccagccaaaugugcuucaggaagguuucugguucauauuauuuuguguuugcaucaagguuuuaggguuuuguuauuaacaagugaaacauuaaaagaaagagaaugacucuugguaggucaaccaugcuuccgaguaggcuccacacccaagaauauuugagcaacacaaauuagaaguaauggcuuugagagagggggauggggagagcaaacauacaaguugugcauguaggaugguagggaugggucugugaggaguugggggauaaagaugauuaaaauagauuguguaaaauucucaauuaauaaaaauaguauuuaaaaacucaaagaacagcauaagcuauuuaaaguuuuuguucaagacagguuuucucuguaguccggauguucuggaacucacucuguagaccaagauggccuugaacucagagauccuccugucucugccucccaaauucugggauuaaagauggauguugcaugccuagcuuagaauauauuuuacguauuuuuaaaauuauaucuguuuuguguguguguguguguguguguguggcgcaccacagcacauguguaaagguacuaggagaaggcacuucucuuagguuacaaggcuggguggcaagugccuuuacccacugagccaucucacuggcccuagaauacuuauugaccucccuuuagguuguaagaaugaaguaaaacagcuaaugaauggaggaagggcuuuaucgggugacuuggugccugggagggacuaacuaacugugugauuguuauuuuaggugccuguggccuucgaugacgucuccaucuacuuuuccaccccagagugggaaaaauuagaagaauggcaaaaggaacuuuacaagaauaucaugaagggcaacuacgagucucucaucuccaugggugaggcugagugagcaccuauugaaugaggugccacagucccaugaggacucaaacacuuucuuuuuucccccaguguccucauucucgcuguucucauacacuguagaaucugguuucaagcugaagaaggacagaacuaacuuauuaugugcauuuccuauacauuccauuucuuuuaccugcuuccuugaguagcuguuguaaauaguuggaaguggauagaugguaagaagugaugcaggaucuaaaagaaauuaauacccugacuguggaccucaaacauucagcugccuugagggcagguguugucauacucauuuaucucuuugucaugccugcuuuccacuuuuccucuucuagauuaugccaugaaucaaccugauguuuuaucucagauucaaccagaaggagaacacaguacagaugaccagccaaggccagaagcaagugagauuccugcagaccccagugaagguaaguaaaugaaaggguuuauauacuuuaaaaaaaagauuuaguuauaugaagacacuguuucugucuuuagacacagcagaagaaggcaauggaucccaccacagaugguugugagcuaccacaagguugcuggaauugaacucuagaccacugaaccauucauuucuccggcccugcugccaucgaaccaucucucuagcccugguuauauacucuguuaagcuccuuuucuuggcuagagaaggggacucaacacaaagaaagcaaggcuuagagcuauucuguacuaaaguauuuacacuuugaacagacauguaaauacuagagggagcucuggaaucacucuguccuucacuaucaaucccucauacaugcuagugaaguacuuacuguaccaccgagugacagccccucccuuuuguucuuuuaauguauauauuuuccuuuuuuguauauauuuacuucaguaccuuuuuuugcugacaaugaucaguguucuugauuuucuuuuuuuguucuuguuuuuuguuuguuuguuuguuuguuuuucaagacaggguuucucuguauaguccuggcuguccuggaacucacuuuguagaccaggcuggccucaaacucagaaauccaccugccucugccuccugagugcugggauuaaaggcgugggccaucacgcccggccugauuuucuuaauauuguuuuuauuguuuauaguuuuagcuugcauugguauuuaucagccuagauauuuacccacacuugagaauaugauuuauguagcuugaacugaucaauauguaacauuaaagaaaacaaacucacgggacucaguauacagccauacuuacaacuaagcuuuauuaaagcgagacuaugccggggccuagcaaacacagaaguggaugcucacagucagcuauuggauggaucacagggcucccaauggaggagcuagagaaaauacccuaggagcuaaagggaucugcaacccuauagguagaacaacauuaugaacuaaccaguaccccggagcucuugacucuagcugcauauguaucaaaagauggucuagucagccaucacuggaaggagaggcccauuggacuugcgaacuuuauaugccccaguacagggaaacgccagggccaaaaagugggaguggguggguaggggagugggugggaggguaugggggacuuuugggauagcauuggaaauguaaaugaggaaaauaccuaauaaaaaguuaaaaaaaaaccggaaaaaaaaagaaauaaaacuuuugauaaauaauuaaaaaaaagauuuauuaaagcaaauggauaugaagcaacaucaucaaaagauacauggaggaagccagagucccuucccugugaaaucucacaaggcacauuuaauucccccagcagugaaugcgacagcacauaccaaaugcugucauagaaccucauuagacacucaaugccuaggguuuucuuggcguuaccacacaaguauucaaauuccagauucccaaaagcaaaacaggucaccagaauaaaacauacuuuuagcaguuaaggaguaguaagauauucuugucauuuagggaaacuguuguguguauaaaaaacaacuuuccagaucuucauagaugccaacaguuccuucucaggaggaaugguuuuggcuguacuacauuuuccaucuccuaacauagggaaggaaccuugguuccuuucaguggagaagacuacuaaccacuuguucuagugucauuuuuguugcuaugguaagauguccugacagaacacaagguaggggagaaagcauugauuuuaacuucagucucagccaguuucuaucauuguggagagggugcagcauagagcaugaaguggcuggucauaucaccauagucaagaguagaaaggaaggaaggaagacaugcagauucacaugauugcuuucucaugcucagcuugauuaguuaauucacuuuauacaguucaacaugaccaccggcuaaaaauguagacauugccucauuaagacuuuuccuagguuuugucaaacugacaaggcuaaugaucauaccuggaaaucuuaaauaugaaucuaaaauauuaaaaugaaaucaugaugauuuccuuuuucuaaaugguguauuuuuguagccuuguccacugaaaagaucuaaaaauaauaauaacugauuugcaauuagcagucuuccuaagggccaauaggcauguaccauuauauugauccuuauauuuacuuguuagauggcacaggucacuguuuucagaaccuugggagagauauaaauccucuuuaggacuuaaggauucuuuuugaaagaacucugcccaccaaaagggcuuugucauauaaucaaucaaucucuguguguguguguguguguguguguguguguguguguguucaucuuuccuuuccuuuuuucuuccuccuccuccuccacacagugaaaucagagauucaaccccuacagguuuugcucuaagguacacaugcacacacagauaaauaaaaguauauuggugcugauggguguaaagagaagguccuaaaugaaugaaauuuuauuuaucagaaauauaauuuuuuuaagauuuauuuauuuuauuuauaugaguacacuguagcugucuucaggcacacacacuagaagagggcaucggauuccauuacagaugguugugagccaccaugugguugcuaggaauugaauucuggaccucgggaagagcagucagugcuuuuaaccaacugagccaucucuccagccccagaaauauguuuuuuuuuuuuuuuguuuuuuuuuuuuuaagcccuagcuauccuggaacucacucuguagaccaggcuggccuugaacucagaaauccaccugccccugccucccaaguacugggauuaaaggugugcgccaccaugcccagccagaaauaugauuuuuauaaucauguuucacaggcaugcuggcacaagcuugucuucucagcaauacagguagagcagggacaaggggauuaggaagucagugucauccuuggccacauaacacgucugaggccaguuugaguuacaugagaucauaucucuaaaggaaaaaauaaaauaaagaaguagcaguaaacagauguggggugcauuccuguaaucccagcacugcagaaacaaaggcaggugaaucucugugaauucagggccagcuagagcuacauaacaaacacaaaaaggaaaagaaggacguuuuaaagaaucaauaaugcuauguucaacaaaugaacaugguuauauuaccuuuaaagagauguauuuauuauuuuauguguaugaauguuuugccugcauguauguauguguacuacaugcccaagaaggucagaagaggcuguuggaauugcaauuaaagaugguugcuuacuaggaaucgaaaccagguucucugcguguucaacaagugccuuaaccauugaaccagcacucagcacaauuucaccaucuaauucaagucccugaagaccacucucucuuuuucuccacaaauagagccuggccuuucaaccucagauauucugucuuggauuaaacaagaggaagaaccucagguuggagucucccaggagucuaaagagagugagcuguacaaagguaccuaugcuggugaguaacagagaaaacagauacucagauccgcuuauacaagaggagacugaagaaugcagcuaaaauggugcuagaaagacaaggaacagagaggaagaaaagaaagauaugguuagccaaauuaggaaugaaaccaaaaggccaccaggauaaacuuuaaauaggaaaacacauuaaaaaaaaaaacauuaauuuauuaguguguguggaggcacauacacagaucagagaacagcuugugggaguugguucucuucuucuacuauauggguccuagaaauuaaacacagguugucaggcuugauggcaagugcauuuacccacugagucaucccaccagccucgaaagcuuacucuaaauuagaacuguuggggcuggguauaucagugaagaaagugugguugcaggcacaaagcccuguguucaaccucuagcacuauauuuaaaaaagaaaaacaagauugccagggaaagaauaauaaguguauauaaacgaauaaagaauaugggagcuagaaaaacagagcauuugaagaccacuucaaauggauagagcagagccaggugugaugauggccuguaaucccaguacugaggaggcagaagcaggauuaccguaagcagaaggauuaccuugaaaguuuuaggccaaacaggguuauacaggaagacucgaugccucagucaucaacuguucaaaauagaauagcacaaaaauggggagugguauagagagaaacaggcaauagaaauaaaaguguuagaagagggcaaauggaaauauuaugagcccucccucaggaaaaaaaaaagguaaaauaacaguaggcaaagaaacaaauguuuccuucuauaaugagauuuagggucaacugugauuuaccucuuaaauuauagaagaaagucuugaccaaugagguggcguuaguagugauaaaggcaccugcugccaagcuugaccaucuaaguuugauuucccaagacucauaugguggaaggagagaaccaacuccuacaaguugucaucugaccuccacauuugcaguaugggaugcacauguuccccucccacaggauaaauaaugugauuuauaaaaaaguguagacauaaugguuuuuuuguacacuauguaaaguuuacccuuguguuauccaaaugcugauuucucugcccucauuucuuguuucaauccaaacauagcuauuauguuuauucguagaagcaacugugucaaguuuguauagacauugcuccucauucauucucugccuugccaauaaaagccaccaaaccaacacagagcauuagagaaagaauggguggggcuucugguucuaggagggguguagagagagaaaagggaaggagccacgaggaaaguagagaaaaacaucagaagaaagagaguggaaucaaguaaggauggaauuuuucaaguaagauaggaauauaaucugggaggaaaccugaguagcuuggagguauagaauggaguagugauuguucaguauuuggcucaaggcaauuuuaauaaaucuuagccucuuuguguguuuauuggggaauuagcugguuaagaaauauagccaccagaucaauucacugcuuacauuuaucuucaagauaauuccuuuuacaaaagagaaucugaagaucaaaagggauucacuuguuuauauagcuuaauagacucuuggggguguuuguuuguuuuuaguauguucugugccucuguuucuuagauucugggaagugcagcugagaaauaccaguuucugcucuuuagaacauuuacaccacagacuuacauaccaaucuaggcaugucuguuuuuaggugccggaguguguuacacggaugacuuaagacauuugagguuuggaaaaacaugugucaguuuaaguauuuagauaauguauaaccaagguugugaaaauccaaccuguaguuuuaguacuugaggaguucaaggcuagacucagcuauacaguaagcuggaggcuagacugaguugcaaaacccuaucucaccccuucccugaccccaguaaaagagugugaggacagaaugggccuaaaauauugacuaauuugauuugacuaugguuuaggaagacagggagggagauggggaacacccuggaaaaaggagaacagaaugaccaaaagaugcagagguggcaauauguucuuauuucugggaagauagucagccuacuucacggaaggguuuaucucauagaaugcagacuaggaguaaaaaguugauuuuaggcccugacacaagagcaacagagaaaguuguugaauagaggugaaacauaaagagaauaauguggggaggauugcugccaaagcuaccccuuuccaaaauggagcaucaacguacagucuuauguuuguaaugauuugccacacagccuacggugccuuauuaguaaugagagcccuucccuaagcuuaucugaacaguuagaugcuuagagccaccugcaagagccaggcaggaaugugagagguaauggugagauggcuguugacagauguaacucugagucccuucuuucagaugaagaacuugucaucaaagcugaagaccuugcuagagcuuccuuguguccugaaguuccaguagccuucucugcuccaccaccagcagcagccaaggaugcauuuucagauauagcuuucaaaagccagcaguguacccccauggcaccuuuugcacgaacggccacugaccugccugaagcuucagagggacaagugacuuuuacucaguuaggaaguuacccacucccaccuccaguuggagagcagguguucucaugccaccauuguggcaagagucucagucaagacauguuaaugacacaucaguguggccaugcugcugaacaccccuuaaccugugcccaguguccuaagcacuucaccccacaagcagauguugguagcaccucccaggaucaugccaaugaaacaccucccaccugcccucacugcgcccggacauucacucaccccucacgacucacauaccaccuucggguacacaacagcacagagcgcccuuuccucuguccugauugucccaagcgcuucgcugaccaggcucgacucaccagccaucggcgagcucaugcuacugagaggcccuuucguugcccacaguguggucguagcuucagccuuaagaucagucuccugcuucaucagaggggacaugcccaggagcgccccuucuccuguccucaguguggcauugacuucaauggccacucugcauugauucgucaccaaaugauccacacaggcgagcgucccuacccgugcacagacuguagcaagagcuucaugcguaaggaacacuugcuaaaccaccggaggcugcacacaggugagcggccuuuccaguguccgcacugcggcaagagcuucauccgcaagcaucaccucaugaagcaccagcgcauccacacaggcgagcgaccauaccccugugcagugugcggaaggagcuuccgcuacaagcagacgcucaaggaccaccuacggaccggucacaguggaggcugugcgggugauagggacccuuccguacagccaccagacccaccugguccacucuuaacugcccuggaaaccucuggccuagguguuagcacugaaggucuagaaucuagucagugguauggggaagggaguggaggggugguuuuauagaucugaggcuuguugguuauuuauguucacagcagagcagaaaguccaggagagagcccacaaguuccgaaaccuacaguaauuauaucuguuacauaaaggaauuugagaucuacacucaacuagagacaugcuugugcuuuggaaauccacagcaguauaagaauacuguauuuugaaaacuggaagagaauccagcaccucugacuugucagauaccacaaaagcagaguuacaaagcaagauauggcuucugaucauccugucagaguagcagagugagagcagacugccucuaggcagagacagguguaugggaagagccccaaaccuugaagccauccggaggcaugagaaugcucagagcguuucucuaaucgcucaguaauuguugggagguugugcuuuagccacuuguuauguugccgugugucugaaaccagcuaaguucugcucauaucaguguagucaccuuucccugagacgugaugacugaggcugcauuccuaggccuagauucugucugcuaauacauuuuguuuaauguuggugaacacgaacucugacuuugauagcuuauuuaaggggacaguucuuaguguuuacuagcuuauuuugaaauguucagacucuuguggcaguuguuaaaagaguagagaacuucaccacagcucugguuaggaaauuaggaagagaguuuucucuccagguuuaggagcuaaagagcccagagaccccaggcacaacagggaucaucacauggccuaaaaaauuauaucaacucauuccuuaucuuuuccaagccagugaucuuguuuuuccauuucugguguuugauucucuuuuucuuucuuuugagauugggccucacuguguauccaggccuggaacuuugcuuuguagaccaggcuggccuugaacuuacagggaucugccugccucugccucauguucuggaugcaccacaauucccaaccccauuuucuuuaugguccucagcagcaaagaucacagcacuuugucaaggcaucaagcacuucagaaaguaccacugaacucagggcuuuuguccauugguagugugaugcucuuaaggaaaggauuucuaccuuguuugccccugccucacuggcagugaacagacaagagaccucucucggcuaccaagagcuaaguaucauaucuaucuuaccuguugugcuauuuuuuucagacaggguuucacugugggguccuggcuggucuggaacucagagaucugccuaucccugcaucuagagugcuacgauuaaaagcaugcugucaugcccagccaccuguuguacuuugaagggucauggcugccuuauguucuuuucuugggcuugcuuagucaucugagagcaucugaaccuaguuccaucccuaagugugcagccaggaguguaucuucucuuuucaacucucacguuuuuaucaccaaaaugaggcuguugaaagaaaagggaagccucuagaaaucuuagaaagaaaaaccuugugauauaguucucugccaaaauccuguccucccuuuggcuucuaaccagacaaauccaaaugagacaggaaaaccaaagcagaaacuuauguagaaacuugguggaaauuagcuugccuuguuguucugcucuuaguggguccaaaaguagacagagaguauggaagccaacauuugggacagaaagcuuuuguucccacacccccuguuuaccucggagucugcuauaaugucuagaaugagaucuggaacugcuuagacgugacacuuucuggauaggaaggggaugcuuuccccuuauuacuaggcucaaccuucagucuggauagcuaauguaacugcagugugagaugguguuugccuaauuaaugugcuccuggcaacguucugucuaaagauguuggucuucaggauaaucacacacauaaaacuguugugugacauuaauaacaacaaggauccugggagacacaagaagucaguguaagaccuagucugcugucauaacuuucagccuguaagcaaugaaagucccauggaugauaccagaugaugguaguagacccauaguauauugggaucaauugccaaaucccccaaaucagguuuccagguucauuaaugacccuuaaagacuugaaugugagaucugcaccugaaaaagagucaaagccucauccacagggugaugaucauccucagcuagagcugaggaagagcugccuacugaaccugugauguagagcuagauaacaucuaaaauucaucugaacccgacagacuuaccaaauauacacaguuaauaguuggaggccugugugcaugacugcugcagaugcauccuaaugucuaaucuguaaggagccauagccagcggggaucuaaacuggccaaaagugaauuauaguucaaauaacaacugaacgagagccauaaaagcagcugggugauggugcugcacaccuuuaaugccagcacucgcaggaggcagaagcaggaggaucucugagcuuaagcccagccugauguauagagggaguuccaggacagccagggauacacagagaaaccugucuugaaaagcaaaaacaaaagccauaaaaccaaauaaaagggaaugugcagggcuaucccaaaaacaaacagcauaaacaugugggauccuaaucucuagucuggcuaagagcaaggacuuaagccaaucuccuaacaaguagaccccauuuguugucaaagauucagaaguggcucauuggaaacucuaccaucuaauaaaaguuuucagcaaauagaaucucuuugccaucuggugccuugagagaaacuauacauuuacuccuguaauuaagaggcaccuguacccuggcgcucaugaccagucccuguagagaagaaaccccagaagaguccuauucaucugcccccuauaugguggcacaaagacuuccucagaguguauucaggaguuggcaccaaccagguuuacagcucgcuagauuuuuuuuuuuuuuuuuuuugauuguggacauuggaugagccucagguucagccacauauaugaaaauaaauguaaguugguuaauuguuuagaaaaaugaaauauaauugaucccuuccuacuggguauuugauaauagaaacaccuuagucaugaacucuagagagagccauguucugcuuccucauuaauaaacuauaaaguuucugguagggacuccacuaggcuucucuugagacgauacuuagccaggcucuguggcuuaugaaacaauagcaaagucuaucucagucccaaaaagucucccugaaaaaaaauaaguaccuaaguuucuuuauuucaaugggauggaagacccaaguuugugucauaauucuugagagagacagggcauuccuucccuccucuuaugcuucagcuucuuggacaagaaagcagccucugcaguugccugaguagcaaggagacauuucugaugaggaucugauguuguuauguucauauacguuuguuugaauugauauuuuugacucuucauucugguucucuguagcaaagagucagucucuuaucauaugggauauauucaacaggcuguucuuuuuucaaguuucaggcuucuguaaacaauauauuugggaguucaaaauuagggacuggagugauaacucagucaagugcuugccaugcaagcaugagcaccugagucuaaucuguagaaccuguuuaaaaaaaaaaaagccaggacugaugcccuaggccugaaucccagcacugggaaggcucuugcuggccuaucagcccagcccaauugguaagccaugggucagugagagacccugucucaaagaucagagucaguagcuccugggcaguaacucccaaaguccucuggucuccacaugaaagugaacacacacacaggucagauugauuguggggcgggguuacggagggaggaggagguuaaugcucaucaugcauuggugcaguacuaauggcuaagaacagggcuucugaugccagaccuagauucaagucucaaguaauauaauauuauuuuaccuucugaaagguaaauuuuguguauaaggcaucucagagguauuagagcuuaaaaaccugcagcacaguuuaaagaaccagugugaaagguaaucgcacagccaggcugaacuggaaguggcaaguguugagaaccaagguuuggccaagugugauggcucacaccugugacuuugguacuugagaagcugggacaggaggauggcagagaauuaaaggccaguagagccuacauaggaaaaccuuguuuuuaaaagugggagaaaaugaggagccaaagagauggcucagugcuaagaccacuugcugcucuugucagaaccuguguucaguucccagcauccacauggguauuuaagggauccgauccucuccuccagccuccacagccccuaggcaugcaugugguacacauauauacauguaggcaaaucacccagacacauacaaacaaaaucuuuauuuaaaaaaacaacuguuucacagaaauacauggcugcuagcaucuuugcauauauuuaguaugaucucuuacugauuuuuuucuacaucuaccagcccccauaaguuucugaugccacaaccccauauaguucugauuaucucugauuuuucuuucuucuccuacuucucuuuuaaguuuuuuggauuuuaugugucaguaucuugcuuacauguauguaugugcaccauauacaugccuggugccugcagaggucugagaggguuuuagauccuguagaauuggaauuaugaauggcugugagucaccacgugggugcuggaaauugaaccuggguccucuguaagagcaacaagugcucuaagcuacugaauuaaaaaaaauuucuuuuuuguuauuuuuguuuguuuguuuuuucaagacaaggucuacuaaguagcucuaaugguccuggaacucauuuuguggagcagguuggccuugaacacacagaaaucugaaugcuacugccuuccaagugcuggaauuaaagcuguguaccacaauaccuaguuuaaaacaaagaauuuuuuuuaaaaauucuucucuuuuauauuacauucugaacggaguucuuccuaccuccuauccugcccguagccuuccugcucuccccccucccccauucacccauucacucuuccauuucucuucagaaaagggcaggcuucccacgaauaacauggcauaucaaguuacaguacaacuaaacaccaccucuuuuuuuggggggaggggguuugagacaggguuucucuguauagcccuggcuguccuggaacucacuuuguagaccaggcuggccucgaacucagagauccaccugccucugccucccgaguacugggauuaaaguacugggauuaaaguacaggaccacgccccggcuuuaaacaccaccucuuguauuaagacuggaagaagaacccagucaaagagugagaagacagccccuguugcuauuguuaggagucccacaagaccaggaacacaauuaacauaugcagagggccuaggacggacccaugcaggcucccugacuaucagcucaaucucugugagcccagguuaguuaguucuguggguaaaacaaagaauuuuuaaaauauccuuuuaaauauuucuaaguuuucuuaauuuagauucuguaaugggaauucuagcccagcuccucuucccaugcacaucuuacuucagucagcugcagucagcaguaaaauuccucuggccucugcaccagggccugaggacuugcuguucaggaacgaaaacaauacaguauuuuagugcugccaagaaaggacagguucuguuuaaugucuaccaagguuucuucuacgucacaagcacuaucauaaggccaaagcuuaguguccuuguucaaagaaccuggaagcugcugcuuaucuuguaaaaagucacuugucacuucaagucaagggauggagaacugauauucuuuucugauccugcucccauuuuuguuuguuuguuuauugaaaacagagucuuacuuguguaaccaagguugccucaaacucaaaauuuugucacugcuuccuuagugauggaauuacagauguguuuccccaccugacaccuccuccuuuuuauuuuugcuuuucuugagacaggguuucauggaucccaggcugacugcaaacaugguauauagccuagauuacuucgaacuucugacccuucugccuauccuuaguuuuauggaguacuagggaucaaacccagagcuuuguacauguuaggcaaacucuaccaauuuagcuacaucccaagccuuuuucuuuuuuuuaaagaauugaccacagucauagacauaugauggcuuuagucaccuugaucaguuaaaugucccuccauaucaugucuaagaccaucaaggaaggcagauaaugcagccucaucagaucagccucaagaagagagcauuccuagguucucaaguuagucauguuacauuccaaauaaagggcuuguugaaacaucaaucaacuaugugggugugugcuucuuagcaaagcaguauuuauaguaaaaucuuaaaauuguccuaaauuaauggggcuggagacaugucuuuaguaguugaaggcacuuguugcucuuguacaggaccugaguuuugccuagcagucauguugggagcucacaacuaccuguaacaauagcuccaggguugcaacuuuugcaagcaaacuuuuuuaguugguugguuuuguuuuguuuuucaaaacaacuuuucucuucaguagcccuggcuauccugaaacucacuguagacuagucuggguucaaacucggagacccucuugacucugaugaugaggaagaggauuaauuaguacuuugcugcauuagaggauugucuaguuuucuagcugaaaaauaaaaaagaauugauacuugguuuaaaaaaaaaaaaaaagacagucucauuagcccugcauggucuugaacuugacauauaaggaugaccuugaacuccugaucuuccugucuucacuucccaagugcugggauuauaggccuuuacuauacauuauauaccucauauauuauucauaaauauaagugaauguauggagaauaacaggucagaaagguggcagguacauucuuggagacuugguuuguuuguuuguuuguuuguuuguuuguuuguuucaagacaggguuucucuguguagccuuggcugaccuggaccucacucuguagaccaggcuggccuugaacucagaaauccgccugccucugccugcugggauuaaaggcgugcgccaccac

SEQ ID NO: 2968 - RNA, 6643 nt, Mus musculus
uuuuuuuuuuuuucaagauuuauuuauuguuauauggaaguacacuguagcuguccucccuuaugaauaucaaugcaaaaauacucaauauaauucucgcuaaccgaauccaagaacaaaucaaaacaaucauccauccugaccaaguaggucucauuccagggaugcagggaugguucaauauacagauauccaucaacguaauccauuauguaaacaaacucaaagacaaaaaccacaggaucaucucguuagauucggacaaagcauuugacaaauuccaacacccauucaugauaaaagucuuggaaagaucaggaauucaaggcccauaccuaaacaugauaaaagcaaucuacagcaaaccaguaaccaacaucaaaguaaauggugagaagcuggaagcaaucccacuaaaaucagggacuagacaaggcugcccaguuucucccuaccuauucaacauuguacuugaaguccuagccagagcaauuagauaacaaaaggagaucaaggagaucaagaucaauacaaauuggaaaagaggaagucaaaauaucacuuuuugcagaugauaugauaguauauauaagugacccuaaaaauuccaccagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagucacaaauaauauaaaauaccuuggcgugacucuaaggaagugaaagauuuguaugauaagaacuucaagucucugaagaaagaaauuaaagaagaucuccgaagauggaaagaucucccaugcucguggauuggcaggaucaauauaguaaaaauggcuaucuugccaaaagcaaucuacagauucaaugcaauccccauccaaauuccaacucaauucuucaacgaauuagaaagggcaaucugcaaauucaucuggaauaacaaaaaaucuaggauagcaaaaacucuucucaaugauaaaagaaccucuggggaaaucaccaugcccgaccuaaagcuguacuacagagcaauugugauaaaaacugcaugguacugguauagcaacagacaaguagaccaauggaauagaauugaagacucagaaaugaacccacaaaccuauggucacuugaucuuugacgagggagcuaaaaacaauccaguggaaaaaagacaacauuuucaacaaauagugcuggcacaacuggcgcgguuaacauguagaagaaugugaauugauccauuccuaucuccuuguacuaaggucaaaucuaaguggaucaaggaacuccauauaaaaucagagacagugaaacuuauagaggagaaaguggggaaaaaccuugaagauauuggcacaggggaaaaauuccugaauagaacagcaauggcuugugcuguaagaucgagaauugacaaaugagaccucaugaaacugcaaagcuucuguaaggcaaaagacaccgucaauaagacaaaaaggccaccaacagauugggaaaggaucuuuaccuauccuaagucagauagaggacuaauauccaauauauauaaagaacucaagaagguggacuccagaaaaucuaauaaccccauuaaaaaaauggggcucagagcuaaacaaagaauucucaccugaggaaucccgaauggcugagaaacaccugaaaaaauguucagcauacuuaaucaucagggaaaugcaaaucaaaacaacccugagauuccaucucacaccagucagaauggcuaagaucaaaaauucaggugacagcagaugcuggcgaggauguggagaaagaggaacacuccuccacuguuggugggauugcaagcuuguacaaccacucuggaaaucagucuggcaguuucucagaaaauuggacauaguacuaccggaggaucccgcaauaccucuccugggcauauauccagaagauguuccaacuaguaagaaagaaacaugcuccacuauguucauagcagccuuauuuauaguagccagaagcuggaaagaacccagaugccccucaacagaggaauggauacagaaaugugguacauuuacacaauggaguacuacucagcuauuaaaaagaaugaauuuaugaaauuccuaggcaaaugguuggaccuggagggcauuauccugagugagguaacccaaucacaaaagaacucaaaugauagguacucagugauaaguggauauuagcccagaaucuuaggauacccaagauauauguuacaauuugcaaaacacaugaaacucaagaagaaugaagaccaaaguguggacacuuugccccuucuuagaauugggagcaaaacacccauggaaggaguuacagagacaaaguuuggagcugagaugaaaggauggaccaucuagagacugccauauccagggauucaucccauaaucagccuccaaacgcugacaccauugcauacacuagcaagauuuugcugauaggacccugauauagcugucucuagugagacuacgccggggccuagcaaacacauaaguggaugcucacagucagcuauuggauagauuacagggcccccaauggaggagcuagagaaaauacccaaggagcuaaagggaucugcaacccuauacguggaacaacauuaugaacuaaccaguacccuggagcucuugacucuagcugcauauguaucaaaagauggccuagccggccaucacuggaaagagaagcccauuggacuugcaaacuuuauaugccccaguacagggggaacuucagggccaaaaagugggaguggguggguaggggagugggggggguaugggggacuuuugggauagcauuggaaauguaaaugaggaaaauaccuaauaaaaaaauuuuuuuaaauuuauuuauuguuauauguaaguacacuguagcugucuucagacacaccagaagagggcaucagaucucauuacggaucguugugaaccaccauguaguuucugggauuugaacucaggaccuucagaagagcaguggcauuuaaccgcugagccaucucucuagucccaaauggguuccuuaaauauaucaaauacugcugucucuagaaaccuucaagagauaagaaggcaauagauaaugcaauagauaaguggguuugauuaaaaagaaaagaagaagaaaacaagaaaaaagggggaaaaaacuaaaauaaaagaaagaaaaaaaagaaaaauaaagaaaaagaaaagaaaaaaauuguuugauauagagucuaauggaaccaagacuagccucaaauuuucuauguagucaggggugacacugaacuucuaauccuccugccuccaccucccaagugugcgguuacagguuuaguagccuuugaaaagaaagcuguuuucucuuugagaaguuccauucagauacugauaaaaggcuucccugaaagggcuguuuuccugggaaauucccucaugagcaugcuaucuucuguggagcagagaccucauccuguugguuaaaaucuggagguauuuuguaucccguucacugugacauacuccagccuucagccacauucauuauggccagaauagcuggagccauuagcuaauuggaauaauuuauuguuauccuugacucuuagggaaaacaaaugauugcuugaaaucagauuuacuaaauaacacggacuggugggauuccuccuucucuaacauguuugcugucuuuguuuccaugaguagacucccccaucucugcccaggaccuuuugucccggauuaagcaggaagaacagcaguguguaugggaccagcaggauuuggcagagagagauauucccacagauccuaauucaggugagaaagaugucagugauuuuuuuaaaaauauuucauuuauuuuauguaugugaguacacugucgcugucuucagacacagcagaagagggcacaggcucacaugguugugagccaccaugugguugcugggaauugaacucaggaccucugcaagagcagucauugcucuuaaccucugagcuaccucuccagucccucagagugaauuuuuaaacuuagcauuuauugugucaauggaauggauaaaaaaauccauguauuguguauuugugugucaaagagcaaguaauuuauauuuucuggaauuucuuuacuuucuuuguaaaaggcuuauuuuauuuuuaauaauguauaugugugugccaacagaggccagauucucuagagcuagaguacagaagguuaugagcuguuggugugggugcuggaaacugaacuuggguccucugcaagagcagucagugcucaucaucacagggccaucccuuaucccccuucuggaccugcauuuguacgauaucucccaugaaaagucuggggagguucuaggauguagggaagcgcacccagcugggcuggagaugcauuuaugugugaguuugugaguuuguaaacgugagagguccaguggauuccuuguagaaauccugacaccacugucucauccuacccuccauaucaaggagagaggaugagaaauugccugugguugguugaggggaccaggcagaugggaaacagagucuccucauagaguccuaagcuccugccgugggcuugucaguggcucuggcucugccucugcacuacagaucagaccagccagcuguggcccuccaggcuucaaagcugagcuuccuuuagcauggccugguccguagucucucuggaguuggauguauaguggaugcucaguggaagugaaugaagucuuaagauugccuuuucccccuaacaacagagucucucaucucagcacaugacauuuuguccuggaucaagcaggaagagcagccguacccauggggcccacgugacucaauggaaggggagcuuggacuggacucugggcccaguaaguagugugugccucugcuagaaccuggaggguuuucucucagugggagagcugugaguccuuguuuggaguggaauuuagugccgucugcuucauagccuguuggcaaaccaggauaauguacagaaaacccagaagauugacuacuagcauugaaagaaaugauaauagcagccacuucuauagcccccagccaccauuucuagauuugucauuuuaaauuuacuuuaauuuuguauuuuaggguguucugggcaaagauucauggagcacaguauagcuggucuaugcuacuuuguggguuuuucuuuuucccaucuuuuaucccucuaucuuuuucauucucuaucacuagcuaggaaggaaaggagagagagagaaagagagaaagagagagagagagagaaggagagagagagagagagagagagagagagagagagagagagagagagcagaaucuaauuucuuuccuuuuguuucuucuuugagcaugaccaccaauacucaguuaaaguuuucuuccugcuuguuauuuccuggcugacaagaggcaaaaagcucauacuuuuuacugaguggccucacgccagguucccaaggccauuuuccgaugauaaggaauuaccuugaauaucucguuuuggaucugcauuccugaauccagugguggccuguguugcaucguauacacuccccagaaagccugggcauucuuucuauuugaaauuuaggaaaaccauugucucuagaaaugacuuguucacuuuuccuguacaaaguacuauauuucucguaguuaacgcacuggcuguuugagaucugaggcuuuugguuuguuuauaaucucuuugcaaaugacuguauuuccucaaauugaagcaccagacauuuugauaucugaggauuuugguuggguuacagucucuuugcaaaugaucauauuuccugcaauugaagcacugggcauuuugauaucagagaucucuagcuauagcuugaccuauuauauuaacaugguacauauuagaaccaauaucagucuuuaaucccagcacucaggaggcagaggcagguggauuucugaguucgaggcccagccuggucuacagugugaguucuaggacagccagggcuauacagagaaacccuaucucggaaaaaaaaagaaggaaaaaaaaaagaagaagaaaaaguaaaaacagaaaaucccuucuaggagcauagccagaggugaggggguaucccaguaaacuuuuugcuggccucuugaaaauuaaaaaacccauuccuucaucccaugccauuuccucuaugacaugucaaaccaaauuuccuuuuuugauuguuuguugucugagacaggcaggguuucucuguguagcccuggcuguccuggaacucacuuuguagaccaggcugaccuccaacucagaaauccaccuaccucugccucccaagugcugggauuaaaggugugcgcuacuacagcccagcucaaauuuccuauuuuuauccuuaacuuucgauccacuacaugucauuugccuuaacuauuuugcgagucccuuuucccaccccuacccccauuucaccccaucaauaggagagaaagaaggauagagggggaga

SEQ ID NO: 2969 - RNA, 2114 nt, Mus musculus
ugggucccuugagaaugauggagucuguuucucggagcaggagugggagaaccuggaggacuggcagaaggagcucuacagaaauguuauggaaagcaacuaugagacgcuggugucucugagugagugaaaguuuucucccuaaaauucucucagagcucuccugacugcaugucauccucugaaucuucugcugagcuaaggaaugauacccuucagguccucucaccugaagagacuugaaagugucucggggaugagccuuuuauauuucuucucugguaacaaaauggcuucuugagacuauuugaauaucauugauaaacuauaauauagguuuuuaauaacaucucuauaaaguauuuuauuaauuaguuuccuaucacuguguaagaaacuaugaccgaggcagcuuagagaagagaaauguauuugggguuuaugguuucagaggguuagaguccuugauggccaagcagagauaucagggguggcaguggcuggaacaacccugagagcucauaucuugaaccucuagcaggaugcagagaagacuaacuuaaucgagacuuuagaaaucuuaaauccugcccccauugagacgccuccucuaacaaggccacaccuccuguuuccaaacaguucuaccaacugaagaccaaguuuucaaacaaacgagccuagggggccauucucauucaaaacacgauguguauaugcuaucuuuaauauuuaagauuauuugaugagaaaucuuuuaacuuaggaaccauuaaauggauagaagugcuuuccaugcaagccugauaacugucauucgaucccuggaacccgugaugggaggggacaacugacuccuuaaguugcccugugccaccacaugugcacuguguugcagauguauccagacucuuagauagcauauacauauuaucuaauaauaaauaauaauauuuaauaauaaaauaaaaauuuaaaggaaucuuguaucuugagaugagacaugcagcacaggcugaaaaaaaaccuuuuucuugagcuggagagaaggcucagcuguuaagagcacugacugcucuuucaaaggucuugaguucaaauuccagcaaccacaugguggcucacaacuaucuguaaugggauccaauguccucuucuggggugucugaagacagcuacaguguacuuacauauaauaaauaaauaaaucuuuaaaggggggggguggcuggagagauggcucagugguuaagagcacugacugcucuuccagaguuucugaguucaauucccagcaaccacaugguggcuaacaaucaucaguaaugagauccaaugcccucaucuggugugucugaagacagcuacaguguacacaaauacauaaaauaaacucuuaaaaaaaaaccaaaaaagcaaaagcagaaaaaaccuuuuucuuggcaguaagccagagucaucaccagccacugugaucugcacauuguugguagacuggaagcacuguguggaaguguuuaguauaaaaauuacuaauacauacucgauaaugcaugcauauuuuucuucuaagacaaauucuuuucaaauguggguccuuggagaaauaccaaggaggccccuggcuagaccacagugagggcaagggaaguggggugacuguuaccccagauggguuacaugcucucuuugaggcuguuuuccugugccacggugccuccacaaggcuggaauuaggcacuguggaaggaauccuuggcggaacuucagcugucuggacagagguggggguguuagggagacaauggcaccuaagccuaguuaccuuaaugaaggaucaaagagcagcagccugacaguccacuggccagaaaugucuagggaaaagugacaguaacaucagcucuuauguccucuuagcuguuaauauugauuugcuguuaauaucauuuguacauuggcaucugaucagcaugcaguaaguuuuucuucuccuggauuuauacuguauuuuuucuaacccagagguccuuggccagccagaggaagaaguggaguugggugcagagauggugggugacuugguggaagaagguacccaccugggugaguag

SEQ ID NO: 2970 - RNA, 22259 nt, Mus musculus
cgguagauuagggccagcagggcacguggcuugggaccguguggagagugcgggcgcuggacagcagcuccggccccucaccgacgcgcagcccgcgccugggccgaccuguugacugaaaaucagccggcgcuuggccagaugcgucgauggaggcccgcagcccagcgacgacgugguagucauggcugaagcggcgccugccccgguaagcgccccgguccauggccgcugugugcgagggucucggccuacccggcucggagcacccccugcccuggccccggcccuggccuggaggccacgcaggccacggaagccaucagccuacacauggccgcaggcggccuggugggcugggcccuaagaucggugcgcgcgacauggccuccguagcccggccaggccgggcgcuaccuuuucuccggaaggccuggaaggacccugcagaucacaaagucccuguguucuucugagaccugcgcccgagcagucagacaggagccagggucgccuuccugccacaucugcaagguugaggcugcgaagggggccucaggucaacaccuuaggaugagccuaccacuaaaauaccuagcgacucuacuuucucguaggaaacaauacuuaacccaauuugcaacagguuucuaaauuuugugacuggguugguuugccaagauauaauggcccucggaucuagaccagccuguuuacagagugaguuccaaaaagaagcugggggagggguuagcuugguaauguucagugugccaauuuagaggacaugcuagaagauuuucaccaguaaaaaaaaucucucaguaagugguaucuauuauuaccaauacaucucagacaacucucugaaaccuuagucucuuggaagcuuuuagaaaagaaccucucuuucucuauuuugcuguguguccuucuagguucccugacuacaaggaauagaaagucaacugggaauuguggagguugugggaguaggacuagaaacccuucaguuccuucccaccuacuccugccccuuaguugucuugcaguaccuaacaucccagaaagcuuaccaacaggauagauuucaacacuaugauaauaacuacagcugauaccacggaugcucaagucccuuacauaaaauuguguaguguuugcauauaaccuauucauaugcuuuaaaauacauuacaucgaugucuagauuuccaauacaguggaaggcuaauaguugcaucgaggaggaaaugacgacaagaaaaauguguacauguucagaauagacagaguuuuuucuuuccaaauuuuuuuagggggacauugggguaggguuggggacagaguuucuguguaguccuggcuguccuggaacucacucuguauguagaccaggcuggccuuaaacucaacagagaucugccugccucugccucuagagugcugugauuaaagacaugugcccucccccaccaccacugggcuccagauauuuuaaucccaugucggguguauuuuugauuguagaccugcagguacaugggacaaaaugccuuuuaaaaaagaacagccaggcaugguggugcacgccuuuaaucccagcacuuggaaggcagaggcaggcggauuucugaguucaaggccagucuggucuacagagugaguuccaggacagccagggcuacacagagaaacccugucucgaaaaaccuaaauaaauaaauaaauaaauaaauaaauaaauaaauaaauagaacaacaacaaaacccacaaacagguguuauacucugcagcccuggcuggucugaaacagggcuacacagagaaacccugucucgaaaaaccuaaauaaauaaauaaauaaauaaauagaacaacaacaaaacccacaaacagguguuauacucugcagcccuggcuggucugaaacuugccauuuaaaugaucaggcuggccucgagcucacagagaucuaccugccuuuagcucccgaaugcugagauuaaagacaugugccacucugucugucugccugcucucagcucuucauucuaagcuagccuggaacucacuuuuuaguucaaacugcccuugaaucugaggcagucucccugccucaauuugugaauacuaccaugccugguuuacgauguggauacuuugauuauaugauucucuugucucuugagcagcuuucugagagguacagucagaugugucauaagaggccaccuaccccuucuuuuucacuccagccaaaugcagagaagagcucauaccucuauuccauagaaaucacacuguggaccguggugccugcuguucaggccuuggagaagaaaaguggauucuugccuggcccgcuugcugacucuggagggaugcucagggacagcagagaagaagcuggcugacugugagaagacagcuguggaguucagcagccagcuggagggcaaguuggccgugcuggggacccugccucaggagucuaggcugcugcaugaagaaccucaugggcaacuggaacuucuggguccagcggcuucccccuggcaacaagggggagguccccaagguagccuuuggauacccugacuaggaagcuuaagggccugugccuguaagcauguaggugaacaagugggacauugugguuucaggugccccugaccuuugaugacauggcuguauauuucucugaauuagagugggccaagcuggaggacuggcagaagaggcucgacaagcaugugaugggggcagcuaugagaugcucguuucccugggugaggcuguguaagacccccuuucggggauccccacucuaguaucaggagugagagagcacccaaagaaacacgaggacccaucuugcuguaaucacaugaggcaguuuaaugacggagcuccggaccgacaugcaucucacauaggagauaauggaugucggccacgaggcucgaaagcuaggguuuuuuauggggugaggggcuuaggggugugggauucagcauagcgacacacuauuggcuuauucaaacauuaacagaaagauuacaugucagcaaaagggcaucaggacuuuguuccugugggcugggggcuuaucuuuguucacauagcaaccaguugauguaugacuuuacccagcgucaaggggcaguagacagaggggagguucuggccaggugguguugacccagaagauagcccugcuuguccuugcauuuuuuucauuuuuacagucaagcuguucuuaggaaugucuuaacaacagcccugucuguucugcuuuguucucagccccaggcugcgggcucauagacaacucuuuuacaugaaucacagguuacaaaaucucauuuuccuucagcugcagaggaauaccugggcuuucauccuacaauggcuuccugcugucuuugcuuuugcuuuaggcagccagacucagauuuuucuccaugcccuccccauuguguaugcagauuaugccaucuccaaaccggucauucucacccagauagagaggggagaagagccuuguccugcaggccccuggggccaggagaaggggggugaggagaagacaauaugucaaaggaaaccaaacaccaguaaguauugguacauccugagacugcuggggcaaagugaacaacaaacugcuuuccuggguagacuggaccauuuuggagcuggaaaaagccccuuacccagagcuggcuacacuuugucugcggcuucucugagcaggaguaaagagaaggcuucuccuuagaacuguaaggauucuccucuguauaggaggcaccagcacaaaagggauggcugugaggucagagguggcaaauggagaucaaggauauaauaggcaucuucugagugaguggauggucaguuauggcaaagcaucuacuuugugccaccugcagugguacccaugccaucugccaucacuguuguucagcugacagcagcaggagacugcagaugcucuucugcuucucucugggauggauccuugggggacaaggcuaggacugcucugcagccaguguuuaacaaugacuccucuggggguuggugaggaggcucggugguuaagagcacugacuguuguagcagggaucauguucaguucccagcacacacauggcaacuuagagcuggccuuaacuccaguuuagguaaucuggugcccucuucuggccucugugggcaggagucauggauacaugaaagcaaaacacucauauucucccuuucccacacacauacaaaauuauuuacuuauuuuauuuuugguuauuuaauucagagucucacuauuagggagcucugacuauccuggaauucacuauguaggccaggcuggccuugaacucauggagaucugccuguuucuuucucccaagugcuagaauuaaagaccugugccaccauguuggcaauaaaauaacuauaucuuuaaaaauauuuagggcugguaagaucgcucagugguuaagagcacugacuacucuuucgaagguccugaguucaaaucccagcaaccacaugguggcucacaaccaucuguaacgagaucugacgcccuccucuggaaugucugaagacagcuacagugaacuuauauauaacaaaguaaauaaaucuuuauauaaaaaaauauuuaaacauaacccaaaguagaacaggacaguaaucauugucacugaucuucaggggugagcuuuuggcaagccuagguuauaaggugagaccuuguaucaaagagagaagaaaggaaaaaaaaaucaguaauagaaauguacuacccgucucuuucuagacauaaccacaauaucaucacccacccacagaaaauuaucuaacaccugguccuuauuucuguuuucaguaggaacauggaucuuaacuuuaauaacccaaaguccacauacugcacuugguuuaugucuuuuaaaucuauauaaaaaaaaaaaaacuccauccaaguccacccacauuuucaacaguuuuacugagguguaauuuauguaccauagaauccaccuauuaaaguaugacccuaacuccucaagaucugagaugggaggauugugaucuaaaaaaaccccagacaaauaggaaagaaucaagaguucauguuuaagcagggucuauagaacaggcuguaauccaagcuauucugggcacaggagacucaugggucagagccugcuuagucuacagaaugaguucaaggccagccugggcaacuuagugagaacuuguaucaaaauuuaaaagugagccggccaugguggcacacgccuuuaaucccagcacucaggaggcagaggcaggcggauuucugaagccagccuggacuacaaagugaguuccaggacagccaaggcuacauagagaaaccaugucucgaaaagacaaaaaaccaaaaaaccaaaaaaaaaauaauaauaauaauaaagugaaauuagagcuggugagauggcuuagcagggaacaaggacaugugagagacacaaacacacaaaaauaggcuuuagacaagaauugagcugcaggcagugggcauggccacuguaucuguauauucugucuuuggucuauagccuagaaucccagagacucuuacugugguccuggagucacuggccuccugucugcgagaccuugguauugugcucaauggcauugcuuuguguuucuagguauuucucugaguccagagcaggccccaaguccagcuagcccugcccaggaggaacugaaucaaaggcagacaccugagcagcagcaagaggaagcaaccaugauuccaccugagccaggcacugguaagugagaacagcuggacagcagcaacaagccagauguugaacugugcggaguaggcucuugggagcugaaccuugaacagguagguuuagucuuuucagugcucagaugucugaauagcacugugggggccuggacacacccaucugccuggaguaaggggaagagugugaaugagcuuucuaccguggccaugucucugucucaccucccaguguggcacuagguuggcacacuauaguuucucaggauucuuucugaaaacuugagaacucugacuuuucucuuucauccaggaucugugucugcuucuguuuacaggugauuccugcugguccuuuucugagacugacucagagaauaugagugucauacacagaacugggcuuacuauauucucuuauucuucucuuacugaugaccucacuccuaacccuuguugccuuccuuccggggguuucucugcauuucccccacagcacaugacuucuccucugguguuccauccaaccaguauaaacucaagcuguaugcaugaaauuugugagaugagaccuggggcgggaggagaaugccuccacccauugaaaaacugggacucuguucugggaccuucccuaaccuucuguuauuuugagacugaugaaggugacagauguagaggggcggccugggccuacaugggauuggcaauguggccuuuauagcucuauucucaucucagaagcccuccagauggagccugaggaucuguucuuccugccagacccuugaguaugucuagggcuugcugaggaaauggccauacuccgugauacuugugucaagaauggcgcucaucagauuuuucccucucacagggauuccagcaagcaccagcccuuuaucacuuaaacaggaggaagaaucugcagagggaggagaguugccacccuccccuuccacagauagccugcuuucuguggagccaggugagugaaaagagaaaacacuagugacugugccagagccucaucgaagcucagagggccuuugguaguaacagucagcccguggucaacuggccugaauggaaaauuacugcuugaagacaugcugcagauagaagacucuaucugcuagugauagaaaggcuguucauauaugaucugcuccaguccuacgguaacccugugagguggccuaccgagauucacagccucaggcaucuugcaguuugcauguugaccuagacuuucaguguagguccuucaccuggauucugguuuguuugguuuuuuuuguuuuuguuuuguuuuguuuuucaguuuuucgaguuuuucgagacagacuuucucuguguagcccuggcuguccuggaacucacucuguaaaccaggcuggccucaaacucagaaauccaccugccucugccucccaagugcugggaguaaaggcaugcgccacugcugccuggcuaauucuauauuuuuuuuugauagggcucaaugccaagaccuucuauuuucugucucuggggaccacuauccucaccucagccugugcuuuucauggcucugucccugcaguuauuacacuaucacaguuacacucuugcaucaggugagaccuucacugagaccccacaggaaucauaggcugauugggcagcacacaccuugguggauuuguuugggaugagugacauacaggcaagucacuccccucccucaucuaggccacagccuccccucaccccuuuuuuugaggugggguauauguagcuggcuggcuuuaaacucacuauguaacuaaggcuugucuuaaauuuguggcaguucucccaucucacuuccugagugcuaggaucauagcuacaugugacacacaaagccucuuaauuuuggucuggaagcaguuggcacucaugggcuccugauccuuuuuagauugugacuauucucauuauaacauuuaggaucuugccaucugucucagaaugaacucauggaccuagaugagggaggggagugacuugccuguaugucacccaucccaaacaaauccaccaaggugugugcugcaggacucuaugcagggucccuggccccuggcuuuugcagcuugcuuccuucucugguguucuuagcucagcuuccaggaaugaggcauaagacagcaagcaaaguugaacaauacaugagacacuccugccccguggugucuaugacuaggaccccuggccugaucuaauggcacucacaaagacuggggaagggaggggaggccugaaccuggaguaaggccuggaucgaauggcaggggaagccaugagguccccuuggaaccagcaaugauuccuaugaccaucaagacagaagccccaucugaggaucaaccugagcagaaccuucugcaguccugcagccaguccguauuuagaguccacagaaggaccaggauuaagaccaggggccacagauggcaucacacggauuggggaaccucaggcagcagaggauaugggagagccacccuguauccuuccucagccacagaagcaggcauuccugugcccugacugugggcagagcuucugcuugaagauuaaucugacaauccauuagcagacccauguagaaaagaaacacaaggaggcuuggaguggcuugccuauuaggucagggaaaagccacuccacacuggaaccagagaaagugguggugccaggcccugucauccacuggccaccugaggagcccacaagccaccggucuccaacaagccaugccuucaugagacaaaggccagcaacuacaguuuaccacuguagugaaugucuucacuccuuucagcaacagaagagccugguauuacaccagcaucagcacacaggcaagaggcagagcuggccugccugucccuacuguggcaaggccucccgccggcccucagaccucuuuugucaccaguguauccauacuggugagcguuccuaucagugcccccaguguggcaaggagccaccaccuggcuguccacaugcagacucauuccugaggcuaaacaauccugcauuuccucuugcuuucuguccuccagggaaguccagcccugcaagggcccagcucugaacaggacaggaccugcacugucucagggccuuucccuugugccugccaagugguggaaguuccuucacuuuccagcugaguugguacuuuaggggcccuucaaaagcacaagcuccagaccaggaauuugaggugauagugucaugccucaaagucaugagagcgggugcuucaugugccucuuugucacagcaccuuggggacagccuuguggagcuucuggagcugggugauggauuccaauucugauaguuugcucucuuguuuggcacucagacaccagagcacaugaaggcucccaggugccuucaucccuggcugugcuauugcuaaaguccugcagacucuguagccacucagaaguccugcacagacgaggcagagggugacacugccgucauucccaggguagggguaugacuggcaagacuguggcaugcagccaugguucuggacguuacuugccugcacacccaaccguuguuuaggcccugcaagcaagacagcaguugucaguaagcgcucagacugaacguggacaguauagcugccccaaacuuaauccuccgcugcaagcacucauguugcuguucuggggguuccuaggccucucuucuaaugcuuuagauguucucuggaaaacaaguauucauauuugaagcacaaauccaagugcuggggugggggaagaggcgcuguauaauccuggcucgccuugggcuugcagugaauuuuuuuccccuaccucuaucuaccuacuaggauuuccuugcuugugccauuaugcacaacugggcuuacugcauuuaaccugaaauucaauaggacagguuaaagaguauuuugaguuaagaaugaacaaaggcugcaugguugccugagcucaaagacguuggaucccagauucugaugacuuauuuuguaaaacaaagauaugguuggguugguuacaaggcccuaagaaccauggagguggaaauauuaacuuaaucggugcucuauaaauacacuggaaaauguagcugcguguuuguggccuaguuuguucuggggagucucaacaugugacccuagugguuggcguggcucuacagcucaaaggugaacggagcucaacaccuagugcucacaccugcggggcugagacgaaacgcuagcgaacgcuaugcagcuugugcucccagcuagccaauagagucuggcuucucuaccgucaggggcggaaccuccagggcuagccaauggggagccgccuuguggaggguguggccugcguuucugccgcgggagcagcgaggacgucuaggucucaaacugccaacugcguccaagacgaccauccugauucuguaucgugaggccaggaagggccgccuguaggggacacagcggcuacaacaagacgaagcagaaucgcgcgcagccaugacugaggcggccgcugcaccgguaaggguggcccuuaccgaucaugugggggaugugaagcgguuccugaauucgccgggaggacaucuuaccaccuccuaaaauuggguagagcucagccagguagucagggaggaggacuaggaggucuguugccacaugauuaaguccuugucuccuuugccacggguuugaucauuuguaauauacggccguugagcuucaccaggaaauaucugggcccggugcaccggcugcggucguuuuuacuccacgacuccuuuuuuccaggaccucuuugcuccaucucgcaaguauuagccaucuccgaucaaaucccgagcuaaggcccccuccaguuagcccucuugguccugggaccuagaaucuagcuccugccuaggagggaggguuccacggccuuucgggccugaauucgauucuauuaagaguagauacauacuuccucgcuuguuguuuuuugaugaacaccgggaagacuuuccuacugcaacuaguuagggaaucaguguuauagaaaacguuggguaggcguguuuuagguucaggugagugaacuacugagaugagauuuacagucccugaagguaggaggcaucuccugcuagcaauagcuuugcagugacuucaaagacauuucuugguguuagauuuguggcaaaggaucccagagagacgaagauauuugaccuuuaugugugaagacugccuccucccaaccacauuuuguuguaugggucaguggucacagaccucaggauggagugaggaagagagaaguuucuagugacaaguaucuuacugugugggacacuuugcugugucuuuuuuauggaagauaucuugggggaaguuuaaugucacaaaauuguauucguuacagucuuugguuuagaacauauaacacauucugaccaauagucaggaaccuucauguuuauugguaauacaauauauaauaaaugucauacacccugagugcuuuuucuguuugaccaccuuagagauagagggaaguuccaggauuuaucuguaguccccacagcuccgcauuuuauuuacaguuaugcauggugacauuaccccccuucuuuugacuaagaugcuggcuuucagcuuucucugccacugccuacuggcaucuaagaucuagcuuccaguaaagugacuguucagggcacuguagugacuguucggggcuguuuguugaggugucucagucacagagaccuaguguccaacuugaaacaagcugagguuaccugagaggaaugaaucucaauugagaaaaugcuuccauaagaucuagcuguauggcaagcucguagggcauucucuuaauuaguauuuggugugagagaacccaguucauugugggugacccacaccuuggcuggugguccugggguaagaaagcaaacugagaaagccaugaggaucaagccaguaagcagcacuccuccauggccucuguaucagcaacugccuccagguuccuggccuguuagguuccugcucugacuuccuuuagugauacauagugaucugugucguguaagugugaauauaaacccuuuccuccccaaguuguuuuuggucauagugauucaucaaagcaauagaaacucuaaggcaccuaguagcggguuaggaauucuugcagugcuaguugagucucugggcccuuaagagaccaccaaagaaggaaaagcuggucucauuuuaggggaagcugcucuaagagguagugaaggugcaggugguggccuuuaaucccagcacucagaggcuggugggucucugagauugaugccaccccagucuacaguacaguuaguguuccaagacuauacagagacccugguggggggugaggagugagaguugaguuugccacuggauaggcaggucuauggccuugcuguugggcuauguccccagaggaagaaaauguggucaaauaacugaugaaacuaauauaauccagcacacuuuggauacuuuuuuuuuuccauuguaauggaucuagguucaagauuauuuccaugaggguucggggggggggggucuuugugccuguguauuuggucuuugugucuguguauugggucuugacugggaucugauaagugaggaaccugaaugcauuccagaagauaccggucuuccuguauuugagaacaguucuggaaguacuacuggaagccaacauaucuccuugucucugguuccaggacuggcauauggggacugaccuccaacaacagacccagauccagucugcagagaucucccuucuagcuauccuaucugcuguucaggcaguggaaaagaaaacagagucccaggcuguccaccuucaaaacuuggaaguaagaacagggucagcugagaagaaguuggcugacuucgagaagacggccauggagcucagcagccagcuggagggcaagugggcuguucuggggacccugcugcaggaguacgggcugcugcaacggcggcuggagaaccuggagaaucagaugcaaaaccggaaccccuggguccugaggcucccccccagcagcagggaugaagcccccaagguauucauagagugaggaaaggccuccaaucugaauucuagugcuuaauacagucacuauggacuuuaaggagcuuuuaaaauugucagaaguacagugugacauugggaagguaacaguagaauggguuguugggaaggguauguuugggcagcaacaguugucuucuuccaaaaugagcuuuuuuuuuccuuauugaaaaagauuauuuugcuagcacacaccuuuaaucccagcacuugggaggccgaagcagucauauaucugaguuugaggcuagccuggucuauagagugaauuccaggacagccagggcuacacagagaaauucugccuugaaaaaccaaaaaaauguuuucaccaaguguggguggugcaugccuucagagguaggcagaucucugugaguugguggucagccuaguuuauauagagagcucuaggacagccaggacuagagagagagacccugucucaaaaaaagaaaagaaaagaaaaagaaaagagaaaaagaagggcuggauagauggcucagugguuaagagcacugacugcucuuuuggaggauguagguuuaauucccagcaucuaauggcagcucacaacugucuguaacucccaaggucugaaacccucacauagacguacaugcaggcaaaacaagacaaagucuacaaaaauaccacugagucuguuugaugauggccaauuacaccugaagcauguuauugauugcagauagcuuuuuaguuagagauaggagcccaugacuacuucacuuucucaguacugggacucccauuucccuuucuuccuccuuucccauagaucccugagccuucugugacgaagacauuccauuuaagaaugagugccccaaagucucucacucucucuacauuuuccauugugggucucuguuaguucccacauacuacagggagaagccucucugauggcugagcgggcacugaucggaggcucagccugguguggcccugggggucccccguggagagugcuucugaggaugagcagcuggccuacaggaauggaggugggcuagaagggaaggcccaggaagacugcugagagugagagcugguuuaaguagaggaagucaacagaaagcaucuccauucaggucccaagggaagauacaagugugcaguggagcuagaaggacccugugcacuugucuguuuuucuauaacaaaugugggcagaagcuagcauuuagucagaggugcccucaguuuugaaggcugguuucugaaggggugguggggacuuguauuccuccagguuucugugacuacugaagagguggcuggguguuucccugagcaacaggaagguagcccagaagacuggcagaaggaacucugcaagcgcguagcaaaggaaaggcgugaggugcuaggcucucuagguaagagacauccccaggggcuuccaaaugugcguucauucuuuuccuccauguauuuccucagugacucuuggaucuaagaaccagagcaaauugauccucugccuucaagcugguagaagguaugauucccaucuuuagaguuaaguguagacaugcuucugauuuguguguaugaguuguuuugccugcauguauuucuguacauccaucauaugcuugucugguuccugcagaggccagaagagaacaucagauccccuggauccaguuacagguaguugguugugagcugccaugaauguacucaaaauagaaccuggauccuaccagucaguguucuuaaccacugagccaucugucuagccccauggacaugauuuauaaaggugacucaggucugagaagugagggcugcaguaagcacuggauccucuagccaagugugcaggaguguguuuguguggaacuugauuaaaucuagaauuucauagcuauauccccagcucuugcaucauccuggagcuugcagagagguuaaauggauuauccagagcuuccaguaaagacccucagguuagaaucugcuccccacuguccaguucuucccaguccauuucuauagaguagaggcuuccucuacuuacauguguuccucuagguguguaguggggcagauaguuuuucaccuuauuacacuuuugaugcccauggcccagcucuuuacccuguuuccaccaugcugugcucucuucagggaaguaacuaagucuuagugugauguuucucuuccccugugccuggcacacucuaggaugauaaacaaugaaugggucgaugugagagcucaguuuucauucucuguuagcuaauagcaucgaguuggaaugcagauuguaaagccauuugcguugauaagggaaauucuaaggcaagccccucccucugaguuacagcucuagucuuuuguuucucugacaggaucuugcuauaacucaggcuagcugggaaguuacaggguugcucaggcuggccuugaauuugugccuguaccucagccuuuggauuaugggauuauaagauuauauuauauugcauuuugaaacuuuguaaagguaaagaaacccuuaguucaaaugacagaaacaguagaagggaucacucuuacugaaagaggauagauuccuguuugcucagaacacaaaggugccaccccccccacacacacacacacacuguguguggguagaauuaguauucuauuaccauugauucacaaaauuaguaugacagcaauuauccuuaaucaacuaauucccaaauaaccacacagaguaagauuuuuaaaaauugccuugagccaaauacugagcaaucauuacuuguucuaacccuccacgcuagucuggcuuccuuccagaauauauucccaucuuccuugcauuuugucauccuucauccagcucucuucugauuuuuuuuuuuucucgcccuguccuccuggcucccuccuucacuucugucccuuucuccaucacuuuuuuagaauuggaaguccuuccuuauucccucuaaagcucuuggcuuuuauuggcaaggcagaaugaaugaggagcaauguuuauacaaacuugaaacagaugcuucuaagaauaaacauaacacagccauauccauauuaaaacaagauaugagggcacuaaccuuuacacauugaaugaaaaaaggcauaccugcuugucuauaugugccuguugagguacugcacauguaauguuagaucccuucguaauggaauuagucgguguugagcaucccagugugggugcugggaacugaaccuagguccucuguaagagcucucccucaagccccuuuccuugguuuuagauuuuacuauauuuaagaagaaaagugggggcuggagagauggcucagugguuaagagcacugacuguucuuccagagguccugaguuuaauucccagaguccacaugguggcucacaaccaucuguaaugggauccaaugcccucuucuggugugucugaaaacaucuacaguguacucauauacauaaaauaaauaaaauccuuaaaaaaaagaagaaagcugggcauggaggugcaugccuuuaaucccagggaggcagaggcagguggauuucugaguuugaggccagccuggucuacaaagugagcuccaggacagccagcagccagggcuauacagagaaacccugucuugaaaaaaacaaaacaaaacaaaaaaagcugucauuugaaggagucucugguagguaaacuaaggaagaacucacugagugguuggcaagcugcacuaagauuaaaaguuuuugggggucccugcaggcagagggaccucagagagagaccauacagaagucaguaaguggugcguggaagauauagaggaucaugagggcacacuugguagguggugguacuuguuggcucacugagggcuccucuacaagagccagauggcaaccccuucccguuguacagaaaggccuaggacaccaugguaguuggugucaggaagcagaugcagaguaggcuggcaugucccuggagguaccuagaacuuucuugcagaguuuugguaugccguggaauguggugacuucaggggcucuggacugccuauccuuugauaguccuggcuguuacuccacccucuguuaacuucuccacugucauuugaauaaucuugcuuaauuuucuagaaguuuccaaggaaagccuaauugagacucuucagucaguaagcaugagcauuacaguuucaacgugugcaagugauguggauaccucagaguuuuagagguugguuauagggagccccuggacagggacugcugagcuucuggccuuuugacuaugcaaguacauucuuacauuaauauguuuuugcucaguagugcagaggucaagcauuucucucacuggauagggucuugcuuguagccugguugaccuagaacuuacuauauagaccaggugggcccuaagcuuauagcugucauucugccucugccuucuuauugcugggauuacaguuguguccaauuuaaaaggcuucucaugagcuggagagauggcucugaagcucagagcacaugcugcuaucuauccauccagagggccuaaacuggauucccagcaccuauauugggcacccacaucaggcagcugucagcugcuggucacucuagccccaggggauccagcaccuucugucuuugagcacacugcacucgugcacagauacauauauacaaccuuuuuuuuuuuucuggccaccucccccaucccaagccccucccaguguagcugcuaaucuuauuauagucuguacucagaacucacaacucacaaaguguaucuggaagucagaggacaacuuacaggcaccacuuuucuccuucuauguuguggguuccaggaauccagcuccggccaucagacuguggcaagugcuuacccaggugguguguuacugacuguugacgucuuucuccagagcuugaaagugccacuugcaaaaaacuugguuucccgacuguuugguuaacauuacagaagcagccuguguaggggaggugggcacacauggcugggcagcaccuucucaguaugacuggaccacagggaccuuuggaaccauggagagcugaccuuguauuucgggucaaaacuuagcacgguguugaagcacauguuugguagcuagauaguuguggcuugaaauugaaauuuauuuuuuuuuuagcuuuuaacauaaauuauuuaauauaaaugcacugguugcuggcucccucuggaggcggggggaugcaugauuugcugugguguggguguagacuuuaagagauuggcacagauuagugacgucacuugucccuugaaaggacacuuacccuaggguacugggcuacuuaggcuucuggagagagauugaugggaaucccagcuguuugguuaaaauuacagaagcagccuggguaaugcauagcaacuuagacaagauggcuuuucuuacuccugccaggagcucaaggugucagagacccaggugccuuucaacuugcugcuuucccuuuccuacagaguugccacugcaguucaaggugaccuuugggaagcaacuggaagcugggccugguagcagacaccuaaacccaguacugaggagacagaagcagguggaacuuugugaguuagaggcuagccuggucuacauagugagacccugucaccaaaaagaaccaaccaagccaaaaaucuaguaggagcuggguguggcaaguucaggauagccagggccacuuagagaaacucugucuugaaaaacaaaacaaaaagcuaucaggagggaaagaagaauugcccuuuucucuuaggaugaggcauuuauuuccaauuuaacaagcaaaguuaguacuuaugcacuauaaauauuaauccauuuacaucucuuguagguuuuuugucuuuuucuguauauaggugaagaaacuaaggcacggagaagcuagggaaauuauaguggaaaagucugagccuuuacauucuacugguuaugugcuugaaggaguauuuuggaaacauagcuuauauucuggagggaucugugggcccagccuaaggggugcuagugauggaaggcuauggacccuuaggcauaggcuacugcuggucauucagaagccacgauucccugcucucccggcucccuagcacaccucauguuauuaccagaaaucccaguaucuguucugucuuugcugccucugugguucuucugagagugcgugggggucacugguccuggccagagauggugauaggaaagaccaugacaucugauacccucagagcuucuucuguuuucuucagaaacaggccagcuggaaucugccccgaguguucuucccuggaucaagcaagaggaagagguaugugagaagagccugcaggagacagccagugcaucccugugcucaggugaggcccagggcgggcugcauuucugggucucugaacaauaugaagccuucuguaugagugucuggaaguggcaucgagcagguuuccugugguguccuguggucccuguguguguuugcuguggucaucuucccacagaguugcaugaaauugucauuuuguccccagucuccugucuuugcuuuaugaccuauaguuugcaugguacuagggcacuguaaggacugacugcaugggacacaaucccccauccccaggagggcuuuucaguuaggagaaagauuaccagaaauuagcacuacaacauaagaacaagaagcuaugucugagccagagagcccuuugagaaugguaaaaauuguggacagcauacacagaagacacauauacucuguguuuacacuucuguaaucagguuguuagaggcagccuaucuaucucauucauagucuugauggcacagaucagugcuugucagagagcagcaucugauaguauaaaugagaagaagccuuaagcgaggcacauggcuuagcuuaaaggacaucugggugucauguagaugacucagagugggccucuggcagaagacagaugggagauagguuagugcagagcgagcgucaguaacaggcucgagugagccuguggccgagaugacucauguuugugucucaucccaccagaaacauggcuggcuaacaagaaaaggacccuggaggggauguccauggcaccagagccauccugggcaacugaaggaggaccuggcaaggaagauuucgagcagggaagcugugucgaucugcucccuguuugcagagagagagaggcagcuccccucccucgaggcucucagagucagccugugccagcugcugaggccacugaggaugaccagaacuucagugucagagagcucagcacacagccugaguacucccaccauggaucucagcccuuugccagucuccaguguccccaaagugcuacacagcaggucacucucaccaggaaucgccgugcacccacagcccagcgugccuacaccuguguccaauguggcaagagcuuuguccaccagucaacacuuaccacacacuaccgcacacacaccggggaaaagccuuacaaaugugccgagugugagaagcgguuuggccgucuguccacguugcuggagcaucagcguacccacacuggagagcgacccuucccaugugcacaguguggucgucguuuugggcgccugucuacucuaguggaacauaggcgcacacacacgggugagaagccauuuccauguacccagugugacaaacguuucacacgccuggccaaccugacagugcaccagagugugcacucuggcgagcacgccuuccagugcacccaguguggcucaugcuucacgcacaagcccaguuuccugcgacaucugcgcagccacucucaggagaagcgcuuuagcuguggccaguguggcaagagcuucaccugucgcuccuggcugguacgccaucagagcagucaugcacacuuggcauccucugcuuauguggccugugagaggagcucaccaagucaugugucaccuacaggucuguuuaaaggcgcagccaggggaaaguucuccagugacccuccugucucacccauauccaaggacacuguggucagucaggaccacaaggcauaugguggaggucagcagcucagcgaccauggucaggaaagucuaguggggucucugcauaguugucugucuguaaagauggagaaugcaggguagcacccagggagcuccauaacgaggccacuaggacacgggccuccuggguccccucaaauccaagccaucugcuaggcuucccagggcuagguucucccauggacugcuggugcuaagugccccugggauuccugcugcagggaaguuucaugaacacagaaaagguggcagaaacaagcaguucaacaguccccugagaucuugguggcucccaucacugucuuagcaauguaggcagcaacaaaaggccggcuaggaagguugcaauuuugaaguuguucagcuucugguugagcagcucaaaacucaaacuaguuuccaagauuucucuagggcagagcuggggaugugacucaauagaguguuuaucgagcauguguggauggagccaugguuagauccccagcauuagauuaaaccggccuuggugguacgugucuguaauccuuguauuuguguagaggcaggaggugcagaaguguaaggacaugcuuggcuauaugagccccuguuucaaggaaccaaaacuuaggaguucaaagucggaguugucagauugucucucucaccaguggccacaugcuuauauaacagcuuguguguuuccagggagccccacuggaggggaugggacuguuagugucauugucaccacuuuggaggaaugugggaaaacaggccugugcuguuugcaucuggggcugggguuacugaaggucugauuucccuuacuuuguuguuguucuuuuaagacagggcugcccuggaacuugcucuguaggcugaccuugaauucacugaaauccacccgccucugccccauacucacuuuaaaaaccugugaaaauaaagguauuugugaagacguguaaagucccugucuugccuugacccuaccaagguugguaauuguuugagauacaguaauguuauucugcuccagauuguggcgaugguggugauuacuuauuuucaauuuuguguauuuauugaaguucuga

SEQ ID NO: 2971 - RNA, 24770 nt, Mus musculus
uagucuaugauaguggugggcugccacuggugauuuucagauguuaagauuaguuugagaucucauagacagacagacccgagguaaucaugaccuuguuuguucuucuaauguaugacugguuguugguacucugaugcggaucuuggcuuccauggacucugaggcuggugggaugcccuuggauugucagcaaguugagguagucucauauugaacuggugcccaaaguaccacuucucuggagcauuuugguuauuccuacuccuuaguuagcccaugagguccuugauuucuucuguaggaagauguuuaacaacuuuuucagugguauaaaacuacucagguucucuuuuucuauauuugaacuguuuuaugauauaauuuucaaggucuuagcaaaaaguucuuuguauuaucuuguuaucuucuacagccuauagcaucuacaguaaugucccguuucauuccugagacugguuacuuguguuuucuuuuugcauugguauuuuaccacaggcuagauccuuguguuagcuuugauaguauaaccauuauuuauuuauuuuuuuugaguauauaaaaaugccugggauuugcuauuuaacucuagccuagaagguaaaguguggccaaaauauacauucuauguaauuucaauacuuuuaaauuuguuuauauuugcucuagggcuuagucaacuagguuaauuuccaaguguucuguguauucguggaaacagcagucuuauggugcaguguguuuacauucaggaaucaagagaauuuuguuaaucagcuugcucaaaauuucaacuuccacccuaauuuguuuuaucaauuugagaaaauacugaaaucuuacaaauagaauuaugaauucagauguuuccucuucuaguucuuugggagaaguggaaugaauaugaaaaaaauuaaaacaaaacaauaaaacaacaacaaaacccaccacagucaauucaaaacaagacaggaaggaaggaaaacuaaaaccaaacccaaucagcuaaccccaaacucugaaagugggacaaagcagaguaugaagauauguucaacugugaaugaaucaguaaccaacaccauguaaaugggcucaggccuccaggaccagaaacuggcaagauggauuaggaugggaaagccuugcaaucacagaacuuuacaggggccacauguaggaugaagucugccccagugggagaugccccaguggugaacagugacuugcaggauacugccggaggccacugauggucccuggggccaccuaccuccuucagccuuccaucagucugcagagugagcaggacucacccucuuaacccugugggugauaugaggaagaaguccccacucagguguggccuauggccacuugccagaucaguagaggauagacuucugguccuuaccucugaacaaguugucccagaacuguccugccaggaacaggacccagugaguccagaaggcugauuaacagcugugacagcaucagguccuuagagaccuuccagugguguaguggugauauagcugacgaaauccauaggguucacucaguggcccaugcuccagucuaaacauuucucuaaaccuguuaggacuguccaguuggaucugaaccacuuacggugagcuuggucccaacugccuuuauuuguucuaagcaggcacagccuagggaagcacuuaccacccaggagaugacaggcccuggcaacucuccuacaaugcuguuuggucacuugugcuggcugucagcaaggcagacagacaugccaucccuuucauugauugauaacauggucucauguuuaggagagaaaggacgaaguuccuguccuggccagggauaccuauaccaguccccaauuuaagacuacccaagucuuccaaguaggauuaugacguugaauguuucuucucuacccgggaccugggccuuaucccugcccacugcacugaagcaccagcauugccccacucgccuggagaugcagcugcccguuccuuucaaguggaagcugcagccacuugauuucuacuccacgugaaggcacugagcuagacuugcucacgucaauguccugugcacagcuuacacuagucgaggcagacuucuuggggagucuuuagucccuaaaacaguucucuaucuuaauguugcaaccaggugaccaucaacuauaaaacuauuucauugcuacuuuauaacaacaguuuugccaccguuaccaaacgaaaugugaaauaucugauaugugagccucgcaggguggauccuucaagacccauagguugagaaucacuguucuaaaaucuauucucuguuuugacugugucuguuuaagccauacucaccaagcucuaggcaugguucccugagggguacccagcccuggauaucuccagggaucacuacuuuagugugucacagggcaaaguagccacaagaaacugcuugugcuugucaaggacaaggccaugucacccuuagcuuuagcaggcagccccaggcccuggccuucccagcuccuauggguauagacacagcucgugaaaggccuuagguucaaaaggaauucaggacaacccugagggaccugaagugaguaaaucuaggguggccagcugugguagagugccaagccccagggcagaagcagauggagugacaucuagucagcccagacuggccuaggucuuaggugugucaugagcuagauggugcccuccuccccguuuauguucaauucuaacaggcacagccaaccugcagcccacuaaccugcauguagcugaggaaugugauauacgcaacccaacacaaacuuguaaaauacugaaaacauguuuuuuucugacuuuuuaaaaaucuuaacugucugguucuugaauguaaacuuucuggaugacaacacugucaugaugugaaaaggcugacacuggacacuaggggaaaguguccccuacccccagcacuucagaaugugauguucucuagucuuuagauuaaguucaaaugagaauggaugccauuuaaaacagccuggguccugguaugagggcacuuagagaaaagacucccaggagauggcaugugagcaugaaaacagccccccauagucaaauguccccuucagaaccaagccuggcagacccuagauuugggacccuugaucuaagcugcccaaagucugugacacuuuguacacagcccaggagacugacacauguguaguccucuccccagaggcccuguggcacucuguccccagcuguacuacauaugcucaguucuugugaggugugugucgaagagggggacaccagcugccuagucccaauguacuagugacaaucugggcaaccaugccagaguguuguccccucugagcacccuuccacagaagccaauggccuuuacuuagcaacuaauacauuuaauuuuagaaucuaugugggaaaauucagcuuaguccauagaccaggcucucccuaaaugagaucugugaaguauucacucuagacagacaacggcuagccuuuuaguguucuugagaucaggagcugguuaaggugcccuuguggugcccucugcagcuggcucugugcacaugugguaugcaugacacccaccuggaaccuagauggcuuugccaaggaggaagagcaacugacugaaccugagccaagaaagucagagguacagcugaggaaugccucugucguggcucuaugcagacaccauggaggccuggcacagcagaggcaaagagccagacuugcagcagcaaugagagggcugguugaugaacagguaagaaggaagauacaaccccuggaaagcagacagccugggauggcuggacuccagagggucccaucaggacaucccugccacccagaaucuccagcaaggcugagcagacaaacaguuaaugggccccccaccuugggucccgguggucaccuccccagaggucucugcugagggcuuccccuagcaggcugucagguuccuugggcugguuuggaaugcugauggcugccacucuagcagccggagguucugugucugcacugguugcaggugaggccacaagggggaccugcacugaaguaggcacugaaggggagaggggauucugguggcaugcagugugcuccagaggagggugugcagucagcacaguguggccuccaggcguagaggagaucugcugggaugaacuacaggugggccuggaagauucuaccaaggaagccucuggaggcagcugaggcaccaaacugcccuucccucuagagaguccugggcggucacuagucuugcagccuucugccuggguccgcagaaucuuuggucugggccugguggggcccuucugucuccaguaggguagaugucuguggcccagucuguugacccagcgaggucucugggggagggccaacugccaggaacccugaccuuuugggccaaggcuccgugggugccuucgcaguugauccauuugggucuucaugguugcaacuuccugagucaggccugccaaggcugcugcaagccggucuagcuuguccgugagggcaguaccaagguuaugcagcuccugcugcaaggaccugccacaggggcaugguggcugaagagaagugggugaccauuuugacaagacaguugugggaaggggagacuugcuaggugacuccggagggucuccagagagcagcuucccuuggguccuggcuaaaaccagaggaaggguggguaaaagugcuuagauauaaggaucuuuucucuagccccagagaccucuuuaguguagucaguauccugccccauaaggccggguuuccagagaauuuaaucuuaaguucccuuuuccccaaaauggucuaauucuucagucccacacgccuugaaugggucucacccuaggcaacauguugcuagucagggccccugacauucuucacccucucagcccagaauggaagagagaucggcugucugcugaagcccaggcaauggccugaguggcccaaggacucacaucuuguuucaccaaguuuuuaaauuaaagcaaggaucugauacuguggcaggaggaucacauguuccagguggccuggguuacuuggugaaaccuugucucaaacaaaaacuaacaaacaccacaaaacaaaauaagaauguggucugaugcuucaucugaagggcagccagggcaauacgaccuugccuucucagaggagccacagcucagagacacagcaaguacccagcacagguauaagagcaaauaacugcauguggcauggacacucaaguccugcacaccucugaggucuucccagcacaaaucagggcauggggacaucacccuacuguugucacugugggucccuggagcaauguauaaugugaagccugugcucugugcaggauguuagcuaggucacucaacagugcaaagguucagguccuucaaacccaaacuuugacuccagaugcuucgcaaugccucuaaaaggugauccuguacaggcacaucuaugaaaacccugaagugaacuguguacugaguggcuucaguguaacacuuuccuaaccauggcgcagggaacuuggagcauguuuacuucuuuaugaugggaccugguucuaauucucucagcggccucuaaaguacagcaaaugcuggaaaagccagcagcucaccugcggcacuggguggucuauguccaggcuccaggucccuggagucuucaguacccuugggcucaggcuuuuccuccagcugaggggcaggcgauggguggccagcugcugcugcagaaaggacacagcacuggggauuaggacaauacugcuuugucagcaucacuccaacauggggauauucugaugagccacaacccccacuccuacccucacccaaggaaaaaucuucaacuuuuaaacaaugauuaagucagacgcaaggugcuggggauccuaacacugacgggcuagccugcugugcauguggggacccacugucauuuccuacuaaguccucggugucuuagaaggaaaugugaggagugugggucauccugagccccgcacagguggcagccagagccugcgaguggagcggccucugaagaugguucccuggccccuaccuccuuuuccuucagcauuggugacaggcccaggcuggcgugugcgcucugcaccaucuucucuucuggguggguggggcuucucuucugcucuuccuguagaaacaaagucugggucccaaggucacagcuccgguggagaguaaaguggcuuguaauaccagaugccauuucuacacuuccggccaauuucaaaaguucuauucucacuguguaugugauguuggcgaucagacccaaggccuaauguaugcuagauaagugcuuuaccaaugaaacagaucacuuuggauacuucuuuuguuaaaauugucaagccuuacaaauauuauuggauucuauauggugaguaugcguguacacauaugcauaugugcauacauuaaugaacauauaugcuguguauaaauaacauguauguaauauacacaucauucagugguuaccgagcucuccuaacagagcacagcucuugacucaggcucgcuuucucucuggcucagcuuuacaggcuguaaagcauaaaaaauuagaggaacauuuuaaugaaagccagcaaauugacagugggacucggagauuguugaagucuggaccucuggcccacuggggacauguggcugucauccagggagacuccaggcucaccugcgcugaggcugcugcagucccugggcucuguucucucacggucuuccgcagaacagcuauugcuguugacucuuggagaugcgccagagacagggcacagacgaacaggguccuuacaggagggaggcuggucuuucucugcgucauaaguaagcuagcaucagaguacugacaggcaccgcaaagagcagccuacugccauucccacccccaugccagcagacucacgcuggaggggugacugccaaaaugcaggcucuggucuuaggucuucuccaucagagcugcugaagcuggagcuggagcaagggcugggacuggggccagggccagucacgcaggugaaacgcaagggccucacaggcaagaucccccucagagaguucuccaggcggugcagaggggagggcaugguggcugucucuaaacaaaggagaagaguucaccgacugguaccugacagcaccagucuggauagccaggcacucgggauuugucuuuuucugcucagccacacccuauuugggcucuaguggauccugaauaacuuacuuccuggucacaggcagagaagcaaagccagaagcuagccaugucccuggcuaagugagcuucagaacucucuggaaguuccuggaagauguggaacucccgaucagguuucaguuaggucuugagucuugcaagcucagcagcccuuccuacuggguagaugguugccaacccacuucuuagcagacucucuccucagcaccaugcaagagcugucaguuuacugagagccacugaugaacuaagugucaucauucuacccacugcaaagacuaaauagcaagguccugcuagagccaccuacaauccacagcagguguaccuguuaacaccagcagcaucuccacugcagagaccccccauagguacaccaaacagcauccuauucuuucugucugcgucuauaagccgugcaaggaaaggaagauaggacagaaauagaaaaacagagacgggaaggcuauuggcuugacaaaaacuaacuggagggaaauuaugauguauauccugaagguagcucacccucuuguggccauugccauguuccuggccugguggucacuugguggcagguggaaguacaggucuguggacugucuugaugcagacuccugcugggcacuucuccaggacgcugucugaggugggguggcucagaggccucaccucucaguccuguuuuaaugagaagaguccugguaguccuacgguaccucauccugccacagaauggacagaauuucugccacugccaggcuuuuagcacacaagcuucaggugugggaauggccuugcuugguugcugcaccaacccaagccauauggaaucucaggagguauaaaauuuagugcccagacaacagggcauaauacagccaugucagaacacuuggucagcaaagcucuggcucaguggagcagcagacaguaguucugggccucuaugcccuggacucugcacucugccuaucgcuccugcacaugucgggaagugacuauccaucugccugccugccucagggcucuggccaagcugguuucagagcauccucucagcucagcugagaucugagggcugcuugccgcugccaaagccaguguaggauaggagcgacugcucuucucucaaacacccacaaauaccauuuuguuaccuucucugucuccaguccaguuccugggcucuguucucuucaauccccuguugacagccgaggagcauggccaggcagccuguggccugggaauagggaucucucucaggcaguucuccaggccuuggaguggagaguuuccugguagauagccugugaaggucaaacaugaacagucuaugauggguugccagugcucugugaaucccugcagccugccucucaguaugacaucagguuacaggaagucuaauuuuuccacagguuucagacacauugcagacagcacuccuagccauacagucuuauguaaauaauaugaacuagauuaugugagguucuagaggaauaagguuaacagacagcacuggccgcauuccuuugugaggcaccuccugucuacucuggaccugggcagagguuguaagcaagggagugucauguggggcuaauguaauguagcauugcauagcuuagaaguaaaagccacagcagacaaaggugcuuggcacaagucuaaguacacaggaguuugaucuccagaacacuaugguguuggaagauuuagaacugacuccuggaaguugucuucuaccauauauaugccaugauacacacacagggguagggggaggcugaaaguugaagggcauuugaauuguauacugugggugggggguaaggguuagggcuggggagggggagggguugccucaauaggacucaugaagaggaaaaaaagcaggcuccauaacaaaaguagucuccugaacuugcaguaaaauguuacuuagcuuuucuacguaugugccagacaaaagcaaagaaagccacccugccccgauuaagcaguguuuggaaaaccagcagaaucuuugaucaggcaagaauaggacacacauaagcaugugaccuacucagcuggugcuggucuucaguuucagcucugcugcuuuaauagcugugcagugcgacaagccaagcuugacauugauccugcuguugacuuagagccacauaaaucaggagcuugguagguguggguuuggggacugugagaaaauguagcucuccacagucauccacaaugcccgaaggaagcccuggcaggcugguuuuacucaucaggggaaacuaaaaugagucacucuuuaagcugccaugucacggaugcagaugucaauuuuacauuucuaggucuucccauuaacaacagauguggccagggcacagaugggcagaugaaguggguauccaacauaggacaaggcagacaugauuguuccaagagggaaggcaaagguagaugcugagagagcucuguaaaauccccaaguuuggucuggagagauggcucagcagcuaagagcaugacugcucuuccagagguccugaguucaauucccagcaacuacaugauggcucacaaccuucuguaaugggauccgaugcacucuucugguuugucugaagacugcaacaguguacucacauauauagauuaaaucuuuaaaaauaaaucccaaaguugccaagacagacuuccucuggcagggcccagggaaguacaugauacugaguauaacucugaaggcggucuucugugguucucacucuacuuccccuaaguuggaggucaguuaguauuauagacacuucuuuuugucuggaauagggaaguauuuacacuaagggaaauuaaggacacauggccagucauuguccuauccucucugagcuaagucaccacaacagaaccucucacucugccaagacaaguccugggucugcuucugugucggaauucccgcucuucuuuuggugcuagagcagagguaacaguggacaaggaccuuggacuccuucccagaggacuacaaccucagcuggaccagcucaccuuucccaagccguugccccuggcugcuccuggggcuccugaaauccagauccccaucacugcugcuggcugaggagaagcugguagggguacccugggagccacaggguugaaccccagguccuucucucauguagcccugcaagcucagaggcagaaguggcucccuuguagcuucugcagagagaagaauaauugggucaagucagagccugcuggagaaauccuugggccuuagaguauauggcaccaggacaccuagcccagagauccccucccacuuccgggguuucccauggcacugaugaaaagucuaucuagcacccccucucugcccccugcaaguacucuugggaauaaggagaaguccucagagcagggaaaguaggugguagcauuugauucucagcaaaccuggauagcuauuugggggaaggcaugaggcagggguuaggaaagaaggacauauacuugaggaggcccagagagaaugaugaccagcaucuuccuccuguguggacaggaauaucuguuaacccaggcccaaguaccuucacugugagauccuuguugcuguagcucaaaccucugagacccggcaucuccuagcugaggacuucuggaccaugagauggcuagugacugaagaggugaugacccaccuggagggaugcccuucagacaggccuccagagcuucuaggggugagcuugaggcccugcuggcuggacaagagaggccaccuuaucaucuuaucuugcugggcucuggccugcuugucagaccccagcuuggcccuuggcuggccuguccacagccugcuucuagagcaggcuccaaggaugugauaagcaggaaagccucuagugaggaacuuugaauguguuuuccgcuucugaagaaggaaugaagcugaccccaacucugaggagaaggguggagcccacaugcaguggucagcuuuuauagccaggaccucacugccaaaggaagguccugaaaccagagggcugccugcacacgggcauggauuaagaacauggacuacaguguaacagcuugggaggagaggcagggaaaaggauccuuagcugaaagagaagcagguacuugugggcuuuggaacucauucccaugggaauauguggguagauaacccagaacuuaccuagagucauggggccccagcggggcacacggaccucucuguugucuccaguggaauaggagcuauagccuugccugcuaagcuggcaggaugcuggcacugggggacucugggcccagccaucuucuaccuucaccguggcaagcauacugccagcuucaugacuaggguggggaggagucuggaggugucucaucccugcgggagaggugauugcuggggagccuugauuucaggcuuggacuucccuaaguucugagacgcuucucuuuauaagguuacaagggacuuucaaggcuccucuacuuccauagcagucacuggcucuggguauaaucaccaccucucccagcccugggugcugcagagcuuucuaagagauuuuaaauaugaaucccuuccugguuagcaacaagucagauuuugcuucucaugaagcaggcuuggcucaagcccacccucucuaagcucccaaggcuguguucugaggaauacaagcuuacugaugaacugacaaaugaucucaauccaaauaaauguaccugcuaggauccccaaccuccagucauagcgccuaggcugcacacaggacaacaggaauccccagucacaacaacagccuacuguguuagaacucuuacccucuaguucacuucucucuacugccccaguaucccuuguagaagguucugguacuuuuaccuccucuaacaagagcacugacuagggaucucccacugcuuugcucuuuguacagugaugaaauccaauggguccucugacuaacacgcugcuacaaggcaucagauuuuguuguggggggccacacagcuguacucagagcagggaaagcaagcacauuacaucuagcucccccaccucuaagccagugagcggccuuuaccuccagaaugucuuuucccuggguccuccugcagcugcaagucugaugcuccugaggggcugggacgucggucuggagcuuuugggaucuccuucagacaguucagcaggcccugaaggggacaaucuccggaugcugccucugucuucacuaagggaaaaggcacaagucucacuuaaguucaguauccucagucuccugacagacagacaaggauuguccugggcgcugucugagcaucacagggacaggaacuaggaccuguagacuuuccaggugggcagcaucugggcacagcuaucgcucaggguggaaacugaaggaguggcuggaauuuucggagcucugacuacaacuuagcuucaaggcauaucaggccuugacagacacauguaauguucauacauuagaguaauucuguaauuaagcucaccccaagccagaggauggaacagcucuacagaugcaagaccaagacucaaagcuugacaguuuuuugaggaaaaucucaggcagaccagaguguccacugacacuugauucaugucaacagaagcgacauuugagcacugaguucucagagucccacauuagaaggaccagagaacaguuaggaaaacagggucaagcuuguugcugcuauccuugaaagagccguuaggcuucagauacuugagugcagggacacaggaucauccacaguggucauaucaugggggacaguauggaacauaguaauagcuaugaguggcaaucugaaccuucugggacuuuggagacuuuggccugggcaggccagguacccagggacucacccgggcagggcaggcucccagccucuaccucagcucucgucugcuucaacacacucaagccagggagagaaggcggcaagucuggggcugucccccggugcuggggucugggcacaaggaucuccuucaaacaguugaugaggccuugcaaugggcuguucucaggaaggguuccuaugcauguacaaggcagcuaaggucaguguaguccugacaggcagcaugagacccucagcuaucuccaucucugggcaccggugaaccacccguucaaacacacaaggcuuaucuuauaguauuguucucaaccuguggguuacaaccuccuugggacuagcauaucagauguuuacacuguaauuuguaaaaguagcaaaauuacaguuauaaacuagcaagaaaauaauuuuaugauugggggucaacacaacuugagggauuaaagagucacauuaggaagguugagaaccacuggcuuauggggacgucauggaguucaguugggugagugacaugaccuucacugaccccacucagcucuaggcugcuccaccucagggaaaggcagccucuuaccuguucccaugcugccucgcuccugucuuagguaacucuugcucuggcccaggcuuugaguggaaugaauggaggucucucucgaggcuccuacaccuuccuucucuauagauaauggcuuaucaucaguuccuacugcaaaacaccaacaaggccauguuaggaagagacucagacccuggagucuccccagaucugucuaccuaaagaauaggucacucuaguucuccaauauuuugagagucacccaaauccuaaacaaagauggcuagggccaucuuuggaagaucugucccaggagggcuggaggcuguuuccucucuccuucuggucuagcuguaaauacuaagacugguucaugccaaaugcuuccagacucuuucucugaucccagucugugaaucuagcccagccgaugaagccaauagcuacagcacaggucaggcuuguaaucaugauuccuaugugauucuuguaagacagauggcacauggaacaacagcuaacuggaguacauauuuggggaauguccuuuuuaaucuuuauucccuuaacuauuuuaaauuaaaacaccacaacaggacuggaggaugacucaggcacuagacgcuaggcacacaaccaaaaauaaaaaacccaaaacauucagacaaguacgauuucgaagaauucugaaagacaaaaugagaccccagagaaacucuagugaccagcauugcuucccugcugcuagcuuugcugagacaggcugagaauccgaccuccagggccuguaccuuaugaacugcucagcgcucccugugugcauauauaguccucagcgaucaacaugggggacaggccaucuggagcuaagcuuuagaucaccuagucuguagaccagaggccaagugcauuuucucaguaucuagagaccucuguuuccaguuagcuucagagaaagcugaggcagagaaagugaagaguccagggucuaaggccagguuccagggcuaggccuuuacaauguuggaugucucuguacacauuaggucagacucacuagcagguaaggggcuuccgugugcccagucuccaggagggccaccggaaguugagcugccugugggugugguggccaggcugggguggcuugcagggcucuccggaagagaauugagcaggccucggggagggcaagcuuccacaaccacagcuacuguugggagauaaagaagacgccaacugguaaguuguccuaacauuaccgcugucaguguuuucccugucauguuccacuaacaaccaccaggacaggagccaucgaccugagcacugccacugcugagcucugaaacuuuacagugcauggucuuggcuaugaccugggaaagcacagagcauggaguauaaagccauucuauaccucugcucccuucuuuuuuuuuguuuuuguuuuuugagauaggguuuuuguguguagcccuggcuguccuggaacucacucuauagugauguucagggguuugugagcugucauguggguucuggaaacagaaccuaggcccucauugagaccguggagccaucucuccaguccggauugacacaguucacacaggagcuuauccauuuguagacuaacacaaagcaccagggguguucucaugaaaucccuuccuuucauuccucguuaccaugagaacacuuacuauaccaucucaaguugaaacuguuuugaucauaucagguccuuaguugggaaaguucauacuaccagaugaguccucauggccucgaacucagaaauucgccugccucugccucccacgugcugggauuaaaggcgugcgccaccacugccuggcucugcucccuucuuacguuauccaacauuaacuaaagagggccgaaaugggucaugcucaagggugaggucgguacugagcugaccagguagacagggaaagaccaguuugugaagcaggacgagcaaaggcuggccagaggaccuaggccccauugguuaucaggacaaagcucagcuccucucuuguucuucaucuucuuacuagggaugaacacacugcucaccaccauacaaagugcacggcaacagggagggauccccagguggcuggacccacacaagaacaccaagaaaaggcaugagcuguuccuguacccagcaggucccagaagcugagaggauggauggguacacagugaggaggucaagagcagagcuggaaggcaucuaugcacagcccugugacgguagugagguuacucaugcagcuuaugggacuuacccucggggcuuguuugcuccccauccagacuggugcucccacucucggaguaguccucaguacccuucacuucuccaaacaagaacucuggaaucuccuucaccagcugcacuaaugcggugagguguaggcucugcugaggcugcucuccuguggaggugugugagccaugugcucagucaccuagcuccucaaagaacccuuucagucacagacagcaaagggcucagagaagggggugcuggacuuaggaggguucuugcccaguagaucucaguagcuccuccugucuccuuucuuucuaagguaauacugaaaggcccuguggucugucugguuuucuaccuucucucccuuaccugggcccugugugcuaccucuacuguuuaaacuguaggcuggcucuggguaguggcaaguggggcccaaggcaacgguucucccugacaugaccucagguuuuauucuuagcauuucucuauggaauagaccacaugagucuccaacucagagcagcaaggagcaagacucaagaaguccuggacugaguuagcugaagucaaagugucauuugaggggcagaaccuaggagcucaaaaccaugacuaagaggaagugcucaaagucuauugggaggaccuacccugggaacuaugcuccaaaugggguuuuugucccuuauccugguggcucucuccugauguggcuccuccagccucugcaggugacaggaaagcagagagaggaagcagcucagaggucccuggggaaaggaggagcaguuaguuacgucaggaacugaguggcauuuacccucccacagucacacgauggcccagaugccugcuuaucuauguauagcuuuucauauaucuuuguguggucaucaaaucaaaagaccauauaccccuaaagccuuguacccagacccccacucuagcucacagaaacaaagaaaguaucaaaggaaaaugcagcccugggcagccucaagcucugaacacuccucucaaacuccucaauucacagguaaggaaaccaaggccuggaggagccuaggguccuagacucaagaccagcaacccucuucugucccugcaacccacacucuggaggccucaggaccucacccacagacaccaacgucucguaguuuucccgcaucacgucucuguagaauucccgcugccccuccugcaggagccgccauuccucuucagagaaccgcacagccaaguccuugaagcugaugggcaccuguggguacagucuccggggggguuggcugcaaccaugccaacaaggcccacccaaacugucccuuagaacucagugagccacaugggucucuuggugugcagaaguaggugggaccuggccugggagaagcaguaacugggacagugguggggcuagcugggugcccaggaugaugugcugucagcaaccuuuuagaaacaaggucaccauggguguaacuuggaaagaugaaacuacauuccuaaguacgcaggcaagcccuacauucacucugucagugaagaagugaauguccaaggaccuggaacucuagcacuguggcauugaaagggggacaucagcuuauaaaaacagccaaggucuaguauucuuuaucccaaauuccuggggacagauccauuuugaauauuugguuuugaauguuuucauguacauaaugaguuauuuuagagaugacacucaacuguguucuuuuguauauaccuagcuaaugguaacuuuuacaguguuuuugguauguuguacuuugacuacaaacauuuaaaggagcucagauguggacuucuccacacguggcaucacagugcucaaaagcuuugcccucuggagcauuuuccaucuuagauuucugaacugggguuaaucaacccacauagcaauaaauaaauaaauaaauaaauaaauaaaauuaaauaaaaucucacuuaaugcucuucagcagggaugacauaauuuaugucagaaauuaaacaccaucaaaaggcgggggaggaacagcaacaaaaaccucaggaagccuugaagaucuagagacacugacccuuuuccaccugccagccagguagcaggugagucaggcgcucauaggccugaccuaugcuuagggccccugaucucagcuccaguguggguccagguuccuagcugcuggcaggaggucccaccuccacuuuuccaguccuaccugcccuucauggcuucaacuguccacaaacccugguacagccuuggucaauuccacugcggagagcugugacacccaccaccaggcucacgcagcagaagcaugcagcagaagugauguccacaaagcccccuaggccgcagucugacagauccaccucaccaugcucccuaccccagcccucccacuauugccacuuagcaucgaaauagcauuguaguguggucauuagggaccuccugcucagaaggagcccagaaucccagggccuucaggaaacacuuuacaucuacacuccacaccuuuagcgacuaugcucaccugcuuccugcggcuuuguaagauaaaagcaaaagcucuuacuuuaaaagugaucauuaaaacagccaugaaaacucagacaaugaccaacaucugauaggcacgagcuucaaugauggcagaaauuaaccaugcaaauaacacaaacagaauguaaaauuaaggaaagaagccaucuagguuagaaacaagcaugcuuugcaggaaggaaucguaaagaaaauggcgacgcuucuaauaaggcagaggagacucuacugccuauuucaugcauuugugucacugauuuuaaaaacuaucucugcuacaaacuggcagcauugucauccacuccccgacaucucucugccugccauuccugacagcugacagccaucaaugugcauacauggacucacgcacccagaguccugacguuuugaaguaguuaggcuccagucacacaucuggccagggacagcaucuccacugacugccgacaucuggaagcccagaagggaucagaggcaguguacuuugccucuuggcucacugugcauucccaaccaucucuauggccugcugggcaacccagcagacucucuacccaggcuuaacuuguggcucuggcccacuauggccacuaucccucaggaacauaucagguauuccacaaaccucuagcagggagccauuuugcauuucuuguuggccuccuagcacacaaaauguggacaaucuuagguucuguaauaaagagccaacaggguaggcaacggcacuacugcccuucaaaauaucuagcaccagguggccccaggcagucaccuggaaaugugcaucucaaaaggguuucuaccuaaccaguuagaggucaacacaggcuuguggugagaauucuggaauuuuuguuucuuuuuuucuuuuucuuuaaaaagaaaaaagcauuuuaagacuauuuuuguuuuaaucccaggggugggacuacggggcugcuccgaagcagcugacugugauuugccuuaugcuuuagcagaggcaugguucugccagaugcagaguuucugagauugugugacaucuggaguucuggggauuuucaguggguauauaaaugcuagagccucaauaggugggguuggcggucauucagggggguugguugcaguuuguugguagcaggguaaaagaagaaacaaaaggaaagaaauuggauucagaggucucuaucucugucuccccucuauccuuucucuccuaucuagugauagcgaaacaaacaggagggggauaaaccgugggaaaaagaaccuacaaaggaacaaagaccagcuauagaggcuaaucugugugaugcaguuugugcugaacauacaccuucuuucuaggugucuucaacugggucaagugcuaguggacugacugaccuguucucacuaacaauccugggucuggaaucucuggcaagauucccacagugaacauucuacauaggucauucaacaucaugcugggcgagcuaagugcuuccuggugacugcacuggaggccucugggaaccugcccucaaauguccucuugacgucacccgaaagauggugccuuugcgauugccggacuuaucagauguguuuccacugucauggacauagcuauggagcuaacuacccacugagccugaauccucauaggugucucuaagccucagaugcucuugggggacccuaccacaggaccccauuacacuuggccaucuuacccccacccccauguauucuacccaucacuuucuagccuccccuuuggcaucucugugacagcucuguccuuuggucucuucuggugcuauccucuucccccucucccuucugguauccuagcagucagugccugggaaccaugggggcuggcaagugggaagaagcugcugagagcagauucccaggucugccauaacagcucaggguccaaaugggcauaugugugccuccugcagaccaaauauccauauuuuacucccacacuuuaaauauguauagaugcugaugugaugaacacuuauaucccuuaaaagucauauaaauuaugguguaugaacauugaccaccucaugcacuuaguagacaacuacaggggaucagagaaguuacaccaucaagaaggaaggggccauaaagcccaaacaauagaagccccuguuuauaaucuaaccuucucacugugauggcuaagggaaucacuggacuguguggccaagccauggcaacacaaagacccaacccaauguggccugcaacccaaagagcuagaacuggccggcuguuucagacccugccagaaggaagggugcuccuacagaauagcaugggcuuacaaacugaguucagcaaaaaagaaaaucuuguuuguggaucucuggccuuggccacaugaccugcauauuauggccuccauagcagaacuccuccuaaauagcagcauggcucaggcuaccacagcuguaugcuuaugagacagcucugcauuagcacuuggcuuuccaugcaggguucacuuuaggugagagugauuaagcuauacacagauuaaggccauuaucugggggaaguaauuuccugauaaaaaugauggggcuagccucuucuuccucucuuacucgugcucuucugcucuuccgccuuccacggugggacaacagugcuacuggaugugaagagccuccuggugcucacaagcucauguuuuaaaaguuuguucccugucugcugaaugauuuuaggaggcuauagaaacuuuacaaaguggaccuaauacaucacugaguaaggcccuuugggauguaguacuccugguuccuucauacccaacccccuaucucccaaucaccaagacguagagaaugcacacuuugcugccacaauguucugcccaaguacaggggucaaaugaccacaacugaacccccugaaaacaugagucauaguaaaccuggccucccuuagguguuucugcuaggucuguggucagaaccagaaaagcagcuaaccacacauuaaggcaacccuugccaggcaccagguccuugccuuacacguuagauuucucagcagcuacaacuguggggggaaaagaaaucugguuuguuacuguuugcuuuuugagaggcagccucacuauuguagcucugguuguccuagaacuuauguaggucaggcaagcuuuagacucacaagagagucugccucccaagugcugggauuaaaggugugcacugccacacucagccaaaaucuguucuuuauaagugacccaucuuagguauuuuaacauagaaauacaaaggagacaggaggcaagauauuucaacagcuguaucugcaugcauuuucaguuugucagcuucauuucucacuagaaguaggcaccugguuucccuccuccugugcuucgauuacuauaacagaauaccugagacagggugauuauaaagaaaauaaauugacuucuuacaguugcagaugcugagaaauccagggucaaggggccaugcugguugaaggccucccugccacaucguaugguacgugacaguuugauggggaaacagagaaagcaagccagaaaggccuucuaaacaagacuacucccccagucacccaucaaccccaaugacuuuccaacaaagcauaaacaugacacuaggcauuaaguuccuaacaggugaaauucagaggauacugucaagccacagcauuucuauuagucuuuugugagacugcucaguccuuuugagagccacaaccuaaggugcacggaaugaccacauauuagucaugggacuucagccaaauggcugcccuaucugagcauuagcaaacucaucuguacuaguggaucauauccuaguccacagggauacuguacagacaggauuaauuaccauaggcuacaauaaaucuagcauaaaugcuguggcucgugucaccaaggcuaucugccuaaucuccaccucaggcucuucuauacaccacuccugacucuggggggcagcauagguggcucuuuaucucaaggcuaaauauagcuggcuccuuuaggccuuugccugcaauguuuuccaggccucucuccaacuagccucaaaaggccauccucacugacaggguuuuguuuugaugcggaugagaacucgcucugaguggagagaugcucccuucagagcuuucccaaauggaagaagucgaauuggggauguuggucagaugguaaaguguuugccuagcaugcgcuggaauuaaguucccagugccacacaaagccagauaugguagcacaugccuaugauucaggccguuguaggaaggucagucaggucaaagucaucuucagccacaugagagucugucuccaaaaauauaaauaaaaagcaaaggaagagagagugugugugaaggacagggaguggggaaggggaagagacagaguggauggggagauuaacuucagaacagcuaccgcuggcuugccaucuggaccucugcccaaucaucagaagaaaaccuuccaggauuaacuaggaccacuguagaugaucaaucuccuugcucauaacucccaugauggcuuccuaagaaacugugucagucucuguaugaaauuuuaguuucagcacucagucuuguaucagccuagccccauugccccagcaugccucaggcuaccagggucagacccuguaccauggcugcuacucacuguccccaacuguagacugugcacacaccccugugauucugucaccccugucacaaugaacauaaagaucuuagaccaucucugccccucuuccuuagccugggaccuuguacucucagagaccgugccugaccaucuucucuaugcaguauaugaauacucuuccuugaacaucagguuggagagaucugugguucaauucccucaucuacagaacagaaaacccaaauaagcagacucuaggauggggccagugggaguaucugagcaagagucuugggcuaccuguuagccauagcuaaaaaagacgcuuccaggccagacaauguucgauuuaccuggcuuaucguuucuccugagauucuugugggguauuagugauguccagccacgaccucaacacaguugccuaaguuuggccaaagcucguggaccaaaauugcacaucugacucugggugucuacccagaaggcagugcagcaacugcccuggcaucuucacagcccacgauccugccgaaacuguaccuaggccacaacaacugauguggcucuucuucagcucugggacugacauauuuuaccagcauuaacuucgaucuguuuucuuucuccccacuuuuccggcccaauucacggggauuacguaucuuaacaaaaauaaaugucagauuuaguuauucccccaagaccugcugaggcuucagucgugcacacccucucacgaucuuguaaugaaaagccaaaggaaugaguuccccagguagaaaaaaagcuccagguccguguguccugggagaaggggagagccuuagacuucugguuagggaauucugggcacuggccgaccuugaucggcucacucgagcucaaagucggcggugacggauccucccgggccuguugcccuggggacugcgcugcaccaagaagcccgaccgcggcguucgucgguccgcaacggcucgucuuaccuggagcgccauggcggaacucagcuucgcgacucccuggcccacccagcuuccggugcggcucuggcuggaggcugcaccgagacccucgagacccucggggacagcggcccaguucugcacgacaggaagcggggccggggaacucgcuacaccgagaaccgcagaguuggcucgucugggucggucuggcgcuucgcaucccgggagggguggucccgcuuccgcccgcagcccccagccucacagcgguaacgacgcaagcgcagacuacacuucccagagggcgccgugccuggggcg

SEQ ID NO: 2972 - RNA, 18136 nt, Mus musculus
ccucccuccuaggcugugagcacccucccuucuagcccgagugcccuuccuucuagccucuucuucuccuuccucuccccucugcccuuccucgguccuaagcucccacuuuccaucuccacacuccgggcaucuugcccucagaccgucaccugcacccaagcccauuagugcacccucccgcggcaggucucucgaagacccuccgcuuuagccugugccccggagcaguguucccgcuucccggguuccuccccccgaucacccgcaacgcugccccacacccucucccuccgcgucuuuccuuccccuccccgcgaaguuucagggcugucagucccggagucuuucgggcagcccgcacccaagcugcaggcagccggcgccauugugcaaacggccgcccgggaccggaggcccgagcgccuggguccccgaagcgggccgcggcacguagccgcaggagcccgccagguaaggacacccgagacucccgggcaggcgucucccccgccacccaaacggagcuuuacaagcccugccgacccacggcaggugacaaccccgagggaaggggcgcgcagacgcgagugugggggagggggggggucagaccaggagggaagggagucaggagggaggguccuggcgcagauggggagacuaggaaacuggaggggagggcaaggacucggggaggcccggugggagcaggugggaagagggcgggaggggccugcggggaggauccccaggagcgggaguaggguuccucgggauagaggaaggguccagugcgaaagggcaggaaacgggcucagggauggggcuggucgggagcgaaggacgcugacaggugagccuagagcagggcagggggccgggacccggagugacuccggagcucuaacaggggcggggauuggggggagucuagucagaaggaaaacuccggagagggcgugaagucaguggggagcagaaaugggcaagggggcugcugagagggagguguguugggaagaaagggguauggggaggggcagaacgagggaguagguccagagaaugugggguuagcuuggauucccccccccaagauggggggcgugagaccuggaagcuagggagcggacuaggagggggaggggaagaacaaggcuggggaccgggaggggagagaagcggagccggagcuugcaggguaggcagagggggaagggaggcgggggccgcugaggggggaaggagagcagcgggagggagggaagcagaggggaggcuggugugggggagggggagggaacugaggagaggaaagaaggaaaagaaacccgagugggggaggagaggggaggggcaagcggaugggggagagcagcugagaaggggagggcgggaguggggggggggaggaaggaaaagaggagggggaaggaagggagggagugugcagccuggggaggggguggcgugcggagaacuaggcgggcgggcacaggaggaagggggaggggagcgcugcccaagacugcugguagaggagggucgggagaggccguagcugcugagggccgacucgaagggggccccuggggguugacccgacgggugcgcgcaagggaggagccaaaggggcggggcaagaggaggagccccaaaaggcugccagauuugguggggagagagggcggaaggcagcgagaggggaggggcagagggaaggcugccagggaagggggaggggagccugcuaaaggaggggcagagaaccgguuggaaguggagcugagaagugcaaaaaucggggaguguccuggccugguguggggguuguucucgcccgguuaguccuauggggguugugagucuuugagguagggguuuagggagaggaagucagagucauuuacuaccucugcaauagcccuuguucaccuccucccacccccguaucccuaaaguguuacugguccuccagggcuggcucucauuucacuagcuacugcccuaggggcugaaggguccacguguagcuucccucuccccaucuugguccagagaauuaaguggucccuguacuuacccuggcaaagacacaguggguggugagugacugcugaugguuuggggacgguuuugaagacuugacagguggggaccagggcugauauccauugccaagcagaguuugcaggaggcuccaugugauuggguauucaucuucagaggccucuguucccucaccugugccuagggcuucacuuuggaguucuuggggauagcugagaccuagcuggaggccaucaggaagaaucugaacagggcugucuuuuuagggucuguggccugaucaccuaggagagccacuccugguggccaugagagagacccuggaggcccugaacuccuugggugagugggggacaaaggaaccaggagggugggaguuccuaggcauccgaaguguagcagugucgucccucagggguauacaacccugagccccaaaccauggcagccuggagaagcagacaucuuuuuaggucaccauuauguaucucagugaccagaccaggaugauaauacuagauuguaugugugcaugggauucacagagaacuggaagcuaaaagcaagcaagcaagcaaacaaacaaacaaaacucauugcacuuacauauuuauuuauuguguuuauuaugucuaccucauguguggaggugagagaacuuuuuuuuuuuugaguuaucugcuaccauguggguuuugaaccaaaugcagaucguuaggcacagagcaaguaccuuuacccacugaggcaucucccccacccagcacuggaauucuucuucuucuuuuuuuuuuuuuuucccuauuucaaacuacccaauuucuuuucuuuuuucuccccucgauuaaaagggccgagcuuaauaccuggccagacugcuggggagcuugggcaguccuuuauccauacagacaagagguaccuuucuccccagaccggcugggaaaaugccccaucgcugguaccaguucaauacuagaagcuucacuugaacucaucccucugccuauaacaggauucucagugggacagccagagauggcuccccagagugagcccagggauggguucaguaaugcccaggagaagaugucauccagaggagagagcacacugcacuccugcucagguaaguggguaccauggaguguggcucuggagggaauauuccuucuuccacaagcuaucuguuaagcaccuacucugcuggaagcuauuccggacaguuguaaaaccuuaggcacuaaauagaccuagguccuucccugcgaggaacuuaaucuuagaaugggcagcagucagccaacaagaaauguaagcaugcuaaaaauuguaagccaccguagaagacagaaagugcuauaggggugauaacagcacagugagagggaccaaguggcugcaggugggccgaggcaggaaugccuaaggcgagaucuagccuggcuccuucccauucucuuuccucacauguuuugccuuggagcuuauaaaacacauaguccagaaauuccuuacaauuguggcuccuguccacccuuagcaccugcucuggcuaucuggaaucugccuuugcugguaugauguagaacagagaucuuugggaaguucaggcuugccuucuagaaccaaugggguuugcuuuucaugugugauguuuuuggaguccuuggggcauccuuuucucuuuuagggcaugagacuccuggccagaaagaaggcauccacacagaacaagcugaagcuccuuguaugggcagccaggccaguaccccacagaaggccgaaccugcaggcucugucccaggugagucuuccugaugcucugaggaucaggcuaaaggaccagggaccaaacuaauuccacggcuucucucugaggagauagcuguguuucaggcccucucccuuuuccucuguaguacuucagcgcucacaaggaguuucacaucuguggacaguggaaugggagaagcagguaccagaagugcaucucccuucuggaagucccaacuccccucaucauccccucucccccauucauguacgcuguuguucucuuggauuauaauugccacaaagauacaggguauucaucaguauguuugcugccgcuacccugcgugccccuuuccccaaaucuugcugaucuucaugauaccaagggcccccaaucuguagcacacacgugugugcaaacauacacacagagacacacacacuucuuccauucaucaccacuugcuugaauagcaucacugacucaagaaagguuuauugagugcacacugcacagagguguugaguauggcagggaaagacagggcaccuagcugcacagcccuugcucugcacuaaccugcugaacguucuggggcgggaugcuguguucccuccaggggucuuuuguucaccugucuucagggugacaguaacaucauggcuagugugaagcuuugugaugcuacaugcacacugccuaaucccuaguuggccucaaacaaauggccauagagcugauuuuagaauucaagaugucugccauccagaaguuaaaccagaguugggcugcuguuacuaugaggcagggcaaauaauuaaaccaacaauacauagccacagguucauggaagcuaauauuaaugguaauugcuauagggguuuaugguaaaggaucuuuaugugcuaggcaugucaaaauguugcuuggugugcugcaaugugagaggaacauggauuucagcugcuguaagugggguggaggaggggacauuguuggcugagaaaggacuuccaggcaggaagcaggaaaggugaucugugacagguuggggagcagcagagugaaggacaaagcuucacaccugcacgaaaaggggggcccccucgugaaaccagaagcuguugcugauucuugaguagaggaguggcauguagaggagggaagugacaucacgucagaggccaagcagacagugauauggacccagucgguuagaaacugggagugaauguaaucuguguaauaugaucaaggcucaggcugugacaggcuuucagggccaggcagcgcucagaucuguggcucaaauguucccagacaagauucacugggggugggggugggaguggguggggugggggagggggaggagggcuguaaaggaggagaacagauuccucugcaugcauggaugcauuuugugaggauuccuucggaacuugaaucugcccuugggccgaggcuccccgugaggccucacccugcuucucucaguggcugaacacucgccagucccccugcccccgccuguaaaccccagucuugucuucucuccuguaacucuuccuucgauccugacaacuccagcuuccuucuuucccggggagguggugguggucggggucucugugucgccuuggcuguccuggaacuuguucuguagacaaggcuggcccagaacucagauccaccugcuucugccucccaagugcagcuucucucccucucucucucucccucccuccuuccuucccucccucccucucucuuucuuucuagacaagguuucacuguguagccuuggcuguccuguagaccaggcuggccucgaacucagaaauccaccugccugccucugucucccaagugcugggauuaaaggcgugcgccaccucgcccugcuugcuucuuucuuaaugggacuucccaguccuguagagcagguggaagggagcugaauagugauuccaaagggauggagcaguagagggagcauuugagaaggcaggacagagcacaggggugcccuggcauuuagggagggagcagagggagaggcaccaagguuucaaggccauccugccuccuaugguuaaaguuggcugggaauaggucugcaaaggccagacauuuguugacacuauagccaguuugaaggacacccacccaagaagggccaagaugauagcaggcaucuuccacagggaaggaaggucagaaguaugcagcagcccuguucuggagggagcagggggaagggugacuacuaaggagucaagggaggauuccugggagggguuggggggggaggagcuggccagccugggagaaaagcccccagggaggccaagcuggccagcagcuuuggcugcauagggaacagaaaggaugaaaggacuuugggguuuacugauucccaggaagcuuugaauggagaagugagucuacuggcaaauggauguacccauggaugggcuuucacacaauuccuuuuuuucccccuugugacugcucaggggaggaauggaugauucggaaggugaagguagaggaugaggaucaggaggcagaggaggagguggaauggccccagcaucucuccuuccuucccaguccuuuucccacuccugacuugggucaguuggcuguuacguacaaacuggagccagggacuccgggagcacuagguggaaucgcgcuguccgggugggccccgaucccugagaagccuuauggcugcgaggaaugcgagcggcguuuccgggaucagcuaacucugcggcuccaccagagguugcaccggggugaggguccuugugccugcccggacuguggccgcagcuucacgcagcgugcucauaugcuccugcaccaacgcagccaccgcggagagcgucccuucccgugcucagagugcgacaagcgcuucagcaagaaggcccaccugacccgccaccugcgcacgcacacuggcgagcgucccuacccgugcgcugagugcggcaaacgcuucagccagaagauucaccuaggcucgcaucagaagacccacaccggagagcggcccuuccccugcaccgaaugcgagaaacguuuccgcaagaagacgcaucugauccgccaccagcguauccacaccggcgagaggcccuaccagugcacccagugcacgcgcagcuucacacacaagcaacaccuggugcggcaccagagggugcacgaugcugcuagccgcacccgguccucuccagacauuccuguugcuccccauucccccaccgcgucucuuaccccguccccuccugggcccaagccuuucgcuuguucccacugcgggcagagcuucggcuggaaaaagaaccucgcuacgcaccagagucugcaucucaccgagggucguccuuuugggugcgaugaaugugcacucggcaccaacguggaccccgccgccgagcccucggccugcacuccccaugcgccugacuguggaccggguucggggcccgcggcaccccagcgcaccaccuccagcgagcgcuccuucuucugcccggacugcgggcgaggcuuugcccacgggcagcaccuggcccgccaccggcgggugcacacgggcgaaaggccauuugccugugcucaguguggccgccgcuucggcucacgacccaaucuagucgcccacucccgggcccauagcggcgccagaccuuuugccugugcgcaauguggccgccgcuucagucgcaaaucucaccugggccgccaccaggcagugcacacugguagucgcccccacgccugcgccgucugcgcccgcugcuucagcucuaaaaccaaccugguccgccaucaggcaauccauacagguucccgccccuuuuccugcccucagugcgccaagagcuucagccgcaagacccaucuggugcggcaccaacgcauccauggggacgcggcccucccagccccagccucgaaccucucugcuccagccugguccaaucccuccgaggugguaccaccuccaaucuuuuucuaagcgaaguucugacccucauccugccuuuccugacagauuugggagacucauaucuggagacuuaguggguuuucaacauucacaccuaaguugcugccaaagcaccaggacacuugggccauuucuuuaauuguccuuucuuuaauguuaguugagaaguccagaaaaacuuagcucuugacaguugugacaacacacagagacuauccuugcagauaccacgcugagaaacagacauuuauggggaucagccaggucaaggggagauugacugagcaagagaccucuaaauagaggauaagaauaguuauuuauguacuugaaguucauuaaaguucagaucugagguucuggagcuguuaacugagccacugaaggaaaaccugacucuuuauucgcugccacuuccauccacaggaaaaagaccuuuucugucaguccagggacguaaacuuagcuaggugguuuuucccaacaaagugcaagaugcacacaggccaaacaacuaccauggucccgcaagugcgcgcgcgcgugugugugugugugugugugugugugugugugugugugacagaaauuuggcucagagggaguaggugaggaccagaggggacaggcugcucuugggcgcucccaggggaccagcacuguuacucuaggugcugcugcggcuccauaccaccuguuuccaggccuucaagaggcuucccagaagcauccuuaccuaucucugccuaggagguacagaaggaggcagugcgugaacaggccauaaagguuguuuguguaucacuuuucccaccaguugucuccuuuugaggacugcuugagccugcaggcacugcaacuguacaccccgcugugacugaagcacaggggcugggcugccugacagugaaggagcagucagggcauggggugugaguuuagagagaacuauuuuggguucaaccucacagaggacuuggagggaauccuuuacucucccggaacuucaauuucucauuaaaaugagagcugguguugaugaaagcugagaguacuuucuauccuauuguuagauuacuaacaacaaaaauacccaaggcaauggucuccugggugcuaagcacugggaaggaucaggagccaucacagcuuaaguagguuuccugguuuguguuacuguugcugggauaaaauacugaccuuggcuuuccaaggguggcuuucacgucuacauugaugccccuggagugauagucaacguuuucuuugcuguucauuguugaaccaauaaagucugugaacccuaaagaaaaaaauacugaccuugagcaggagagaguuauguguuuuauacuuugaagucagcguccauuauucauggaagucaggguaagaacugaagcagagaccuauuggcuuguuuucaucacuuguucaguuuguuuccuuaaaauacagggaccacaugccuagggguggcacugccuacagaggaugccccucccacaucaaccacuaaucaaaaaaaaugcccccacaggccagucugauggauugugucaauugagguuccuucuugccagaugacuguagcuuuguuaaguuggcaacaaaacaaaaccaacacauagccaacauaguggucuccuugagggcaggguaggggcaaacaggccaagcauagucaagggaggcugacaggcugccacuucugaagccaugccugcagaaaaggcaggggaaaugugggugggagguugaauggaaguaggaggcccaaguuggguccaauccaagauccagagagcugcaguccucaacccaagcaagggaagagaagagaagcuggaacuggcuugagaaccaaaaaggcugugggcacuccaguguacaguaguuccaacugugucuaagagaguggggucagcaggguuuaagcagggugaaaacguguuuauauuccaacacuuuaggaggacuggcuggagacuugugcaucagucacccaucagucacgugguggggaucuuggacuauggaugcguccgaggagauggagaaguguugaauuaaaaaaaaacacuagucagaugguacaggacuugcuaagaagcaugguagaaccacuggggccugacuucugcuuagcuggcugacagcagccuuccccugagaagcguccacagguugggagagcauauuugugcugggagagcaguccuuuuguagcuucugagguugacuuguagaaaguacagagcucaggauaaggcaagcugaagacggguggucugagaacuaucugcauucuggaaacuauuagguauuaggugccuaccuuucagagugaguauggagugaaaaagggaagccuuggaccaggcgcugguguggaacacaagcaaugagggaaggaucugagagaaagcugcaaagacuaguccccagagaauagagaagacccugagaggaggugacagggaucccuggauaacacuuucaggaaggaacaagcagcugaaggcugggggggggugggggggcggugcggggggaggagaguacaugaacccagggucuugugccaaggcaaugguaugcagcaucugguugggugaguuccaguugcaaaggugaaccacaaaaacaaaguccgggagcaggaaugagcaggagugagaccugggcaugggugagggacagugggaagccacuuucucuguaaggccaacggcaugaauguguguaagguuuuuucccuggcuaagaaugagugggugacuguugacaacugugggcagggcuauaaaacagcacuccuaccgcugcucccugccugcugcccgcuauugaaauccccaccacucugcugccccaaaacauagcucagcuucccucugaagcugcccaccuggccucuggggcacugagcuugaaggacccgcugaaaggcuauugcauggacuguuuggcucacacacaugacauucacccacugcuuccccucuccaaacauucugugauucuuguguaagaacagcguuuugagccuucagcauuauuugaugagcgcuaccacgugccugggauuucacauucucuugaagauucaccaccuggcaaaucuuuguccuuugagcuuguuugcaaauaguuugaaagucauuuagugucaagccuagcggucaaaacaaaugacaaaugcucagaaccaagugagcaagacugaccagccaguguggggcugucagcucagccccucugugggcugaggcgggagaaucagaagggcaaagcuaaccugagcuacagagugaguucaagccuagcuuggagaaccuagugacagguugaggucagguggggguuggaggguaccuggcaagacgacucagcaugccugcucugagccugcauuccauccacagacccacugacugcuccagguuguccccugaccuccacacauauguugugguaugcguaugcacaaacugaauaaaaaaaaauuuuuuuuugaaagggaaaguucuggguuuguagcuugguggcaggcacuuguccgaaauacgcaaguggucgauuccuaugccuccugugcccaggaucugagugaaaggcagggccuuugaagacugcuacaaggaggagcucaagauucagccagagguguucuuauuaaaauuaauacauacuucuguuucuccaggugggacccaaguugugagccauccccaguacugguaugcaaaaaaacaaaacaaaacaaaaccaaaaaaccucuaagaaguaaaaugcaaauuauauguauuuauuuauguaugaauguuucauugaugaugagauguuucaugaauuagccaaaauguauuuaguuuucccccaaauccuguuccacagaaagauuaucuguaguaaacaguuuugaagcagacaguuuguagucccaguacgugauacagacauguauagcucaugcugccugccugugaggaacuuacagucugacuggagaugaaacgugaaugcccacagacagaggaggaaggcucugcauguuccugcuguugccccuucaucugaaggagcuggagucaggggaggaucugguguuuucaacaaaacacgcagcccucgcauugcuuacccuugacagcuguucagaugcccggaacgcugcuucucauccacuucuucucucauuuucuucgacauguugccuugcuuggggaacaaucagugaucaagagacuauuuggcaagggcaagcaaagugaguggacguuagcagcagcuaaucugccaaucacgugacccacgacacaggaaucuugcuuguggcggagugucuggugucuucuuccucugucugcaggguuggacacugagagcugcuggucagagggaccugccaaacaugcugcaaaucucaagucagagagagucuaggugugucucugaccagcucagacaagcaaguagagacucuggcauuuuaauccuuugagcuugcaaauccacccagcccugugcaaacauuguaggaaacagagcacaagcccuugaucucaugaauuugauucuucagauguaaggcaagcuuuguccuguggauggcacuuaaugcugaguguucugggagaugguaaagaauuaaaagucauagucccagacucacaaacuugaaccugagccaaaagagaaagcuggggccuaacaacaugcccaucauuuacggcugggcaggcacagguauuacaaccuauucaugaccaaggggcagagaaaggacaggguguaggcuggagaagucagggguguuucuggagaggagugugcccuggcccaagaagagggcuaggaucagccaaaaagccauuguaagggggagcgugggccacaggaaaccaguuuuacguaacuaaggcagugguaagaccugcuuaucccucucaggguagguucagagaaauccaaccucuucugaaaugauugauauucuagcugauggauauugccuuaguuaggguuuauugcugugaugaaacaccacgaucacagcaaggaggaaaggguuuauuuggcuucugcuuccacaucacuguuuaucaucaaaggaagucaggacaggaacucacacagggcaggaaccuggaggcagggguuaaugcagaggccauggaagggagcuacuggcuggcuuguucuccauggcuugcucagccugcuuucuuguagaacccaggaugaccuaugaaggcauggcacccaccauggacugggcccucccucauugaucacuaauuaagaaaaugucuuacagcuggaucuuauagagggauuuucuuaauugaggcuuccucucucugaugacucuagcuugugucaaguugacauaaaacuagauaauauaguuaguaguuacuaaccauucaucguuauauaaaugucauaccauacuccacauacauguggucacuggugucaguugagaaaacagugacuccauagucucucuccaucuggcagcuucccacaaccaauguucuacuuucucugacuuugaccauuaagauucucccauaagcugaaucauuuaauauuugucuggcuuauuucuguuaguaaaaaauccucaagggucauacauaugguagcacauaccagaauuuccuuuauaaacuccuuuuuuuaagaaaguuaaaugcauuguauguguaccacugugggacaaguggaccgugccaccagacagaagaccugguaagguugaagcagguucaaaacccugggaagucucauaauugaaaauggcaggcauuagaaccagcucccggccggggucuaucuguccuaacacauaaugauauaccccauugagaggacuaugacaaccggucauggucauguagcauaaaaaccuagaguucuccaugcuaaugagguaucuagauaggcuucaaguguuuagccaaugagcuucccuuccugggcaucucuucuugcaaaagguauuuaaucccugguucacccugaguaagaugaaugcauucacauccuccauaaauaaaguaguuuggacaagcaaggacccucuucuucaucaaggauccccaagggaaggaggagggucugccucauaaagagccaccaccuaaacccccuggagaaggccucucuucuagccccuuccuacuuucucagcauucacuugaagccaguccugauuuccugucuggugcauaggggaagcacagacccucagaccccuguucccaacuccucucggguccagagguaucuggguacacaggaggcugggaaccacccuucucagcuccucgcuguccccaggcgucugggaacacaggagauugagaacuacagcaucugucccagccccugcuguuucucaccuggaaaaacacagguuggaagcccuuaucuuggauugugcucugccuuaccugaggaacacacugguggcacucuggcaucccaguggugagacagacacgaauaccacaguacuugaggaagucuguucucuccuuucaccaugugggucguaaguaucacacagcaaguaccuuaaccuacugggccaucuuacagggacaacauuccuuucauuuuauuuuauuuuauuuuauuuuauuuuauuucuagucuuuuaauaugaguuugaacaccguuuucuuccuuuuaaaggcugaauaauauuucacugugugucuacaguuuuguuucucuauucaccucauugguacagguuguuucuacccaauggcucuugugaaugaugcuguaccccguuguagagagcaucuuuacauuccugggcucuguaaacuugaauucauagauggucccagcagcugaauauguaagaggugacuggagaaaagaauaaaaagggauggauucugccuggauggucgggaggcaucucugagaagaugaaucaaguugacaggaauaucaucaguguuguggucugggccuccagccauccgggcagcaugguucuacacacccagaguauucaccgucugucuccugggaaagaaaagaagaggagagcaucucccccaugcccaagauuaugaaaacugccauagcaaggaaugcacugcauuugggucucaguggcaaacguuccaggagccacugacaguuucaaagacaugcuacugcagucuaugaugaacuguggaagacacaauuuaaaacauccagcaaugaacaggcuggauaaagcccaguuuucauggaaagaauauuguaggacaugcugaauaaaggcacuucggagaggaaacaagugucccagcagaugacccaaagggagaccagcugugugacaggcaggacuuagagaaugcaugagggugggggaagacccccaggaugcuuugcaucagacaggugacaccauccaggcccugccucauacuuagccugguaucugagagccacuugggaauuuuccagucuuuuaauguugccuucuucugccccuaccauccauacccaccuucacacacaaagugggggauagucuguucccagaacccuucaccaaaggugccauacuccuuucuguagucuuguuacuagaguaccaggguuuaggaggcaccaaaugacaaagcagcuccugucuuguuguugguuuggagguuguaagacugaggccgaggugcuggcaggaccucaagcccuccgcuuggagcaaaggauggagaugcuggucucugccucuauccuagcugccccuucacugguggaugcuucuccaucucuccuucugaccucauacgacuucccaagccaucauucugugggcaucugugucuucucaucuuaaggacacagauccuauuugauuagucccaaucuaauggcuucaucuuaauuugauuaccuuuacaaaggcacaaauacauggcuagauacauggccacagagcuguaggaaagccuggaaugaaggcuucaggugccuggagccugggagcuggcucuggaggucauaucacucaaaacagcugcugcagggcagaaggacauuuuugccuguacaagugauuuugcuugcuuuauuuuugagacggggucucacuauguagcccuggcuuacccagaacucacuauguaaacuaggcugucuuccaucucagaaagauccaccugccucagccuucaucuaggagagacuucauuucagcucugaggccauguaucuggaaauugugucuuugcaaaggcaaucaaacuaauucauuccaccaauuucuggguggaacgaaaggugcgugccaccauaccuagccuuugcugacaauuuuacgaaccccaggggccucagacagacucuuccucuguucucuaggggaacucucuuauguuuacguacuuauugacccuugggauuuagcuggcgacaaagcaggguuggagaccauuacacucuucuauggaugaacaguaucuugugcuuucuggagcagccauugugggaggggcuggaggagugucucuagggaagagcugugggacccucccuggggagaggugggagugcaugacaagagccagagggguggaacaguggccagaugugggaggugaaggucccaagaagcugaagauucgagcugcuagaucuguacaggcugcauaggagacagggggagcagauuaagccaacuacccaacugaagacagagccuuuagguuugggauuagggcagccucggggcaggggaccuuccuggucaacuacaggacacugguuuauguaacagguuuauguaauacuguuauguaaugucauuagaggcauugcaaauuguauucuacuugaggcucugcagaagccagaccagggaucccuuccaacccugcaagacaggcccuggggggucugagcccucuuucucuaccaggauuucuguccaggacucccuucccauggucuucagggucuuccuacaggauauggauuuuagacagaugaggccaacuccauccugaggaucccugggaucuuuccucugcagaacaacccacaggcccacucagaugccuccccucccccaacccuuacauuuguacucccaaugcugucacccugggaauguucuagaacaugggucucuaaacuuuuguggaccacuauauauuuuuaaauguuuauuaauuaugcauuaauuaaucacaauuaaugcauaauaauuguacauacuguuggugugggugguucacugcucugcauucaguuccacggggcucagcuuccucacgugagagaaaaugugcagcagugcccuucuguuuccauuccuuuuacucaacgccuuucaguagcaaauggcaguacuucacuucuccuugaggcugcauaauauucccuguguacauagacuacauguuccuuacccacgauucagucagugggcaccuacgcuuuuuuuuuuuuaaauauggugccaugauaaacauggaugcuucuuucaaaauaacguguugaaauaagauuguauauaaauucagagcccauuauccacucuuaaucauauccaugugcccucauggguucucagggcuguugaaagaaucucuguucucaugcuacguacaagacaauuugggcuuagagaaggugagaugauuccacagggccgcaggugggaggaagggcaugaugagcccacagugugguagcacaggcgcuguuuacagguuucuggcucccaaugugaccugugccuaccacaacagagccuaaaaggaauauucuggaacaggugggugugcacaaguuucugccugauaccauugagacugcucagugaauggucucuugcuuguucucugcuucuucucuaccaggacacaugguauaagaggacagggguuaugaaaggagaaagaaauaucucguuugacucauucauuuucaccuggagagggaccuuggugugucuggaugcuguuggaauacuaaccuuuuauguucuaagaggcucugaugaaguucuguuucuguccuggcaggagaccacaugaaguuccacuguucucugaggaggaaacaucucaugucuccugaugccugcucuucaguuucugucuagcugagacaccacaaaugauugcccucuucguuuugaauugcuauaaaagcaugccugggucugaguaauuuauaauaaaugcaaauguauuuggcucaugguucuguag

SEQ ID NO: 2973 - RNA, 4235 nt, Mus musculus
cgugauagcggcgagcuaucccagcggacgauguucagggaugcgcgagcgcagauucgcuugguccagggccuucccggcugagauuccguugcgcaugcgcacagcccucugccgagacuugcaccugcuuagagucugccguucgaucugauaccccaccugagcaucgcgcacccagccaugacagcccauuccuuugcccucccugucaucaucuucaccacauucuggggccucaucggcaucgcugggcccugguucgugcccaaaggacccaaccgcggguaagaaaggcgagcaggccucgauucccugcagacgcuucccuguccccuagcugggcucacccauuaacacugggcucccagcuugcuacccugcaauucaugcccucacagagacgccccuacaugacuucuuccagaucucugcaccugggcuggggcagccaggaaacaggcuagagggcugggugaacggauagauucagaugucagggcaagcagguggcuaaaggucacccacacccaugcagucgguaaaggcugcauauggacacuccuugcuuauucuugugugacauugggcaaaugccaggccucaauuucuucacugaggaaaauaggggcucuggcaacaccugcuuuguagggcuggugugaggucugcccuaagcaauguccugggcaugcuguguauguauacuggauguuuuuagcugccuucauuuuuggaagauuccuagcagauuuucugcaccacaugccagccccuucuccuguuagccucucaagucaugaaagccucacacuuugcccuuuguccauuuucucagcacugacaauccacugcacagccaggaguggucccagcugccuuguaguguuaagggagggcuggggcacuaauccguucagcaccaccuugaagugcuuaggcucugucauggauuagacuuagccuaaacuggaggcauagacggaugggcaucgccuuuauuccuacaaaugugaaagugauugcuggacagagcaccuucugcuuccaguggaccagaaucuggcacccauauugagagacucagaacuguuuuaacuauggcuccaggagaucugaggcccuuucuggcuuuuggaagccagcacacauguguauacacacacacacacacacacgauuuaaacuggacuugcuuuguaaucacucuccaugucaucucuucuggaagucuuggugagcuccuugucccuucagcuguguuguaagacucugucucucugauuuccugaguggauccaaagccccugcuuuuucuauaacagcccagccucugucaacaguggcugugcccuugcuucuugccuuguacuguggucuuuuguuuucuuugauguugcuggaugaauuuugaggccauccucugguggguggccacagauggagugugggcaagccuucuccagcauacagauggagagguguuugcugauggagaaggaagagauuuacaacaccguuuggauguagacaaucuuguaauucuuacuuggagcggaccccagcauccuggagaugcugguguucagguagcaccaggagggcugacacagggccccguguaccaaugcugcuuuuccuucuuugcuguuucagggugaucaucaccaugcugguagcuacugcugucugcuguuaccucuugugaguauugccuuccccaggagcugggggcuguggugaccacuaguugggucugauuuugccucaguugacaguugcaguuuguggugcccccagcugagcugugagguacgugaguuguggaccaguucaguaguaucugcuccuaacugggcaucagaauccuccagauugguuguucaaacacaguuuucaugcucuacucuagacucagucauacagaagucagggcaucauacugcuaacaagugcuggguguuugugauagagccaguguaaccacuagggggcagcagagugugugugacagagcuggaguggcuucuucuuuuuuuuuaaagauuuauuuauuuauuuauuauauguaaguacacuguagcugucuucagacacaccagaagagggagucagaucucauuacggaugguugugagccaccaugugguugcugggauuugaacucaggaccuuuggaagagcagucgugugcucuuaccugcugagccaucucaccacccuggaguggcuucuuaaggcccaaggacacccucacccuggguccagccccagcucagggacauuauauacuuagagaaaauaaaauaaacucacaucaaaauucacaaauccugaacccauucccuguaccaaccaggacacagacccugccaugcucuuugaaagagaguagccgaguccucccuugguauguuggguauggugggucccucuguguccaggaccccccucacucugcuauccuggcagcuggcucaucgccaucuuggcccaacugaacccccuguuugggccacaacugaagaaugagaccaucugguacgugcguuuccugugggagugaccccuggggugaucagcuggcuucuggccucagguacugaagggaaggacugacgugagagugaacugaggggccuguggugggaggaagggggucagggccaccacaggggcuuccuuuggacucaggaauuaguuuauuuagcaaggggaaugaaaggcaaugcuaguagucugaggagcuuuccaaggaacggggugggggugggggguuguggggugagucagggcaggggcagggcgggggaggagaagguugucucagugguaauucuuaauggugugugcuuuucagaugcccugcugugaagggugaauggcccagccuugaugucccuggagacccugcauucccucuggccccacccaucuguaugaccauccugugcucgcccugccaucaugcuguggaauccauaacccccagagccaaccugguuucaguuucuggucucaguuuccccuguguucccagcuauuagcggcccuccauguugggcaagccccgugcucagucaggccacagugggagcuuaccugagcuuaaauucccacacuuggcacuucccucuuucuuccaagcagaucccggucaaggagcuggaccugcuguuaucuauuuucauccagggagcagaaggcaggacucagcccaguaccagaaaggacuugagucuuuguggagaagggacauguggcccaaaaucucuaggcuuuuuaacucugucuccaccguguugaaauauugggucagggucacaggccuccuccagcucugaagugaaugauauccauuuagucucugacacuuguagaugugacauuccuggaggugcugaugucuuaaagaagcagucacaccaaaaacccggcacagucaggaucaaagccuccauguuuagccuuuagcagcagggaaaucacuuggcaugggagggagguagugugucuuuggaauguucuagucacuuuccucucccucuguagauaagaucgcccacucccuaguaccugucaguugggguacaacccuuuuugccacucuucauuggguugugguggggcagaucccaguaccauugaagagauuuggaguugagguugggggauagacaaaggugacguuucugggguacuacuagcacuaugccucccuggcuuuugagacccucugucccuaagcucauaugguucugugccaagcacagugagacagaaaauguaaaugacagaggaucagcccagggcauuccuccagcccaugcccucaccucucugagagggugaguagggcauucuugccuguguugccagggcuugcuaggacagaggccuauauaauccauggcuccuaaccaguggcuguuugaguucccaggggaagaaagcccagucuugauuaucuauugacuauuuauuuggucucccuccccuuauaggggggucguuuugggaguggcagcagaauacacuauagcucagauugcugggcauuaagugugcuaguggcucagaucugcagcuggggccucugugggcaacccaucccguccuacccugacuccugaagccuuccuguggggguggggcauggugagcaugacuccuguugaaagccgauuccugucuaauaaaucauggugaugcaagauugguuuaguuagccaaau

SEQ ID NO: 2974 - RNA, 1008 nt, Mus musculus
gagaaauacaugcaugcacacacacacaaacacacacacacacacaaauacagagagaagacuggucauuaaagcuacaacauagauuucacuuaagaaccucucuagagaaggcucugaacuccaaucacacuuuuucacuagggagagaacauuucagagagaauaagggagucgggagagggaugaccagggaaucaaaucaaauaaggaaaaaggaaggucaggauuacugagggcuaguuaagucaggugugguagcacucaccuauaaucccagcacucaggauacagucauaaggauaauggaugcauggccagucuggacuacuuaaacccugugacauggaaacuucuaguucuuuggaagguugguuaugccaaaugguguuuugcugggcuacacaggugaaaggaugucuugcuaaggcaaacacaugaaagacuguuuucccgaagcagacacacgugaaaggauauuuggcuauagcagacacauaaaagaacucuugaugaaggaguauaaacaugaccccacagacagugggagucuggcacugagcuuugguuugcuucaccuugauguucuucacuaaagacacgcauguauugguucaccuuacagaguguuguugagcucaacuugugauaacucggacauugagagaaacucgcccaaaaacugcucaugagguuccugagguagcuugucgccucuguggccucaccucaggcugguuggugagccaggugauugaacugcaguugccuggugucugcugaaaggacuggacugcggcuccugguuccugccuauugugucccugccuagaggacuggucugcagcugcugaauuguauuugguguuugcuaugggacugaacugcucaccccuaaaaaacgguugcugaacagauccaauccccccaucuccuaauaacuuuucucuuccacuaccucugcuggguagagaagaaguugaaaccuuauuaaaaaaauagguugcg

SEQ ID NO: 2975 - RNA, 3115 nt, Mus musculus
guuggaaaggaacagacucagcaauuuuauuagccuggaguugaaagucucugggagacgauaugcuccugcugggugcugccacagcuguacagggaguaaggugaaguccuagagaagaagggaaaaccagguugggggugcgggagacuguuugggucagauucuagcuuuugucacguuucacaaguccuuucucaacccaauuuccaugccaagggcuggcucuccccauuaaccacuuaccugucuagggcuuauuugguucucagggcccuggagaaggcaaacuguccagguaggaaguagccgugggggucuucgccagccugugcuaucuuaaugcauugcaacuccugaggauccugcuagaaccaguguuugcugcagcaguucuaggaagggaggcaccgccacaacccccaggggaaugucccgagguggggguggggggacccagcucuucuuuucagguuuccuguucuucucccauagacccagauuugaucugucccuccaggcuucucccuaaccucguuuccuucuuaccugaggcccuugcuucagaauugggcaguggacuauccggccuagaauuuuacccuugggguccauuuuaaugcaggccaggcauuuccgccuucucuggggaggagaacagggaugucagaguggagacuagccucuggcaugcucuggagugggcgauguagugauuugaauaagaaugucccccauaggcugacauauuugaagauuuggucuccaguugguagugcuguuuggggagguuuugaagguuugaccuugauggaggaaguacgucaguggggcaggcuuuaagauuuuaaaaccucgaaccacucccaauucacucuuucugcguucuguuuacgaggaaggcugugagcucucagcuuccugcucuggccaccaugccugcuggcauccacaucucccugccucccaccaugauggacuuuuauuccucuggaacccuaagccaaaauaaaccuuuccuauuauuaguuggucuuggucaugguauuuuauggcagcagcagaaacauaacuacauccaaggggcgaggugacaugcgagccagauggacaugcagcuuacccuggcauaggagauuuuagaaguucucuucuuuggacagucucaagaaguagcccagacuggucuagaacuugcaguucaccugcuuuaacuucuccuaugcuggcauuucaaguguaugccacccuuggcuugccugcagacuaugguacuuuaccugugcagguaucauuccugugugagcaugcauauguguacugcucaugggcaauauaccacguggguguauucacaagugccugcguuaaugugcaaacauguuuaaaggcacgaaucuuccccagaugguguuugccugucucuguuucucucugguguguguguguguguacucacaccuguaugcgucucacuucacucugcuuuauuccauuggcagacaaucucucacuguaccuacagucaggcuggcagccaacaagccuagggauacuccucuguagccacacccagauguuuucauaugggugcugagauuuaaacucagguccccaagcuugcacagccagggcccuuaccaccuuggccucauaucuacauuuuuccuuugagauuuauuuugaacaaaccaagagucuugcuaaaucaccaguauaauccagucucuucccuuaaccccagggaggggacaaggaccuucagugaacccacaaaacugucagagaacaagaacuuuaacucaaaagugccgcaccaccagcccgaggucaguccauagcaguagugucacccuagggugacugauuacugugaaacccuucagugaacuguguguaucguggccagaauacaggauaaacuccauagagaaguuucuuuaggaggacccacucugauggagaaauuucucucuucccuucacccuccccuccuugcagacagucccuggugaugggcacagcgcuucccuggacucugguuccuuuccuggcagccugucccaucagcaagaaccccuuacucaccccguuugguuugauugugcacuccggcuuuuuccaguccuucuuggggcaguuggucugcuggagcuuaaauuccaaccucacaaaggugccagcugagaagagcuacagacagacagacagacagacagggcaagcagauaauuccugcauguuacuccuuuucuuuuccccaacaccuuaacuuagaacuggcacagccuaggaggguggcaggcuggggaccuuucccaguacagcuuucugggaauucacuggucuccagggcugcagcucuccacucucuacccaaucacaccacuaaccacuucuucagcucuguccacaccgaucucuuggaaggccaacugcacagguggguguuuguggaacuccuccagagccaccuguaggcuccugcgcugggucucgcugaguucgggcucugucccacgugugcccacugugcccagccauagggcuagggagaucagcaagcacuucauggcuucaccucaguccuaugguucugcaaagauggugugugggcuuuaguucuuggagcugugguggugguggccugaccuacuccuagggacagaagugccccuuucugaaguaccccuuccauugguauccaacuagcccuucccauucugcaaggccuuguuuccaaagaaacuuuggggccaacaaaguuuuagaguucccugccaacagccccgggaaguaauccugcugguuauguccacuauagccuuuuuucugagccauuuucuccuccuuuugggucuucccuccauauccaaaauccccagccucuuucugguaccuugaaaaugaucagguuuguugcuuuagcgaggccuuuuucuguguggucccuggaacagcucccuggcaguuguucccucucacccucucaucucccuuuucuccucucucuugguccccaaagccccgccuuuucccacugacccuucucccagaguccggaguuuuggaguuuucuguuucccaaaguucccugaccuuccucuugcauuga

SEQ ID NO: 2976 - RNA, 3115 nt, Mus musculus
ucaaugcaagaggaaggucagggaacuuugggaaacagaaaacuccaaaacuccggacucugggagaagggucagugggaaaaggcggggcuuuggggaccaagagagaggagaaaagggagaugagagggugagagggaacaacugccagggagcuguuccagggaccacacagaaaaaggccucgcuaaagcaacaaaccugaucauuuucaagguaccagaaagaggcuggggauuuuggauauggagggaagacccaaaaggaggagaaaauggcucagaaaaaaggcuauaguggacauaaccagcaggauuacuucccggggcuguuggcagggaacucuaaaacuuuguuggccccaaaguuucuuuggaaacaaggccuugcagaaugggaagggcuaguuggauaccaauggaagggguacuucagaaaggggcacuucugucccuaggaguaggucaggccaccaccaccacagcuccaagaacuaaagcccacacaccaucuuugcagaaccauaggacugaggugaagccaugaagugcuugcugaucucccuagcccuauggcugggcacagugggcacacgugggacagagcccgaacucagcgagacccagcgcaggagccuacagguggcucuggaggaguuccacaaacacccaccugugcaguuggccuuccaagagaucgguguggacagagcugaagaagugguuaguggugugauuggguagagaguggagagcugcagcccuggagaccagugaauucccagaaagcuguacugggaaagguccccagccugccacccuccuaggcugugccaguucuaaguuaagguguuggggaaaagaaaaggaguaacaugcaggaauuaucugcuugcccugucugucugucugucugucuguagcucuucucagcuggcaccuuugugagguuggaauuuaagcuccagcagaccaacugccccaagaaggacuggaaaaagccggagugcacaaucaaaccaaacggggugaguaagggguucuugcugaugggacaggcugccaggaaaggaaccagaguccagggaagcgcugugcccaucaccagggacugucugcaaggaggggagggugaagggaagagagaaauuucuccaucagaguggguccuccuaaagaaacuucucuauggaguuuauccuguauucuggccacgauacacacaguucacugaaggguuucacaguaaucagucacccuagggugacacuacugcuauggacugaccucgggcugguggugcggcacuuuugaguuaaaguucuuguucucugacaguuuuguggguucacugaagguccuuguccccucccugggguuaagggaagagacuggauuauacuggugauuuagcaagacucuugguuuguucaaaauaaaucucaaaggaaaaauguagauaugaggccaaggugguaagggcccuggcugugcaagcuuggggaccugaguuuaaaucucagcacccauaugaaaacaucuggguguggcuacagaggaguaucccuaggcuuguuggcugccagccugacuguagguacagugagagauugucugccaauggaauaaagcagagugaagugagacgcauacaggugugaguacacacacacacacaccagagagaaacagagacaggcaaacaccaucuggggaagauucgugccuuuaaacauguuugcacauuaacgcaggcacuugugaauacacccacgugguauauugcccaugagcaguacacauaugcaugcucacacaggaaugauaccugcacagguaaaguaccauagucugcaggcaagccaaggguggcauacacuugaaaugccagcauaggagaaguuaaagcaggugaacugcaaguucuagaccagucugggcuacuucuugagacuguccaaagaagagaacuucuaaaaucuccuaugccaggguaagcugcauguccaucuggcucgcaugucaccucgccccuuggauguaguuauguuucugcugcugccauaaaauaccaugaccaagaccaacuaauaauaggaaagguuuauuuuggcuuaggguuccagaggaauaaaaguccaucauggugggaggcagggagauguggaugccagcaggcaugguggccagagcaggaagcugagagcucacagccuuccucguaaacagaacgcagaaagagugaauugggagugguucgagguuuuaaaaucuuaaagccugccccacugacguacuuccuccaucaaggucaaaccuucaaaaccuccccaaacagcacuaccaacuggagaccaaaucuucaaauaugucagccuaugggggacauucuuauucaaaucacuacaucgcccacuccagagcaugccagaggcuagucuccacucugacaucccuguucuccuccccagagaaggcggaaaugccuggccugcauuaaaauggaccccaaggguaaaauucuaggccggauaguccacugcccaauucugaagcaagggccucagguaagaaggaaacgagguuagggagaagccuggagggacagaucaaaucugggucuaugggagaagaacaggaaaccugaaaagaagagcuggguccccccacccccaccucgggacauuccccuggggguuguggcggugccucccuuccuagaacugcugcagcaaacacugguucuagcaggauccucaggaguugcaaugcauuaagauagcacaggcuggcgaagacccccacggcuacuuccuaccuggacaguuugccuucuccagggcccugagaaccaaauaagcccuagacagguaagugguuaauggggagagccagcccuuggcauggaaauuggguugagaaaggacuugugaaacgugacaaaagcuagaaucugacccaaacagucucccgcacccccaaccugguuuucccuucuucucuaggacuucaccuuacucccuguacagcuguggcagcacccagcaggagcauaucgucucccagagacuuucaacuccaggcuaauaaaauugcugagucuguuccuuuccaac

SEQ ID NO: 2977 - RNA, 33807 nt, Mus musculus
uguauucuguuucuuuuuagcagaauagacuccaggaauuggguugcgauagaaaagugucuccuguagcagagcugacauccgaucuccacccaaggcuggagggccucucgaggccuucccuuucccgugcaguaugcaugucuucaugcagcuacagcuauuuuuagaacauuauagcugaagcacucugaucuucuccacagaggacauccagagcauuuccaucuaagaugcuaaccauuggaaagguaggggcugauuuagaauguuuggguuugugugugugugugugugugugugugugugugugugugugugugugugugugugugcguguguauagauagaaucuagggcuuuaagugugcccagaaagcccucuaccacuaaacuagauacccagcccucuucuuuuuauggacagagucuugcuuugcaaccccagcugacuucaaaucuaagaucuuccugccuuggucccuugaaugcgaagauuaucgaugugugcugucauuccucgccucccaguuugcuuucuuuuguaacaaaauaccugcaauugagaaacuuacaagggaagagguugacuuuggcucagcauccugaagaccgggaaguccaggaugucacuucugguaaggaccauauagaauuucacaaugugguggaacucaagaggcaugcguggaagagaaagcacaagagguauccuugcuuugugacaaccuguuuccaugagaaccaacccugcccaguaggaaaggccuuaauuagccucucuacagcccagccauccuuaaagucucccaucacaaggcuucuucaucucccucccucacuucucuccaugcaggacuuggaccuggcagucagugugucuuuuagaaggagucagacauccuugcucacacuagacuugcuucagcuguuuggggcuucuguggagaacuuucuuuccucagucucaacgaauucuuaguuggagcugacuccuguaacaaaaucuggauuagccagaggaaaucagauggcuucccccuauuuuccucaggugagagccacuaagggacgaguaguucucaagaagguagccuugaauuucagccuauccaguguugcaauaaacaagagugaauucuaauuauuuuauuuuauuuuauuuuauuugguuuuuugagacaggguuucucuauauagcccuggcuuuccuggaacucacuuuggagaccaggcuggccucgaacucagaaaucugccugccucugccuccugagugcugggauuaaaggcaugcgccaccacgcccugcugaauucuaauuuuuuaucaucaguuuuccacuguguuggagaccuaaccagggccuuccugguaaucacgcugccucugagauauaccccaacccaaacugugacaaggcaagggaaaggacuuugagccucuagggguggcagcuugugaaagguuggugggguucauaaggggcagccagcaaagcuugaugaugguuugcuuugguacugucuccggccucccagggcuucaagcuguccucagcaccguugcuauccucaguggugggcaucuucugucucguaacaggccaggaaggacagagugccuuucugcaucuacuccuuaauuguccucggccccagcagcaaucuuuguaugggaagguucccgcucuggucucucccacuguuuucuuuuguucaccagcugggagagccaaggaggcaggguuauguaggauuuuacagccaguggcuuguccuuuacccaggucugugugggauuugccuauugcauucucucucagaacagcucugaggguccuucgaucggccucacacauguugucagaggcagcaguuaauaugcaacauuacaggaaaucuacuacagugaauucucccaucuucucccacaacaccucaauucuagcuuuucaacagccagccagccacucagaaaucauuaaccaggacuuuuauuuccagugacgauauacuacaguuaaaagccucucaccauuuucucucauucugggaagccagcauaggucaugagaagacucagugccuacagaauagaagauguuucauuuugauuaaauauuugugguauacauaaacuagcacugcccacacauaaaacugcagugguuaagggugaggcuggguagugcugcuguguucucaucacccacccaccaugcagcuguguggccccuggcaagccucugaacaucucccaggcucagaaugucauuuguaaaaugaggagcagagaguuuguuucauagggauauugaggggaugaaaugaguuguguauuugaagaguuuaucaccacacuggacauaaaaaucaagucuuccugaggguuuaagcaucccuauaaaacaugcaggugaaaccagugggucuuacugcaugcucuucugcaacacacuguugugcuggacacaugcucugccgaugccccuucuauauuuguggugagggaaucucuauaaucucagcuguacuucccacuuauuaaggacuccacaguaagaggagaaguaugacccacauagugcagagaugcacaucuccacucucuccaaacacaaacaggguuucauaauauugacacguucuaaaguucauguggaaaaacagaggagcaguucuagacaaggaauuugaaaaucaaaacaagacagaaucaucguagggaauacugaaaccgugaaguguuaaaauccaccgucugcagugaaacuaucaucauaaagaguagcguggccugggcaagaucacucuccaaacacaaacagaaaggugcacaccagaaagaaaaggaugggcagguuuuagcacauaaagccaaaauuuuaucacuucagaaauuagcguugcuaagugaggugggcaugccugugaucccagcacuuggcagacaggccaccggguuuggguaugaggccaguggggucugcacagugagaccuugccucccaccccuacacccccaaagaacaaucuuuuggggaaaauauuuuccacacauaugacaaaugaacaucuuuaagcaugaaacccaaacaaccaucccaacuucccagccuugaaagugagcaaauagaaagucaggcaaagauaaauucucaguagucauagcauaaacugguuuaaaaaaaaaaucacacaaaacaaacaagucaggaaaccagcaacccaagaagcaaaaauugaagcaaacagucauuuuaauuaaauuugggaaaauagcccauguugucaaggaaauggaaaaaaauggucauuucucagggauaacugaugaaucuugucuuugaccaucuguuucuaccuccaaaaguuugaaccuggacauggguaaugagacauuaaucuauaaggacauaggaaaaauauguaaucgauuugcauauuuauacagccauuaaacuauauauauauauauauauauauauauauauauauauauauguuuuaauauaauauauaagagaacaacgaaaugggagaaaacuuacaauaucuuaagugaagagccagcauguacaguugcaagggauaacccaggcuuccccaauauaaaauacuauucagaacacucgaguaugucaaacaccgaauguaauuggcuuuaggaggcuaauauaugagagggcuagauggcccuugggagagauuuuaaaaguguuuuuuuuuaaaauaauuguacaauucaaagcuugucucuguugaaagcaugaaaggacacgaaauugcacuggucuggaaguuccaagaugggguucuuuuggaaagccaaggccaccugcuaguggguggugagucauggccacaggcuugcaccugccuccgcagacgccacacuggcugcugugcguuuccaaggguaaacgacccauuugugccaacagccaccugggcccggccugcaucucuagagcuuaggccacuccggaucuuaguugugggaauagagggccuugcagaauucacaguugcgggccauucauucuucauccagaugcgcucuguugccguggugcuguguuccagcccuaagcuagagcggacugggcaaagccccaggcucgacgccaggagaaccguuggugcccugucuaguucucucuggcucugaguuuugaaaaagacaguaaggguggaccaaacacagugaccacagccuggccacaagguggcccaggggcgagcauccuuuucugggcagaggguuaggaaacugaagcucgggccgguggccaaaccggagcugguggcugccauggcgauggagccgggggcccucccuggccuugugccggagcggcagugcagcggggugaccuggcccgccccgcccccaggccgcggccgccuagccgagacugacccuccgcagcuccuguagucacguggagcugggaacccagcgcguggggggagguuggggacgggccuggcaguugugaacucgaaccugccgcugucgccgcugcggggcggggaaccggccgcagaggccggccuggugcucuauggaugggcgcugcgucccuggagggcacgcgggagagguaugggucgaguaagggcgcaggggccaccgagggcgugcgagggcagcuccaccuguggggcgcgugaccgugagugugugcggcugugggguucgcgcgcgcgcgcggaauaugaaaggggggggggaguguugaggcgcggggcgagcgcaccugcgcacaggcuccgcgggcugcgcugugcgugggacccgagauggcccacuggcugguccgaaccgguccagcgagccagcaaauguggacggaggacacgcaucuauacaaagggggagugugugggccugcugccacccggggcugcccuagaugaccaaggaaauucuggagaguccugggcacucuggcgcucccugcguagacccucgggagacaggccuggaauuuauguugcgcggagagugggggaaggggaggcaauagggauuccagaguuacugccuaggcagcccuuuggccacugagaaagagccuugcaacagauggaggaggcuauucuucuggggcccuaccaggcuaggagguggccuccaaaggcagcacugugcuuccucaguaaagggucaugcucaugcuuuauuuaguucaguguccgcuaggucauucgaccaggcuggguauggaguucaaggcugaacucuguagccuugaaucugggagagacugggugaugacacaaaccugcccuggcuuagcgcagagccucacacucguucuuuucucucccuuccccagguaaggcugaccucucagcaguuagaggucugagcucugccauggggauagggaugucuuuauugcuacaguuuucucugucauccgggggcuaccgaagugugggccgaagcagccgaagucuccccaggaacauccccagaaggagcuggaaaaagccucacccccagcucuucagucuucaggguagaguuuggccuuucuugugcccucaaaccaacccauaacuccagcgcucaugucuccuauacuugcaggacagggauguacuggggaaggaauccauucuccuaucauggagucuucccuggguucaggcgggggugggaguuggggguuggugggguugagucaugucuguagucccccaaaagagagcaggcuguaaaggaauucaggagguuuugcccggacagaggccacgaacagacaugaaaaggucccugggaagucuuacugccaccccugaacugacucuguguaggaggcucucaggaaucuggguuccccugugggguauagcugaaguggggcaguccuuggcccgguuugggcaggaccaggcaagggacagagauuaugaucucuucuucccaccccuuucuuuaccccaguaaucccuagcccccuuaagagaugcugagccaggguucucccucacuccaggggaggggcagcagacuguggguguuccuuggauugagaagugcuugccucuccccccuccccccaaugucccaguugcaauugcuuggguguggguggagaagggcuggcaggcagacuguggguagucuggacaggugguggccugguguuagucugugcuaguagaggcaccuugcccaccucccaggucugaagaaaggcuguuuucacuugcucuccaggcuuagagcugagcuggggaggcuggaaguaccuuccucaagguuuuagucagaugguuuuugaggagaucuccacacaccuagguguuaaugcggagcacacaguggccuggguguugacaagauccugucuuguguguccgccccaaaccuccccccaucccguccugccccccccccccaccuuugguuugcucaucguuuacaguaucaccucaggcaaguccuaccacuguuuuaugccccacacuugcuucaugugccaauuagggagcucuggugugguagaagaaagugcuugccacagggaaaggcaauagggggguugcgauauguaggguacaguaggaauauucaagaauauuuucuguaagaccuccugacacaagguagauacuaugggagaaucccaaggaauaccaacaugucucccuucuagaaguuuccagggcaauaaagauacaaagcuauucccuaagauagaaccgugagggcaguuccuagagggaggcguucuucuuccauggggugggaagggagaaacugggagcacacacuggccuggggauugacaacaguguuccugcggugauugugcuuuuccacccucagcagaggaagaaccgaugcuggaacagcgcugcaggggccccacggccaugggcccagcucagcccuggcucuuuucugggcccucccaggaguccucccagcccgacagaggguugagguaccagggcaaaucagcucagccaagaggccaaaccccaggcaagguccaucguugugcccacugucggaagcgcuucccgggcuggguggcccuguggcuucaugcucggcggugccaggcccggcugccucugcccugccaugaaugcaaccagcgcuuucgccacgcccccuucuuagcgcugcaucuucagguucaugcuucugcaguccccgaccuggguuucaucugccaccuaugugggcauagcuuccgaggauggguagcccugguucugcaucugcgggcucacucagcuucaaagcggcccaucacuugcccugaaugcgacagacgcuucuggcgacaaaaacagcuucgagcucaucugcgaaggugccagcccccugucccugaggcccggcccuucauaugcggcaacuguggccggagcuuugcccaaugggaccaacugguuguucacaagcgggugcacguggcugaggccuuggaggaggcagcagccaaagcccuggguccucgcccacgaggacgucccgcagcucccaggccugguggagacgcuguggaccgccccuuccagugugccugcugcggcaagcguuuccgccacaagcccaaucugaucgcccaccgccgcgugcacacuggugagcgaccacaccagugcccagagugcgggaagcguuucaccaacaagcccuaccugaccucgcaccggcgcauacauaccggcgagaagcccuacccaugcaccgaguguggccgccgcuuccgccacaaacccaaccuguugucgcacagcaaaauccacaagcgcuuggaggucucagcgcaggcugccccacaccccgagagucaccagauugcagcagagccuauggcacaaccugcacuuggggugccccugggguccccgcggaccccagcugaggcaccugcgcuccugcauagcugcuccgacugcggccgcagcuuccggcuggagcgcuuccugcggcuacaccagaggcagcacacaggggagaggcccuucgccugcacagaguguggcaagaacuucggcaagaagacgcaccugguggcgcacucacgcgugcacuccggcgaacgucccuucgccugcgaggaguguggucgccguuucucacagggcagccaccuggcagcccaccggcgagaccaugcaccagagaggcccuucgugugcccggacugcggcaaggcuuuccgccacaagcccuaccuggcugcgcaccgacgcauccacacaggcgagaaacccuaugugugucccgacuguggcaaagcuuucagucagaaguccaaccuggugucccaccggcgcauccacacaggcgagcggcccuacgccugccccgacugugaucguagcuucagucagaaguccaaucuuaucacacaccggaagagccacauccgggauggcgccuucuguugugccaucuguggccagaccuuugaugacgaggaccgacucuugaugcaccagaagaagcaugaugccugagaggggccguaggccuaggaagacaggccuggauauccuuggcaacagggugucagugguccgggugggguaccuacacugaugcugcuagaggaacagguaaagaucccagagggauagaggagacagugaucugggcucuguuuaggaauggacuuuccccuagguauccagggaacccauuuuagaauucgggggaccuggcuuugagcuaguuggcccccagccccagcugguuuuucuaagggucaacucagacugcccuguacccuggaaaaauagcaauagcagccccaucuacccuuugaguccucaacuaaacaccagugggaagagaaccguuccauccucugguguuaacgccuuaauguccccaguauuuacuaugaguugcuucaggucauuuuuugauuuuuuguuuuuucuuuuggaaguaggugugguauagucguuaguaaaugaaucccugggcagggaauaugggcuggccggcugcaccuuggugaaccugcugguuagggcagcagcagaggugaggcuguuccucucucucucugucucucucuggucucugucucucucucuuuuuuuaccagaacccuucugcaaugccuccugcauaggucccaagauguguagcgauccaucccugguuagcaauuccaucaauuucuugcauauuauccucccaggacauugauuuacuccuuuaccagccuggcuuuuuuuuuuuuuuuuuuaaucugccugcucuccccuaaguauaggccuuccuggugguuuuguuuaaccccaugacccuccccaacucuucucagagcuuuggggguuaugugaaaggcugacuaguugaggguuuagcugcagggaagguccuggguagauuuccuuuuuaagguucccaggguguggaugccagccuccacccaugcaccuggguacuggggcacuguuaccuccagaaggcacuacuucuaucguagggcgagucuaauuguuagacauuucuuacuuauagugauuggauucugcuuuccuaugacuucugccuacugggucuuguuuuguuccuuggaucgaaacagaaccguuuacccaccuuuacaaacuagagaauaaagauuugguuuuagaacuaguggcuggugguguucuuuucugugagagcuguggugaugggggaggaaacaccacucuguuuccuaaaaaggagucaggcuuguagcugagcuccccuccucuccccucccaguccuugcuggaggcagagggagguauacccagacuccagcaagugcugugugcugggcaaaagcacccgagagcaaggaugcuuauuuuggagccaaggucuuuuaauauuagacccagacuaucauuguuuuucuucccacuucaaccuuugugucccaucacgagaggcucaucugaagggugguggaccuuaagugcuuugguuacaccuguagccuugucaggcgaugugagaaagggaaaagagguguugugaacagccaagauagcuuucggcucacacaucccccaacacugauuacagauccacacagacaugagcucagccuuuucuggggucagcucagagucagcagguccccuaagcucaggugguggugguuugauuuuugucuggcagggccucccugguuggucugcugagucacagauagcuucacacacagcugccugcucuucuugucagguaccaacaggcccucucgccugucauuucugcaccaguccccaaacagaggagugcaaaagaacaacuguuuguuuugugaauggacuuugcuaaguucuaucugaucccaccugaugggcugcuccgggcgcucuugcucucccuucaaauucauguaaacaccugcagcucuugcucucccuucaaauucauguaaacaccugcacacgguccuggaauacuaauuacuagaagcugagauucgggucuguuucugccuccuuuugucuuaaagauguguguguauguuguauuuuccuucauguauguuuguguacauguguguacccggaacccauggaggccagaccagggaaggguauuagacucccuggaacuggaguuauagaugguugugagucaccaugugaauucuaggaaucaaacccagguccucugcaagagcagcaugugcucuuaacugcugagccaucuccccagcucacccuuucagccuugaccaccacuguauaaaaaagaaauuagugugcugguuuuggucacauaauacuggguuuggggagauggcuuggcuuguagaacauauaugccuugcaagcaugaagacuggaguguugcuucccagaggccauaacaaaagcugaguauggugggucacaaucccacagauacugagaucccaguaucuugcuggccaccucagugaaccuagccuauuugaugaaguuccagcuaauuagagaccuugucucaaacaagauggaaggugccugaagaugcauaaugugacccccuggcccccacaugcaccaacccccccucacagauuuuauaauauagacucuguguaugugcaucaauacauaguuugcuuuuuuucuuucuuuuuaaacauuuuuaaaaauuauuuauuuauuuauuuauuuauuuuuugagacaggaucuaauacaguuccaggcuggccuugaacgaacuaucucaguguguaagauaggcuagccuucacuuacugugcuucauucuuccacuucuggaacagccuugguccugagugucagucuggagagucugucacucuggauaggaaguguuguuccugggccacacuagcugguggaggaucugaaacuagaaugcugcucugagagguaggaaugaaaauccagaaaggcacauaagcaggugggaaaacucacucaucuauuucacaggcaaacacaucaaaguccagaaacagaaaacucucucuugugaugacugcacaugaauuuaguggaaaauggcuagaaacuuggccccaguuuccacaaugcuugacagcugaacagcagcugggggccuagaggcuugaacaguuacagauuggugccaugguagggguuacaggacauccauccuggucccaaaugcaccuccaaaguagcucuggagagaaaaugcaguaucuuuccaguugaccccacugugauuacccagcugcgaccaaacucaaggcagaggugggaggaauucuaucagauguauaggaaagggugggaaugaaaacacuuuccuggagguguuugggaaccaaucacccuucuuggcagucuggaccugguuagcagcuagaagauauuucacucaacagaaccuuagugcauagugaaauuagaugcgguuagguaaccucuucagaccuguuuucucagcuagaaaaagcuccccgaaugcaaugauuuccaaagccacuugcaaacagcuccaaacauaauuuaucaugacucaguguggucugaugauaugcuggcugaugauggcucacuguacccucacgaggcaaaagagcccugcaaugugcaauaggcaagugugagcaaugccgccuaaacauagcuuucagggaguaaagaaaaagagccacaauaaaguagauauacucuccagagggguccuaaaagugcuguguucuauuuggcccgcgauggcuuccaagcaaggaaaccuaauggcaccucacuaccgugguaccccgcaccuacgccgcgaguucagauaucaauacgcgcuugugcgggaggcagagcgcucaaaggugggcagauccgaggcaccugguggacgggcacagcaacuaugcuccgcggggcacagagcauuagggggccaccucuuccaccccagcaguguucagcucacugauuuuuugcuuagggccgcgcggccgcaggcgaggucagacccuggcuauuggcuccggagaacaaaggggccgccccgcgggcugcaccaauagggccgggagugucaucugagccguucagccaauccgcagcggggcggugcagggcgaccagccaaucacacgcguccgccugccccgccugccccgggacuggccauggcccggagcccgguacccaagucgccccuuggguagccguucccguuaaccuuagccacaaagucaaagguauuuauuucucaggcccccucccuccgaguccugugcaauucuggcggggaggggcggugcagggacggaccagcgccgggucgcuguucccgugcugcuccgguguaccgggcuguagaggaaggaugggucccgggccuugaggcgcccugagucccgcgugcaccucagcucugggucccaauuuucuguaccaccagcacccuuccuagcucaguugggagggaccugagguuggcugggaggucaacaggccagggcaguaaggucaggaggguaggacuguugaagagccaagaggaccuacugagccaucugguuguucugagcucccugucugugucugcuuccguguagaagagcuucugggggcagcaaucccaguguuggcuacaagcgauucugcgaggcgggaugaggguggagacggagaacaagcaaaaggaaagcacgcagaaguuacaacugugugcgcgucuucgggggugguuacugagacuucuuucaaguaaaaugaccgcagcagucucaguggguguggugucuggcgacacagaguccgaauggucucuagcagcaguggcaaguuggguguggucaccugagguuggagacaagugacaggcucugcauuuuuauuuguuuguuuuugguuuuuaguuguguuaauaacaugaaaacaucccauagcauuuguguccugucaguuccgaagcuccaugauucugugcuucuaccacucaguuguggcugacguuuauguaaaugagcccucauaaccguguuuuguaaugguuuacaaggcuggggucuggacugugugcuagggauagaggcauccuguauuaggaugcguuuggucuucuggugguaacagaaagcauggaugaugacaguuaccccacagguacuuguuuggaugacacauagcuaaacaguaguuuugaguuucccaaagaugucugucucuggcaaagugaccccugauuuggaccagggaggggguguaugggcaaggucacugcaagacagacaaguuauagguaugcaggugugugaggacauaacaaaucuagauauuggggacaauggggaaagcuaaccaaagacuauguuuugaauggccuugccaagacauuuuugucuaaauuuccaaguguuggagagcucuugaaguaugucaaggggguaaaaugucaaaauuucaguuuuagaaaaaucaguuuggaucuggguggugguggcccacacccuuaaucccaguacucaggaggcagaggcaggcagaucuuugaauucgaggccagccuggucuacugagugaguucaggagucagggcuacagagaaacccugucuuagggagaaagggcaagagagaaagaaagagagagagagagagagagagagagagagagaucaguuuggguucugguggcagauggauuuggagggaccaagaaaucaguaaaauuuuaaaacuauuauucauucauucauugaaugugugugugagaaagacggagagacagagauagaggaagagagagagagacagacaaaggacagaggacagaauuuuuggaaguugguccucucuaccauguggauuacauagauuccggguaucaagcuuagguauccagaacuggcuugcaugucaaaacacuuuuacccacuaagccggugacucucaaccuuccaaauacugugaccauugaauacacuuucucaugcuguggugaccccagucauaagauuaauuuucauuuaauuuuacauagcuguaauuuugcuacuguuaugaaucauaauguaaauaucuauguuuucccauauggucuuaggccaccagugggguuuguguuucgcaggcugagaacagcugcauuaagcuuuuucuuuuguuuuguuuuuugaagucauuuaggugagaaauggugagaucuggacucagaauugaugaccgguggcccaggacacuagguuccugauccccauucuaggugugauguggaggccuggagaacugugcuggccuugggugugggcucaagggagaaacuugggcugaugauucagacuugggguaacacagcucaccuaaguugguagaggggaaagggcucuguguggcccaggcccuagaggaucucacacugcaugggcugcugggcacagucugauuuuguuuguuuguuuguuuguuuuuugagauaggguuucucuguauagcccuggcuauccuggaacucacuuuguagaccaggcuggccuugaacucagaaauccgccugccucugccucccgagugcugggauuaaaggcguuaccaccacgcccggcucacagucugauuuuuaugucccaucagucugcacagcuucuguuccugccucccuaaauucugguauuugaagugaauagcuguguuaauauggcucuggauauucaaagacuuuuucuuuuuuuuaaagauagagauccauguggcccaggcuaguguugaacuugguauguagcuuaggcuggacucgaacuucuggggcucuuguuuacugaaagcuuguguuacaugaauguaugaacuccauucagcuuugagaagaugucucucaugacugacucaguuucucuugucacacguggacagaauagagaguugugcuaugugccucacauuggcaugcuuguauacugucggaaauguaucuuuuuaaaagagacuuagguuuaccucauguguuuaagugcuuugccuauguguaggucuaugcaccacauauauucugugccuauggaucagaagagggagucagguccagucccccaggaguuacacaugauuauccgucaucaugugaguacugagaacugaaccccauccucugcaagagcagcaagaacucucaauuucugaguugccucuccagccccuauaccuugggguuuaagaugcuuuccucuguguuuacaugcauaacccuccaguccuccgcuuaucuaagggacaauuuugucugucccaguguugccugacucccagugguuguuugaaacugcagcuaauauuggaccauauucagucuuuuccagcacacacaucugacaguuuaauuuauaaaugaaacacagagagaggguaaggucaauuaaugauucaauauaacaguuaugacaguguacuaaaacaaaugucaugagguucuuaguucucucaaaauaucuuauguacgugaaguuggccaugacuaacugaaucuggaaagcacacugugaugguuuguauauucuugggccagggaguggcaccaucuggagguguggcuuugauggaauagguaugaccugguucgauaggugugucauuguggguguggguuuaagacucucaccccaguugccuggaagucagucuuccacuaggagccuuuggaugaagacuuagaacucucugaucugccuggaugcugccauguucccuccuugaugauaauggacugaaccucugaacuuguaagcuagccccaauuaaauguuguuuuuauaagacuugccuuggucauggugucuguucacagcaguaaaacccuaacuaagauagaaguugguaccagggacugggguauugcugugauaggccugaccaugcuuuuauuugaaagaauguggauuuuuggacuuuggauuuggaacucaguggaaugcuuuaaauggggcuuaaugggucauccucguaggaauauugaagacuuuguugcagagagugauuugaacuguguugaccuggcccaagagauuucaaaggagaagaauuucaauauguggcaaaaagacugguuuuguggaauuuuggugaagaauguggcuacuuuuugcucuugucuaaaaagucugucugaggcuaaggugaagagacucagauuauuugcauugucaaaggaaguuucaaaaaagcccagcagagacuuuguucucugguuaagucuuuuuuuuuuuuuggcuuuucgagacaggguuucucuuuauagcccuggcuguccuggcacucacuuuguagaccaggcuggccucgaacucagaaauccgccugccucugccucccaagugcugggauuaaaggcgugcgccaccacacccggcucucugguuaagucuuaugaagagaaguuugaacaagcauagcaagcuuagaaaggaaaaauauaaaauauaugguucgaguauuaaaggaguaccaggaagugaaauggagcaaaauccuguguucuaggagauaacggauuaagggagugggaccuuggggcaagauccuacccagcuaaauuuagaucuaggcauggugguacacaccuuuaaucccaggagacaagcaugcugaucucuguguucaaggucaaucugcagagcaagauccaggauagccaagcuuaggcagugaaggauuugaaaaacagaaagccagugacaauguaauaguacaagcgggucauguucuaguuccuguaagcagcagaacucagcagcuucagccauguggcucuggcucuagaguuaagaaugcaaggaacuacugggacaauugaugcuggcuagcuggagcuaagacauuagcaaugauuaagaagagaccaacaucacugaguugaaaucugggaguuguuuucugggagcacaaagaagcuguguuccagagauagccaagguuguaccucccgcuacagcuggacuugguaauguguaagaaucacccaggugguacugguuuugaaggcaugaagguguaaugaagaacagcugaggcuuagcacugugagaggucauggaaggccauuggagaagguauagucucagcuggagaugauggcccaggacugaaguggucugcaaaggauuugaagcuuggcaccaugaagagagcccaugagaggcuauuggugaaaccuaguuggaguggaacaccccaguguauuggaugaucaccaagaacagcagccauaguggaguggaucaaccugagcuuagagugcuacagagggaaagcuggagaagugauuccagaccuuaggaguagccuaaaagaucaaguggaaucccagacacugaaacaugaagcuguaacauugaaauugccuuggagacucaaagauguuaaagaugacagagccaucggguacaugcugaggaaagcugcuaacagggaguggaaccagcccaggagaaagcaguuuguugcagucaacagagauaaaaaaggaguggagaucugaagacugcuuugacaucauccauggagaugcaaaguuuggaguuugcccaguugguuuccugucuugcuuuggggauuacaguccauuaguugcaugaaucucagaagagaccuugaacuuuggacuuuuaauauuguuaugagggcuuugaaaguugggcuaaaugcauuugcauugugcuauguuuaaguauggcccccauagacucauguuuuugaacaagccuaugggggccagggaguggaaugugaugguuuguauauucuugggccaggguguggcaccaucuggagguguggccuugauggaauaggugugaccugguuggaauaggugugucacuguggguguggguuuaagacucucaccccaguugccuggaagucagucuuccacuagcagucuuuggaugaagacauggaauucucaacucuaccugugccaugccugccuggauacugccaugcucccaccuugaugauaacagacugaaccucugaaccugaaagccagccccaaguaaauguuguuuuuuauaagacuugccuuggucauggugucuguucacagcaauaaaaaccuaacuaagacacacacuuggcaaaugggcuguugugcaguguggcagguauccccucggcucucccuucugugucuuugaacuucuguuuccuuagcugguuuggauaggaggcauugcuucugugugcguuugcuuguguuuucucagguuccugguugucuuuggucauguuuaaaugaaaucuuuuccaaggcacaguaaauuuguuguuagugacaaaggccuggggccagaggagugacagcuuuuaagucuucaguuuaauuggccagucauuucagugcguguggaggcucuugugugucaggguuccagcagggcagggcucugccuuccuagagcuccuggaagacaggaguggccuuggccguuagucacagugggaugaccacacuuggccuuugacucucacaugaccaaugucauugagagaugaguucuaaaguuaauuuauuugaauuuaagaauuuuuuguuguacuuuaaaagugauuuugcuuauuuuuauuuuauuuguauuaauguuuugcuugcaugugugucugugugagggugucagauucccugaaacuggaguuagaggcgguuguuagcugccaugggggugcugggaauugaaccucuggagggcugagucaucuccagguuauuugaauuuaaagaacacauuugggcauagacaucaaacuccugaagaugagggacugggaguuuaggguuguccuccaagucuuaugccuuauauugggggcuacacaguuacagagaguacuccguuaggggcaaggcugccccagcccauucagguaccagcauauccuggaccuugagcaaugacugagccucuuagaggcaggauuuccuuugcuaagugaugaugugguggguuucgcuugcugagugauacuuugucaguguucagcagcuggugacauucuccuuguuccugugaccacccauucuuucuuuccccugaccacugucaagguauucaaggaagcccuuacccccuccucagacaagaagagaugugggcgaugaaccuccuccgccccaaggggagaucuaagagcccagugacacagagauacugaugccguucucaucuaucccaauguagauguuaucccagcucucuggcaauuuccuggugagggaggcaggcaggcaggcaggcagggaaagcgagcagaaggcugucacugguggggugcucugaggagagguagggucagugaauucuaggaaagaugugucuguuagaaaaggaaacaggguagagggaaggugacagguggggaaggcccccgaggcagacucucucucuggucugggucuccugggaagguaaagggucuuugguacauauaggagcucaacaggacgaagacucugugggauuucugggcugagaaaagccaguggcugggcuuuugacauuggaaguccugcuuuacugcugacaaaggaguugugagguaccauccacuuuucaacuguuccugggcaggguccuguacuguggaaggggugagugaggagaccugacaggccccugaggugcuugcuuguccccggcacuuggccuagccucauuccuauuucugcacuucgugugcuucagccuaugcugacacuaacauccccuguuaucgccccagcccuaggccccaccaccugcugcaggccacacuccccugcaguuucugcaguugucagaacagcgggugguuuguggacuucccaucaggggaguucauuuccagauugcauccugacccaguguggguaucuaggcuugagcaggccacaggaggguggaggugacuggggcuuuaucguguguguguguguguguguguguguguguguguguguguguguguguguucuguccuuacgguacucgugagugggguggaaggaauaggaauagagcaccaagacuagggucaggcuccaugugauagaccaaccugugcuguuucccugucucguguguguguguguguguguguguguguguguguguguguauaccugucccguagcuuuuguguccugcuagguggacagucggcucaccuauucacucuucucagguggguuaugagaaagguaaguggcuugguaggauaauagauggaaugagagacacacuugguaagggaagggucugugguggcacgguggaccugagaggagugucaauggggcaaggccugccuuggacuugguuuuccuaggcuguucugcagacauguaacaucagagcauacaggaaguaggucucaaaaaccauggccucuuuccuccaucucugucuuuuuuguaucucccuccccccuuauuuuucuccuuugagcaugugugggucuccuuccuucuguucccacauuugucacugcugagaucccagaagaguugcuuuucuccugccugguguggccugaacaggcauauuaagguggugcgcaggcugggucaccaggaaccaaagcccuucuggugccauuuuugaaucaguucugagaagccagaguaggugggacucugggugguuuagggccuggccuguguggcguaggugagaccugacccucuaaccuuguccuguauuucugacccacacucacucugagacucccuauggcuaggugaccucucuguuugcaguucucaaggcccaaggugugggguacagaaacacacaaagagggagcuggagacaguggguggaggcaagagagagcuccaguccccagaugcaucuccagguagagauugccuuuacuuccuguuacuccccugucucugcccaccaguggguuucagugucuaggaggaugcacaguggcaguucuucccagauccucaugggggaaacagagcugcagccaaaucugcagccuccacagaagagaucuccacagggguaaaaggcagagguuuguuuuguucauugaauaaauauuaguaagaaugguaacguugccagacaguggaacuccagccccggauacagcccauacaaaugugacccacugcacacacgugcucucacaacaaaucauggcugguccccaggcaggaggauggcacaugcagcucauuaugaaucaccuggccauuggggugccaucuguuagauaauugcccuuauccaaauuaagaauaaacauauuuuuuuuagauuuauuuauucuauguaaguacacuguagcugucuucugacacuccagaagagggaaucagaucucauuacagaugguuguaagccaccaugugguugcugggauuugaacucaggaccuuuggaagagcagucagugcucuuaaucgcugagcuaucucuccagccccacaucuuauuuuuauaacagaaaaguuucuauuccagccagccugccagagggagguauccaccuucccuggaagauggagcugugggcuuccuuccuguucaugucuccaguggauggcuuccagaccccugaggaagacauuaguggguugucaggauggcaagaggcuuauuuaguuuugaaaauaucuacagcuguuuagagaggacagagccagagcuuagcaacugcaaguuucuaaagaaaauguucugagaaaaagaaagaaaguguuuccucccuucccuacagcugggguuugucuuuccagucagggcacugguuucuagccuggauaaguauucccaaagcagacucaggaagguggccugggggaucaucaaaccaagggcuagucuuuauucaggucucuagggcccagaauugguuuucuaguugaagauaaccaaaucaaaaguaccaagaagccccugucuggggccaucgugaagucagcuuuaaguuuccauacacagccccugcuugugcuaaggugguauuaguggaugaagccggcccccaaccuuaggagagagucaugucucuguggugagcaugagcccgucugugagccacagcucaaagccagacagaguguuuggaaaugcucaaaccaguaaguguuggaggugagugaggggggauguagcucaguugguggcgugcauuaauagcauucuggaagccuugaguucuagcccaagcaccacauaaaaaagccaggcccaggucugugaucgaagcacuagggagauagaggugggaggucacaaaucgaaggucuuccuuggguacaugauaagcugacuagcuugggcuacacaagacgcugccccacacucuccugaauauagaggguggugaaaagaacugugaggggaguuagcuuguccacggagguuccaggguaagccagcuacucugguaagcugacacuugagcagaagaaggaaacaagagugagaugacagguagagauuguagggaugagcagaguggcuugggucagacugggguauccaagcaucuacacugucugccugaagccguacccagguauaaagggaagcaguugggaauguucaaaagaugacugugaaguaagauggaugcgugcuacaucgugaacuagggagugugagcuagcauguucuuggcggcauugauggcaacaguggcggugacaucagcagcagcagcauugagaugcccugcagggguuuauucuggggcauuggaagagugucccacugacuuaggacaugugggagaaagucugccuuccaggcauuguuuugguuuggugacaaugcuagggguugaguuccagaccuugcacaugguaagcgcucugcuacguggacaccuccaggugucuucuuuaacagguucccccauaucuauccuuaccugauguacccaguuccuguguggcuugcuccucacacacucucuacccacgcugagggugucagccuugaaacucuaguguggggauuaggagacuuugauguuuauccaguucagcuguuuagcuaucuuuaugucugagcacaccaaggcuucucuugggcccgguuucucuuugcacaugagaauuaugcccacguaaccuucccaucugcacauuuuuaccugagggaguggauagaacucaaaaacaaauaaacaaaacaacuccccccccccccaaaaaaaaagcuugggcuaugagaugggacaugggggcugggaaaaugguuuggaucaugacccauucauuggccauucuuucucuuuucucccaucuuaccccccagguggcagggcugagaccucaccagcacugaugcaguaggaggccugcagggauggagaguggccuggcuggcagcaucucagguaagagaagucagccuccccaucugagacccccugcccuccuuggagccaaacguaaguugauguccucaacuaguaucuucugguauguagaaucucacugugggcaccaggacuuugaaggucacccaaaggauaaaacaaggacauuaauguugggaggaaaaaaaaaagcaaagccaggcuauagaaguaugcagcaggccggguaaaaucggggugcuuuuggugcuggaacuggggcugaagacuggcuggucaggucuggagaaugagcucucuggguaggaugcuggcuuagagaugcugggguuuagugaauccagaguucuggucccagggucacucggaguucaaggucuucaucucucugcaggcugcuaugaugacaaaagcaggcagccuggggauccccaggcacaugcugccuggaguggaaaaaauuuccuaccuggucaugugcucuuguuaggagcccucugcaggccagcagcagcccucuccugcgaauggcccucucaucccuuaguagcaguccugucauggcaacagagagcaucauuuugucauaaugaacagggacaaguaccuauagaccagaggcuuuuaucacaucugagcccaaggcaaugggccucugggcaggcugagguucaagcacaccccuuucuuagcuguaggaccugcagggaccugggauguccacauuccucucuacucuucagugggcagauggagaagagcucugcccagggucgucuuccugguuggaugucaaagccaaguuuaaucaggccaggcauuaaacaugggggucucuggguuacuuuaauuggcagcaugucaaucacggacagugaucucuucucaucgaauaaaccucagauucaagccagacuggauacuugguaccaaauguuuccuauguccagauuucagugcaggucaggggacaguccuguaaaucaauucaacucauuagacuugggcauucaaguccugacaauauauaauugaagucacuacuuuccuccuaaagcauggcucuauuaaaaugaauucucaugagcaagcacagggaagaccaaaauuuauuuggaacugacauuuauuaacauuaugcaccaggaaucuaucauaaauauuuuccccugaaauaaaaugucuuaguuacuuuucuguuucugugauaaaacaccaugaccgaggcaacuuauaagaagcauuuaauuuggcuuaugguuucagaggauuugaguccauaaugguggagugaagggacagcugaggacacaccuugaucaauaaccuacacacacacacacacacacacacacacacacacacaccuagagagagacagagacagagacagacagaagaaccgggaauggcacaagucuuuugaaacaucaaagcccacccccagugacacacuccugucaaugaggucauacuuccuucuaccaacugagggcuaaguauucagacguauggccccucuggaggccauucucauccaaacugccacagaaagucaguugacacuaagacauaggucagucuuccacccuggacugauaaugccaccccgaguugugugucacacucucaguuccaucagccaguuugucuuuugcugcagugccugggcuagcagcaucagcucgcuagguuuaugauggaacagcucagcacagcaggguuucgcucaaacaucuccucaccuagauggacuuuaguuucagagcagauaacaggaaaacuacagaguggaggccccucuuucucuguugacauuuuacuuuagugaaguaugaucgaugagccaauacugauauaguaacuacccaaagcccauaguguagacgugggcuaacccuuggagcugaacuuucuauggguuugguagagaccccaaauacagcacccaacugcuccuccuuccucccuccaacaugaaugacugguuccuucuuuauguuggugccuuuuccagaauguuguguagcuggcacuacccagccuguggccuuuucagguuggcuucuuucacuuagcaauauacauuuagguuuccccagacccccaucuuucuaugaccugauaguggauuucuuuuuauuacuaaguaucacuccuuauguaaauagcagucuccacuccuguccucccucccccuccccguuugcccacuccuccaagggcaucuuguuuggaauugguuuggggucaaugcuuacaacacugauugcuagauuauacgauacacucacgcucagcucuuuaauccguugcugaagugucuuuugaagaaguugccauuuuucaauccuacuguuaaggaauaagucccugcugcuuugcauacuugccagccuuuaggcuucugucagcguuagcauucugugguagcagcuuaacuuuuaacauuguaugagccaacuuuuuccuuucaaggauuuucuuaucaaauuauauacauuauauguuuuauaagccaacuuaaaugggauuacacugaauuuaaguauuauuggccuuuucauuucggaauauauuuguccugggguucuuuauuaguuuuacuucuuuugcugugauaaaauacccugaccaaaugguagaaagaacagagaagaaauggcuuauuugacuuacagugucagcuauaagagucaucauuggggaagucauggcaggaagccagucagguagucaugaccucacaucacguuccagagcacagagagaguaaaagcggcccaguccgccugcugcugcugcuguucagcuuucuguacaguccagagcccagguccugaaauggugccuccaggaucaggaugggucugcacaccucggcuaaugaccaagacaacccaccgcagacaugcccacaggucaacugaacuauguagcuguucauugacacuuucuucccaggugacaauuaaggcuaauagcacaacuucuugucucuucaguaaaguuuaguaguuuuuccuuacaaaagacuuguguguuuuuuaaggcauucacagcucuuuuauaaugucuauugucagucuuuaaaaagugauuuugagugcuuugugcccgacagucuugcugaacucuaguauuuccacuuauuagugaauccucuggcacaccugagcacaugagagguuuuuuuuuuucucuuuuguguucccccuauccuuuggcugauuccccaaggacaagguuaaauaguaucaaugauaacaagugucuuuauucuguucuuuuagcugucuucuauccuuugcuguugaauagaaugcuugcuauaguuuuaguacacaauuuuuguuguuguuguuguuaacuggaauuucccuauaguccuagucugcuaaugcuuucccuccugccuccugaaaugaugucuuuaucauaugacucugcaucuguugagaaugacauaagacauacuuuuuuuuuuuuuuaaugcuagagaauuaauuacagacaacauggcugccaggcaaucucucuacaacaccacaugauuucuuuacuuuuaauaagauaaccucaagaauuauaucaagccagcauugcuuuucuggaguaaaaaugccugcuaggcuauauuguuucugauucugaugaacuugcuuugcaaauguuuguuuuaggagcaguaaaucuccaauuuccugccuauccccauucuugcacacuugucuuauagacggcucccaguucccagccucucaugcuuuccucucucuucuccuccuuucucauucccucccaguuacuaaacaguugcagagcugggaauaguuccuucuuacaaauuaaaagauauuuuauuuaugagugaugagcgugugucugugagugcaugcugcacauggcggggucccacagagacagaagacaaugucagguccccuuagcuggaguuacagcugguugugagccacuccacguaggugcugggagcugaauucagguccucuggaaagagcaggacaugcucuuaaauuuugaaccaucucucaaaccuuccuuugaauuuuuuauacaaugaguugaugcaaccauguugucuauaacccgguuuggugcgagaauucagcuuucacauuagccucuuacaaguguuuauacaaucuguuuuuaaaaagcauggccuuguuuaaaauuauuuuuaacauauuuuauuauuuuaaaaaaauuaaggacaggguguacauaucccugacuguccuagaacucaccauguaggccaggguagucucgaacucgagcucugccuguuucugccucccaaguguugggauuaaaggugugcacugcugugcuaggcuguuuuauuuucauggguauguguguuuugccugcacugucugaucugucaaucaccuguaugcagugcccauagacaccagaagggaacaucagaucuccugagacuggaauuacaggggacgccuugugggugcugggaacugaacccagguccucuggaagagcaaccaguguucuuaagcacugagccaucucuccagccccuuuaaccuacucuggaaucaauuuuaauuaguacuuucugguaaaauuaauuccuuuuuauauguaaagauuuggugauaugaaggcugugcaugacauuuuaggauugggggauccuuuuguacuuuugcguuaacagcccuuuucuacuccuuugaaaugugcggcugugcugcugcugaacucuguuguucccaaaucuuucucuaggcucacaacuguuucaugcugcccccuuccugucaggugugagcaucuuacugguguaacacacagaaaggugcauaugucacaagcuccauaaauucuuauagagcaaacacaguguugugaccaggaccuacaucaagggacaccaauaggaccucagagccaugccucuguaaugagccauggucuuggcuucugauucacagauuaguuuuuaccagaucugauguucauauaaagugaaucacauccguacugucuuuucugaagugguccucacuguggcuucuuacugccaggagcuugggcguaagguauggucugguagcuguuuccccgaguucuaguggauuaccuuuauugaaagggcucagaaugcguuuucccauucagagccuuugggaccucccuaccuacuuauucuuggugaauuugcuaaaugcgggggguuggggggcgcggucuuuaccagugggguguuccugcuccuugcccugccugugaagaggaaaguuuagcgacucagggugugguaccccuaaccacugagggacugagcaugucuuugccuagaaagcacccaguuccaaacucuuagaaaaagagcagcaaguauuuggacagagagauggcucagcaggagcucuuaaagggcaaaccugauagcccaagcucagucccuaaagccuacuuguggaaugagaaagucaacaccacagagcugcucucugaucuccacauauucaccuugcaucugcacacacacacacacacacacacacacacacacaccuggggugaggggagggagguuuuuaauuuuuuuuuuuuuuuaaauggugacuuugagcauuggccaucuauucucccugggucaggaggcaucucugcuugguuucuuuaaugucucugacucuucugggccuuggguagaguaggcaggacagcguaugcaugcccauggccuuggcaagccagccaugcacuuguguuuacucucccguggguuuccuccucacuccacauucugccuguccguauaggauccuucaagucuuucccuaucccuguucuucccuguauuuaaagcuauuugccuuucacucuuucagcuaucccuacccguccacagcccucuuccucucuaggcucuucucauucuagagugaugucuucugacuucucccuuuguuugccucugcaggagaugggcuggcaaggaucaagcaggagaagccagaguggcuguugcagacuguggcaucucaggccacagagaaggacaaggaaaacauauuucagcagcagaguggucucccucccugccagaccauggggaggccuagggcucuggggucacaagaggagacuggggguacacggugggccccacuuccugagcaggaugcaccacuggcugcucgaguuccagggacagcuccagguccucugagccccucacuuucugcgggugggggucacuuugugugcguggacugugggaagagguucagcugguggucgucccugaagauucaccagcgcacacacacaggugagaagccuuaccucuguggcaaguguggcaagagcuucagccagaagcccaaccuggugcgccaccagcgccaccauacgggcgagaggcccuucugcugcccggagugcacgaggcgcuucagucagaaacagcaccuacuuaagcaccagaagacacacucucggccugccacucacacauguccagaaugugagcgcugcuuucggcaucaagugggccuccgcauccaccagcgggcacaugcccgaaaccgccugggugcccgagucaacuuacacgagauguuccgguaugcugcugcacgucgcugguccugucgccugcgcccaggauccccacgcgggcaucccgagugggucuggcuggggcucugucggaguugguggggccagcaugguguccggacaacagcccacagccgcuuaggucccagugaacagcgccaguucaucugcaaugauugcgguaagagcuucacgugguggucaucgcucaacauccaucagcgcauccacacgggugagcggcccuaugcgugcccugaguguggccgcugcuucagccagaagcccaaccucacgaggcaccuacgcaaccacaccggugagcggccgcacccuugcucgcacuguggacgcagcuuccgccagaagcagcaucugcucaagcaccugcgcacgcaccuaccuggcgcccaggccgcaaggugcacgagcuguggccagagcugccccagccgugcagcacugcgagcccaccagcgugugcacacagcugcggagcugcugcgcucgcagucggcaguccgggauggugugccgggcucugagucacaagcugagauugcccagagugugguugugaagccccaagguccccagggugcuaaggaagugcuguguggccaggagugugagaccuuggcugugcccagcgagcagcgccaguucaucugcaacgagugcggcaagagcuucucaugguggucagcgcucaccauccaccagcgcauccacacgggcgagcggcccuaugccugcccagacugcggucgcuguuuuagccagaagccuaaccucacacggcaccggcgcaaccacacaggcgagagacccuaccugugcacagccuguggccguggcuuccgucaaaagcagcaucugcucaagcaucagcguguccaucguggaacucaggccccucacccuggccccgaggaagagcuguagugugcccugugcagcuaugguggugggugcgggagugugugccuguaggguguaugccaggaacaggagaugcuccccgaguuaggcucaucaaaguucugaggcccgaggaugguauucuagaagcaucucaaaggaagucuaaaaagugccucguaggggcagugagaucaaagcuguggguguuuaagaugggcugugauuguuagugugccauucagaauuggcccccagccguaggcaccuugugaggagcuguuggggguccuagugaagggcuguuggggucucuaggaaagccacugugugugaaaugaccugggacagaucauugguagcacuagccuaucacauacgcuacaagauggucagugcggugguccccaugggagagacggucagagacuccaggauaccaauagaacaaaggcuguagcuaagaagguguaauuauuuccccagcuccaaggacagugccaagcagccacgcuggaucauuugauggcccagacucugagcaucuugcugcuuggagcacuagguacagcagacuggccuaauuggcaguguguaugaugauuggagggugcgguacagucagguggucucauccauagcuuggcugcuuggggaagugacuauucaagaacaggcugugccaaguguguguguguuugugacugccuuggguccuuacccuuacugguauuggagaaaaaugaaggacugaauauuccacauggugucacuguucuuucugaaucauccuuacccgagcccaggugugugagcuccaggugugugagcuccaggugugugagcucccuaggauaaggugugugugugggggggugggggggcaggugcaggggcuguuaccauucaucuguguccuacuccuaccugcugcccaggcuggaggguaguuuucugucauccacucuccuucaugucacuugcacgucucuucccauucacugaugcucuguuccccacucuaucccucugaagucaccucucaugucacucuacagaagaguggcugaugugcuggagcugacagaagccagggccccagccuaggcuauguaaccuugggucuauacuccuuccaggagaugaguaccagggcaggguacccuggaagcagaaggaaagugagacccaguaaacgucuggaggagggagaacuauacuugccgguguccuggggccgaugacgucaagugcagaguucagccuggcuucuggucgccacucuaaguggagaauaguuuagccuuuuauuuuggagaugcuuuaguuguaguguuaucaaaggacagguaaggccacagaaggacagacaagacccuugcagccauugcccuugucccgaggagcacagcggcagugaagcuuagcaucaagcccagacugcucuuucuuggucagauucuuugauucuaaacugggcugaguccugcgcugggugaggugugcagaucagcucugaguaccaacaagaagcugaaccugcagaguucccaguccuccccuauaucccccacacacaccagaagcagcuccuccccugccucccugguaauacccugcccuuccuacccagccugcacugcccuuccuacccagccugcacugcccuuccuacccagccugcacugcccuuccuacccagccugcacugcccuuccuacccagccugcacugcccuuccuacccagccugcacugcccuuccuacccagccugcacugcccuuccuacccagccugcacugcccuuccgggagguuuccagugucuugcguuacaucagaacagaauccuuccaggcuucuccaucuuugucaucgagcaaauccugagucgagccugaaaagauggccuacuccugaaaggcaucccagggcaccaccauuuggggcuagaggaccauugccuucaggguagacucagcagaaacacugguucccuagagaaccaagugggcgagggguggugcaggcagacacugaagcauaucaguuaugcuccauccuucaauggaauagguucucuccugcaaauggcccgaguugaaugucaaaucacaguggagcaucaguaggauuugggguuaacaaggcccaguuguagccccugcuuguacgaguuggugagaaugucuguucacuuuucuuacauggugacugucucacggggucagagggcagacagggugaaaucccagagggcugaauuaugguuuuuaugcauauugaucagauggggucugcaaagcauuggcuccuuaacagaccugcaccaggauuuguacuagaugcguagaacauagccccugcccucacugaaggacuuccuagggaaucauuuucaugugcugugcaacuugucauaaucuguaugcucaacucucaaaaaaaauggcuuucagcgcua

SEQ ID NO: 2978 - RNA, 8387 nt, Mus musculus
cucuacucuucagugggcagauggagaagagcucugcccagggucgucuuccugguuggaugucaaagccaaguuuaaucaggccaggcauuaaacaugggggucucuggguuacuuuaauuggcagcaugucaaucacggacagugaucucuucucaucgaauaaaccucagauucaagccagacuggauacuugguaccaaauguuuccuauguccagauuucagugcaggucaggggacaguccuguaaaucaauucaacucauuagacuugggcauucaaguccugacaauauauaauugaagucacuacuuuccuccuaaagcauggcucuauuaaaaugaauucucaugagcaagcacagggaagaccaaaauuuauuuggaacugacauuuauuaacauuaugcaccaggaaucuaucauaaauauuuuccccugaaauaaaaugucuuaguuacuuuucuguuucugugauaaaacaccaugaccgaggcaacuuauaagaagcauuuaauuuggcuuaugguuucagaggauuugaguccauaaugguggagugaagggacagcugaggacacaccuugaucaauaaccuacacacacacacacacacacacacacacacacacacaccuagagagagacagagacagagacagacagaagaaccgggaauggcacaagucuuuugaaacaucaaagcccacccccagugacacacuccugucaaugaggucauacuuccuucuaccaacugagggcuaaguauucagacguauggccccucuggaggccauucucauccaaacugccacagaaagucaguugacacuaagacauaggucagucuuccacccuggacugauaaugccaccccgaguugugugucacacucucaguuccaucagccaguuugucuuuugcugcagugccugggcuagcagcaucagcucgcuagguuuaugauggaacagcucagcacagcaggguuucgcucaaacaucuccucaccuagauggacuuuaguuucagagcagauaacaggaaaacuacagaguggaggccccucuuucucuguugacauuuuacuuuagugaaguaugaucgaugagccaauacugauauaguaacuacccaaagcccauaguguagacgugggcuaacccuuggagcugaacuuucuauggguuugguagagaccccaaauacagcacccaacugcuccuccuuccucccuccaacaugaaugacugguuccuucuuuauguuggugccuuuuccagaauguuguguagcuggcacuacccagccuguggccuuuucagguuggcuucuuucacuuagcaauauacauuuagguuuccccagacccccaucuuucuaugaccugauaguggauuucuuuuuauuacuaaguaucacuccuuauguaaauagcagucuccacuccuguccucccucccccuccccguuugcccacuccuccaagggcaucuuguuuggaauugguuuggggucaaugcuuacaacacugauugcuagauuauacgauacacucacgcucagcucuuuaauccguugcugaagugucuuuugaagaaguugccauuuuucaauccuacuguuaaggaauaagucccugcugcuuugcauacuugccagccuuuaggcuucugucagcguuagcauucugugguagcagcuuaacuuuuaacauuguaugagccaacuuuuuccuuucaaggauuuucuuaucaaauuauauacauuauauguuuuauaagccaacuuaaaugggauuacacugaauuuaaguauuauuggccuuuucauuucggaauauauuuguccugggguucuuuauuaguuuuacuucuuuugcugugauaaaauacccugaccaaaugguagaaagaacagagaagaaauggcuuauuugacuuacagugucagcuauaagagucaucauuggggaagucauggcaggaagccagucagguagucaugaccucacaucacguuccagagcacagagagaguaaaagcggcccaguccgccugcugcugcugcuguucagcuuucuguacaguccagagcccagguccugaaauggugccuccaggaucaggaugggucugcacaccucggcuaaugaccaagacaacccaccgcagacaugcccacaggucaacugaacuauguagcuguucauugacacuuucuucccaggugacaauuaaggcuaauagcacaacuucuugucucuucaguaaaguuuaguaguuuuuccuuacaaaagacuuguguguuuuuuaaggcauucacagcucuuuuauaaugucuauugucagucuuuaaaaagugauuuugagugcuuugugcccgacagucuugcugaacucuaguauuuccacuuauuagugaauccucuggcacaccugagcacaugagagguuuuuuuuuuucucuuuuguguucccccuauccuuuggcugauuccccaaggacaagguuaaauaguaucaaugauaacaagugucuuuauucuguucuuuuagcugucuucuauccuuugcuguugaauagaaugcuugcuauaguuuuaguacacaauuuuuguuguuguuguuguuaacuggaauuucccuauaguccuagucugcuaaugcuuucccuccugccuccugaaaugaugucuuuaucauaugacucugcaucuguugagaaugacauaagacauacuuuuuuuuuuuuuuaaugcuagagaauuaauuacagacaacauggcugccaggcaaucucucuacaacaccacaugauuucuuuacuuuuaauaagauaaccucaagaauuauaucaagccagcauugcuuuucuggaguaaaaaugccugcuaggcuauauuguuucugauucugaugaacuugcuuugcaaauguuuguuuuaggagcaguaaaucuccaauuuccugccuauccccauucuugcacacuugucuuauagacggcucccaguucccagccucucaugcuuuccucucucuucuccuccuuucucauucccucccaguuacuaaacaguugcagagcugggaauaguuccuucuuacaaauuaaaagauauuuuauuuaugagugaugagcgugugucugugagugcaugcugcacauggcggggucccacagagacagaagacaaugucagguccccuuagcuggaguuacagcugguugugagccacuccacguaggugcugggagcugaauucagguccucuggaaagagcaggacaugcucuuaaauuuugaaccaucucucaaaccuuccuuugaauuuuuuauacaaugaguugaugcaaccauguugucuauaacccgguuuggugcgagaauucagcuuucacauuagccucuuacaaguguuuauacaaucuguuuuuaaaaagcauggccuuguuuaaaauuauuuuuaacauauuuuauuauuuuaaaaaaauuaaggacaggguguacauaucccugacuguccuagaacucaccauguaggccaggguagucucgaacucgagcucugccuguuucugccucccaaguguugggauuaaaggugugcacugcugugcuaggcuguuuuauuuucauggguauguguguuuugccugcacugucugaucugucaaucaccuguaugcagugcccauagacaccagaagggaacaucagaucuccugagacuggaauuacaggggacgccuugugggugcugggaacugaacccagguccucuggaagagcaaccaguguucuuaagcacugagccaucucuccagccccuuuaaccuacucuggaaucaauuuuaauuaguacuuucugguaaaauuaauuccuuuuuauauguaaagauuuggugauaugaaggcugugcaugacauuuuaggauugggggauccuuuuguacuuuugcguuaacagcccuuuucuacuccuuugaaaugugcggcugugcugcugcugaacucuguuguucccaaaucuuucucuaggcucacaacuguuucaugcugcccccuuccugucaggugugagcaucuuacugguguaacacacagaaaggugcauaugucacaagcuccauaaauucuuauagagcaaacacaguguugugaccaggaccuacaucaagggacaccaauaggaccucagagccaugccucuguaaugagccauggucuuggcuucugauucacagauuaguuuuuaccagaucugauguucauauaaagugaaucacauccguacugucuuuucugaagugguccucacuguggcuucuuacugccaggagcuugggcguaagguauggucugguagcuguuuccccgaguucuaguggauuaccuuuauugaaagggcucagaaugcguuuucccauucagagccuuugggaccucccuaccuacuuauucuuggugaauuugcuaaaugcgggggguuggggggcgcggucuuuaccagugggguguuccugcuccuugcccugccugugaagaggaaaguuuagcgacucagggugugguaccccuaaccacugagggacugagcaugucuuugccuagaaagcacccaguuccaaacucuuagaaaaagagcagcaaguauuuggacagagagauggcucagcaggagcucuuaaagggcaaaccugauagcccaagcucagucccuaaagccuacuuguggaaugagaaagucaacaccacagagcugcucucugaucuccacauauucaccuugcaucugcacacacacacacacacacacacacacacacacaccuggggugaggggagggagguuuuuaauuuuuuuuuuuuuuuaaauggugacuuugagcauuggccaucuauucucccugggucaggaggcaucucugcuugguuucuuuaaugucucugacucuucugggccuuggguagaguaggcaggacagcguaugcaugcccauggccuuggcaagccagccaugcacuuguguuuacucucccguggguuuccuccucacuccacauucugccuguccguauaggauccuucaagucuuucccuaucccuguucuucccuguauuuaaagcuauuugccuuucacucuuucagcuaucccuacccguccacagcccucuuccucucuaggcucuucucauucuagagugaugucuucugacuucucccuuuguuugccucugcaggagaugggcuggcaaggaucaagcaggagaagccagaguggcuguugcagacuguggcaucucaggccacagagaaggacaaggaaaacauauuucagcagcagaguggucucccucccugccagaccauggggaggccuagggcucuggggucacaagaggagacuggggguacacggugggccccacuuccugagcaggaugcaccacuggcugcucgaguuccagggacagcuccagguccucugagccccucacuuucugcgggugggggucacuuugugugcguggacugugggaagagguucagcugguggucgucccugaagauucaccagcgcacacacacaggugagaagccuuaccucuguggcaaguguggcaagagcuucagccagaagcccaaccuggugcgccaccagcgccaccauacgggcgagaggcccuucugcugcccggagugcacgaggcgcuucagucagaaacagcaccuacuuaagcaccagaagacacacucucggccugccacucacacauguccagaaugugagcgcugcuuucggcaucaagugggccuccgcauccaccagcgggcacaugcccgaaaccgccugggugcccgagucaacuuacacgagauguuccgguaugcugcugcacgucgcugguccugucgccugcgcccaggauccccacgcgggcaucccgagugggucuggcuggggcucugucggaguugguggggccagcaugguguccggacaacagcccacagccgcuuaggucccagugaacagcgccaguucaucugcaaugauugcgguaagagcuucacgugguggucaucgcucaacauccaucagcgcauccacacgggugagcggcccuaugcgugcccugaguguggccgcugcuucagccagaagcccaaccucacgaggcaccuacgcaaccacaccggugagcggccgcacccuugcucgcacuguggacgcagcuuccgccagaagcagcaucugcucaagcaccugcgcacgcaccuaccuggcgcccaggccgcaaggugcacgagcuguggccagagcugccccagccgugcagcacugcgagcccaccagcgugugcacacagcugcggagcugcugcgcucgcagucggcaguccgggauggugugccgggcucugagucacaagcugagauugcccagagugugguugugaagccccaagguccccagggugcuaaggaagugcuguguggccaggagugugagaccuuggcugugcccagcgagcagcgccaguucaucugcaacgagugcggcaagagcuucucaugguggucagcgcucaccauccaccagcgcauccacacgggcgagcggcccuaugccugcccagacugcggucgcuguuuuagccagaagccuaaccucacacggcaccggcgcaaccacacaggcgagagacccuaccugugcacagccuguggccguggcuuccgucaaaagcagcaucugcucaagcaucagcguguccaucguggaacucaggccccucacccuggccccgaggaagagcuguagugugcccugugcagcuaugguggugggugcgggagugugugccuguaggguguaugccaggaacaggagaugcuccccgaguuaggcucaucaaaguucugaggcccgaggaugguauucuagaagcaucucaaaggaagucuaaaaagugccucguaggggcagugagaucaaagcuguggguguuuaagaugggcugugauuguuagugugccauucagaauuggcccccagccguaggcaccuugugaggagcuguuggggguccuagugaagggcuguuggggucucuaggaaagccacugugugugaaaugaccugggacagaucauugguagcacuagccuaucacauacgcuacaagauggucagugcggugguccccaugggagagacggucagagacuccaggauaccaauagaacaaaggcuguagcuaagaagguguaauuauuuccccagcuccaaggacagugccaagcagccacgcuggaucauuugauggcccagacucugagcaucuugcugcuuggagcacuagguacagcagacuggccuaauuggcaguguguaugaugauuggagggugcgguacagucagguggucucauccauagcuuggcugcuuggggaagugacuauucaagaacaggcugugccaaguguguguguguuugugacugccuuggguccuuacccuuacugguauuggagaaaaaugaaggacugaauauuccacauggugucacuguucuuucugaaucauccuuacccgagcccaggugugugagcuccaggugugugagcuccaggugugugagcucccuaggauaaggugugugugugggggggugggggggcaggugcaggggcuguuaccauucaucuguguccuacuccuaccugcugcccaggcuggaggguaguuuucugucauccacucuccuucaugucacuugcacgucucuucccauucacugaugcucuguuccccacucuaucccucugaagucaccucucaugucacucuacagaagaguggcugaugugcuggagcugacagaagccagggccccagccuaggcuauguaaccuugggucuauacuccuuccaggagaugaguaccagggcaggguacccuggaagcagaaggaaagugagacccaguaaacgucuggaggagggagaacuauacuugccgguguccuggggccgaugacgucaagugcagaguucagccuggcuucuggucgccacucuaaguggagaauaguuuagccuuuuauuuuggagaugcuuuaguuguaguguuaucaaaggacagguaaggccacagaaggacagacaagacccuugcagccauugcccuugucccgaggagcacagcggcagugaagcuuagcaucaagcccagacugcucuuucuuggucagauucuuugauucuaaacugggcugaguccugcgcugggugaggugugcagaucagcucugaguaccaacaagaagcugaaccugcagaguucccaguccuccccuauauccccc

SEQ ID NO: 2979 - RNA, 8387 nt, Mus musculus
gggggauauaggggaggacugggaacucugcagguucagcuucuuguugguacucagagcugaucugcacaccucacccagcgcaggacucagcccaguuuagaaucaaagaaucugaccaagaaagagcagucugggcuugaugcuaagcuucacugccgcugugcuccucgggacaagggcaauggcugcaagggucuugucuguccuucuguggccuuaccuguccuuugauaacacuacaacuaaagcaucuccaaaauaaaaggcuaaacuauucuccacuuagaguggcgaccagaagccaggcugaacucugcacuugacgucaucggccccaggacaccggcaaguauaguucucccuccuccagacguuuacugggucucacuuuccuucugcuuccaggguacccugcccugguacucaucuccuggaaggaguauagacccaagguuacauagccuaggcuggggcccuggcuucugucagcuccagcacaucagccacucuucuguagagugacaugagaggugacuucagagggauagaguggggaacagagcaucagugaaugggaagagacgugcaagugacaugaaggagaguggaugacagaaaacuacccuccagccugggcagcagguaggaguaggacacagaugaaugguaacagccccugcaccugcccccccacccccccacacacacaccuuauccuagggagcucacacaccuggagcucacacaccuggagcucacacaccugggcucggguaaggaugauucagaaagaacagugacaccauguggaauauucaguccuucauuuuucuccaauaccaguaaggguaaggacccaaggcagucacaaacacacacacacuuggcacagccuguucuugaauagucacuuccccaagcagccaagcuauggaugagaccaccugacuguaccgcacccuccaaucaucauacacacugccaauuaggccagucugcuguaccuagugcuccaagcagcaagaugcucagagucugggccaucaaaugauccagcguggcugcuuggcacuguccuuggagcuggggaaauaauuacaccuucuuagcuacagccuuuguucuauugguauccuggagucucugaccgucucucccauggggaccaccgcacugaccaucuuguagcguaugugauaggcuagugcuaccaaugaucugucccaggucauuucacacacaguggcuuuccuagagaccccaacagcccuucacuaggacccccaacagcuccucacaaggugccuacggcugggggccaauucugaauggcacacuaacaaucacagcccaucuuaaacacccacagcuuugaucucacugccccuacgaggcacuuuuuagacuuccuuugagaugcuucuagaauaccauccucgggccucagaacuuugaugagccuaacucggggagcaucuccuguuccuggcauacacccuacaggcacacacucccgcacccaccaccauagcugcacagggcacacuacagcucuuccucggggccagggugaggggccugaguuccacgauggacacgcugaugcuugagcagaugcugcuuuugacggaagccacggccacaggcugugcacagguagggucucucgccugugugguugcgccggugccgugugagguuaggcuucuggcuaaaacagcgaccgcagucugggcaggcauagggccgcucgcccguguggaugcgcugguggauggugagcgcugaccaccaugagaagcucuugccgcacucguugcagaugaacuggcgcugcucgcugggcacagccaaggucucacacuccuggccacacagcacuuccuuagcacccuggggaccuuggggcuucacaaccacacucugggcaaucucagcuugugacucagagcccggcacaccaucccggacugccgacugcgagcgcagcagcuccgcagcugugugcacacgcuggugggcucgcagugcugcacggcuggggcagcucuggccacagcucgugcaccuugcggccugggcgccagguaggugcgugcgcaggugcuugagcagaugcugcuucuggcggaagcugcguccacagugcgagcaagggugcggccgcucaccggugugguugcguaggugccucgugagguugggcuucuggcugaagcagcggccacacucagggcacgcauagggccgcucacccguguggaugcgcugauggauguugagcgaugaccaccacgugaagcucuuaccgcaaucauugcagaugaacuggcgcuguucacugggaccuaagcggcugugggcuguuguccggacaccaugcuggccccaccaacuccgacagagccccagccagacccacucgggaugcccgcguggggauccugggcgcaggcgacaggaccagcgacgugcagcagcauaccggaacaucucguguaaguugacucgggcacccaggcgguuucgggcaugugcccgcugguggaugcggaggcccacuugaugccgaaagcagcgcucacauucuggacaugugugaguggcaggccgagagugugucuucuggugcuuaaguaggugcuguuucugacugaagcgccucgugcacuccgggcagcagaagggccucucgcccguaugguggcgcugguggcgcaccagguugggcuucuggcugaagcucuugccacacuugccacagagguaaggcuucucaccugugugugugcgcuggugaaucuucagggacgaccaccagcugaaccucuucccacaguccacgcacacaaagugacccccacccgcagaaagugaggggcucagaggaccuggagcugucccuggaacucgagcagccaguggugcauccugcucaggaaguggggcccaccguguacccccagucuccucuugugaccccagagcccuaggccuccccauggucuggcagggagggagaccacucugcugcugaaauauguuuuccuuguccuucucuguggccugagaugccacagucugcaacagccacucuggcuucuccugcuugauccuugccagcccaucuccugcagaggcaaacaaagggagaagucagaagacaucacucuagaaugagaagagccuagagaggaagagggcuguggacggguagggauagcugaaagagugaaaggcaaauagcuuuaaauacagggaagaacagggauagggaaagacuugaaggauccuauacggacaggcagaauguggagugaggaggaaacccacgggagaguaaacacaagugcauggcuggcuugccaaggccaugggcaugcauacgcuguccugccuacucuacccaaggcccagaagagucagagacauuaaagaaaccaagcagagaugccuccugacccagggagaauagauggccaaugcucaaagucaccauuuaaaaaaaaaaaaaaauuaaaaaccucccuccccucaccccaggugugugugugugugugugugugugugugugugugcagaugcaaggugaauauguggagaucagagagcagcucugugguguugacuuucucauuccacaaguaggcuuuagggacugagcuugggcuaucagguuugcccuuuaagagcuccugcugagccaucucucuguccaaauacuugcugcucuuuuucuaagaguuuggaacugggugcuuucuaggcaaagacaugcucagucccucagugguuagggguaccacacccugagucgcuaaacuuuccucuucacaggcagggcaaggagcaggaacaccccacugguaaagaccgcgccccccaaccccccgcauuuagcaaauucaccaagaauaaguagguagggaggucccaaaggcucugaaugggaaaacgcauucugagcccuuucaauaaagguaauccacuagaacucggggaaacagcuaccagaccauaccuuacgcccaagcuccuggcaguaagaagccacagugaggaccacuucagaaaagacaguacggaugugauucacuuuauaugaacaucagaucugguaaaaacuaaucugugaaucagaagccaagaccauggcucauuacagaggcauggcucugagguccuauuggugucccuugauguagguccuggucacaacacuguguuugcucuauaagaauuuauggagcuugugacauaugcaccuuucuguguguuacaccaguaagaugcucacaccugacaggaagggggcagcaugaaacaguugugagccuagagaaagauuugggaacaacagaguucagcagcagcacagccgcacauuucaaaggaguagaaaagggcuguuaacgcaaaaguacaaaaggaucccccaauccuaaaaugucaugcacagccuucauaucaccaaaucuuuacauauaaaaaggaauuaauuuuaccagaaaguacuaauuaaaauugauuccagaguagguuaaaggggcuggagagauggcucagugcuuaagaacacugguugcucuuccagaggaccuggguucaguucccagcacccacaaggcguccccuguaauuccagucucaggagaucugauguucccuucuggugucuaugggcacugcauacaggugauugacagaucagacagugcaggcaaaacacacauacccaugaaaauaaaacagccuagcacagcagugcacaccuuuaaucccaacacuugggaggcagaaacaggcagagcucgaguucgagacuacccuggccuacauggugaguucuaggacagucagggauauguacacccuguccuuaauuuuuuuaaaauaauaaaauauguuaaaaauaauuuuaaacaaggccaugcuuuuuaaaaacagauuguauaaacacuuguaagaggcuaaugugaaagcugaauucucgcaccaaaccggguuauagacaacaugguugcaucaacucauuguauaaaaaauucaaaggaagguuugagagaugguucaaaauuuaagagcauguccugcucuuuccagaggaccugaauucagcucccagcaccuacguggaguggcucacaaccagcuguaacuccagcuaaggggaccugacauugucuucugucucugugggaccccgccaugugcagcaugcacucacagacacacgcucaucacucauaaauaaaauaucuuuuaauuuguaagaaggaacuauucccagcucugcaacuguuuaguaacugggagggaaugagaaaggaggagaagagagaggaaagcaugagaggcugggaacugggagccgucuauaagacaagugugcaagaauggggauaggcaggaaauuggagauuuacugcuccuaaaacaaacauuugcaaagcaaguucaucagaaucagaaacaauauagccuagcaggcauuuuuacuccagaaaagcaaugcuggcuugauauaauucuugagguuaucuuauuaaaaguaaagaaaucaugugguguuguagagagauugccuggcagccauguugucuguaauuaauucucuagcauuaaaaaaaaaaaaaaguaugucuuaugucauucucaacagaugcagagucauaugauaaagacaucauuucaggaggcaggagggaaagcauuagcagacuaggacuauagggaaauuccaguuaacaacaacaacaacaaaaauuguguacuaaaacuauagcaagcauucuauucaacagcaaaggauagaagacagcuaaaagaacagaauaaagacacuuguuaucauugauacuauuuaaccuuguccuuggggaaucagccaaaggauagggggaacacaaaagagaaaaaaaaaaaccucucaugugcucaggugugccagaggauucacuaauaaguggaaauacuagaguucagcaagacugucgggcacaaagcacucaaaaucacuuuuuaaagacugacaauagacauuauaaaagagcugugaaugccuuaaaaaacacacaagucuuuuguaaggaaaaacuacuaaacuuuacugaagagacaagaaguugugcuauuagccuuaauugucaccugggaagaaagugucaaugaacagcuacauaguucaguugaccugugggcaugucugcgguggguugucuuggucauuagccgaggugugcagacccauccugauccuggaggcaccauuucaggaccugggcucuggacuguacagaaagcugaacagcagcagcagcaggcggacugggccgcuuuuacucucucugugcucuggaacgugaugugaggucaugacuaccugacuggcuuccugccaugacuuccccaaugaugacucuuauagcugacacuguaagucaaauaagccauuucuucucuguucuuucuaccauuuggucaggguauuuuaucacagcaaaagaaguaaaacuaauaaagaaccccaggacaaauauauuccgaaaugaaaaggccaauaauacuuaaauucaguguaaucccauuuaaguuggcuuauaaaacauauaauguauauaauuugauaagaaaauccuugaaaggaaaaaguuggcucauacaauguuaaaaguuaagcugcuaccacagaaugcuaacgcugacagaagccuaaaggcuggcaaguaugcaaagcagcagggacuuauuccuuaacaguaggauugaaaaauggcaacuucuucaaaagacacuucagcaacggauuaaagagcugagcgugaguguaucguauaaucuagcaaucaguguuguaagcauugaccccaaaccaauuccaaacaagaugcccuuggaggagugggcaaacggggagggggagggaggacaggaguggagacugcuauuuacauaaggagugauacuuaguaauaaaaagaaauccacuaucaggucauagaaagaugggggucuggggaaaccuaaauguauauugcuaagugaaagaagccaaccugaaaaggccacaggcuggguagugccagcuacacaacauucuggaaaaggcaccaacauaaagaaggaaccagucauucauguuggagggaggaaggaggagcaguugggugcuguauuuggggucucuaccaaacccauagaaaguucagcuccaaggguuagcccacgucuacacuaugggcuuuggguaguuacuauaucaguauuggcucaucgaucauacuucacuaaaguaaaaugucaacagagaaagaggggccuccacucuguaguuuuccuguuaucugcucugaaacuaaaguccaucuaggugaggagauguuugagcgaaacccugcugugcugagcuguuccaucauaaaccuagcgagcugaugcugcuagcccaggcacugcagcaaaagacaaacuggcugauggaacugagagugugacacacaacucgggguggcauuaucaguccaggguggaagacugaccuaugucuuagugucaacugacuuucuguggcaguuuggaugagaauggccuccagaggggccauacgucugaauacuuagcccucaguugguagaaggaaguaugaccucauugacaggagugugucacugggggugggcuuugauguuucaaaagacuugugccauucccgguucuucugucugucucugucucugucucucucuagguguguguguguguguguguguguguguguguguguguagguuauugaucaagguguguccucagcugucccuucacuccaccauuauggacucaaauccucugaaaccauaagccaaauuaaaugcuucuuauaaguugccucggucaugguguuuuaucacagaaacagaaaaguaacuaagacauuuuauuucaggggaaaauauuuaugauagauuccuggugcauaauguuaauaaaugucaguuccaaauaaauuuuggucuucccugugcuugcucaugagaauucauuuuaauagagccaugcuuuaggaggaaaguagugacuucaauuauauauugucaggacuugaaugcccaagucuaaugaguugaauugauuuacaggacuguccccugaccugcacugaaaucuggacauaggaaacauuugguaccaaguauccagucuggcuugaaucugagguuuauucgaugagaagagaucacuguccgugauugacaugcugccaauuaaaguaacccagagacccccauguuuaaugccuggccugauuaaacuuggcuuugacauccaaccaggaagacgacccugggcagagcucuucuccaucugcccacugaagaguagag

SEQ ID NO: 2980 - RNA, 6930 nt, Mus musculus
cgcacuggucccagagucccagccagcuuccaggagcugggguagguccaaagccuuagcuagccuggggaugaagaagaugaagaucuugcuccuccguaaagaaggauggccagggaugggguuguugggacacugaggugacuuccugcaaggcaacgcuggcccuagaaucuggaccccccuuuuuuuuuuucccaggcaggcgcagcgcucgcugccucccuuuuccccgccagccagguuguuggcgcguuagaccucccagccucacggggcugcugugcggcugcgacgaagcuggcgacugcggcgcugcagcagaggcaagggcuccagaggcggcgccacgugagucccaggcuagagcccaagaucaggagggagguuaccguauuuaucgaggcuagugggggacccuugaugccgggucaccgcgggcgugcuaccguauuugccuggagccguggaaguccuuucugggaguggcagugccgggacuuaauuacuuguuuacuuaggaucccgcggucucgcggggggcgcugcgggcaccgggugggucgauugcaugcguuccuccaggagaugggguuggcagcucaacaaggugggcugcggaagcuggguggcggccuauuuauguuccuaggggugggguugcgaugcacagcuugucacauuucucggaccccugaguuaacaaggcugugagagucucgcuggguggggugagcuuuuggaauuaaggcagggguuugaccagaccagcgcggcaggaggcuuuucggcuuuauggggggcggggaagaagggcgcagcgcugcgggagacuuaacuguuuuuuccuugggcugcucagacucuugaggaaaaagcugcugcaggcugcagaaggggagcagguugggaugugaguggggcaccugauggaggaacuugggggagggacagaaaaccaaggcuuuagacccuccaggcccuggucagaggucuguagggaaaguggggagguugcccaaugacaggaccaugcucagauuggacaagaagacuuugaugggucugucuuugcuaaugccaacacagaugucuggggagggauuauggguggagccacagggcaauggguucuaauccuuuucucuaggguuaagugccaauuccaccuuggccugaagguaggggaagauagagggugucucugagacccugacccugcagguugauugacugaggcuggaaguauggagaugaccugaagggagguuuuaagggaacccuaaucaagcuuuucugauggggggagugaauggagugggucccaguugcucuacaaggcuugggcgugauagcaagucaccaugcccuauaggggccgugacccuuugagaaugaauggguuugugguggcugggguauugguaggcgugugugucaagggauguuuaguugcugagccgcuaguauagugaaacauuuucaauuucaacagugagucaggagacuuagggccuaguccuggcucaccuugcugugugaccuuggacaaguauguugguuucucccagcuucaguuguuccauuuacaaaccugggcucagggacgcuguucucccuguucaaggauguugugaggguaguggggaacuauuucagagaggccuaguggccugggaagacaaucuuuacaccaggcaugaugggagcccagugcuggggugaugagugugguggucagccuuuggaccaggcuugucuccuugggagcucuugcuuugguucagugaucugcagcuuuucaaauguaugauucaucuuauuaaacagugggacuacuuuuaaugguuaacccggggaggggucaccuucaacuuuccccgggugggggugugugguggugguggugaggugggggggagguauuuuacuuccugcuuuaagccauuggugaccuuccuuccugaagguuuugggucaccgccuaugcuugggcaucugacuagagaaucugcuccugggaguuccagcaguuuuuagccugugucuuuuaugucaaaggcacagggcuugaugugccuugucacagaagguagcucucuguucuugagguuauuccagggugacgauaaaggucacaaagcugggcaguggacugcaagaguaugcuggagaagucaggggagacuuguagaaggagguggcucuugagaggagccggggaugacagacugugaugagucaaaacaaagcaaaacuagcugggcaaacaguggagguuguaggaagugaguguuuccucaggcuggagaauggcugacccuggggucuuccuugaucccucucuccgcuucugcuucuccaggagcuggugauugcaucuggaagugcccaugacagagcugguguccuccaggggaggguccccuacaggggacggggaggagggucugggggacgaucaaggccugguuauccaccacccggcggaggaacagugccaccgcugcccacugugcgggcagaccuucucccagcagcccagccuggugcggcaccagaaggcgcacgugggggcuggccgcgcagccgccuucgugugucccgagugcggcaaggccuucagcgucaaacacaaccuggaggugcaccagcgcacgcacaccggcgagcggcccuucgccugccccgagugcggccgcugcuucagccucaagcagaaucugcucacgcaccagcgcauccacagcggcgagaagccgcaccagugcgcgcagugcggucgcugcuuccgcgagccgcgcuuccugcucaaccaccagcgcacccacgcgcgcaugcccacgccgcacccgcgccgucccggugucuucggggagcggcgacccuacuucugcccucgcugcggcaagagcuucgcgcgugaggguucgcucaagacccaccagcgcagccauggccacgggcccgagagccaagcggcccauuugagccgugugcuaugaccugugggagaccugcuaccaccagcugucuccaauccagaagccacauccaagggugcuaaauugcagugcccugucuggaugggcuccugggagggggcagggccagcuuaggguguugaaaggccuccgggccaccccucccccuugucuuccugcccuuggaccccuuggcuggcugcauguaucugcuuugggcaccugcauuaauuugccuccuccggcugccuagagcaggugagacucacaggguuggccagaguccccugaggugugaggguggugggaguggggaguguggagugggcguguaguguuggcugucuaggucaggaagggggguggguggguggggacuuguguuggucuccaugacuuacugcguacccgaucuucauucccagcaugucagacuugaaagcuacuuggagaaggucacuugccacgguucccagacccaagcucgguccccaaagccucagccuccuguacccacugccugguggccuugagaagccauuccacuccaugucucaguuugcuuaucuguaaguuggagaugaagaugaaaaaccuuuaccuuuucccuggggugccacgaggcuucacuguuaucagaaggugaagccauuugucuggaguuacuuaagaaguccacacucaugccugggacaggguguaggguaucugcacagagauaugggcuacucugggacagccugcucugaguugggauggugucuggcuuuaccuaaggggcuuugauggcuuuguccuuaguucuagagggacaggauuucuguagggagaguugggaagcagaaggauggguuccggacagcaaggacuaggauuuguucagagggaagguacaccagacauuugucaugagugcagggagcacggaucugugauuuagaaugagaacagaggcccugggaggauggauggaugcacaaagccuugaggcucauucagguaaugagaagggaggccucagucaagauggccaaggucgucugguaagacugcuagcuagggcuugcuugaagacccauguuuacaaguugucacucggagguacuggccuuuucugccauuugacaaacaaggaaaccacgauuugcccaaacuuguuccaaauuacagcaaauaauuagcgucacuauagcaggucaagucugggcuuugguuuuucauuuuggaccugaaaacacgucagcucuauuguugaauuauugaaaaugcagcugggagaaccugggcauguggccaggggccgggugauaggcuaucaugggcagguuaucacuggguuugacaggugcagggauaugaaguuaggaagcugcgaccucugagcuggccucuguucccugagcccuugcuuccagcuaggcccgugcuuggugcuggaggcuguucauugcuuuugcucucugucccaccucaaugccaugcgccuccucuggaaucacuucugccugagaucccuggggguuauuguaauauuauggacuaguauuuagugacagaaaauauuuaacaagauccuaguuagucacucaaguacccagacccaaggcaugucgggugucaacaggcuaaaacuuggcgguguuuuguuggggagugguaguaagaggguucucuuaaggucccagauagaccaagaguaggucaggugaauguacccauguaguccagaugggcugguaggcaaggccaugcuacuacaaugugcugaccauagucucugcuucugugaacagauacgaagccaacaggaccucauggcccagaaccugcagggcgcaucugggcauggaaacuaaaacuggagucucguagguccuggguuccugaccugaagacacgucuccucagaaguccuaccucuggaggugcccuguguugguagagcaugggauuagaggcugauuccaugccuuggugggaagacuccccagaucugacuugucacagcugggcaagccucauuuggcuuccugauccuagaccucagcucggggguggaggcagacaucaccuguguggagaaguggcuucucuccuccagccuggcucagcccuugguugaagggcaaggacaaggugugacuguuguguaccguugcagcaaguugauggcagacugggcucaagaggcaaaacuucccugaugacauggagagcacgugaaggcuuccaugcccguucccagcuagacaggugacugcuucaggggcuuguggcccuuuaaguggaggcuguggaccucguccuagaacucgcguacucauggaacucucagagugccaagcaguuucaggagccucuggacuccagccuaaagaccucagcccuggggaguccaucuuccauccuuucccuacuccacacaagugugacgcucuccuggucuccucuuguuugggaauaaagaauucugaggcugagccccuuuuaguccauccaaucccuuucucuucaaucugacagcaccccaaauuucuggagccaggcuucccuccccagacacugcccaagacugacuccugggcuugguuccuuuucccuguuuugugucggacaggauguaggguuuuacaguggagcccucugcuugccuuuggcucuaacuucccuguggagucucaagggaagguuggccugcugaagggaugguaaauaauuuucucugugucuguuccucgggaaaggaaucguacuuccacuagccauaugcaaacaauuggaccuccuagcugggcaggcuugcagcuccaggcagguaucaccugggaagguggggguugcagggcaccagaacccugcacauggugggucuaagcagugggaaaagccaguggaggaguugcaugugucuccuaaguaagcagggguacaacuuggagaugagggucuugggccacugcuggucaaggacucauauccuuacauauuagcccgucagucgagagcccacaacugucucccucccuuccuagaaugagccacucauuaggaaagggggaggggcuuucuuuucuaucaggacuugguagaaaccucuggauuccugacuuggggucuuacugccugcauuccccaugcaguuuggguuacaaguuccuacugaaccccuaugccuuauucuggggucacugaguacucaaagagaucagagaaagggaaggcgcuacccauaccaugggaacuuccaugcacccucuuuucuaacuuagggcgacuuucaccaugccucucagcuaacugcccagcuugucucauccccacuguaacugagccaugccuucccuuguccugcucugaaauguucuuccccuagccucuaaacccacuuauucaccagggccaagccucucagccuacccagcccauguuccuuaacaguccucguguuaauacauggugucucccugaguaucaugugcuguuuaaucuugugcuuguuucuucuguguuuguguauguauacgugcugugugugcccgugugcaccuugaguccccaacuagacugugagcucccugagggcaaggggcugucauuucuucuucaacuucuagugggucuagcccaagaaccucucagaagacaacuggaugaaacacaugcuggaggucaucugagguggaggguugugugcauggggagaguccacauggcuuagcaagaggucuaugcuguugggcuauggccugaccccuuggaucaacaauggaugcucaaggucucacauccuugcaaauuggagguaguagaaacaggagggacacccccucccccaacacagauagaccauggcuacaccggagugcacaugaaugguuggauauucccaaaggucccugauaucuguuggaggaggugacucaaauaaauguucucuacaacagau

SEQ ID NO: 2981 - RNA, 2988 nt, Mus musculus
uccacccauagaacuuccugucagggaaugagggaaguuuuacuucauaguucaguagaaaacuugaaccaggucaaauugguuccuuggagagauccugaacucucauuaacuguugcagaagaaggugagucuggcuggaagagaccuggagcgagggagcugugagagggagggcgaauggagcaucuauggggguggaaguauugugucugcacagggaggaagcugcuggggggagggguggaggcuaagagauauaaggagaugaacugaugcguugcagugugucuguggggaaggucacagagggccuggugcccuuuauagaaaguucugugucccccaaggcagguucguuagaguugggagagaacucagaucauguuuaauucauuuuuucuuaccucaaugugcugacuccucuuaauuguacaacagacagauuugcauguguggcugugugacccuuggcuugacggagggcugcugaagccacaguguagucuaggggcuccgagucuuguuuugcaucuugucuguugcuuucucuuuauuaugucucuguaguacacucugaggugaaguggugacacuucugccaguucuuuuguuaugcaggauuguuuuaacugucuuggggguuuuguuucauguuuauuaacaugauaagugagcauauuucuggcuucagugugauauuuaacuguaauaauuaacauauuaacuguguaccagucaaagcaggggagaugaacaauuccucucucucccucucucucucucucccucccucccuuccuccccccuccccccucccccucccccucucucuuuggucugagauagggguucucuguauagccuugccuguccugaaacucacucuauagaccaggcuggccuugaacucacugagauccuaccugccccugccuuccuuacacuuucuuuauguuugaguccuugaaugccucuccuaggucgucauaaaauauauaguaagcuguugaccucuauagucauccugggcuuucagguauuuggcacaguaacgauuugggcgcacucauuucccagaccuggcauugggcaugagccaggaacaucuguuccaauauuggcaugaaggcgguagcaggacuagagacagccuguccaugccaucaggaacagccuaaaugauauccagaucaucagccuuuuaaaacuauagaacacugcaaaauuucaggagaaaaggaaaaaaagaaaggaucgggagugcuuuccauuugucuaauagguaauuuuccucucuucuccuuccuuaagaucugugcauucagaucuuuagagucagcuugccuugacauggcuggccagggagacacugaagugaggaucauucugguagggaagacuggaaaugggaagagugcuacagccaacaccauccucgggagacgucaauuugauucuaagauuugugccaaugcuguuaccaagaccugccagagagcauacagggaguggaaggggaaaaaccuuguuguagucgacacuccugggcucuuugacaccaaggagaccaugaaaaccacauguuucgagaucagccgcugcguucucuacuccugcccugggccucacgccauuauucugguuuugcgacuggaccguuacacugaagaagagcagaaaacggucgcucugaucaagggucuuuuuggggaggcagcccugaaguacaugaucaucuuguuuacucacaaagaagaccuugaggaucagagccuugauaauuuuguaagugaugcgggugaaaagcucaauaauauuaucucccagugugggaagcguuacuuggccuuuaauaacaaagcagcucuggaugagcaagaaaaucaagugcagcagcugauagaacugacagagaaaaugguggcccaaaauggcggauccuacuuuucugacaagauauauaaggacauagauagcaggcugaaccauugucuagaggaacugaaggagacuuaugcucagcaacucacuagugaaaucgaaagaauagaaaaggaauaugcugcuaaauuagaaaaaggaaaggcggcacaaauuguuuuugcacagagaaaucaugaugaaaaauuaagaaauuugaaggaaaaggcugaagagacuguauuuauguauauuuuccaaaagauaaaagaaauucuuucaaaacuuugggacgaguugugguaaauuuuauuuauuuauuuuuauuaacgacauuuguuuuugacaauuucauacaagcacacauauaauguguucugaauauauuaaugacuugcuuggugcugggagccauggccucagccauugccuuguggacauuuucuagcuuacauaaacaauccugacagaacauucguggucauaacaggaagaauguggguaaagaggacacugugaccguuguuuccagaaccucaagauugccaccugaccuucagagcgaucccagacucuucccccauccccugaagccuccucuugcuuaugcucauauugcuacuccugaauaaagguuuucagagcuugaucaguaugauugacuucuugucccucccacucucucacuaccuuuuccuggguccucgcugaugaucccuguaggugggggggggggggcagcuugguguguuggcauuguaguuuauagaguuugguuaagacuaaugaugucuuuucuuccccagcagucuacauagcaacuuccagcaacaugaaaagggaggaagcuuccagcccaguucccgccugauuucuucauauaguacaguguguagaguguuuagcaauaggguggguauagcaaguucugguggguucuuuauaauuugacaugauuuauuaauguaguauauuguauuuucugaagaugguuacggugacauguuacauucccugacugauugaagcauaauugauaaauaaaauugcuugcuucucaugugg

SEQ ID NO: 2982 - RNA, 1038 nt, Mus musculus
guucuugaugcaauaucgcaugaaguuuauucaggaaucagcaugcuaaggccgagcucauaacccgcacaggggcagaggagaucaacccucagcaguugcaguugaggguuuuuuaaaggaaaaaaaacauaaagaagggggaagcugaguaaacaucauaagaauggggaugaugaauuacaacucaucucuuaugaaaagguuacaggcuaucuuuggcaaacauuuuuggucccuuacacaauggcacacaauggcaccugggugggucaagauuguggugagccaguuccuggaauuaggugggucacccaguggucaucgguuuuucaggcugaaggcaaaagaacuccaugcugggcuuuguuucuaggggucuaagaaacacauugaguugggggcuuacaccguuagcauaacccccacauuccauacccuaccuuucuccucucauuagucccucuauucccugggacaauucuacuucucuuucauaccauucauauauauacauguguguguauauauauauauacauauuuguguguguguauguguguuuguguauauaugauuuuuauuuaccuauauuguuaguguacagccaauuguuaguaguacagugauucagcuggccugcucucagggaccuagcaaaggcuuaguuaaucaccugcucaugcugucuuuuuuucuaauauauauuuuuugcaucuuugccaaaagucuaaugacuuugccuguguggauuaguguugugaauagcccugggucuaauuacauuugauuuuaauucuguucuccugugagggguugugaacaaggaaugagucagcacucaggugauuuccugaaaaccugcuucccaccuuaauuuguaaaauaaaggagagcugucaauugggcagauaaagggaagauggaguggaaggugaggagagagaagaaggaaaaaaauggaagagggggaggacauagaagaggaggaggaggaagaaaagcagcacaaaagcacauggccuggagaaaccacaa

SEQ ID NO: 2983 - RNA, 7934 nt, Mus musculus
gaggaagaaccugggugggagccagaaggggagggggaaugggcagaccucaacacuuccuggcaggcagcugggacugagggccccuuuagggguuuuccagcaggcagcuccucacugggcacuggagagcuggagaaggugggcgagguaagagcugggguuggcacugauuguuccuguggaauccuuugauugcacagugcucucucucccagucagggauagagcuuucugagcaggugcuggccugugccaccuuggguguaugaguguaucugugucaccuguaucccugcuccagcaggccugaucaucuacuccugauggaccccccucaaguggggcccuuuccugucagcuacuugcuggcaaacugagagacuccaugucaggccccaucccuccacccccuucuugcucuccucucucuggggucagcuuuaagccagcuccucccagaccucucaguuccagccccacccaucgcagaggacagcaggugagacaggacccuucacggccccuugguagcccccuuuugaagcauaggguuccuucuucucuggaagagucuccaagucuacuccucaagcuccaucuuggcucaggaugcuucuccuuccuucuaucucugcuuuccuguaggacucuggggagggagggauguguuggacagaggaugugacucuggaaacagggcugaggcuggggaggucagagucuggcuuuaccuuccauaguuaucagugccucacgccugcguucuaagagcagggccuuugagaccacgcagaggugggacagcuguggggacacgggguguucuuuuucuuuguuucugaacacugggaggagggauaucagagagccacuaucuggagcggugccagaaguggugagaggcuucuuggugccuagggcuuuaguuccugcucugcagaggaagcagagggauucuggguggccagggcagggauagcacugggggucuagagggggccagcacccagacaacugagacuuuauuccuggaaccucaagggaaggugugaaccugaggccuucauuuguguuucucuucgucccuccugaaaaguugucagacuccugugcuuucggcucugaggugcacgggugaguggaaggugcuccguggcgugggggagaacaugaagggaugcaaagggaagugacuggaguggccgucaauauccagucagaacugaugcuuaaccagacugcccaggagagccacugggcagaacuucuuuuggacagaggcaagccaucagaggggcuaaaugguuguuauaagcccauaacaggagacagugggaagcuguguuaagcucugugcugauuagaauggaggccacgcugaggaaguaaucaggcagaauaugaagaccucaugggccugccugaggcccuauggaaacucggaacagugguuuuauucagugggagaaaaguaauauauaccacagaccacaguagaaacuguuuuucagaaauuaauaccuggaccagcaccauagguccuugccucuguaucuaccaaauuaugauauacaguccaaagaucaacaucuuuuuuaaaauuacugcauguuuguaauuuaaacaugccuguucaugugggugugugacuaggggugcauauugccggucguaauuuucagauauaaaagaacuucuaugaaaaaaaucaggacaugugaggaggaggaacucacaaaagcauaaacuaaaaaaugccuuucaaaacaaauagccagccagccacugaaacggugagagaaccaagcuggagagccagggaagaggcuuuauguggggagaguccuggggaaucguuauuuuuauuuuucagacaggaucucauuguguauaccuggcugacccagaacuugcuauguaguccaggcuauccuccaacucacagaaaucuaccugccucugccuccaggguguuguguuuaaaggugugugccaccacacauggagggaacuuuuuacaauacacacauuccuaugccuugauuguagcuguguuuggaugaagauagacauuugucagacuucaagauaagcauugaaaauggagcaaguguuugcauuaaaugaaaaccuacaauagaaugugauaucucuuagguaagaaagcagaaguagcuggcacacuccauggagguugggggaaagccgcuccauucuuggaugaaacgccuauguggucauugcuaccacaucugcugggggcgggggggggggugucacugacaacagccacuaaaaugcauuauucuuuccacccugguugucauacaaagggguuggaaauaaccugcgugccugucaauaggauacucuuucaauauuaugacacacacacacacauagggguacuaugcagucauacaaauggaagcuuuggauagacugguguuuugugugucucuguguguguguguaaacucagguuccuuuucgucccacugagugagaccaagccaagcuauguuaggcagccuuauguuacugugaauaaagcaacuugaaggaggguugauuuauagguuuguuggcauggauugcuguuuuugauguuuugagcugagauaaggccauugcucugggccgcaggcaaggcaaacacaaaggaagagggacuguguccuagaggcugcuugccucaaggugguaaggaaagaaagacagagggaagaggggagagagaggagggaggaaugacuaugggggguagaugcucuucaaaggcauaccguauugacuuacaucuuccagccaguccccacuuccuaagucuccacaauccacccccaccaaaagcaccugcagucaagcaagcugugugagccuguggggagcaccaccuaggagcaccgaacauucaaacgauagcaucccauuaauccuuuggggagggggcccagggcugugccuggugaaaggcucuacaagugguuuggaucuucaaucagggccacugugacaagguaucugcacugcucggaagauccucuucacccugagccccuggccacuccuuacuccacuuuaccuucccuaacugugcacuucaucugucucuguugcuuuccccagcaggaaagaugguccagagcacagugacugugaauggagucaaaguggccuccacacauccccaguccgcucacaucagcauccacauccaccaaaaaucugcuuuggagcagcugcugggagcugugggcucccugaagaaguuucucuccuggccucaggccagaauccacuaugggcagcugucucuaggggugagaguuccugagguggcacagaggguggagacucccaucuuggauaggaugcagaggaauguguucugaauccucagggaagcacacaagcucauggcuccccuugcauuuggggcaaggauuugggauuuucucugcagggauucggauggaaagacauaacuaucucucuuuggcgcagagagggcuguguccgacagagagugggugacaggagaagaguuucagggcugugagaucaggucuuccccugaguuaguucaugggggccaaaggcugcagaugcaagacaacacuaaccaaacccuucaaggagaggcggagaggaccccugagccuggaaguucucagcaugacuagaguuaaaaguagauccagugacauaaacacgggacaucucaccugaggauccggggugugagcaagacucugagcuaaugggaacaggcuuagccagggagcaacaggaugcggaaaggaaagaacaccaagguaaaggagugccaggaacagggcagccgcagcugaugccagugcuggugcugugaaaguaaagaccagagggaaagaggcucacugcugauuuugccagaaaccgugagugacagggggaggagcucggaaccagcuucugugcaugaguuuugagcacaaacugggcucagguugccucaaagccaggaggaacccagguaggaagauccaggcucggugcuugugugucagagcagaugcaaugaggggaaacaggaaucuagauuuuugagugcccuccccgcaacuugggaugggauggguuuaggguguaaggaagaaauaaggccagaaacaugcaaaaguuuuagagauggugagagcccuggaaggcagaggcuauccuugggguguaggguuugguacaaucuaauggaugaacccgaggugccggaaggacaugcagauggggcacaggugucagugacaauugggcuuccuaggagaauacucaucauaguuagggcugucugugguuuauuggggcugcaccaccguugagaugagaagaucgggaugggcuugagcaguggggagcaucacaugguaggauagccuguugggaaacaccaugguucaaggaaauggcuuuaagugccaccuugcuuaaucacugacuggacgauuccuuaaagagccugccuuaagcuugaaagacugaggcaugucccucaugguagguuaucugcagccacaccuuuuucuaaaaggggucucucuggcacaucuuuuuuccccaucacauaagaccuuaaauaggcuaugcuggccucaaauuagccauguaucaaggacggccuuggacuucugaguuccccaccuccucuuccccaaugcuggguuuacaggcacggauaaccucaucaaggcuuaucuagauggaauccaagggcucauguaugucucugcauguucaccccccagccccccaccccucagcacuauguccugucuacacagagcccuugccauuguguuuggauaugaggaguuagguugggauuggaugcugaaggaggugcugaacuuaacaggaugauauucuggagggagaaggagaugggaacgguaagaacuggcagaaaucgaugacauuagggaaagguaaagaaaggcagauagguggagagcaacgcagaccagugcgacucagcagcuguuaggacagauccuuccagagucagagcugugaggaggccaaagcagagggaaagcuaagcccagccccuggguuggagcugugcaguuaucccugggaugugaaggggguugauuuuuuuccccuccugucuugcaggugacccagauauugcuggggcuugugagcugugcucuuggaguaugucucuacuucgggccuuggacugagcugugcgccuuuggcugugcuuucuggucggggucuguggugaguaagaaacuagcaaggagcuaaguggagcuaagugguugccugggggcuggagagaacccuucugaagcacuuuuuuuuccccugggcaagguuagaaagggcaggccacagugacaagugucggcuuguaugcugcuugccuuuggaacccugcuuuaguugggcuguucccggagcuguugguggaagugugaugggaaaccuagccaaaaaaggaaacuggaggccauuuauuuuucuggugucuucucuuuccaggcaauucuagcuggaguugguacuauuguccaugagaagaggcagggaaaacuguccgugagucucagcuuccucuaucaacccuauccaucucuacucuccaaaauggccacucuuccugcucuucucuaccuuuuauccuuuaguuagcgauacaaugggucuuuccuggaggguuagcaggggcuuccugacacaguggcggggggaguuggguggguuugaggccgugauucugugacucugccacugaugagcagaguggcaucuggaccucucucuuccagggccagguaucaugucuccuccuccuggcuugcauugccacagcugcagcugcuaccguucugggugugaacagcuuaaucaggcaaaccaguguucccuacuacgucgagaucuuuuccacaugcaaccccuugcaaucaagcauggacccuggguaugggacagugcgauacagugaugauucagacuggaagacagagaggugcagagaguaccugaacaugaugauggugagaacagaacccacacuacccucacucucagggacuggagcccuggagggcaggaaugaacaagcucagugaacuuggccuucaccccaaggccuuugguuagaaagcuaucauugaagcuggggcauuucucagacuuuuguacaugacgaucccuaaauuaaaggugggguuguaagcccccacuguaagccaccacucuguccuuuuuauugaauggcuauucugcuuaucuacuuauggaugcauaagguaucacacaugcgugcgcgcacacgcucacacacacacacacacacacacacacacacacacacacacagcagauaagauagauuuaaaugccucuuuguucauaguuuucacaguucucugggguagcugagucgagacaguucacaccuggguuuuccuagagagguaguggguguggucaucuaagagcucacuggggcugggcacucacacugaggcacucauguggcaggcagaugacgagcucagcugagcugucauccugagaaccugcagcagcuucuucaugugccucuggcuucccaguauagcagucauguccugggagcuugucaagaggcaggaauugaagcugccagacuagugaagggcuguccaucgauggcauggugucauuuccaccagccaagcaaguggauuagaaaugguggccaccuugucacuagaggaugccaccugcuuuccuggaaagugucuggacugaguguggcuuuggaaagguggcgaugugaaucaggggagccaacaauugacugagucuguucuucccuugccucuagaacuuguuccuagcguucugcaucaugcucacaguggucuguauccuggagauuguugugucuguggcuucccugggacuaagucuccgaaguauguauggccggagcucccaggcccuggugaguguucgggaaggggcuugcugggcaaugugggucuccgcagugaagaggggagaggaacacauggguucagaagucccugaucuuccuucaucccucacugucuguggagugugaacccaucuugugucccagcuggcuucugcuaccuugugccuuucuguggcugccuucacgcucauuccccacuuugucgaagucuguuccucacuucuccuacucugccccucaccuuuccugccggagagcuccuccuugcugucauucccugucggucccuucuucugcugcuuucaagugcggaaaccuccucgggcgucuucaccuuccauucaugaaucucuuccuccucuugucuuuucagaaugaagaagagucagagaggaagcuucuugaugggcauccagcaccugcguccccggccaaagagaagaucccugcuauccugugauccgcccacacccacgugucccuguccauaguaauccagggaggacgcgacuguucccagggccucuucuggccccgcagcacacaccuacuucugauguagccacuauucagcccucuuucucucccucucuccccacuguccucacgccaauguccuuucuuccacgaacagauauuaugucauuuuauccaaugccgauaaaggagaaacaacuugaaaauaauacccucucacagaaaggugugggcucugcauugagacagacaaugagccaggaaaggccauuucuugaguugucaugugggcagaagaguggugguggagccugauaaauacucuggcaaaaacaacuugugggagaaaggguuuaucuuauuauccuguccaucaguuggcggggggagcaucaaaagcagcaggagccuggagaagcuggucauaucacacccacaaucagaagcagagaaugguaaauguguacauacu

SEQ ID NO: 2984 - RNA, 5786 nt, Mus musculus
uacagaaugaguggcuggcagauugguuaugaaagcauggcccccgacggagagggucgagaucccaggacaccuagacucagcagagucucuacaggcaccccgccucucuccagcgccccagcuggagaaggggccggcacccccaccccccacccccgcccacccgcgaugccuaaagaggaagcugcguggccccuugcuugcuguggcugcuucucccagguacaggaggcacgugcgcuucugcguuuucccgacaggcggcgcuauucuaaugguaagcucccuugcuucacuggguuuucuuuggagcccuugaccuucacagaaguaaacaccaaugacuugcaaggcucccaccuccccgccuccuugccugccuuaggcugcugcuccccccugaguuguccuagcugguggcugucaucccaacgugacccugacuuucauacacagugggcuccauuaggcgauuguagaauagaaacagcuucuuccacacuugaucacacuagagagggcauugcuggauugcagccccagaggacagaauugcuuuugcacucaguacuuucuucagggguaguaggguggauguuuugggugguggugguuaugguuguugguggagguuauuugguuggguugggggugggggguuguuguuugguuguucacuuauuuugagaucaggacucguucuauaaccuaggcuggccucagauucacagcuaacuuccagccucagccucccaagugcuggguuacaaguugauccaugacaccagaucucaggguaucaccaugauuuaggcccaggcuuucugucacaaggcauagaacauauauucaguucauugucaugaaaaaaccaaucaggcuauacacaagagacuugguauaugagccuucuuagaaagauagaaguuuggaguuugcagauaauggacucauuagacuccuguggccaauaagccacuaguuuuaguuuucuuguggacaccccccacccccgaagacaucucuuuguaauaagcugagaacagaaacuguuucuugggggccuagugacuguuauuccggagaaagaaugugacccuacuugcuugggaaaaugggugccacguucuugcucauaaguacauugccuucauucauuagggggacaaaggaauuccuggcaauuuuuguuguuuuuuccucugcagaccuacuuucuagcucuacucuguaccuggaaggcuggccuuuaaggacuccauucacgcuggccuugacuuuggguucauccuguagguagcauggcaggcaggugaauaaggucauuguaucagcaccaguggcuucgucugugccaggcagugucugucauggcuuggcucugcauaaaacaucucugagcagcuagaggugaacauggcaccaaccacuucgaggccugggugcucugccagcccaugcugauuucuguaaccuuccucgucuuuguaaaguuccauucugccugugagaaugccaucuguccccagcaggacccuggccgacacaucgagcuuucuccuucaccuuuauucuccuuugaauguggaauggauuccacucccugugcccacaaguaaacguaacaccuagagcuaagcucggugacagagaugagacacgacagagaacaaccaccgccacccagccuggugucucuaggauggagguccacagccuguggggacagagcccaguuggggaaugaucaugugacacauuccagucauagaccgccagacacgaggaagggaggaauguuuugggcagcuguguugaaacuaaagaaggcguaugaaaaggauugcaggacugccuggggucagacacuguugggggccagagucuggaaauaaauggagaaugcagaaaggacauucuggcaaggacagagugauggaaggggcaagcgugggagcagggagacauaggccaugcacuaaagaguaguggaguggaagaaauaaacacaauuccuaggaaacagaccuuguugcugagcacccuugcaauaccagcguuguugagaacuggagacaguauugugaguucuaggucagccuaggccgcauugugaguucuaggccagcuuggacuacauaguaaaacugucuugaaacacccacaucaccaccaccaccaucaucaucaacaacagcaacaaacaccauuugcuaguacacuggaagcaggaaggagagaagggugagucuggaaaaccacuucugaauggauggccaugguguuuuccacaacaagagaggcaauguauuccauucuguuuucuuggguugggugccuguggaaaaggcaaguaaaaaacaaaauaaaaccaaaccaaaacaaaccacucaacaauaaaaaagacuguuaggaagcuguagauguaagccugagcucauaauagucuagacucaguguacucacacuguguauuuucuuccuuuucaaagcauuuacuuacuguaugugucggaguguucugccugcauaaaugucacauauacauguguggcuggagcccauggaggucagaagagagguaaggucgccuggaacuagaguugcagacacuugagucaucauguaggagcuguguccuccagaaguucagccagugcccuuauccacugagacaucucuccggggaugucucacagaguguacacuggucaucuucagcagaggcaugagccaggaauuuggaugagcuugucaugugucuguccucuucugugugcuaagaauaaugugaccaacagucaagaugcugaccaucucaugagugcugucagcccucaggcucugugccagguccuuuauggcuggccauuaugucgggaucuuggaccugacagaaugcucacagcaacccuaugaggcuccaguucuggaagaauuuaguaacuuguccccagaccaacccaucuagaaaauguccucauggcuaagaaucucaaaggucuugggaacucaaaaaaaaaaaaaaaaaaaaaacaaaacaaaaaaaaaaaaaaaaaaacucaaggucuugggagguuucuuaauuuuucuuuaagcaaacagcccaguuacugucuuuucaaagacuucaacuccaccuucagaaaagguagccuuaccacugaggguaggauuugcugcuuuaccuaacuccuauuguccauuugcagaaguucugagauccgccccccccccccccagacuucccaagggugaggcugacagaaggaagcugcuuuugacuacauuccaagugaucaucacaaaguucagugugggagcgggcaugauggcacacuucuguaauccuaggcucugggaugcagagucaggggaauuaccaggagucugaggccagccuggucaacaaagcagguuccaggccaggaaggacgguauugccagacucuguccacaaaaccuaagacacacaaaaaagacgcugaucgcgugcgcacacacacacacacacacacacacacacacacacacacacacacacauuuguccuuuuauccuuuuguacacauuucagagccagguacaaauaucuaugaucaccugaaacaaaauaucuccuacauauuguuaaccagauuuccauacuugucucgguucuuuuuaauguuuucuuuaagguaagauuaacacacaauguuaaaugugcacaucuuguguaugguguauuccuaaucuaguuacuaaagugaauugguacauuuugucucccgacuucauaauguaucuauucuaagaauacauugggccugcuggaucaguaguguaucagcagggccagcuccuggagacuccugcagccacacugaccccuugauucuauaguucccuggccuccuguacuucugacgucugcucucuuuuuagaaggauaacccaggcugcucucuacgucgcaagagcuugaggaccagcccagcugcaaagcaucugucaugucauguucugugaacucagaugccauccugagagucaccauucaucccagcuccagcaucauuuaaugaacuuuuacaaauguuuccauuggguaccccaaguuccccugaggaugcagagugcuucaucaccuguggggagcacucucagaccccuuggcaguaagucacuucuccuacucuacccaccagagacaaacacuugugucuucacuuccugcugaaaaugaauuaauagcccuucaacuuuuggcucuggcuucuccuacuuagcaaagcaucacugggauuuguccacacuaugucaguaucaucuuuuuuaaauugcugaguaguauucaagcuagacaagccuuagucaacuuauccugcccccuccuguugauggcauuaugaucuuuguugcugacauuguuuaucccuuggcuuguaauauccuccuugucauugaccuguggaccccacacaaaaucacacccauaagccuuccaagacgcagugcgaaggcuggggcuuugaaaaacacuuuguaauccacugccacaccucagcucaggggacugcucccuccucccuacuuguucauacuuugaccuuuguccuugacuguuuuaugauccucacuuguuuauagauuugacuccuauuacugcagcccacaccgcagagggcaggcaccaggggguuucacucugccuuauaccuggagcugccuggagcaggaggggcacaggcuuggcaagcugaaaccaauccuaccuuuuccaccauuaacauaaugauccucauggguugugaauaaaauguccccacaaagcucuuggcauggagcaaguuucugaaacagggggauaaaacuuacuuguggaagacacagaggagccugugauaaaguuagucacaugccaugaagccuggguuucuuuucauucuuauaguacagaaagauuugcuuuguuucaaaaacagacaugaccuggagagccagauaagcagggaguuccacuucccauuuaccuuacuuugcuuuuuauugcugugauaaacaccagggcccaaagcaaguagggccugagaggguuugcuuugcccuaugcuuuacagccaucaucagaagacaagacaggaacucaaguggggcaggaaccuggggaguugaagaagaggccauggaggaauucugcuuacucgcuugcuuucugugguacauucaacuugaccuuuuauacaacccaugaucaccugcccaggaguggguccaccccuaucaauuauugauuagaaaauuccccacaagcucuccuaagggccagugaaaagacuagucaacugagggucucucuucccagaugacuguagugugugucaagcugacacaauguuccaggcuaacuggcacaacugcucucuugacagauugacacagggacacaucauuguuaaacugcaacuuuuacuuucuuggauauuaccaguauuucaugguaacaccucgguauaaaacauaucauaaucuuaaaagucccauagucuuuuacauuuuaaaaguccauguuccugccuggcaagaugacucagggguuaagagcacugacugcucuuccagagguucugaguucgauucccagcaaccacauagugguuuacaaccaucuguaaugggauccaaugcccucuucuggugugucugaagacagcaacgguauacucacauauguaaaauaaauaaauaaaucuuuaaauuccugcuccccugcaaauaaaaguccauguucucucuuuuaa

SEQ ID NO: 2985 - RNA, 4867 nt, Mus musculus
uagauaagagagaguauaagagauuuggcaauaagaaaggaaacaacgccaugcacagagaagccuagacaccacugaggacagcucuggcuucaucuggacaaaggaaggaguucaccuaagaacuaggggcucugaggugcuugcucagagacagaaauaccugagagcucucaucuccucugcuguguuucagagccaugagccugguaggaaggaccuugguucugggcuggaugacuaccaucuuggugguacacaugucaguggcaaagcacuccaggugggcacugaggaccaagccccagaugcugugggacuugaguggugaggagcuggaggcugugcacaacuucgugaugagcagcaaggagcuagagcugcagccauccacguuacugacuuuggccaagaacuccguguuccucauugagaugcugaugcccaagaaguaugaggugcuggcuuuccuagauaaaggggccaugcuuccuuuacgggaagcccguguucugaucuacuuuggugcccaggaguaccccaaugucaccgaguaugcuguggggcccguugaacagcccauguacaugcgaaaacugaaccgcaagggaggccagcagcugucaugggcauccagacccauguccaaaguagagucugcccuccucuugcauacccugaagacagcuaccaagcccuuacaagaguuuuucuuugauaccacuggcuucacacugcaggacugcaaugguggcugccugaccuuuaccaauguuggcccucgugcuaugacauuuggaaagcgccauagcugguuucuuuugcaacgcauuaugaaugacuacuuccugcagcccacggggcuagagauccuuuuggaccaugggagcacagauguccaggacuggauaguagaacaagucugguauaacggcaaguucuacaacagcccagaggaacuggcucagaaauaugcagauggagaaguggacauagugguccucgaggacccacugcccaagacuacagagcaguuuccacaguucuccaccuacaagcccuaugcugaauuccuuaugcccaucagcaaggguggcccucgagugauccagcucuauccugaauuccccaugcccaucagcaaggguggcccucaaaaggcccagccugauccuaaauuuccuauccccaucagcaaagguggcccucaaguggcccagcccuaucgugaauuucccaugcccaucagcaaggguggcccucaagugguccagccugauccuaaauuuccuaucccgaucagcaaggguggcccucgagugccccagccccaugcuaaauuucccaugcccaucagcaaggguggcccucgagugguccagcccaaggcuaaauuucccaugccuaucagcaaggggggcccucagauagcccagccccauguuccccacuacagacuaaaacacaacacugugcucuauggagacuggaacuucuucuucaagcugcacucuucuuaugggcuucagcucuuuaauguacauuuuagaggugaacgcaucgccuaugagguuggugugcaagagguuauggcacuguauagaggacacacagcugcaggcagaaagaccaaauacauggaugugggcuggggccuaggagguauuacucaccagcuaacuccuggcauugacuguccccaugaagccaccuuccuggacgccauccacuacuaugacagugaugguccuguccucucucggcgagcccucuguaucuuugaaaugccccuuaggcaguacuuuaacuccaacuuuagaaguagcuucaguuccuaugccaagcugaguggacccaugcugguucugaggacagcaucaacaauccacaaucaugauuacaucugggacuucaucuuccacuccaauggcaugauggagggcaagauguacgccaccggguauguucaugccacuuucuacagcucagaagggcugcucuaccacagucgccugcacacccaccuacuuggaaauguccacucccaccuagcgcauuaccgcauugaccuggauguggcagguaagucuuaagaccagaccgucccaggcacuaaacuguccaaacacuucauagauagacaggcuaagacuccccagcauaaaaucagccguguucauucagccuucuuacauaaagaaacaucaugcagcccuaaaaaauggagacaacaaacgguacucuaggauggcccuaaaugugggauguguggucccuuuguugagugugaguggaaugguauacaagguugggggaagaagugccaugaagggucagaaaugcuagcccccccacacacauguguagcagauguguacaguuuggucuucauaugagucucaaacaacuggagcaggggcugucccaaaagcuguuaccuguauguaagcuauguucuucuaguugggcugccuugucuggccucaguggaagaggaugcaccuagccucacagaguauuaaugugccaugguggggggauagggucccgaagggggucuggggaaaggauugugggagagggugagagggugagcaggguguaaagugaauaaguaaaauauaaauaaugauaaugaugauaauaauaauaauaaaaagaaagaagaaagaaagaaaugcuaccucccagcacugagaaugaccacagugucaucuggguguccaguguuucuuggguaaugaugucaucacagaggcauaacauggcugugaugcuuaacaucaaauccuauagcagaacaacauccucaauauggcuaucaggaccagauggguagcugccaccgucuccacccugacuggccucuaucccagaguacaccaguaguacucaugccugaguacucaugucucugagguagcccacuggaucucuagaaaacagucuguggucacccuucugucacagcugucuagcucaucuguaggccuccuuucuucccacagugcuaaccgagugccuggccccagcuucuuccuuugggcugacuguggguauggccuagcauggagaucauacagaacagggaggaaguuuccgucccagcccugauucuugcccuccucuccucaugauauagguaccaagaauagauuccagacacugaaaaugagacuggaaaacaucauggaccccuggagccagcaggucaaacccauccuugacaagacccaguacuccugggagcgccaggcugccuuccacuuccggcagacucugcccaaguaccugcuuuuuagcaacacugggaaaagugugucaggucucagccacagcuaccgccugcauguccccuccauggcugagcaaguguuacccccaggcuggcagaccuccccggcuuucacguggcccaggugaggggacucaggcaaacugcugaggaagcucccucaguaaccuuguguaugaucaguuucuguccaagaggccauguuuuugcuggccucggagucugccuucuaaugggaauuccggcugacagacagauggaaaacauuucagguccaugaaagacuaucacugauucuggggcagcgcaauuucccuauccuugguugugauggugucucuaggcaggggaucagagucagcccccauuucugaagcuacugguaugcgucucugcuugcagguaccaguuggcagugacuaaguaccaggagucugagcgguuccacgguagccuuuacaaccagaaccaccacugggcuuauccuauggucuuugagaacuucauucacaacaaugaaaacauugaagaugagguauugauccagucuccuuuugcccaccucuggucuuguuacuagucaaugaugagauuuuacuggccccaggauuguggcuggugguguagggcaaguucagaggucaggaaagauggguucaccucuuuuaaauggggcuaaggguaucuugggauauauauaucccaauucccaggauccucaguuugccaguauucagcacugcccugcccacugagacucauauuucugccauaggacuugguggccugggugacagucggccucucacacaaucaccauucugagauuguccccaguguggcuacaccagggaacucggcgggauucuugcuccagccauuugauuucuacaacagcuuccggagauauacagguacaaaagccacagcuacaccagacaccagacucccuagaagaucuacucaaugccugcacaguucagcuacaugagacacagucuugugucuggcccagcuucugccuaauagcuccagggacacccacccgcaccccacaaaggcgacaacaaacccuucggucucuaucauuguauccuggcucucagaggcauuggggcaggggcaggggcugggggccagggggagugugagccacaugcucagaugguuagccaugggcuccauucacauuucccuacugcaccccaaaagacuaccuuagcgaggggaaaggaagcagcgcaagacacuggaguccucuaccaggugaguuuucagugucugagacucucuguucacucucagaucccucucagggaaccuuuugagauaccgucccacuaaaugauggguaggcagaaggaagcugcuaugggaaaugugacaugguuaccagcaucucaccuuuuggguguccuucuagccucuccaacucaugcccagugugugugcugauucgcugcaucgcugucuauaacaacagaagccugaagacaacuggcuuuccaucuguagugaaaaauagcucaauaaacaagggcacugcaccacuguggugccguaugaugaaag

SEQ ID NO: 2986 - RNA, 129743 nt, Mus musculus
uuugaacacguggcucauucaaaaagccggacacucggagcggcugcccccgccccgcuccccucgccgcugccagucaccccucgggguuuuuuuuuuuuacggggaggcggcgccugccccacguagugugauauuuucacagcccgcuggccgcugccaaagggguuggggaggaagagacaaaaaguaguuuccccccgcgccuccuccuuucucucgcuaaucccgccuccuccccagaguuaggaagacucgacgcugggcucgucgcuaggcuuuuucuuucucucuuuuuuuuaauacccagaagaggaaaaaggacccugggaucugguuuucgcccgccgcucccgugcuugggucacuguguggguuugaaagccaagaggagaggaacaaaauccaccggcuccauccuccgccgugggugcuuuuuuuaauuuagcauuuuccucggguuuuaaaacgaccccuuuucacaaugaacaaauuguacaucgggaaccucagcgaccacgccggccccgcggaccuggaaagugucuucaaggacgcuaagaucccgguggcgggccccuuccuggugaagacgggcuacgcguucguggacugcccggacgagggcugggcccucaaggccaucgaggcgcuuucagguggggcccgcgcgcguggucggggccuccccgucuccgcagcugccauccgggaccccgcuugcggggcggguggggguggggagggggacgcgcugucagucgcggggcgcggcgcggcgcgugcugcaggccgggccaggcgggccuuggggcccagcguggacgcccgccgggcccucugucuggucgcugucccccagccguagagaacagaaaguggccugagccuacgcccggggggaggccgcguccaggcggucccgcuccacgccgccgcguccaccucgcggggucguuagagcgaaaggggcaggugggcggcggcggccggcuguugccagaacggcagcccugccacgcgcggcgccgcagucccggcccgugcgcgcagccgcggcccgggugucugagugcgcucugccuggaugcccgaggggagagcagcuguccgugccuuucgguuuccaccguccccagcuggacucgaggccggcgccuugaugggucagcgcgcguggaccagcaccccggccgcccaaucuccuccuggcacccuggcucuuuaaucccaucgcccagugcuccaggccaaccuggauguggaccagaaagaaggccgcgcgcccccauggcaggcuguuuguugggggugugucucuugcagaccuuggggugcgggguggcccuuggagggggucaggaggcgaaaauugcaacccaaguggugagccugacucuugcucucccuccccagcuuucugcaaguuaaaaagccacacccacccgaagggucagcucugcacccucuccuugcccugcuccucccuuguccuugagucgggugggaaucuuggggcccugcugaggucacugaagcaggguguguuuucucuuaaagacuguagauuucaagguggggaaagcugcugaauuuagcccgucgucuugccucuuguguguucacagguaaaauggaacuacaugggaaaccgauggaaguugagcacucggucccuaaacggcagaggugagcggauuuacccuuuucuggccgcuuuuuagggaggaagcacagaacacagaugcaaacucggacccuuuggcuuacacgcuggggccacgguucagcuagcucuuuuucugcuugccuuuaaguuuauggcaggugugugugcgcgcgcguugauaauucugggacguaaaugggggcuugccugcggccccugcuucuggguuauuguugcuguuuuaaaagccugucaaggaagcucucacagcuacauguucuuggcagagcagguuuaggucucaacuggcagcccgaguuucaaaagccaauagucuuugggaaccuacgggauuuagaagacagguccaggacagauguggagaagcugguccgccguggugggcgcuucuaauacaggaggaggaacacaguugcuuuugcccugguucacuggccagccagcggccauuggaacacagugaaugcugggguccuggggccuuucaaacacuccaaaguuguuuuuuuuuuuuuguuguuguuguuuuuuuuuuuccuaacagugccuuuguuccagcuccuccugucccuugguguauuuugcuuacaaauaaucaccaagagacggugaaggcugggggaaucugcaacuucacugagauuucucuucuaugagagcaucuguagcugucacuuuacaaaauauuugcaggcuauuuuagcuacugaagcuuuuuggagaagcgccccccuuccccucccucccugcccuccccccccccccccccccccccgacucuguaacucuuaacuggaaagacugagguuagccugcuggguuuugcaaggugggguuaggguuucuggcuggcuuuucagucuucccccauuccuaaccuggagcaaacaauaagccugaaguuaauucaaaccagggcuguguguaucugguuaaguguuucugagagugugcucugggggacagagggauuugcccugcagagacagagggcaagaaugcugugugacuguuuugaaugaagcucucuuccacaugaaucacuucacacuccucguuuuagaaauaaacuaguguggauacuuguagguuccuuuuuaaguccuuguuuaauuucgccuaagauaauuggaaagauauuuguguaaccagauuuaggucuauuuugauaagggucaaguuauuucauauaguagaauguagucuuuuauuauuuuuguuuacucuucuaaaguagauguggauaaaaaguaucaaacugaucuugguuucauaggaauuuaaacaauugaggcacaacucauuugcccuuaagaaguuuagagaccuagccugugaaucagccauuuuggaaaaacgaaccuuauugcacacaugcuaguugguuucauguuuauccagugugucuuagugcuugucccuccggcccccuucccgucacuccccucucccccccaaucuuucaagggguugguuuaugcaggcgagcacucuaccacuugaggcacacccuuagcucuugguuuuuaaauccacuguagaauuaaaaguaagcaauacaacaaaacgaagagcugguguuguacccuauuaguagaaugauugccuagcaugccagaggccuuccacuccagaauccuugggcagggcaaaugauuauaauuaacaaagggacuguugugaauuuaaaacauuaaaugucuuuuuaaauuuaaaaacauuaagugaguuuuucagcuccagcuaauggguugaccucaguuugcuguauccucuguuuuuuauuuuugaaguuaaugucuucccauguguggagaauuaauuuaggaacuuggguaacaacugcuagucuuccuccuaaagcuuugcuuaugcuggaaacaguuacuuguuacuguuugaauugcaggguuccucuuuuggaagacuaggagauaguaacaagugggggcaaauguuuacuggacgcuugcuucuucaguuuauuaauaacaacagaagcuuuuccugcccuggccccccaccccacuaccagaaugcguaggguuuuaaauguggucuuacuagccagugacguaggccuuacagguagagugaagugagcugacggaguaccuuucuguuuuucugacuugggagcaguugagugcuagaaauccuuuacugaaguguuuugcauaaagacuucugugucucucuggaaacuuuaguguucaucuccauuauaguuuaguuuucacugacccuugaagcugugcaguucuucuuaucuggacccuuccaucauuucacaggcucuggaagagccaggaagugaccuggccccuaugugcgcacucacccaccuauggcaagguguggauuauuuuguuagugauugaucauguggauugcuuugauagugacuugauugcacagcacagucagaucgauuggucgucaggguagccugcugaacuuugggauggaguuuguuaugcuuugcagucauuuuccaccacuaugugggcaucugaggcaggcacgccuacuugcagggcagugaccuuuauaccuguuugcaaggcaugucgggaggagccgagugcuggggaauguuucuggccgcacugagagggauggacaggggagcaggcacagaggugauuggaugcuugcaggcuggcugcaagcugagcugggcgggacccgugcaggaaggggguauuguugaguuugguucaaaccaagcuuaguuccccauuacugaagucucaagggaauguggaaggaauguggcuuuucugcauucagacgccccucuguuguagauuacagcggagugcacagggcccgaggaucccuguuugcagaaaagaagcaugcuuuggacuuugagaugguguuacacccucaguuccaaaaucaagaaaagauacagcaugggaaggcuugauagcuuccagaggcaggccugauuuuuuuuuuuuuuuuuuuuuuaacucucggauuugaggugagugaggaagaaguuuugccuaggaaggauuguagcaguccuaggaaggauuguuugggagggccuguggugucuguagggcuucuggacucugcuguuugcuuauguacaagguaccgcugcccuguuuucguuaugcugugggcuguugggcacaagagaagaaauguaaaguugcugacacugcacaacugagacauggugguuuuagcuaaauuuccaugacuuucagauucaugaucccuuuuuuccuauuuucaguuuuucacagccuacucauauuuaaucagaguugugauuuauuuagcuauuaaccuugguuauaaauauuugaguaaaggagaaaaaaaaucauaagauguuauaguuaauaugaaccaagaaagauccuuaguuugugguucuaacacucaaguacuucauauucuuaacaagaagauaaagagaacaaccuacuuugauacuggaaucuugugcuugcagugucaguugaguagaaguugcugggacguuaauuucaucucacuguaaguggcuauuuaaaaaccuagugugcugccucaguggcuguuaaguguagaauagaaggaugcccugugcccauuagcccaggacguuguaacugcuggcuguggggccagcuucagagucaggauagcaaacacuguuuucagcauugaacauuuaaacacaagcuauuccuuaguggucugggacagauagucucacuuuugaaucguggcuuaacguuagggaacuuggcuggggaggaauuucaagcagaguuaucuuuucagugcacaacauaaacuuggcacugugugacuaagugcuuguggcuggagggauuuuuugauuuuuuuuucccccaauuuccuacuuguucaauauaguuagaauuugugagauuucuuauuuuggccuuaaaaggaucuuuuaggaagcaaauggauguugcuaaguagcuucuucuauguuuuuuucacaguugcccugagaaagauguuacugaaauaucacaugcauccggagccaaugggaguagggagccuguccucugagccaaugggaauagggagccuguccucugagccaaugggaauagggagcccguccucugagccaauaggaauagggagcccauccucagagccaauaggaauagggagccuguccucagcucuuggcccugguuuuuuaccuuuguggcugcugagacucuuguucaggaccagacgccuuuugugacaaacucuaaggggcaucauucguuccgagguuugggcacuuuccuggaagcaaauggguucuuggauaggcuucagauuaaaaauaucuuuuggaaguacagagauccagugcuuucccucuguggagcuucacuugaaaauuucuguagcaggguaguuacguagcuuucccccaccuuuuuccuguguacaacuuucaggcagucagugaguggaaaauuaucuuugccaugcuuugaagcccuuugugagccccgccgcuguguguguugucauaggcccgggaucuugaauuaaagcgaggcuguugaaccaccuccauuuuggugagaaacuccccugcaguuguccuuagcagcuucccuagcaguaacuaauucuugacagguaugaauuaucuguuugcucacucugacaguugguuuggacugcgaggaaggagaagcagaaagaugguuuggcugugcuauucuuagcucuguuuccucuaucaacuguugccucugauucaagcuuccagagucacaagacaggagguggcacugugguagcagugaccaaaggauugcauucuuaguuaggauuucugcccuguauguccgauguuuacaaauuaauuggcuuguacugccaggguuuugcucgaaggcuggugguaggcauacuuuguagugcucuguuaaaauggaagguuuaauuuaucaugaccugauguucugucugguaagugcuuagcauuagugaauaaauaguaucaaauauuaacaugggaugugaauuuuauugucugaaggggggggggacggggacggacgacacacgacccguaccaguuguacauguuuuaaagaauuauccugagaccauuuaacuugauuaggaaauaguuugaacuuacuaagaaaaccguaguagagcuguaagaggaaacgaccaaguguagauuuuccuuuuccuugaaucguagaucuugcuguaugacccaggcucacugcagguucuuuucuuuucuuuucuuuucuuuucuuuucuuuucuuuucuuuuuuuuuguuuuuuuuuuuuuuuuuguuuuuuuuuuuugagacaggguuucucuguguuguccuggcuguccuggaacucacucuguagaccaggcuggccucaaacucagaaauccgccugccucugccucccaagugcugggauuaaaggcgagcgccacaacucuuucuguuucuaugagucuguuaggugguugguucugucccacaugacuucguuuugggugauuuacuaaaacuggaauaaagaguccuagaggaaucucccucauaacuggacccuuggugcuuauccuuguaaaaucuugguggugucaguuaguagccaaaaaagguccuccccuccacaucccuccccugagauuggcacguuguuaucuuugucucauuaaggaaauuuaucaggccaaacuggaugcaagaaagauaaggaaauagucucugucugcagaugguagaguuguguacaugaucaucaugggagggguuggugggugguagccaucuuuacauuuuuacacaggugcuggggauuacagucagaguaggaagcucucuccugcagcuucauaucccaggccuuuauuuuuuggcauugcuguguggcccagaauuaucucuagucuuaacauauauuugggaaaaaucuuuaacauuaauuguuguuucugcuaaaggggcuacuggcuucaaaugcuuggaacagaaaauuuaugaaaauuggacugaagguguacccuagugguagaguguuuauuaucuaccauauucaaguccaggguucaauuuucaguacugaaaacauuuuaaaauuguuuuuaucaguagaaauggagaaccaaucucugcuuuuauuuucuuggaagaaauguguuuguauuagccaaggcucuguauguuucuaagaagcagucucaguaacugcugaagaaugagaucagaauguugagaaucaaggaugacaagauguuuugguuagagcaacaguguggaagaggaccaugauuggagaagggacagacucuggguggaagguagaaacuuuacuuucagcaauuuucuaguagaaauaaaaaagagauggagaaggcauuuguaucuuucagucuggagcucaaagaaaugaagaagguggauggagacugacucaugugcuugaaaccaucaaauuguucaagaucaucaagggacugagccuaaggcucugucggaggagggagaagccacugaaacagggugagcuaauucucacaccauggugaugugugggaugagaacuagcucagugccauacaaagaaacucaccagcaaagugaaaguaacuuggcaaggcaagcucuuuuuguaaaaaggauuugccagagggguuggagagauagaccagugguuuagagcccuggcuccucucccagaggauucagauuugguucccaucaucuauauggcagcuccauauaagguaacuccagccccagcagauccaaugcucccucuguccucuguaggcaccaggugcccauguggugcacauauguauauacagguaaaaagacucauacacagaaaacaaaaguaaacaagucucuaaaugagugggggaaagguguguguaugugaguagagacuaggaacagagauagccuuuguguuucaucccuaacugagguagugacugugucucaucucauugaucagaguuugaccucacagucugaugugauuggcucuucagcagguaggagaaggggaagaaggaucagggaguaacgaguccuuuuuggguucacugccuugaugggaaaaaaaaaaaaaaaacacuuucuuuacaauggucagagggaguguuuugaggaaaaguuaaauagacuggaaaaggagguauagucaccuggguuggguccugcucaggaguuccgugcuguagaugaguaugugaguugaggugguguuaaaucucagucuuuggugcagaggagagggcccaacauuuaagcucguuuuuuugcuauugcaggggacccaggacucacaugguggcucguaaccaucuguuacucuaacauccaauucugaccuguaggcgccagucaucuacaagaugcauagacacauguaggcaaaacacuuauacacauaaaauaaaacugaaaacaagaauuuaaacaaucugccuucauuugccuccagcgugcugggauuaaagacauagagaccacaucuauauaucucuuaaagaaaaauaagcaacuaacucauuauucugguucuacugcugaaagagaauggguguaugauauuucaaugaccuggaauauaacauuucuuccagauuucauuuauuaggcucuuaauuucuagaaacaguuauaaguuuauuauuucuaauuuguuagagcuggaagauuccccuaacuucaguaaaucgucuuguuuaacagacaaaaccuguuugugacaucugaccaugucuggugcauuucacuauuucuguucauggugagcucaguuucuuguuuguuuuuuggggggcgggguuugagacaggguuucucuguguagcccuggcuguccuggaacucacucuguagaccaggcuggccucgaacucagaaaucugccugccucugccucccgagugcugugauuaaaggcgugcgccaccaugcccagcucgugagcucaguuucuuaaacaagucauacugcuuuuuacuaacaugcauuugggaaauccucuagagcugucuuagcaaaaggaugaggugaaguuuagaucuucuguagaacaucaugauuugacaaacagaguuugaaauugguggucaagucauuauggauagcauaggcuaguuuuaauuaguuuacucuguagcucaggcuggccucaaacucuaaauucucuagucacagccuccccuacugcugggguuacaggcauauaucaccacaucuagcuccuuaaaguuagucauuugguuguuuuggaugcugggagaaguuaaguauaguuuucauuuuacucaacuugugcuacaagaaauacgaucuuuugaaagugccuaaauucuuccuuaauuuugaaaaucucaugccagaugagagcaggcucuucaguuguaaauucuaccuuugauggccaccuuagcugcaggaaugaaguguuuucuuagaucagcugaccgugagggacuuggcuuccugucaagacuuguguuuggguaaguucuuugaucaguaucaguaaaaugcucuuuggcacugaagagcuggcucagcaguaaagaacagguuaaaaguaggcauugcucuuccaaaggaccagaguucaagucucagcaccaacucauaaccaccuguaacuccaguuccaggccgucugacuucugcuuccaaggcaccuauauacauaugacuuacacaacacaacacauacacacaaaauuaaaaucuuucuuuaaaaagugcuacuuucaggcuggagagauggcucagcgguuaagagcacugucuguacuucuagagguccugaguuuaauucccagcaaccacauggugguucacaaccaucuguaaugggauucgaugcccucuuccagugugucugaagauagcgacaguguacuuacauacauaaaauaaauaaaucuuuuaaaaagcugcuacuuucucaaaauauuagacaccuacuguuuccaggaaggaaaauuaaacagacaaacuguauauucuucugugguauugcuuuacugaaggauucuucacagagcccuugggagaggagacuggcccgcaacacuacacuguggagccgacugcuggcccccucgugcaaauccucaaguguauuacacggcagcuccaucuuguuuguuaggauacggcaaggcagagacuguuucuugccagcuuggaagucuuugaaggauuggcuuacuacugucuuuauuuaauaaagacaggucaagauaguugagaaucauaguuuauuucggagugaaacccuucaggggucuuaauuuuguuuuguuuuugcagacagagucuuaggagccaagucuggccuugaaugccuggcacucuuacacccacuccaccuguacccccucacucccacccccaugcugugagugcuacacacccagcucagguuuuuuuuuuuuuuuuuaaagaguucuuuuuauuuauaugaguacauuguagcuaucuucagacacaccagcagagggcaucagaucccauuacagaugguugugagccaccaugugguugcugggaauugaacucagaaccucuggaagagcagucagugcucuuaaccacugaucaaucucucuagccccagacaucaguuuuaagaaagaaaucaaagccugguauaguggugcaugucuuuaauuucaggagaggaaggugaaucccugcguucuagaacagccugggcuauacagagaccuccuuccucccaaacccaccaccagcaccaaaaccaagcccuuugccuuugauacauucuuuagcaccuucaucuuucuaugaaugaguaggcuagagucuguagagacauggcucagcuuucucccuagagugacuguuacucugggaauacauucuuagguuauuaaaugguuccuuuuuguccugaguuguuugguaggacccugccuugcugagggaagucucuuuaguucauaucauuuauuguugaggguuaggagacuuggaggggagucuuuaccuuguguguccuuggagaacugaagagccuauauccuaaaggcccuaaaggauauaggcuuuggguuugaauuguaauucccaguaacaaaagacaugacaauguuuccuuacucuuuccuuuuuuucuuucauaaaguuuuuuuuuuuuaaacauguaugugaauguuuugcuugcauauauauguguguguugugcucuuggaggucagaaaaaugcauuggagucccugaagcuaggguuacagcuaguugugaagcuacuaugugggugcuuggaacucccuggucucuuuugaaagcgcagcaaauguccuuaacuauugagcuaacucucuagcccaggcaugcuaguguuuaaagaugaggaggcucaggucugagagggugucuuccagggcucuuguaagaccccaugggacuguaccaucaugccuguuuuuagucugaaacauuuuauaacacaaacucuuagaacaaguauuguuauaucaaaaauauacauuuagcuggguguggcgauguaggccugaaacccagcauuugggagccagagacaugcaaauugaguuugaggccagccuagucuagaaaacaaauuucaggccagcucgugggacccaucucaaagcaaagcaaagcaaaaccccaaaacaaaacaaugaaaauacagauuuguaaguacaaugugugugggguauggggggagcuauaaaauuucuauuauugacaggauuaaucauaggcugacaauaaauaaagccucuggugauggaaugcagggugggucaggaccuucugugauguuauggugcacccuguauuucccacacccuggaggcagguucaggaaagacugugagauuguugaggaccuaggucacauagugagauccugucucaaaacacacaccaauaccaauacaaacaaaacccagaccugucuuucaagacugugucaccauagaaacgcuugccuugucuaccagagaugucugcaucacuuguagccagcagauaacugggaagcuaaaaaccaaaaaauaaaaauaaauaaagcauaggcauuaagcccagcauucaggaggcaggcagauuucugugauuuugaggccauccagguguaccaagugaguuccaggacagccagggcugcacacagaaucccugucugaaaacuacaccaaaccacaccaccgucaccacuaccaccaccaccaaaccaaaccaaaucaaaccaaacccccacccccaaacuagguaaugauugaguucccccuugagacucccagcuuuaauuagcuuaguuuucuuuugagaugagaggucuugcuguguugccccuguuggccucaaguugucagauucagagcucagcuuccugaguagcuggagcuauguagguuuguaccauuguguucaacugcaguucuuaaaaucugauuuuauuuauaauaauuauuuucuauaaauauguguauggaugguuugcuugggugcaugucugguauccaagagggcuagcagagggcaucacauucuuggcacuggaguuacagauggugaugaacaucauguggguacugggacuugaaccugaagccucuaggggaguacaaggguucuaaccacugugccuauuuuuuuuuaaguuuauguuuuauuucauguauauguguguaagccacuuaugugcagguacccacaaaagccagaaaaggguguuagguccccaauaacugcaguuacaggugguugugagccaccuaauaugggugcuagggagaaaacucaagucauaugggagaguggcacucuuauuuacugggccauuuuuuuuaagguacccccucccguuuuuaaaaucagcacauuuuacacaaauguagacacuugcuuuuuuugcaaaugaaauaugacagaaguuuaaaaacuguuuuauuuaaaauaaauguguggacgugugcauaccgcagcacguguguggcggucagaggaccgcuuuguagaaucagcucucuucagacugaccucaucaagcugaaaggcacuuaacuucuccugugacaucgugcuagcccuggguguuuuaaaagauguauguauguauguauguauguauguauguauguauguauguauauauguaucuuauauauuuggguguuuuguuuggauaccagaagagggcaucggacuccuuauagacaguuaugaauuccauauaagugcugggaguugaacucaugaccuccggaagagcagccagugcucuuauaaccauugaaccaucucuccagcaucccugggauuuuuaaaaugucuguauuuuuuguauaugguguuguaucucuuuuuucucuuuccacccauccacccauccacccuccuuucuuugagauagagucucacuguguaacccaggcugacuuugaacagggacaaacccucagugugccugccaccaugccgugucugaguguuuuuuuuuuaaggguuauuuacuauguauacaguguucugccuacaugugcaccuacacaccagaagaauguaccagaucucaucauagaugguuaugagguaccauguaguugcugggaauugaacuuaggaucucuggaagagcagcguguguguguguguguguguguguguguguguguguguguguuagagguaaacagauuauaggcuguucaggauuagaggggcucagguguggggcaggaugaucuugauucaggcuugguugugggggggguggggguggggggugggggcagaagcugaggugugcucugggagggacuugauuacaugaguaauuaauuucaggagccuucaguuuaguugaugcugugugcuggccgguuuugugugagcuggacacacaaacuagaguugucugaaaagagagaacuucaauugagaaaaugccuccauaagaucugacuguaaggcauuuucuuaauuaaugguugaugggggagggcccagcuuauugagugugguaccaucccuaggcuggugguccuggguuguaaaagaaagcaggcugaggggccgggcgugguggcacacgccuuuaaucccagcacuugggaggcagaggcaggcggauuucugaguucaaggccagccuggucuacagagcgggucccaggacagccagggcuacacagagaaaccuugucucaaaaaacaaacaaacaaacaaaaaagaaaacaggcugagagcuggagagauggcucagcaguuaagagcacuaauugcucuucuggagguccugaguucaaauccuagcaacuacaugguggcucacaaccaucuguaaugagaucugaugcccucuucuggugugucugaagacagcuauaguguacuuacauaugauaaauaaauacaucuuuaaaaaaaaaaagagagggaaagaaagcaggcugagcaaaccaguaagcagcaccccucuguggccucugcaucagcuucugccuccagguuccuagccuauguaaguucuugucuuggguuccuucaaugauagacuacaauguggaaguguaagccaaauaaacccuuucccccucagcuugccuuuggccacgguguuucauuacagcaauagaagcuaaccaggauaugcuguuuggcucacagugauuugggauuauuauggaaaauguggugucugggucaguuuugggaucuguucuccugacaguuuguggaguugcuuuugccucuuuacucucugugggcguggcugugcccuauaacauuccacggcuuucucgccuucuaggguaaaccucuggugggguaaucgggguaagauaugauuagggcuaccaagccuguaauaaagaugacugcacucguguuauuaacauugguuauggcaagacaauugucaauggugaugauuaaagcucucaguauuauuugauuuuuauugaagacacuccaaaugauguaaugagcuuuuaaagaaaaccaugacugguccuuuuauauuacuaacagugaaguuagggaccacagcucaguguagggaggagagccaggagcauguugguuggagcuauacaaaccacuguuggugugaguccuugcuggcucugugaugcuccgcagagugaugguuuuggcaucugugaggagggugguaacauggaugucuguggaggacuucuugggcuaacugacgucuacguggaguugguacaauaacguuugugaauuuaccccauggcaaaagagaaggagggauuagccuaccagcucuucacaaucccaucuguggggcaaguagaacugugccacgggacagaagaacuagguugauucaaaaaaaccugcugguaaaucuuaauaauugagaaugguaggcauuagaaucagcuccugcccugacuaccugucuuggaauaugugacacaacaucccacuaagaggaccaugacaaccugcuauguugcuuaacaacuuagcgagcucuaugcuaaugagguaucuagauaggaccugaguguuuauccaaugagcuuccuuuccuggguaucccuuucugcaaaagguauuuaaguucuaagacaagcacucuuaaccgccaugaauaaaauaguuuggacaagcaaugacugucuucuucaucaaggauugcugaagguggaggccuuugucagagagccgugccuggaucucccuuagaagaugucucuucuagguccacuguacuuugacacucacuuggagcuaaaccagauuuugccucaugccagguuaaggucaucacagccacagauucccauucccaacugcucgcuggcaguccccggcagcauuugggcacacaggaguuugagaaccacaacaucaauguuuuucgcccagaaggccauggauagggagggaccccuuuccuagacugcacucugcuuucccugagcgacauucuggcaguacuccaguucccagcagcaaggcagacaugcagccuguugccccccaaccccagguuugccucccaugagugacaaaucaagugacaaaugucuuagagauauguccagagacauagauugucuuaaauuucuuuguagacuaucgguuaugcacaggaaauauaagaaacuguacuuuauauauccagauacauagauuuuugaauccucaaaaugcaccuaguugugaaauuauccugagagaucauaaagaaaucuagacaaaagauaagaguggggguucagaagagcauaucuggaagcugucuguagaacagacaccagucuuauuaguuagggaaugccagcuauaggggaacuuucugucuuaccagcuugcagaagaaugaauacgauugagaauguggugcuggcaggaguguagggagaggaugcucacacagccagcacaugcugcggacggcuggcaggggcuccauuuggcaguauagguuauauaucugcuaacuaaaauacuuggggccagaaguauaucauauauauauauauauauauauuaauuugggaauauuuaugugaaauuuuuucaguuuucuuaaucugaaaacuccaaaaccuaagucuuuguggggugaucucaauaguuaaaaaagcuucagauuucagaauuuuaaagauguuuggacaagggcagaaagcagccauauucuuugcgaaaauauucugagaguggacagcugcuaauacucuucccuucugaaaccuccugagcuucacccaccuggacguuagcacagucuuucaaguucccaccaggauggcccauuugggccccuuaaagcauuuaacuacuagucccaaagucuuugauguucugccaacaagcagcaacaucaggccuguuacagcaauacuccagcccaggguaccaacuucagucuuucuuucccucuugagacaagguuucucugaguggcccuuggcuguucuggagcuucuccuguagaccaccaggaugaccuugaauuuacagagaucccccugcaucugcuuucugagugcuggaauuaaagaugugcacuacugccaccacccaucacugacuuccgucuuaauuacuauuuuguugcugugaagagacacuauaaccaaggcacccuauagaagaaagcauuuacguggggauuacaguuucggaugguuaguccauaucauggcagagagugugguggcaaacgggcagauacagugcuggagaaguagcugaaagcuuuacauccugaaccacaggcagcaggcacacacacacacacacacacacacacacacgcacgcacacacacgcacacacacacacacgcgcacacacacacacacacacacacacagggcuuggaguggguuuuaggaaucucaccccccuccuucccucaugacacaccuccuccacuaccuccuaauccuucucaaacaguuccacugacuggggaccaagcauuuaaacauauaagccuaugggagagccauucucauucaagccaccaugcucaaugucuuaguuaggguuucauuucugugaagagacaucaugaccaaggcagacaacccuuauaaaggucaacauuuaacugggucuggcuuauaggguuagagguuuauggugggaaucauggcagugccuaggcagacauggugcugaagaaggaguugagaguucaacaucuugauccaaagguaaccaggaagagacugucuucaggcagccaggaguagggucucaaagcccccagugcccagugacacaacuuucuccaacaaagccacaucuccuaauugugccacucccuggccaagcauuuucaaaccacagcacucaucacauuuuaauuuuuuaaauuaaaaauauguuaugugcgugaguguuuugccugcauguuuguguguacccuaugcauaauggugcgcacugaguucagaagaggugucgggucccuuaacuuuggagcacagaugcuugugaaccaccaugcgggugcugggagccaaacccaggucuuuaagagcaguguucucuuaaccgccgagccauuucuugagcccgcuuaccucagcuuuucagcuauuguuuagacaauccagaaaggcugcugacaaaucugccguguuagugaauucugggcccuaugacaucaggcccauugguucuccuugugucuugagagaauuuucaucugugaagauugagcuauuugaggucauguuaauagguaaaaguuacucaaaauucuaguuuuacuuaaagcuaaaauucaaucauuuggaaauaaauauuagagaaaaaaaucauuuuguaagugauauguucaccugcuucuguucaugaguccgucuggcacacauucaagcauaacuagccacagggcuccugacaugucuucagguaaacacaguguuuccugaggagagccugacccagcccugaugguguaugacugugaucccagcacucggaaugggaguuguaggccagcucugggccguacggugaugcccuggcucacaaagaaagaaacguucacccgugcuucaggcagccgcccagccuccguguagucuagaaagccucagcagggcugagugcucccucuguaccuauguguuucaguucauagacgucuaagugacgugugcgcaagaacugagacagagagaugaagacagucauuucacaacuuugauguuaaggacguuaggcuacaaaaugcuccuaacuuucccugcaggugccagugaggcagguguacagggacaggcgagagccgcugcuuugcuuccugcuucuggccagcagcauggcaacacagaugucagcacagugaaaggggcggagugacauccgagccauggcauaaugauagucuugacuccucgcgcccucaggggugcacagccugcacuuugggaauuacagcuccacgcuaauguguacuuugacaguacuuggaucagguguucuuugugaauguguauuuacaccauagcagcagauggcaaaagcaagcaagaauuuuuauacaacugccugguaggggauuucauacaaaaaacagaugugaaggacagaaauguaaaacacuaaacuaaagaggaaaaaaaucuaaauucauagaaauauuuagauuaauuaagaagaaccuagaaacaagagugagggcuggagccagggcucagcggcucaucggagaacuuagugcugcugcagaagacccaagucuggauuccuuucacccguggguguggcagcucacagcugucuaucaugccaguucuaggagaucucaagccuuccucuaacccccuuggggccacagacucacacaugguguacauauguagguaaauccaaacaacaacaacaacaaacaaaaacccaaaacacaucacguugugguaguuugaaugaaauggcuuccauaagcucauuugaaugguuagucaccugggagugggacuguuugggaaggacuagggguguggccuuguuggaggagcuguaucacuggguugggcuuugaacuuacaaaggcucagcucauccccaguuagccgccucuggucuccaccuauggaucagguauaaggucucagcuacugcuccagcgccuugccuuccugcugccauguucuucaccaugauaauaauggacuagcccucugaaacuguaaacgaacuuccaauuaagugcuuucuucuuguauaaguugccuugucauggugucucuucacugcaauagauuaguaacuaagacagacauaaaaauaaauauucaaaaagccaaaaaaaaaaagaaaguguaaaugaggaaaauagaguaggcuugugauuugggcacucagucaggcuuggaguugagcagaaagugcaggccuagggagacggacgcugcuugcaugcccacccacaggaccucuguuaggcuagugaggcucucgggcaugguuuguuuugacaguuucagugauuggaagcugaagauuaugguguugcuuuagucacaaagauaaaguaaggcgcaaccucugaugucucucagcauuucuaguccugcagagcuguccacuaagcugcgaagaugaccaguguugccccugcccagaaccacagcagugguauucuugcauuucuucaaguucuuugugcuggaugucuuuaccuucaugggaugcuagguagcugcccauugaacacccucccccuccccgucucccucucguucucuguccuccuucccccuuuccuucucccuucucucucccuccuccuccucuucccucucccuuccccucucucucuuggucucucuauguagcuuuggcuguccugcuuagccuaagcuuucuuucucacauaguucuauuagauauaagucuuagcagauuuuaagugauuuguucaguggccauaaaaaugguacuuuugcaguaaaaagccuguaagcagguguuccgggacaagguaaagggcccauuucuuauaauauuugcacuaacuuuagcaugaauugacaguuccugccucagaauaccaaaaugccaugucauggcuagcacugcaguggugacugugguucucugucucugaugcccccaaccuguguuaguuuguuucacuugaguccaugcuuuuaacuuuacuaucacuauuuauuuagguaaagauuuuguuuguuuaaagauuauuuugggcuggaaagauggcucagcgguuaagagcacucacugacugcucuuccagaggcccccaguucaauucccagcaaccacaugguggcucacaaccaucuguaaugggauucgaugcccucuucuggugugucugaagacagcuacaguguacucauauacaauaaacucuuuaaaaaguggggcgggugggggagggucucacucuguagcccagguuggucuguaauucacgauguagcccaagcugauauccaacuuccagugaccccccuccaccuccuccaccccugccucagccuccagaguacuucacugaagugcagguuuuguuuuuuaagauuuauuuagcuacuccacuuugugcuccuggugggauuagccaaaggcuuaucuuacaugccuuguuggcucucucucucucucuccugcagcucuaaagcucauugucuccucuccuccaccuccucucuguccuagcccuugcaaaucuaaaggucccaccccaucuucuuuugcccggccauugguaucuuuauugcuugaucaaaaaccaguuggggacaagguuaaaaugucucguuauauuguguguuugauguaugugagugugggacgugcaugaugcaugagcgugcaagagccagaggccaguguuuaggagcccacccguccucucuuucaacugugcuucugggggucagccuggugucuggcuggacgcuucuaccagagggcucguuuugaugccucugccuuauguuuaagacagggaugcugugugacccuggaggucaccagguuaaucaggcaguacgcuccaccugcucccaccaggacggguaagagauuggaguuaaagaccacugcacccagccagcuuuuccaugggugcuggagaucuaaacucagguauauccauucagcugucuccccaaacccuuagaaaucugagccccauuuuuuuuuaaagauuuauuuauuugauuaauuaauuaauuuauuuuauguaaguacacuguagcugucuucagacacuccagaagagggagucagaucucguuacggaugguugugagccaccaugugguugcugggauuugaacucuggaccuucggaagagcagucgggugcucuuacccacugagccaucucaccagccccugagccccauuuuaaagguauuuuuuuuuuucauuuuauuacuguuuccauuuuucuuuuuauugagacaaccuccccaguguugggauuaaagauguguaccaccacuccagauguuuuuccuuuuuaagaaagauuauuuuuacuuuagcgucugaguguuuuugccaucauguauguuugugaaccgugugugugcaugcaguggcugagggagccagaagugggcaucagauccucuggaacuggaguuacaguuacgacgagcugccauagagugauaagaacccaaccuggcccugagcuagaaguuuucuuaauuacugagccaucgcuugaguguuggcucuugccuuucaucuuguguccauguuguaugacacuguuccacaaacuagcuggccugugagcuuacacccauuuccauauuccaucacauuguaggagugccaggcuuacagauacggacuguguccagcuuuacacagaggcucucugucugacugaggucguuauguuuucacguuagaugcucccccaguguuuauuuuacuuguuuaugucugucuguguauacauaugugggugcuggggccugcugaggccagaagacugcacuggauguccugggacaggaguuacaggugauuguaagcaccugacaggggugccacuguagccugaguuuucuuucuuucccucuugacaggguuucucuguuauguagcccuagcuguccuggaacuccacaggucaaccaugcugcccuugaacccacaguugaacccauuguuucugcuucuaaaguacugggauuagagaugugugugaaaugccuacucuauuuucuuuucuuucuuuauuuuuugagacaggguuucucuguguaucccuggcuauccuggaacucacucuguauguagaccaggcugggcucgaacucagaaauccgccugccucugcuucccagugcugggauuaaagugugcaccacaugccugacuuuuuuuuuuaaaagauuuauuuauuuuaugcauaugaguacacuguagcuguauucagacacaucagaagagggcguuggaucucauuacagaugguuaugagccacaaugugguggcugggauuugaaaucaggaccguuggaagaguagucagugcucuuaaccgcugagccaucuuuccagccccaacuuuuuuuuuuagugguauuuucaaacuuauuuuuuugggugcugagucugguauuuaaugcuuaaauuaguaguuuuaaagacaaacuugugcuuuuuuuuucucccagaaagaacuauaaacugaaaaauaauaaaauuugacuuuauaagccuaaaugaagccauaauuguaaggaaaacaugugagucuugaaguaucagcagguaacugcuuuguguaugugugugauguaugugaaugcccagcugcucauguggaggucagaggacaacuuagugaugcagggucucuccuccucuccaugguuucugagggaagaacucaacucaagucuccaggcucgcauggugagggccuuugcccacccccucaccuuuauuuucaaaauaauguaaauaacaaccuuuuaaccagugaaauaguaacguguuuaguucuagacagaagaccaaaauguucgcucagugcauaucagccugaccauuucugaauuuauggacuugccuagcaguuuuaaaauaaaauauguaauuaaauguaauuagaaaccucacaauggagucauagguaguaauuuagugcuguagucuguccaagauuaguuguaugucuuuaauauuaaacauugaauccauuuuaaacucauaacacuuuacaagcuguuuuuaaauuauucauucauuauuguguauugggugcgugugccauggugcgcgugugaggucagaaggcagcuagcuucauggagcugcccccuccuuccaccuuuccuuguguucuggaguuugaacucagguugccaggguuguguuguaaauguucuuaccaugggucauaucaccagcagcuauaaacuauuuacauacacagaacccaaaacaagacagacgaggaugaauguagguucagcugauagauuuuauauugacccucuuuaccgcauuuguauuuucuguauuuguaucagucuguuuuuaaaacaguuuacuuaagguguaugaguguuuugucuguaugcuugucuguguauuauaugcaucaagugcccauggagggacuggaguuacagucaguuugugagcuaccgugaggguucucuggaggugcagccaguucuuuuaacagcugagucauccuccagucccagagguuuuuuagguuguuuuuuuuuuuuuuuuuguuuuuguuuuuguuuuuuuuuguuuuguuuuguuuuguuuuguuuuugagacagggucucucuauuuagcccuguuuagccauauagacuaggcugaccuugaacucccaaagaucugccugccucugcugggacuaaugcccaagugugccaccaugccaccaugccuagcuuuaaguuuaauuuuaugauagccuacguaacaaugcauuucacaaaugauuuaaacacaguucuuguugccugguuuuauaguaaauuuuaauuugguuuaccuacuugucuuagcuacuuugcugugauaaaacauuaugaccaaggcaaccuauacaagaaaguguuuaauuugaggcucauaguuugagagucuaugaugauggaacaaggggaugguggcaggaagagccacaucuugauccaccagcagggggcagaccugaguaucuugaaaucucaaaggccagugacacaccuuccaucaaggccauaccuaauccuucccaaauaguuccaccaacuggggaccaaguauucaaauauauaagccuauggagccauucucauccaaacuaccacacauacauacauucucacucuggauucauucagagacuauuaugggaauuuugguaaaauaacaucaaaauaccuaaacuuaguaccugaacucgucaguuaaauuugaauugcuaaaacuucuuaaaauauggagugcuuucuuaucaucaauacacagccaacugguaaggaguggcuugaagaguugaauuuccuuaaaauaauuuauuuauuuauuguuuguuuguuuguuuguuugguugguugguuuuucgagacaggguuucucuguauagcucuggcuguccuggaacucacucuguagaccaggcuggccucgaacucagaaaucugccugccucugccucccaagugcugugauuaaaggcgugugccaccacgccuggcaaaauaauuuauuuuuauuuuauguauagugguguuaaguacguugccugcacuucugucuaugugagcacuggaucccguggaacuggagucacagaugggguugugagcugccacaugggugcugggaauugaaccaggguucucuggaauaaaaccagugcucuuaaccaucaagcuacucuccugcuucaaagggauugaauuuuaaagugacugacugguauuugcaguaugacccugauacuuauuugcaguuucaugcuuccccucccccacccccaugguuuuauauuuauuuaugagacauugccucaguguguagcccuaguuguccuaggacucccuguguagaccaggucagccuugaccucacagagacuugcuugccugggguuaaagcugugcacugccgugccuggcuccuuuccuuucagguuaucuggguuuguuuguuuguuuuuguuuuuguuuuguuuuguuuuucgagacaggguuucuuuguauagcccuggcuguccuggaacucacuuuguagaccaggcuggccucgaacucagaaauccgccugccucugccucccgagugcugggauuaaaggugugagccaccacacccggccagguuaucuguucauccagccacuggugauuauguccagguaccagggagagaggaaaacuugaccuuaaaacuuugaaagagagacauuuuacuaaguaauuuuauccaauuaggaaggcagauuucugugacagagaagaacacugacauaucuguaggcauugucauaacuggugguaacuuuaaauaguuccacugggcuuuucugacugauuagauaauuugcagcuuauggaaaagaagggagcuuccuuccuggguuccacagacugauuagaaucauuagaauuugaagauguaaaaaaaaaaaaaaaaaaaaaaaaaaaaaaaaaaaaagggggcuggugagauggcucaguggguaagagcacccgacugcucuuccgaagguccagaguucaaaucccagcaaccacaugguggcucacaaccaucuguaacaagaucugacucccucuucuggaguguuugaagacagcuacaguguacuuacauauaauaaauaaauaaaucuuuaaaaaaaaaaaagaauuugaagauguguugauugccugcuguaaguaaaucaaaauuugccccauguuuuguucaguuuuguaacaacaucugaauucauaugcucuuggaauauauacugagacaguuuuuuccuuguaaaauucagcuaugaugauuuaaaagaaaguuucuuuauauuuaaaaaugacccaagaucuguaccuaaaagcauagguuaaaugacaauuccaaugauguuagucgcuacagaggagauuuagcaucgaaagcuugacucacagacuguauuuuuguuugauuuggauguauguuucacaugcguuuaugucugugcaccauguguauguauugcuuacaguggccagcagagggcgucgccuugccuggagcuggagucacagaugguugugaacuaucauguggguacugggaauugagcuuggguucucuauaagcaaccaguucucuccacugagccaucucgccagcuuucucugagacuguauucuuaaauuuaagauguguuugaguuuuacuuagcaguagacuccguuuuaagcaggugcaugugauacaaggguucuugggaaaaugauuuuaaacuuccacuuaggcaugauuucagcuccagaaaaguguuugaaaauacaaaugcccuguggcccacgacuggucaggagcaugcugguguccugcugugcugccccacacccccauagacagcaggguugauagcuuucauuuuggccucauuucuugcaagccagucauuuuaccaaguggccauuuaacacguucuuaaaaucguaucccuuuccaaaacacuuauuuuaccauuuuuacaagguguuaaggucuaaagcccagccuacuaaaguuuaauguccuguacagauuguuaauuacagauuuaguuuaugauccuuuuucuaauugggaagcuuuaaaaagaaagggcaaagggcacuuagcagugaggaaauggccauuuuaaacgcuugcugucuguuagaggagaagcuggagggagggcgggcaggcaggcagaugugccuggauuuccuccugaggacaaggucugugugaaggacggcuaggacagccuuggauuucggugcuagaagcccucucccaguucugggcauuugagccaaucauaucaguauuguaaaggacaccagacauuucuuuuugagaacugugcccuuauggaugugcugguuaaauuuuuuugcuugauuucaacuugacacacucuagggucaucugagaagagggaucuucaauugagaaaaugccucccucagauuggcuugugggucauuuccuuaauuaaugauugaugugggagguaccagcccacuguagugucaggcucccuguaaugguuuguauauucuuggaccagggaguggcaccauuuggagguguggccuuguuggaauaggugugaccugguuggauuagguguaucacugugggugugggcuuaagacucucaccccaguugccuggaagucagucuucaacuagcagccuuuggauaaagauguagaacucucagcucugccugugccaugccugccuggaugcugccaugcuccuaccuugaugauaauggacugaaccucugaaccuguaagccagccccaauuaaauguuguuuuuuguaagacuugccuuggucauggugucuguucacagcaguaaaacccuaacaaauacggugccauucugcaggugguccugagauguauaaauaggguuagaguuaggguuagagcaagcuaugagaaaccagcacacagcauuccuuuacugccucugcucagucccugccucuagguuccuguucuucucgaguucucgucuuggcuuccugucuugguggauugugauuuggaugaguaagacuccuucccaaguuguuuuccaccaguguuuuaucaggcauuagaaagcaaaccaagacagugagcuugaaggugugggcuucacuuguaaucacagugauuguccauguugcgagguuagcuugaugucauaagaagcaucauuuucaaaaucuucuuaguuugcauguguguguguggaguaugugccacaguaagugugggagucagagguaacuuuuaggagugggcuccccuccuuccaucuugcucuuuuagacuuucugcugggcuguguauuucagguuagcuguccuccaaaugcaugggugauuuuccugugucugccucccauauucauguugaaaugggaugcgcccacugccucaggagucugggugguucugggcuuucacagcaccauuuccaaggcccuguuugugugugugugugugcauguguguguguaugugugugcgcgugugugugugugcauguguaugcgugugugcaugugugcgcgugugugcaugugugcgugugugugcaugugugugugugcaugugugugugugcaugugugugugugugcgugugugugugugugugugugugugugugugugugcagagcagagagcaugcugagcaaguguuuaacuacugagcuuuaucuccaguucucgcucuacuuuuuauuuugagaaaaguucucauuaaguaauuaggugugaugaauuuguaauucucuugccucagccuuccaaggggauggcauuauaggcccccuuagccuccauuaaaauauuauuauauuuuauguuacuuuuuaaauuuuagauaagauuuuacuaccuguaccaggcuggccuggagcuggauucuucgccuggcucagccucuugaaugcacauagcacaccacaucuagcuaccauguuaccuuuuaaguugaauaguauguuccagacaugcugcaugccuuuaaucccagcagcagaagcugagacagagggagugccaacucaaggccagacugggcuacccagugagagccuaucucaaaguaggcuuauuaguacaauagguaacugguuuuggaugcaacauaggaccucaauaguaggaagauaauaaaaucuggugccuguauacauaaucaaucaaucaauauuuuuuaaaaaagaguuauuuauuuuuuauauaugaguacacuauuguucucuuuagacacaccagaagagggaaccagauaccauuacagauggcugugagccaccaugugguuggugggaauugaacucaggaccucuggaagagcaguuagugcuguuaaccacugagccaucucuccagcccagauaaauaaaucuuaaaaaaaaaaaaaaaaaaaaaaaaaaagaguccuugagugaaugguaauuuauuauagggauuuuucuuuuuuuuuuuuuuaaagauuuauuuauuauuauaucuaaguacacuguagcugucuuuagauacaccagaagagggcgucagaucucauuacggaugguugcgagccaucaugugguugcugggauuuaaacucaggaccuuaggaagagcagucgguacucuuaaccacugagccaucucuccagccccuauagggauuuuucauaacaaguauugaugaaauuuugaaguugauuuugagauguuuucuuagaacucuggcuguuuuugaguaucuuccauggccuaaguuggcauuggacuuguggucuuccugccucaguaucuuugaaugcugggauuaaaauguauuccuuuuaaacauuuuauuauauggagccuguguucucugcuggagauuguuuuuuguuuuuuguuuuuuguuuuuuguuuuuuuuuuuugagacacaguuucuuuguguagcuuuggcugccuugcuacucacucuguagaccaggcuagccucaaacucucagagaucugccugcuucugccuccugaaugcugggauuaaagggauguaccacuauucuggcuuccuuguuuuauuuaaacauaagagcucuuugguuugauaagacugaaaauuuccuacuuaguuguuuuugugucuaagcauuaauaauuauuugucugauuauacaaaagacuaagccuaggguuguaaaccaugugggcuggagcccuguacuuucaggaaacacuuuuuaaacucuggaagucagauuauugugauaauuuuaaaggccuuacaguuggauuuuauaggaauauuuuuucuuuaauuuuuuuucuucguuuuuauuuuaugugcauugguguuuugccuguauaugucuguguaagggugucagauccccuggaacaggaguuacaggcaggugugagcugccgugugggugcuggaaaaugaacccggguccucuggaaaagcagcaagugcucucaaccacugagccaucucucugguccuguauugaaguuaaugaggggcuggagagauggcucagccaucaagagcacuagcugcccuugcagaggacugacucaguucccagaacuacauuauggcucacagcuguucauaacaccagguccagaggguccaauguccucuucucaccccugaagggcaccaugcauacacguuguguacauacauaaagacaaaaugcucacacacauaaaaaauaaaaacaaauggggcuggagagauggcucagugguuaagagcacugaccgcucuucccgagguccugagugcaauucccagcaaccacaugguggcucauaaccaucuguaaugggaucugaugcccucuucuggugugucugaagagagcaaugguguacucauauacauagaauacauaaaaaaaaaaagaaauaaaaacaaauauuuaaaguuaauaagaagguaguaaaauuugguaaagaucaaugccaacuuucccacuuuaaaaagaacaaagaacaaaaaaaugacaccagagcuggagagaaggcucagcagguucccagcacugcugcuuuuauagaagccagggcuucgauugcuaacacccacacuguggcucacagucauccacaauuacaguuccagggcuccauugcccucuucugacuccagagggacacaagguacaugaacauguuuacaggcauauaugcaggcaaaacauucacacacauaaaauaacaacuuaaaagacaaaacaagggggcuggagagauggcucagcaauuaagagcacugacuguucuuccagagguccugaguucaaaucccagcaaccacaugguggcucacaacuaucuguaaugggaucugaugcccucuucugguguguuugaagucagcaacagugugcucacauacauaaaacaaauaaauaaauuaaaacaaaaacaaaacaaaacaaccaagaaauagaccuuggaccugucuggcagcucugagucagcagugucacuacaaaccugugcuggggcugccgcaguguggucuggaaagcugaucacagucauguggaaaaucuacugcucuaaaucagguuucucccuuccucccucucagacggcauguaccuccccaucccaaguacuggggaucacaggcauguaccccacaagaaagugcgggauugagucuaggacccaggcaagcacuguacugaacuacaaccccagccugguuuugucuuuaggcauauuuauuuuauguguaugagcauuuugcuugcauguguguaugugcaccacaugcauaccugaaaccugcagagcucagagcagggcuuccaaucuuccugagcugggauuauuggugauugugagccacuuaugggugcugggaacugcaagagcaaaagugucccuaaucacugagucggcuccugccauggacuuccguguuacaggcuucuaacuuggaguaguugucuaguccugcaucccugugcugccacgacaggcucacaccaccauacccggggauguuuuauaaugccuuuuauaaaucuuuuaguaucuaaguuugaugucagcuguucaacugaaaacacaugaacuacauauguagucuucuuaguacccacauaaagaaauaaaaaagaaauaaaugaaaauaagauuuuauauaacuuaauauaucuaaaacauuuuaacagucuaauaaaacauggaaaacauuuucuccucuuccucuucaucuucuuccuccuuucucuucuuccacuucuuccucuucuuucuccuccucuuccuccuccucaucugucuucuguucucuucuguuuuucuuuuuuuuucuucuuugguuuuucaagacaggguuucucuguguagcuuuggcugucuagaaacuggcucuguagacuaggcuggccucaaauucagaggucuaccugccucugcuucccaaguguuggggugagccaccacuguguucauuuuuaauucuucaaguucacuguguauuuuauacuucuauaacuguuuguuugugccaacuuuauuuguuaauacccacacagaagagauggccuuugaaauaacuuuaaaaauaugcugugugcugauugaaaaaaugauauguuguuuauuuuauuuuuuuauauuuuuuauuagauauuuuccucauuuacauuuccagugcuaucccaaaagucccccauacccuuccucccacuccccuacccacccacucccacuuuuuggcccugguguuccccuguacuggggcauauaaaguuugcauguccaaugggccucucuuuccagugauggucgacuaggcuaucuuuugauacauaugcagcuagagucaagagcugcgggguacugguuaguucauaauguuguucgaccuauaggguugcagaucccuuuagcuccuuggguacuuucucuagcuccuccacugggggcccauguuguuuauuuuuaauuuguguguggacaugcacauaugagaguccagcuuacaggacucucuucucuccuuucaccaccauagguucugauuuggcugcaagcaccuuuaucuauucagccaucucacuagcuccuguaguacuuguaaggugagcguuuacuacagaagacauaggaaugguugauguuuaaaauauuaaaugagaaauauguaugauguuuaaaggcuuaauaucagggguuggauauuuagcugugugguaagcguauuuguuuagcacgcaugaggccuuggguacuuucucuagcuccuccauuucauucauagcaugaggguuugggagggcuuuguaucugagcccuucuauuuucucugaucuacaaggaagcaguaugauuugcuguguuguauuggacuuuugaaggcgcuuguucauacaggcaacaaagcuuucaauaguguugguguucggcuaaucaucucugguuacuugaaauacuggcagugacuugucuaaagacacauuguuauaucuguagauagcuacagaaucuuugguugcuaagguaucaagggucaguaccauauucggugauugucuuguuuugguugcuugguuucauuuuugagacaggucucacuguggcugggcuggccaggaacuggcuuugagcuuugguuggccugaaccuugcaauccuuccuccuuagccucccaagugcuggaauuguagcugucuaucauauauauacuaauuauaaucacuuccuggaugaauuucuaaacuuauuuugguauguucacagugugggggagugucauugugcacugaagcuagcagagaaugacaggcguccuggucaguuacacucugcauuauuccuuugagacagguccugucacugauccuauaccugggcugguggccccaagccauagugucaccuugauuagcucccuauucugcgauuaugagggacuacagcuacacuuugcuuuuuacgugggugcuagaauuuuuacuuggguccucagcaaaugugacuacuuguaaccauaggcuuuuccaccugugucccaauuacugaaacaacuacucuaagacuuaauuauauaugaucucuuccucugacuggcucguuucuaagguuuaaaaucaugggcugauguuauaaugcuaguuagaacuguuggacccuuaacugucuucugugaguucauucuaauguucuauugcaguaguauauuucccucuuaacaauuagaagaguuuauuauaaauugcaaguaaguugaaaauuuccuguuauuauaauggccaggacuuucuaugguuccuguuuuaguuaaagcucccuccccaucucuaguaauguuugggugucauguguuugacuucuugaaacuuuuauuguuaaguguguacuuuguuguguuuuguuuugagaugguuuuucuacauagcccuggugguccuggaacucacuuccuagcccagccuaccuuccaaguugaauuuuuucugccucagccuccugaaugcugggacuacaggcauucgauugugugugccacuuugucuggcuuauaugaugcgauuugugaaucucuuuuaucucaacuucuggguccuuccuaaaaguucaaacuaagccuuugaguauaucucaacuuucccuaagggaaugauauaaggaacugaggccuuguguuggcaaccacuccuuggugagaggguuggguaagguacuaccuuagccagcuauggugccaggugacacaggcaggagcauggugcugaucaucuccuuagggauuuaucuaauuaaaaaauugaggguugccucuuaaaagaugauuuaguacacagauauaaauuaccaagcucaucuuucaaugggugcucaagaaauacacaacaaagcauguacuacuuagcacuaucuuguguguguaugcaccaugucugugcguguaugcgugugugagugaagaugugcacacuugcacgcagaggagagagacauacuuugcugucccacuguaucugcuguauuuacaugugacuggauaggcuggguugccagugaucugucugcauccauuccucaaugccaguuacagaccgccauaaucagcuuuuaauuggguguuggagauucaaacuuggguccucagugucuagcauagcuccaggaacauauagguacauagaaaagcucuggcuggguggaucaguuucucugaugcggaagcugcagcacacugaaaacucaguguguguuuauuauauacacuugaacagggagaugggauuauuguauacagcugaacaaggaggcagguuuagcuaaucuugguaggaguagucucuguggggggcagucuuuaggcuggaaauauuuggggagaaaaggcuaugguggacauuuucugcacuugucaacauccuuagagcccagaggaaagcuuugccaucccucugggccucauggggauggaggagugaguuuugccaucuucucaugggucugaggcuaugguccuugacauggcugugcccauguccccaugucaacaauccauucguccaggcuuucucuacucuuacacucaggcaucugcauuuuguccauugagccaucuccagcagaacaguaucacuuaggauagccaugcauucuuuggugaguuugcuucuguguaacacccccagcuguccugaacucacucuguagaccaggcuggccucagagucacugagauucaccugcuucugccuccugugugugaguaaaggugcucaccaccauggucugcaguucugccccugagaacccuuuuaugaguucuaaacugucuauacauucugauuuuccacaguaauuuuucauuacaauaacuaguuucuaaauuaauauccuuuguauuggauuuuucuaauuaaauauggauuuucauuuuauauauacaguuagaagcagcacuuacauugggaguacaaauuuagguuaaaauauaaauguuauguguuuuguggcuucaaagacaucacuuaaugaaucuuuaaagagaggagaaacaguaguuuauggaaaagugaugauuugauagcucuaagucccagccauccagucaugccugucuuguggacagugaacuguuaggcugugacuucccauaaagacaugcaacaguguucaagugggauaaccauggacauguaccagguuuuuuuaaggaaaacuaaaaauugaugggagcauucauguuuuaaauugagcaugcuugcucuacuuaacaauauccguaaacacucauaauaaaucgcuucagucuccaggucuuacagaguaggcaaguuccacuguuaacuguuacggcaguuuaaagggcuaauuuaauuuuuuuuuuuuuuuucgagacaggguuucucuguguagccuuggcuguccuggaacucacucuguagaccaggcaggccucgaacucagaaacccgccugccucugccucccaagugcugggauuaaaggcguugacuaccaagcccgccuaaagagcuaauucuuaacugcauaaaaagagagguauaauuuggauguaauaguauugguuguaaccauaaccauaagaacaggucuucuuuggguaugagaugucuuuggcacagcucagugacagcgugaagccuacacaaagagccacaggguguggaucgaagaggccacacugagugcacacacacucuuugugcauggcuuggcauaauugaaaaugccgugucugccgugggcaggcuugcacuugggaguagaggacagaugugcuuuucugacuaccacugggaggggcucccacauuuauggugggucuuuccauuucaguuaaccuaaaagcaaaacccucacaaaaugugacccugugugagauuuuuuuugacucauaggugauuuuaggucuccacacguugacagucacugcauugugacaauagcuucgcacauggagucagaugugagaauggccuccuguggcaucaugucacugcucauacaaguccugaucuugaaccauauggcuuuuuggacucaaggcacuugaaaugucuaacuugcccacauauuguuauuauugggauguaguuacugggcuuaagccaaugguugacuucagaaugcccagaggugguccuugacccugcuacacaugugcucuauguauuuaaaaugagacaaccucugccuuugucuccuaacuuauaaaauacugauugugagggcuaaaugagggucauuuuucucugugcuuauauuuuuauaccuaauaucaaccuuaucccuagauguaaguaucaagauuuuaugcaaauauaaaauuugaauuagaaauuaacaguauggcuacaagauauuucuguauauucccucccucccccgccccccuaucucagcugggauaaauccaggaagauuaaccacuuuagugaucagauuguagacucugcacugcuaaugaccaaaggagaacagggucucauguaggcugcaaacacacuuguaguucuugaaauucuguaacugaagcaagggauacaggguuugguuagcaaucuaccccaccaaaaccagaaaacaaaacugcucucaaaauggaacuuuauccaaaaguuguaggaaccaacaggaagaggccaaaugugggacaaauuaaguaucagaaagcauuaaugaaaugaaauaauacacaaaaugcuugcaucugacguuguaacagugcugaaaacauuugguuucuuuagaauccagcagugcacagcucauucugaaaggggaagaggcacuccuggccuccugaaggcggaggcagaggcagaggcgugucugaggugauuucaagaaggcaggauugagugagccaagagaggaaagugaguuaggcaggcaguuccugcauuuauuguaagaaaaugggagucuauggagauucuacgcacgccucccagcuccuccuaccugagagauuggacaggcacaggcaucugucauguguccccuccauuucuuguccauuaaaacugcagaauaaucucuuuuuuaaaaaagaaugcugaguuuggugauaauaauagcaugugccuuuaagugaggcacucaggaggcagagguaggaggaucucagugagcuugaggcuagccuggucuacauagcaagugccaggacagccaggaccugagaccuuguucaaaaaacuaaaaagaaaaagaaaagagaguguguaugugacuuucaggucagccugggcugcugagcaagggucagccugggcugcugagcaagaacccguuucagagguagaucuuacuuguauacagauuucaucacaaacaaaaagccaauacugagcuacuccuagggagcccuccuccucuuccuccuccuccucucccuccuccuccucucccuccuccuccuccccccuccucccccuugccccacuccuuuuccuccuccuuuuccuccuccuccuccuucauaagcaacaguaaaaacauuaucaaacccuggggucugacauuuuauaugggacagaaaagucuaggcacggggaaacuggagagggauuugaaauuacgagagcagaggugagccagggaaugcacgggguguguguguguguguguguguguguguguguguguguauagcacguggugaauggacacuuggugguuuuuuauaaucaggaaaccuugaggacuaguuagguacuuaguguugacuacuauuaauuuggaacaucuuuauuauauuuguuuagugugugugcacaugagugugccauggagggcuugugaaggucagaggacguucugugacagucuguucucuccuccuaccauaagggacccaguccuugacagcagcugccuuuacccaccaagucauccagccagacugaguucuacucauuuuugauaacagcauuuucucuaaaauguucuggaaagagagucugagaagggagguuggguaggcagguuuaugagugagucucuuauaguccaggcugacuuugaacucuccauguccugcuuucucucuugggugugacaauuacaggccugugccacugcauucagcuguuuaaagucuccuuuuguuggcuuguuuuuuguuuuuguuuuuccuucccuccaccccacccccaagaagguuuugaggcagggucucacucuguaguccugguggaccuggaacucacucuaacuugacuagacugaccuugaacuugggcugaaccuucuuccucagcugagauugcaagcaagauucaacaggcuuuauaaaauaauccauccaucuauccuuccuuccucccucucucucucucucucucucucucucucucucucuuucucucucucucucucucuuucucucucucucucucuuucuuucuuucuuucuuucuuuugguuuuuugggacagggucucucuacguagcucuggcugaccuagaauuuacuauguagaucagacugucucugaacugguucuguguccugagugcugggacaagagcuguaguccaucacacccagccugacacuguuuuuaaaggagauacauguauuuauaaauaaaucaugagacugauaacaguuuaaagcugauacuuacacucagggaggaagagugcgaggacuugugaggggagccucaguugucuuucgugggugggaguugagacaaggucuugugguguagacugguucagaacccccaucuuccaagugcugggggaucuaggagggcucuacuacacauuugaguuguuucuggguauuuuauggaguuuauguguuuugugcuaucuuguauaucauauucaauuuagugaaagguuauugaggugguucauaagccguaggcaaaaucuagaaucagauaggauuuaugacuuggcacucugccaggaaaauguaagccguguuauuaagacccugguaugaacaaaccaagaggaggugagagagccaugagcaacugagaauaagcagggaguagauauguacuaaugggggucuuagguagucagucuugggguauucugaagucauggcuacggugaauaaggcuccaucuccuagagcccuuuacacuguuucagccugaucugccugggcgggguuagguguagacuccacacgauccagaucaaacuugaucagggaggcugaggcuggggagggauuguggaggccaucuuacuaguuuuucuauuucaguggccauuguuuuggguuuuuuguuuugauuuugagauucaaggucugauuauuugcuuauuugcuugucacucuuuauguaugagugcucuaucugcauguaagcccgaaugccagcaggggcaucggaucccaguacagaugguugugagccaccaugugguugcugggaauugaacucagggucucuggaagagcagcccgugcucuuaaccgcugagccaucucuccagcucucuguuuagaguucauuuugacuggacuuacaaguagaagcucucagcaagggugguugcuacauccugacaaugugcucuuggcguuuucuuuggcuugcuucaugcucuuggcuaaaaguagagcaugcucugcagccuucuccuuguuuuuguuuuuguuuuguguguguguguguguguguguguguguguguguguguuguucuucagagugguauguugucuucugcguuuauguugccgggaacagggcaucaacacggugcugaaucuugggagcuuugguucugggcuucucccugcuccccacccccacccccucccccuuuuuuugcuuaagagguuucucacagcauuuugauggacagcaucaucuuuagagagauugaaagcuuuuggauucugcuagcuuucugggccccaaccacugagucauaguaguaccugucagucaggaauauccuucuugcauuuucucccuguccuuaucccucuccuccccccacuuccuccuucccuacuucuuucucucucccucuucauccaucucucccccucccccccucuccuucaaccucuccccuccccuaacaauaacuaagcugagagcacucagauuggcauccacgaugcaucccugcacagacuugcaccucuccccagcucuccuugcucuguaacaagcaugucccuuacuccauagcaggccaacugccauggcucaagcaaggcagcuuauucaugggaaacccuuguuugugguucucaccacugaucacccagagcgucagcagcggcuuccgugcacuucucauagaauggacaggguuaggacauuugcguucaucguccaccggagauacuucauaucuuugacauuuauuuuuaucuuggcuuuaucuugacacagccaacuaccuaggagacaccaagauuccuuggugucauuugaaaauuuacauaaagucacucauuuaacuaagaucucgaagauucuguuuaggauuucugagucuccucggccuaugauaaaacuuguuuuuuuaaaaaaauacgucacuuacugaauuuccaugacagacauuucaacauaugaacauaaggaaugggagcagggccuugcacaugcugggcauuggccugcaguacagagucaugccucugccacagcaacauacaaagaaguguuuuuaaaacccauuuuccccucaggggagaaaucucuuaaauuuauaaauagauuguguugaaguuguuuuuuaguauuuuuuuuggaaauuuguguacuuaaauaauuggagauuguguaguuuucauuuugcacuaagugugacaacuguuucccuuccacauaagaagcucauuagaaaaggccaguuucuguuacucaaguguuuuuuuuuuguuuuuuguuuuuucuguucuggaguuccaguuagugaaauacauagcccaggcuggccuggcaugugcucuguguguagcccaggcuggccucagacuuucuauaccuccugcuuuuuucuccugcgugggguuacaggcacauuggcuuuucuuucccuucuauuaaauuacaauaacacauaggagauuagcucuguuguguacuuaccuggggccaagcacugcucuauacucccaagauaacccuguuaucccauauuuuauauaugugauuauauaaugucagagaaaaugaaacacuacuuuauuugacugauauuugaauugaacuauugcauacaugcauguauaagugcaaguuucucccuggcuuccaauucugcauguagcuaaggcugaccuuaagcgucugcccucuagagugcuuggauuauagucguguaucaccaugcuugccacaaaccacaaugauuuugaauagucauuucauagaagccaucuauaaaugucaguauucucuuucuuggcucuuaagcauuuagaaccaaccuagauguaacguaauguaguagcugggcuggagacguccagaggcacugacgugugagcaugugaugagcagugucagugccuuucucaagugcucgcuuggcauggauggcgcuacucugcugccugaguacucuuggcaccuuugguuaaguuuucauguugaagcaucugucuccugugugguaagaguguggggcaaagguaacacugagauuaaucacugguaauugggagaacccuucucagagucaaaaacaacucuggccacagugccaguucacauaagaugaaguuugaaggaaucagaagcuguaaacugaacaguauuuaggaaaugauuauuccagaggaacuuugaauuaguagaggagaguucugugcauuuuaaaacacccuugggaaacauggcuguuucuuucuuuuuuuuuuuuuuugagucaggguuucucuguguagccuuggcuguccuggaacucacucuguagaccaggcuggccucgaacucagaaauccgccugccucugccucccaagugcugggauuaaaggcgugcaccaccacugcccagcggcuguuucucaaagauggugcccuacagaauuuuuuggauauuuguuuuuguaaucugcguauaugcacauuuacacauugacuuuagggaugagugaguccagagcgggcagagacucagcuucugcuuccaagccugcagaugcuugagugaagcagguucacaucugcauauguacagcaaaguucuucaucuccuuacuuacccaggguaaauauuuacagugugaacgaagcaauauagagcagauccaaaacauauauuagaaaccuuguuaggaugcaucugugugugagugugcaugugcacacacuccgcuguguucauuugugugacuucgggugugcacauggggucagaggacagcuuuagguguuuguccugcccuucaucuuguuagagacugucucugcuguucucugcugccuaaaccagacuggcugaaccacaguguauggagaguuuccugccuggucauaggaacacuggguuucuaacaugagcugcugugccuggcuuuucauggguucuaggaauuugaaauccaggccuucaugcuugugaggcaagcgcuuuacucacagaccugucuccuagcccucagguaucuuuacucuuucacaaaaaagcgaaaucaguaugagccugaugucaggugacgauggugcaugccuuuaaucccagagcacucaggaggcagaggcagguggaucucuguuaccaagccaaccuggucuauagagcaaguucuaggacagucagagcuauacagagaaacccuuucuuuuuuauuuauuuauuuagguuuuucgagacaguguuucucuguauagcucuggcuguccuggaacucacucuguagaccaggcuggccucgaacucagaaauccgcagccucugcuucccaagugcugggauuaaaggugugugccaccacgcccggcagagaaacucuuucuugaaaaacaaaacaacacaaaacaaaguaugguccugaauuguuguuguuguggugaugaugaugguggugguaaugaggacgaugacgaugaugaucuuuugguuuguagcccaagaaagccuuggguuuccaaucucccugucuuagccuccugagugcugggacuacaugccuaauucacaggaguuauuuuuuaacaaaguaucauuuccucuguauguuauaauuagauggugcucagauuuuucuuuuucugaacugauagaauaccugacuuuuauuuauuuauuuauuuauuuauuuauuuauuuauuuauugucuguucucccugaugauuugcaauuuuacuguuucauaaaaaaaaaaacuugagugcagcucccaucugcucuguguagauuaugaacaggaagucucugauuugaguuuauguuccuuuggugucugacuagggagcagcaauggcguuaauucuauuccgugggagaggaaagagauaauaacucacuagaaucuacaccaaacgucauaggcccuaacacuucaaaauuauaggcuauuugguggggaaagggaaguucacugugguucugauuuuugugaguuaaacaauugaauuacguucaucaucauugccaucaccauuagucugucugucuauccauauccauccauccauccauccauccauccaucugucaucuuucuaaucauucagagacccgccuaccucugccuccagagugcugggauuaaaggcgugcccccccccccccccagcucuaguauuauuuucaguuauguguacguacugaguacagguggccuggaguuagaguuauagguaguuaucagcauccugauucuguugcugggaacugaacucagguugucuggagaagugcaugaucuuaacugcagaaccacccccccccuccccaaccccucuccagccccugaauuacugucuugauuugucaaacucaggugccuaggauguugucacuguuguuugguuuuacugaggcacaggcccaaacugaauccuccugauucagucugaauucaggcacaucaucauucuauugaauuuuauagucuggagguugggaaaaagugagagucuuucucuuuucucuggucccaaguucccuaaaugcuauaaugagucucuuggcuguggucucagaacaaaaacaucuggauaaggcuucguuugugcucuggaggcuuaaguugaggaacggcuugaaugcuaaccuuagucaucagaaugaauguauuuaugugucuguuuuagugcuuuauaaaauaccagucaccuaacaguucugggcccagggucacagcagggcgugccuugggguuauuuuaccuuuucugugggcuacauuuccucauuauauuuuggugugcaguuaaacuaaaauucauauuuuaaguauuuucuaagcuucuauguugcuauugguguguguugcuuuuguauguuuuguuucuuaaaauauuuuaauucuucugcaggauucguaaacuucagauacgaaauaucccgccccacuuacaaugggagguaagagcuuuuauguuaaggucucaguguuggagcuuacuguuuuguuuuucuaaagauuuuucucuuuccuucaguucucagguauacuagaaccuaauucuucucucuaauggcugugguaugggcuuuucuuuguaggauuaaaucccuuaaaaaucuguucuuugagaucucuuuaaaugcccaacaguuaguaguacuuguuagcuuucugauuuagcuccgugcagcagcaucuuguugauaggaguugcccaggagaauuaaauauggcguuccuuccuuggcagaaaauuuaaaagacaaauaccugcuucuuaccacuuuauuauaaaaugugauucugcuuuuuuuugcuuagaugauggcccuucagugauugugugucaacaaagagcuguguagcacaauucacuagcccgagucagcaguuuccacagcaucaugacagugucauggugagaccuugagagucugaagaggucacaguaaaugauuguuaacucugcagaccaugaacucugaaaauuaaacaaucucacuauuguguuuacuguguguguguguguguccuuacuuaaggaggucagaggcccauuucaggaguugguucugaccucccacucagggauugaacucagguccucaagcuugacuguaguagaauccuuacuaguugagccaucucgcuggcuccccugaaagguuuugaagcuugccuugacaccuugcaagggaaccgucauuguuuguauuauuagagcauaaacaucaagagugacuucuuuugugguuucagauuagguuuccaaaugaauuugcugugucauuaaacuggaccccuuauuaaaaugcaaagcaugauuucaagguuuccuuggcagugagcugagggaaguugugaauuucgauucuccaaagucccugcuuagaaucaaaucacuuguguguaaaauaucucacccagugcugucucgauuuacaacugcugcauuuugaucuuggaaaggaugguuaguuccuuaguauguucugaaugauuuuguuauauauaaaaucauacauuguagguugacuggugacuucagacauuaaacuauaugcauuucccuauuuuagaguaauauuuguuuaggaaauucauuagcuugagggguagaccuuaaacugauuuugagagcaucaagaucguaaauuugcaccccaguuuucagauggaccauauuaaauaugguuuaaccaggcacucuuuucaggaaucacauguagugugcugaggcuguuggugagauaguuaccucagccaaagacaggcgaguaagcaguuaaagucguggugucugcuggagcgaguggcagacguuucauuauauggcuugucaugaccuuuuuuuuucauuuccccuuguuaugaguaaaaucuaauuaauaaaacaaaccuuuauuugucuuauuuuuuucagaauuuauuuuaucuucucucccucccuccaucccucuguuuccuuuuccuuucuuugacaacauuuugcuuuguaguuuagacuggcuuuauaauuagaacccucagccuuagccuccugagugcugggaucccaggcaugcgccgucaucacuccugguccaauggccuuuaacggggcgguaagguuacuuacaugagaaguggaagaagauuggaacuugaaggcuuuuuuucagcugugauuuaagcuuuugauuuuuuuuuaacaaaaauaauuuuuuucuuacuuugguagggguggauaggaucuagcuguguaaccuagacugacuucaaacuucauguccucacuacaggcacaugcgccaccuuucugccucagccucuggaguccuggaauuauaggcaggcgugaacauguaugccugaagccagauugagccagagcuugugaggaguuguuugugugggcggugccuuucccuccaccccuucccugaaagaucacuuuguaucuuuaucugugcacugugggcaugcuggcugccuccccaaacccucgcuguacaccgugguaacugugcucuuacaguccggauuccauccuaauggaagcguuagaguuugauuccaccgauuaauguuaggauuacagagagugacauagccagaugugugaugugacccaggaucagaugaaaaaaaugcauugcacagacgacagguuccugccuugaaaagagguuugacugcauucuauuuuaaguugauuuuugcaacugucuggaaaaaacaaaacaaaacaaacaaaaaagaaauggaugaugggauacaaguuaaauacgaaccaagcaugaggcaucucauggcauaggcaauacuguuuugugagacagucaguggccuggcaagagguagacaaccucuagggcaugacuugugcaugcgcgugacgguuggaaccaguucucuccuccuaccauuuagucccggggacuugauucauguugucagcuuggcagcaagcaccuuuacccauugagccauuucacaagcccugaacacacuuuaaaguggugcaucuucuccuuucugacccagagaugaugauagcagauagacuugcaugccuuaaaucuucgcucucaggcagaggcacgugugucucucugaguuugaggucagcuaccuagagaaauccugucacaaaacaaaacaaaacaaaagcaaaacaaaaaacaaaaacaaaugaaaaaaagauucacuuacuguggcuguaaaccagugcuuggucuguaugaacauccaguacauuauaugugugggauagaacaaaaccaucaccucacaaccuugauuaaauucuucaugugucugucagguccagcugauuucacagagcacacaguaggccuucaccagggcauuugagaaccacaugagaucucaagagguuaaagagcaaaaggaauagaaguaguuaugacugaagggaacagccaaucagaaucuagggaauuggaaugagccagagucgcugagacuaaguucucugagcugugcaagcucauggcuggagcuuaugaguuuuguuccuggagccuaccgccauaaaaggccggagccaagugcuggaauggggaugagcacuggaccagaaagagcuccuccuacagucucuaucugccccgcccccagcuucccacugcccugcucccaucccccucugucccacccuaacccucccacugcccugcccacagccucccacugcuccuguuucugcuguggcagaagcauacagggaacagaugggaagaggcaugauuugaguucccaaagucucaaagaaaacgucgaucugggcuugagagcuccugcugcugaucugaccuggaaacaaaguaacaguguccguucuaccacuuaccuugugaggcguuuucugcgaggucugacuucuccacagagucaagaccuccuaaaguuaagaggaaacuuaacccucuggaaggccuggugccggagagcuggaaagcuucuuucccccguauguaggcugcgcacaggaaauggaauccucucguccauccuucaccuccccucuuagaccggugggcacugaagcaucccacuuccauccuuuuccugcaccgugugcuuggcagggugacccgugugaggggaaugccagugucuuaggaaggaacuuguaugagaacuuccugauugucugacuguugcucucugaugagaaaaaucggaguuccuacuagccuugguggggugcaaaggaaggcagacccuaaggaagacccgccuggacauaagccacauggaaaugcugguccuggauaaaagagcaaguuuagguccucagugggaaagcagagcugguguuuccagggugagcuggaaacaggucuaagccaugguuagucaucacuagccuaaggcuccccugcugaugggcccauggcugagaugacaaagggcagaugccugguuggacaaacacuuaagagaauguguacuuuauuuauuacauuucucuauuuaagugaugcauuuuuuauucauauguggaguaugcucauaagauggaugguuggacguuggaggcaacuugaagggagucuguuuuuucaccaugccaggcuuggcagcaaaugccuuuaccugcugaccugucuugaugaccuggaaugcauacuuuaaaaucauaauuucgcauauaaaacaaaacagaaauacaacccacugugucuuuuuagcuuucccacaaaaccuggaugucugauccugggacuuaguugaucugggaagacaguuaucuuagaaguucugaagaagccaucuuuuccuguuugugucugguguggcuuuggguguggaaacuucccuggccugagcagugggagaaagugggggcuccucauagaucgagaauccucggauuauccaggcuucugacaagccagucaaccagccuugcuguuugguguaggaaucaaguaacaggugcuauuccugggaaauccuuauuuagagaaagaacugggcgaguuguggugccucuaaguggcugcucugggauggccagucucuucacauuacaagaagugauuuggccuuuggugugucugugugggaguggauuccagucccuauggcugguagguuaucuauaggaguuuacgaugccauuuucccgaugccugucaugucugacugcuuguucuguggugguagcugcugcuacuuugagauaucacuuuacaauuuuauaacuuauuuauuaugaaaacuaucaaauguaaaaguggaaugauagagugaaacuugccguuaccaacaugugguuuuguucuguacacacaugugguuggcugguuuuguuauguguacacacaugcacucuuuccccuuucuagguuacuuucaaacuuuuuuuuuuuuuuuuuuuuuucuugagacaggguuucucuguauagcccuggcuguccuggaacucauuuuguagaccaggcuggccuggaacucagaaauccgcuugccucugccuccccggcugaaacaaauuuuuucuauuaugacauuguuagguauuucaguuugugucuccaaaagacaugaccagggcuuccauaguuuaacccuaaacaggaacuuccugcuccauccucauccuucugaaaucuggaagcccuggggccaaggugccugaagguuugccauuuccugggguuggagagaaggaaggagcggucugugcuaguucuuagcuugugcaacacagcucccuuucucaaguguugugcaugugucugacuccagaccccuguuauaaagaggcaggcacucggggaucugugcaagccucacuguaacuguaacgcucccugaagccucugcagguaaggucacauucugaaaaaucaaauuaggaugcauucacacaaagauuugauuaggagaagguaucauugaauccaaaaaaguccuuuuaaacuuaagaugucaugaucagcaggaaaaggcauucacugccaagccugacgaccugagaccaaccccuacuuccuacacugcagagggagagaacuacuuuaaaguugcccucugggccaggcagugguggcgcacgccuuuaaucccagcacuugggaggcagaggcaaguggauuucugaguucgaggccagccuggucuacagagugaguuccaggacagccagggcuauacagagaaacccugucucaaaaaccaaaaauauaaauaaaaaaaaaaauaguugcccucaguuuuucacacauacuucauggcauaugagugcccaugugacauacauauacacacgcccaaguacacacacacaugagcaaauacaugaaaaaaauguauaaguaacaugcugaaaaauucauguugaauuugaugcuacuaagcaucagaaguauccauguuuccuagauuguuucuuaaaaaguugauuauuuucguuaauccacuuccuuuguggcuacauuuucuuuucugguaaauuuguggaaguugguuuacauuguagagugccacauucuuuuucuguugaauauauccauauauggucacucaacaugucccugugaccguuguggaacuuggauacauacagguuugcuuuuuguuguuuggacaagacaugguaugcuuccuucaugaagagguauguggugucuaucuuugugacuggcacuggucuuugcuaacauuccuuaguugugcuuuugaggugguagccuucggguucuuccaugucuucauucccugacugcaguugggugaaaaugagcuuaucuucuugguuauuugauuauucaguuauuugagauaguuuguauagaaaacccagccucccguuuaucgagagccuuaaaucagagccagcgcacgucugccuguauaacuguaagcuuguggguguaagacucuuuggguugcagacuggagucacuuuuuucuguguuuauauccugauaugaauguggcgacuucuugaagccagcguuguuuuaagugccaccucagcacuuacuaacuuacuuuguuuuguagcacaaagccccagguuuauuugaguguuuccuggccuuaagguguccugauugcuugggagauaauauauaguguucacaguggggccuuuccccucuugggaccaagucaccagccuuucuaggguucugugacauuuguguucucaucccuauaggcuuacucaugcuuuucauuucccccucuguaucacauuaugcuuuaccuugccugggagugaauacuggcagcccaucucaccuacccccucagugcuggguaugcaccucaggcccugcugcuugcuaggcaaguauucuagugcugaccucuaccugaguuuuuauuuuacuuauuuauucauuuauucacugauuuauuauaucacuucuuggcuuuuugacuaagauuacguguguguguguguguguguguuugucuguuugaaacaagauuucucuguguagcucuggcugugcuggaauucauucucuagcccaagcuggccuccaacucacagcaauccaucagucucagucuccauagugcugggaucaaaggugugugcaccuggagaggccggaggacaccuuguagcauuuguucuucuucuuccaugugggccccacagcucugcuucaccuugggugaagaguugguaagaauucuuggauuucuucuuuccuuaccugccaugguuauuggcauuaaacucggaaccuggugcuuuuuagauaauauauaguuuucuaucacugagcuauguccccaucccuggugauagucucugaaaaauugguuugcuuuaugaaguuaaucaauagagaggcaugcuuugucacauucuuuuauuagucuuuaaaauucuauggaaucugaggagguuucucaauuuucgcacugcucauuccagugucuuaaaucugucuugcuagagguuuuuuagaugauuuuauguguaggaauguuuaccuaugcauauguauguguacuguguguauucuuagugccuaacagagcucuagaagaaugugcuggacccucuggaaugauugugaguugccauguggguucugggaacugaacuuggguccucuugcaggagcagcaaaugcucuaucucuguuugacccuccucucugcuugcucucuuaaagaaaagaaguacuugguuucauugauuuuacuauuggugaaaacaauuuauuacauuuuuguuuuuguguauguugaggguauuggcauggucaugccagggcaaacaugcggaggucagaggacauguuucagauguuaggucucuucuaccacaugggucccagggauugacugcagauugucagccuuaggggcaggcaggugccuuugccuggugaagugugaugccgugccaucuuuccuggguucucuaugagagcauuaagugcucuuaaccacugagaucuuuucuccugcuccugauuuuacucuuuuaagaauauauacuuuuuacuuuuaaaugacuggaaauauucuuguuaucuccuauuuaugacuuauuuacacuuugauucuuaggcuguuuuugagauuuuuuuccuuuggcucucauuaauugguuaugcuauauucagagacagauuuagggucauugccuuguucagaguucacaguaugccucuugucuuuugcuaaauucuuacccaucacugcacauccuuuucugcaaacacuuccuuccguuuucuuucuucaacaccaguggugugacuccacccuucugauuuuaccccauaaagcuuugagccuuucuucauuuuguucagugucuucucugugaguuguucaaaguaauuggauuugguccauguguguggcaaugacaauuuccuaucaccugcagccuacugggaauuuauccaauacguuguuuauuaaggucucuuauuucuuaucauucuuuuaaagaaugcucacccuuuguggaacauuuuuauaguaaacaucacuaaaauccgucaagaagcuuuacaucugcgucagucuugguguuuguauugacuuucuguaugcguugauuuucuuccuggcuuucauaugcuaaguaauuugggguuguauuuuggauaucuuaaguauuuugagagucuccauaaauccugugaagaagacugauaaucuugugggguacccuccucuuggcuggguucuuauugcaaguuggaaccagccuuagauaguuuagaguuccaguuucuguuguuuucagaguuugggggucugucugauuugugcaccacacacuuguagucaguccgagacccaggcagugauccagccaugaccucgcucacaguccagagugggcugcugaguuuggauugagccaggggcuccggcuggcucauggaguaaccucaggaguuucuaguaaugugaccuccccgacucccucacuucuguuaguacuguguugugcccugggccuuuccuagcuggagaagcuaagagucuugaguccugguccuuggucacacacuucuuauguugauuggaggguuuaaaugacaggauggaggaaauagcacaaaguucaacccaaccuuugggacuguagcucugccuucccugggagguuuguguaguauccuguucccaggagaagauggcaaggcuuucccacuccuucucccucaggucugaauuguggcaccaugucagagggaaagggcaaauaacacaccucagacccaacaguacucccacccuuguuauuacugugggauucauaucuacuauaguaugguucagcuuuuauagcugcauucagugagagaaacaguggaguagaccaguuaguucacuugugucugguugcagaaccugguacaaaaguucaguuuccuugaccguguguaguuuuuauuccuucuagauuucaaaggggaucggaugaggucaucauuucucaagaaugcaacacugugguccacugcucuaaaguuaucucuuccuacagauaacuguggguuacauuaaggcccaguaggucuuuagcugucuuugaagaugugaguugggucguccacauguuggugcagcacaagagcccugcaagucacaugugcuguuuggaugugugaacccuucugcuugguucucucauuuuuauuguuuccacuucugauuuaaugaauaaaauaaagcuaaaugggaggaggagaacgguccccaggugaggacuuagaacagugugucaauugagaauggccuguuugauucuguuucuaaauucagcaccagcauccagaaagguaaaugugcuucaguaccaagggcauuucugucccuuucuucucugccuugcugaagggccugcucuaucucauguuuuuguuacuagaguucucgcuugugugccuuuacuuucuguugucuucacucgaugccagugugugugugcugauggcuucucaggcuuccuuuguuuaugguuucugucugaugggcggaggugcuuaguguugauugaacugaggguauguuauguccuuccaccuuccacggucagcugagauccagguuucuguguucaucugccugguguucuuuauauccaccgucccuuccugauccuuccaccuuccacgaucagcugaggcccagguuucuguguucaucugccugggguucuuuuuuuuuuuuuaaagauuaauuuauuuauauguaaguacacuguagcugucuucagacacuccagaagagggaaucagaucucguuacggaugguugugagccaccaugugguugcugggauuugaacuccugaccuuuggaagagcagucgggugcucuuacccacugagccaucucaccagcccacugccugggguucuuuauauccacuguccuuuccugauccuuccaccuuccauggucagcugagauccagguuucuguguccaucugccugguguucuuuauauccacagucccuuccugauccuuccaccuuccacggucagcugagauccagguuucuguguccaucugccugggguucuuuauauccaccgucccuuccugauccguaguauaaaguuuguggaauaaaagcguucugaagauugaaggcagugguuguaaugaaggugagugugugcaaugccacuaacuguauugaagucuguuauuggaccauauuuugaccauagugucaaagcaugcaaaauaaaacaguacaaacaagaaguauuuggauaugacuggagccuaaagacucuaauaacucuaauagugaaacagucaaauagcagaacgcacauaaaagaaccucuaguggaccaguuauuugugcuaacagaaggauggcuuguggccaucucagagcucacuuaacugauacucuuuguuuuuaugggcgcgcgcgugugugugugugugugugcgugcgcacgcgugcgugugugugcauguguguaugugugcgugugugugugugugugugugugugugugugugugugcgugcgugacuguggaagccagaggauaguccaugauaucauucuuaaggaacuguucaaaauuuaccuacuuacuuacuuauuuuuuuagagacauggcaucuuacgacccugagacacaccaagccuggcuggccagugagccccagguaucucucucccaguguccaccuuucugacacugagaucaugcauucauguuaucgaguccaaauuaucuuauauggaucuagggggcuugaaccccaaauaccgauguguagugguuugaauguucccuauggucuuggacauuuaaauagcugaguucuguagugauucuauuugggaggcuuaggagggagguguggcuugguuggaggaagccugucacuggagcuguguuuugagaaauuguugacuuggcugucucugcuuucggcuuauuuugagauguaacucucaggucucagcuuucagcucuggcugucaugacuguggcaugcugccaugcugccaucucuacaguuaaagaccuuaacucucuggaaacauaggacccaaaagacccguccuuaucugugaugcuuuggcaguauaaguugguaccagagaguggauaguugcuguaaagauccuguuguccuccucuccccccucuuuuuuuuuguuuuuugguuuuuggaauguggaagauuucagaacuuuggacaagagaggcaacugaaugcuggaaaagagcuuaaugagccaaugguaguaggccccuggcaggcaguaggacugagagaagcacagacaguggaagcccaguuugauuaaaagggaaagcaaggaccuuaacagccauucaugugauauuuugacaaacaaucuggcuguuuucagcccaugucuugaggcuaaauuaaaaaguaauagacuaauuuauuuggcaggaaauuucaagacaguguaagauugagucugugacuugguuguuacuaguaacguaugcaguucuacaauaaaaaggagaaaaugaggccaaaagaaagaaauacagaauguguagcuuggagaggaaagagcaucggcaggcgugauaucacagccaagacugugcuggaggcgaggcugccacuguuggagauuagcaggagaggagggauccucacuggagcaauggcaaggguaccuucagggaaaguuugcuucaguauacaaaagcugaugcuaacguagucacagcaggcaaguguccaucccaagcuaacagccagaguuggcagcagcauucccgugguacuggauuuagaggcauaaaagguaaaagagauuggguuguugugcacaaggacucuuggccgggagucccugcgugaaggcccugagagagcaggaauuggcuuucucugcuuccugcuugcaguucaagauguugggcccuuggcccucagccguuaugggcgcuaaccccuuggagaacgguaagcgcaaauaaacccauuauucugugaguuucuuaguuuugaugacuuaucacagcaauagaaaaguaguuaauucaucauguagaaagccuacgugggaaauaauggggaagucaugcaacagcugccucugacuuacacacacacacacacacacacacacacaaauguacaucugcagacaugugugcacacacaaacguguauacaaaaaguggccuaaggucauuugaaaaauaguuggaaauucuggccuaauaucaaguaaaaauucacuuaaagaucuaauaaauaaauaaauaaauaaauaaauaaauucaaguuacugauccaaauugcauauugggggguggguagauagaugcugauuaaacaugcuaagcaccuuuaccacugagguaaaugcccagcccucaaacgguaguuuuuaaaaucaaauauucuaacauaguagaauucaaagauaucugaauuugaaacauucguaggaaugacaaucugaaaaauaauaaaauuuuuucccacaauuaaaccauuauguuuacauaagaacugaaaacuuugcauguccaguaaaaacacuucaagucauaacacagaauaguuucaaaucugagcucaggcauuaaaggcagcgcucaucuacacuggguguugugauggcuugcacagugcacacacuguguguucagagccaaggcugcagugcagcaccagaaacaccucagauucauucuacauucaaguuuggauuuugguuguugugccuucagaaaccuuuccuguugacauuuuuguagcaaccccuacgcucaguuauaugagcguaguuauauauauaugacccuaaagaucugugcccacuguuuaagauguucagcuaugcaguggcuaagagcacucagggcuucucuggaaugccugaguuugguuucaagcacacacagugggcugugagaaguuugaugaccucucuggcuucugcaggcacccauauauguuuauauucauucauucacuuauucucuccuccugucucucacacaaaugauucauaaaaaucccuaacaaaacugguugagcucuagauccuucugacccaggaguggugaaggacacuugugacguuuguuuacauuagugauuuucaagcaaccacuagcuuuuaaaaucuacaaugaauuauuagaagaggaaaauuaagucagcggagaauccuuguuugaggugugugugugugucugugugugcgcacacacacacaugugcaagagaaggaugucgguucaugcucucccacucuuuugcucuuuugagagagcaucuccuagaaccucacccuaagcuggcagccagcaggauccagugauccuccugucucagucuuccacaguacuaggggcccauacccggcuuuuucuguaggugcugggacuugaacucggguccucauauuugcgaaugacugcuucgcaacacuuguuccuccuggaagauuucuguuccugucuucuuugagucuuuguuuucucccucuguucagacugaccccagacucccaggcucaaguaauucugccucaaauuucugaguauuugggauuacuggugugggcuuccucgcuuccauaaauaacccagucauuuuugagagaaaauaucugaugaugggcguaagcuuaauuugccuucaagggucucuuuugauucauuauuggauuugcaauguauuuuauaugcaucauuggcuuuucuuucuucuuagaucugcauauuuaaaguccuuguuccuucaugccaggacacagggaagcaagacuuuucaggccuagauguuagaaggcuucuuccuguguguuuuucugugagucuuggcuaacacauuccgguagcgagguaguaaggguccugggcugcccauguucuuugcugguggugagcucuucugggauauguggaggucagcgcgauaguacagaucagguggacuagaccuuaaaugucauugaucucauucaucuaaccucgguaacuguaucaguugaacuuuuguuguucugugcuuuuguggggcuggagaucaaggccagggcucuguaacugugggacaaggacuuuauacuaguaguagcaaacuguccuuuccuccuuguaagauaaggagugucuuacuauguagcuuuggcuggccugaacuggcucuguagaccaggcugaccgcaaauucaagaaaucuaccugccucugcuuccugaauucuggaauuagagaccugagcuaccuccugucguggugacccccaaccauaaaauuauuuuauugcuacuucauaacugugauuuguuacuguaauggcuuguaaauaucugauauguaggauaucugauaugugaucccaugggggucacagccaacagguugagaaccuccagucucacuuguccuggagauccuugccuucccucuugugcccugggaucacaggucccacccuguacuucaaauaaauucuagggaucacaauuccuguucucacauuugugaguuaagcacuuuggcugcagagccaucugcccacaccuaaacccacgguaauuuugauagcuuuuagaacacuuuugcucuccaguugacuugguucccacgggucauucccugugguguuggaugguuggcucuagguguuuaugguuagacauagaacuagucugcugacuucuguguggauugaaagugcuugcacauuuagguuuuugucuggguccuucugaguugcuguauaaacuauaauggaccagugcacauaaauagcacacacuguuguucagucuagagacugggaagacuugugaugaaggcagcagcagauaaguccagccagaacugcucauggguuccuggcccauggacagugguaagggaacucucuggggccccucuuuuuuuuuuuuuucuuuuucuuuuucuuuuucuuuuucuuuuucuuuuucuuuuucucucucuuucuuuuucuuuuucuuuuuuuuggggggggggggugcgguucgagacaggguuucucuggaacucacucuguagaccaggcuguucuggaacucagaaauccgucugccucugccuccggagugcugggauuaaaggugugcucuaccacacccggcuucuuuuuucuuuuuucuugguaccuuuccuacccuaaagcuuugccuucaugaccuagucaccuagcaaaggucccaucaucauaaccuuccauuguguuugaacaggaugauggcacaagaagucuaacacaucuaagccuucagguuauugcgguuguugguaacuggagguuuagaauguuuuaugucaugugcugauauaaaagaauauuagguauagugucuccuauggagucaggaacagauucucaaaugcuauggcuuaaagcgacagaaaucaguucuugggcagcuguggcaggcaaaggcuugaggcugaguggauguuagucauagugaguguagaggacaguuacucuuacagggucucguggccgccugucuuccuuuuaucauggucucuuccucaucuucagaguacagugucccuaucuguuucugcuagcagaaccuucuuuuuuauuucuuuauuuucgaaaaaaaaauucacacacacacacacacacacacacacacacacacuguugcugucuucagacacaccagaggagggcaucauaugccauuacagaugguugugagccaccaugugguugcugggaauugaacucaggacuucugggagagcagacagugcucuaacugcugagcuaucucuccagcccgagcauucugauuuuuaccaacuuuucuugaccuggacaagaauuccugugaucacaucaagcccuccuggaugagcuguuugauucccugaaaacuagguccucgauuauacccacugagcccuuuguuguaggagagcuauugcugguuugggggaguaguagguaguuguaugagacuuaaauaucaaauaaaccccaagagugggaaauuguagucugaaaggccugaagaugauguuuuuuucagaaccuagagguaucgcuaugcaggauaaaugucacacugugucacauuguuuagagcguacucauuccagcagcagucagguccauggagaugagcagggccuguuggcagcugaucccuuuugaagauggggagacaauugcaaucauuacugcugagcugguacuuugaucuggagggcgccuggagccagcugagagcuggcgcucuccugucucucccaccagagccuuggucaguggcuggguguggugcaugccuuuaauaccagcagucuggaggcagagguagacaggucucugugagcugggaguccaggcuaguuuauauagccaguucaugccagccaagguaacacaacaggaccguguaccaacaaacccuguguagucuaaccugucaaggagaccagccuugaaccuucugucugcuacagccucuaaaaugcugggguuauauaggaaugcagcacuacccaggguucugccucuuuaaaaaauauuauuuaucuauuuguguucaugugugcgggcaugagugcucagacuaugccacaccgggaauguggaaaucagagaacaacuuguacacuugguucucuccuuccauugugugggucugacuuuggaacuccuauaaucaggcuugcggcagacaccuguagccacauaggcagcuuugguaucuuacccuagucagugccucuggacugcacaaaaugaaccaacccaauccagaucuuauucacauguucacuguucccaaggccuuguguauucuccauacgaaucugaacagcaguuucacaauaugucagcgagaggugguuucagugguguacauuagcaagccccaggguaugcaguggagccuucggacuuugaggacagcccuguacugacuguggcauuuugggcaaagggacagagcauugcagaaccccuuuccuguccaugcaaaggggauucagcaagacaauuucagcaaggccaucaugagaacaagcaugugacacaggcucaggugugugcauucugaguuaauuagcuccuucaaggcugcuuguuuuuggccaguguccauguguccugcugugaagucgaacuuuuuccaaacuccaccucacucuucauuucagagcucuuagcacagucugucagggaugccccugcuccucuccaccucucucaguucccauuaacuguuuuguucccacgcuagcugccauuucuuccacaaagccuuccuuuaucuucuggccacaccugggucaggugucuccaguauuucuccccacagcacugugggggcagucgcugcuuuuuauauuuguauugccucugaccuuugucucucccucgcagauuccaggcuuuggggacaaggguugcaguucccccauguuguuuccaaagaccuagaaggaugccagaugcaggucaggaggcgcucauggaacacaccuucgucagaaaccuuuucagccccaucauaggcuauuuuuauuuauuguuuuguaugugcauguuuguauguucauguuuguguguguuugugugaguagaggccagagguaugugggugcccuaccucaggagcugucuucuguggguuuugauacagggucucucacugguuugagauuugcuaauuaggacaggcuguggccaucuagccuuagggauccuccuguccccgucccuaguguugagaguacaggcaugcuaccauguacagcuuacuucaugagugcuaguuggguccuugccugcauggacaguuuccucagccugguacgcacacacacauauacauacaugugcacacaugugcacauaaauuggcaaauauguguaaauuuguugucuugaguuuuauuaguauagaaauaaaacucuuuuuagguaaauuuucuuuggguuuugguaggacagacuugauucauaguguaagcuaugugaaccuucacugucauggaacaugcuacccuguacauuuuuucaucucaauuugguuauuacuuuuaguguucugugcaguucagaguuuugguuagucuuuuucuucuuugugugugaaggucagaaggcaacuuuucucaguccauuuucuucuuuuacuguaagucccgggguugaacuuugggcaucaggcuuguguggcaagugcuuuauccacugagccgccaagucagccccgguuagacuuuguaacaguacuuuaaguugauacuaaacuugaucuuugaagucagcucaguuaauuucuuuucuuuucuuuucuuuucuuuucuuuucuuuucuuuucuuuucuuuucuuucuuucuuucuuucuuucuuucuuucuuucuuucuuucuucuuaaaggaaaacuucugacuccaguguugaugugagucacagagaguugggagccuccuugagugacacuccucacggcuguguuaggaaaaaggcugcaccccacaugcagccuccuucagguggauuuguguuaagcccuuccaagccaacacccagcauggcucuucugagcaaugcucuucugagcagaucuguuguccggugacuccagacacacugugggcacuugaggauuucagugagguugaacaucagcugagcaaauaguucugacuuguaauaaucuucauuauuccuuuccuaauaacaaugacuuguaauaacuauuauuccuuuccuauuaaugaugugacuucauuguguuggguucuuccuggcuugacaaaacacgagcaaaucuuucaucagucagagcuuuguuucucuaucauaggaauuuuaucugacuugguguuuaagcaguguuugcuuagaaagagaaccuuugcucgggccgccccuucacuacuggagacagagcuuugcagcgcaugacagaaucugaggcccuugccaagcagguuuagucugggagugauugcucccaagcuuaagggucaccucuaccuuauuguauauuuuuagaguauuaucacugacuucuuauuaauuuuuaacuuuaaguuucccuggcuuuguccccaggccaugcauauuaaacaacugaaguggcucuaaguugcuucauuuuuugaggaguaguuauuuugcaucagugguuuuguuuuuuuuuuuuacaaauuaaaaacauuuucaucuaaaagaucuuggcaugugaguuagacccauggcuccacccuuagaaucucacaauuguaacgugugugugugugugugugugugugugugugugugugugacaugcugcauuuguuuuacagugugugcaggccgugccaugucguggcaguccuuugugggucagaggaccuuugggguuggucccugccugcuaccuugugugagacucccugcagguggggcgcucugcuggucugagaacuucuggauguuguucugucucuuuccuucucagcacuguacuuuacgugggcucgcacacuuguguggcaaguacuuuaugggcacgaggcaagcauacccuguuaguacccaacagcuaguuguaauaaaucaaagucucauggucaagggaacauguuuuaauucuagaacuugagaggcugugaaaaaucuuuuucccccuuaucaguguagguguaguguuugaggguuugucgauugagcuagcaauagauaagaacuuaugucuaugaaaaagaugugggccucugaacaacuagggaggguuuuuauaaccuggcugaggagagaaggcaggaauaguacaugucuucucggugaucaaggagacaccaaucacaaaggaaaccagaaaucuguacauauguggguagugacaccccagcagaagcagcacugggggaauggauagauacugacaucucaaaauaggaagaguauuuaggaagguagccugggaugcauaaugagguccagacccuagacuauauauaguucuugucucaaugaugaugacgaugacaacaauuacaaccaccaccaucaccucacacaaagcagaaggcuuuuagaaaggcucucaggacagugugaugguuaacuucuucagacaugaacccucaauaaaacccacauaggagcuuuauggcugaaggguggcagaugcccuccuuagagucacacaucacaaguucagacaagaauguuucauucaaaaggucugcaagggccugaggaggacugcagugggaagugcuuccaugugagcucguggacccgaguuucauuccuagaucccacaucacaaaguagguguggcuccuaaguguugugcacacuuguaaucucagcacugggagagcagacacggggaucccuggguuuaccggccagcucauccagacuaacuggugagcucugggugacugugugcugugcgcaucacagaggucagguuguguaguuagaacaauaaugaaaagcaucccacauguguguuugguauuuuaacauuagcuuuucuaauuuugcuguauuucguuuuguguugaugacagcuuuauuaagaaauucauauacugggcaguaguggcacacgccuuuaaucccagcacucgggaggcagaggcagaggggcagaggggcagaggggcagagagagaggcagagaggcagaggcagguggauuucugaguucgaggccagccuggucuacaaagugaguuccaggacagccagggcuauacagagaaacccugucucgaaaaacaaaaaaaacaaaaacaaaaaaauucauauaccauaaaagucaccuaaguuuuucauuacucauuguauauagugugugugugugugugugugugugugagagagagagauugaaagagagagagagagagagauacacauggagaucagaacauacaugguugaacacaagacaguaggccucaguggcaaguucucucugaggcauccugcuggucccccagucuccuuugaaagcacacaauucagugacucuuaguguguccacuaaguugcgguagagcaccguuaucuagcuuuagaacguuugauuacccuuaagagccacccuucccagugaguacucacuuccuccuuccuuuucuccccaacucugggaaguucacuuuccauuucuauagguuucuguguucuagacauuuuauagacuacacaugcagugugugcuauuuugugacugagucuuuucccuuucuuuucuucagggcuuaugcacauugcagcauguacuggcgccuuaauccucuuuugaaauggacuuugcauuucagacugguuggauauuuacagagaaacuggaaacuaguggagaggauucccaaguagugcagacccaguccccugucacuaacaggaugcuuuaguggggugugucuggcacacgaugaaccaauguuauucaccuuuauacuaaccuaaaguugaugcuugauaaagauuauauccuucauucuuccugcgacugcuccaggauccugugcaggaccugcccaacaugcaguuguggguucuccuccacucccugcuguuguggcaguuucuugccucauuguuuuugaugaccuugaugguuuuagcaguaguaaauauuucguagacagucuuaguugggguuagcugagguuucucuccugguuagucugagcuuauacauuugagaggagaugucacugucagucuaucgaguguacacugcugucagcacaacuugccacugcauagcaauccuggugcccugggagaagcaguguggguaguguguuuguuguaaagcuacuuccuugccucucacagaccgcugggagacugucacugcaagucuggagagguagcuuagcaguuaagauugccugcuucucuugcagaguguccucgucacuguugaaccaagagcccaggaucuugagagaacuacuuguccaugaagcagugucugcucuguguagucaucuggacuugagaccacuuauuuuguauuuuagggaauaauccuaaucuuucccccucucccugugaccuccuuugauuguguuuauuccuuuguaauuuaugugugggggcguuuggccuucagguauaucugugguccacaugugugugcaccgugucaacaggucagaggugguguuggagccuuagaacugaaguuacacacaguugugagucaccaugugggugcugagaaggaacccagggccucucuguugucuccucuuugaagccuaucauacaucuugagggcauggcuagugucuacagggcagauagauggauaaguaagugggauaauguguuugccuaauucuguguguagagaugaguggagagucucuccugccuuuaagccuucaagugugacuaucugagcaacuuguuccagacagcauggacgcaaggacucuuacucagacaugcugaguggccuguuggauuuugcucagacaaggcccccccccccccccccacuaaguucaaggucaauccuggcagauuauggggauuaugguugugccuacaaggcaagaggcuuuaagcaauacauuuguucucucagaauucuggacauagcaaccccaagugauggcacacguggugugaaccuggagcugccagcagucuuaguauuucuuagcaucacugcacccacuacaggcugucuuugcaguugugcuauaugccuuugucuaaaugucccucuuuuuauacgguaccagucacgccugcaggugcuaaugacaucaacccugaugacaucaguccugaacacaguagagugguuagcugaaaugagguaauggacugcauuccagagccaaagagcucuacagugugcucuaggugaaggauaguuaguggggauucaguggggaguggaugagagacgaggcugugacacuugauaguagccuugaaccucacuaaaguuuguggacuucucauccccuuccaacaagacagaaagacucuaaagguuuuuaagcagagccagaugaaugccuaagauugcuagcaacaccagcgagcagccaggccuacuugugcccugauugcagacuuagaaucucagagauuucuaguuugugguagaaugaguuucuuguuuccugggaacagaccuuagaaauuaaaauauagucccagaguccucauaaguauuuugaccuaaauaucuaaggaacugucuuaccaaagagcuuuuguuaguuuuuguuuuguuuuuuguuugcacaguguguguguguuucuuaaacaauuucugaaagucaguauaaccuauauaauuuguguuuucauuuuauuuuuuucuagaauaauacuguuaagagacucaguuccuuaacauugccaagcauguauuuuaugccuuguuacauuuuuaaaauggagcuguaauucauagaguauacauuuuacccucuagaauacacuacaaugacuuugaguauccucaggguuggaaacaucacuguuaauuucagaauguuuucauuguccccuaaaaugacugugguucuuaucauugucuccuugcuuccuaggucauagagacacugauauaauuuuugucuuuauagauuaccuguuuugauauuuaauguaaauggaguuauuucguguauggccuugcaugugugcgcuuguuguuucauuugcuguuuuaaacauggucccacuguguagccagguagcuuaguguuugcaggcuuggaguccuggccuuccuuaggguugcacagcggcaugcuuguguuggcagucuuuucaaggugcugcgcuuuaacaugugcggcacuauuucucaccacuagaaagacugcugcccugggagggaaccauugcaguucucccauuggccguacagcugcacagccagugugugugcuccugggaacagugugugcuuguuuguguuaaguaggauuuucagaguuuuaaaggauguguaccuaaagcugggauuggugaggugugugguagcuuuucaaggaacuaucagacugguuucuaaaaugguuguaugauuuuuauauuccuaccagcagugcuugaaugauauaagaaaauuuggggugucugaguucuuuuaacacccuguacacaucucucaucacaugcauugucuacaaacauccuuccuguggccaucuucauuuucucgaaguuuucugugcagcuuuggaggucaguacucgggacuggacuaagggccucauaguugcucguuuucguuugugauagggucucucagguucugggcuggccacaugugcgccagcaggcccggcugaagcacaaaaguucuaaacacuaaaacugcauuuggccucuugaagugauuaugaugauugcugcuuacuggguugcugugcgguuuguaguuaucuaaagcauuccaaaucauugccuaggcaagugauuuuuauccucaucccagcaacugaccugucagugaacaugucugugcguagguuuucacuuacaucuggaugaguucuuuaauguugacuaaacagaaaugaagucagugcgccaacaauaaggaguagcuucucgacauuuuguccaggcuggcuuccaacccucuauucuccugccucagccuuuugaaggcuggaaucccagaagugcaucaccacaugucuacguaacuggcuuuguuuuguuuuuaauuguuaaauugcuguaugugcaugcaucccugugaauguuugugaauguuugaaacagucucauucugaagcccaggcuaacccuugaacucgcagcaauccuccugcuucugccuagaacagcuaucaugagccaguacacccagccugaaguguuucuguaguuucuuucagggcccuucuguagcugagaucacuugggccuguuagcuuuccuugcccuuuuauaacuggggcugcugugauuuuccugucuacugguguguuuuaaauuguacccaguuguguauuuuggaggucuuuuaaguaaacuuguuagaugcgacacugcgaccuccuuaugcucuguucaguccuagcaugaaggggagccaaacguucuuuuuuucuccacguaauguuccugcguguaugaucacagcguggucaucugugggcaacguucuuagcagcgcugacuuuggaggucaccucaucgucuuucuguguuuucuguuguuugguuacagccuuaaaacagaucuggagaaggcaguuuggugcuugccucugaaguguggaccugaguuugcucuguccuguguaaacugcccacaugguggcguauguguguaucagcaacuggaaggacagagacaagaaguucaauaggguuuguggccugccaguccaggccagugagagaaccugccucacagagucugcgcaagucuggaccugaugggaucccagugccgagagcggaagugaauacaagccccccaccccuaaccuagaagcuauaugcaacugauaacugcuugcaaaugaaaaauugcuuucuccaacagaauuucacuggguauacagaacagagauuuuacccagaguuauguaaggauuauaacugaacuucuuucucuucccuuggccaaucuaggggugcacucagggccccacacaugccaggcaaguucucugccacugagacacccaccgcacgauuaggcuuugccucugcucccuaccauccccuuucccgggcaguggguuugcuuugcuaguuguuaaggacuaaguuagcggcuucugaguuguuugauguuuaggguuuuuagaccuugaguuaaggucuuacuauauaguccaguuccugaaucccaguccucaugucaaagcuugucaaauucaagaauuagagguuugugccaccaugcuggcuaauuguagaauucucccaucucucaucuuuggguuuaggggcugaggccuggaaggggccagacugucaccacuguccugucucuuaaauucuccugugggggggacggugacucaaggugggggugaaggaaaagguacugguaacaguuggcccuggagauguccugaggcacuugaauaauucagcaauguggauuauucagauggucagggggaaaaggugagaaaggccaugcuucagccaguuacuuuaaaucccaccccagcucauacaucuauaauggagacaucacucacauuuggaggagcaaauaagaguguauuuaaggguguaaaacagaacuguauauacaagugugaagaggagugaagcacgcuacucugggugugcauagauauguaaacauaaacacacaugucucuuaacgaaguuggguaaaauuugcaccuuauacaauaaaccgccauguacagucagguguuaguguguugugugaccaccauuaauuguagaaccaucucuucaucccugagagaagcccgugaccuuucagagguugcuccauuugcuugcucuccacgccugaccaccacugucucuaugggcucaguuacuggagugagcagaacccgacagcugggguugacuagcacugugaagccucccuaccaucguuucucuagcugcagaaugagcugcugguaccuugugagaauguguggagugagugauggacaggucugcuuccagacagcacaauugaaagccaaggacagcuggugcaaugcagaggguaucauaugcaaaacaggaugagcaggucaugugagugguacuugcagggauugggacgagggugugacaugcucacucaggguuuuaaagccagcauggcucaguggaaacaugggagugcgggaugcccuuucuuaggaccucagagaugauggugggcgggucuucggggaaggugacucuucuucugagcacaugacugagugcucacugccucauccucaccugcuucgaggaucuaacuagugaaagguagguuuuccagaagucugugugagcucaggagggcuuuccuggugaucggggugcugugcugccaaugcucugugagggcaagacuucccaaccuaaaagccauccucagacuugcuguaagagacgucuuagccaaaguacugugcuggugauaguuuagagaaauaauuaggugaagccuuuauuuuguuuauuuggguuaguaguuacuagaaacaguuccugagaccugcacuguguaagugcuuuuuguuauauauguagucuuuucagagaugcaacaacagaggccuugggccuauuccugaggcaguguuaggugcaucugaagaacguuccuuugcucaccccuagcucugaagagcagcuucuauggacaugguucccaccucuuuugacaggaggaguaacccgugucugugaugagccaucccuaguaucuaaaacuaauuuuaguaucggaaggcuaucaguggcucaguaucagggcaaagcccuccugagcucacacagacuucuggaaaaccuaacuuacuuucuuucuuucuuucuuucuuucuuucuuucuuucuuuuuuuuccauuuuuuauuagguauuuagcucauuuacauuuccaaugcuauaccaaaagucccccauacccacccacccccaaaaccuaacuuucacugguuagauccucuaagcagcugaggagggcaguuagcacucagucaugugaccagaagcaggagagucaugugugggugccccuuugaguuguacuuaaauuucacuauggcgugggugcagagacuacugcuuccuuuucaugagucuguaauaagugcaccuguuagcuuaaauuuccaaggaauuuuaauggaauugaagaucagcuuucuuugcacucaggacaaaagccuuuuuaauuauuauuauuauuauuaucuuuuucuucauauauuacauacagacugagacuacuucucuucccucucuucccucuccccaagucccccccccccccaaaacagcaggccucccagggacaucaaccaaacaggucauaacaagcuacagugagccuaggcacauaccaucacaucaaggcuggacaagggaacccaauaaggggaaaaggguuccauaaguagacaagucauggacagcccugcucccacuguuaggauucccauaagaacaucaagccacacacacacacacacacacacacacacacacacacacacacguauguaacaugcuugucuuucugggucuggguuaccucacuugggaugauuauuuauagaagucuuuuuuaaaaacaggauuuuauuauaugauguaguuuggccucaaacucuugaauguucucuugccucagccuccuguauacugggguuauagcugugucacuacaguagacacagacacuauuuugugucuuccuuuuaacguuucagucuuuauuaggugggcauggaguaagcagauguaagccaugagcuugucucucacccuuagagguuaguacaucuuuggagaagaggugucgggcaacugcuggucuggauuggcacagagacugucaugccaguauuuucccauuggucccaccgccaugugaaaaguaaagagaacuguagcaugggaaacagacaaggggugagccaccugcauaugguagguauuaccugccagcuuuaacagcuagugugauggcgaagaggagggcacugccacacacaccugcuaacaccaucaccaaguguaggaacugccaguaugguggguaaggaaagauaaagaaggacaugauaaaaugagacagacauggagaaaaucagagacagucacuuuaccacucaauuuugaaaauauggcuguagcauagguauuggggucacacacacacagccaugcuaaaguauggacagcgcacaccagugacuuggaaucccuuuggguuauguaacuucuggcaggaggacaguugggcuggaggcaagcaugcuggccucguggucagacagcacgaggagcugcaugaaagcagcagcaacacaggagaaggucuuggcugagcgccgugcacuuccugcgccugguggaucggcugcaucacaguuuggaggagguggagcugaggcuagggaagcagaggaaggcugacaacauuggagcucgagcugcgcugcgugcgugcguaguuccagcucuauugagauaaucauagggagauaagaauaaauggccccacugggcugaagagacacacgaggaaauugcuuuugugaugacugugaugguuugauguguaaaggcauguugugugacuaaacuuuucuuggggagacacaauacacacgucugcuuaccucagauaagggaauccacaacagaccaaaguacagauacuaccaaagucugacuuggugaaccagugaguuuuaggggguuacauacaggaaugugagugagggguuaguuccaggagcagaaaugacucaaagacagcugcauuaccaaaagcccgccccagcauggguggcagcucacaaagcuggggaccaggagcccacugcacagacugcagcacaguggguuggaggguguuggggaguguccuaucuaggugccucaguugguauaaaccucuuuaauuaagccagccuagcuguuucugcuucuuccccgcagcuggucuggacucacagucuuguuugcagcucagcucuguugaaucugaggcuuuuauuguuuacucuggcagggaggggccgagugaaucaggucaguuucagggacuuccugaagcuauugaauucuuuaccuuauuauguuuuuaaggagcuucuuccaugaugggagauccuuuugaucucaaggaaacugguacacaucaauguacaauaucaaaauaugucaaauuuugugucauuuguugaccuucaguaauacucaacagcuuuguugagauggaguucaggaacaaugcagucccccuuuagcaugcacagugcaaugguuuuuagugcgucacuguuucuuuccaaucaccauugugacuuuagaaaguuuuuugaacacagaaagaaccuccagauguugcuggccauuuucccucugccccuucuuuuagcaaccaguugucugccuugugccucuaugggauuugguagucuagacauucauacagguggagucagacagugugccuggcuuccggcguuuaacguacuacuuucaagauucaccuaggcuguaguauauguaaaugcuuccuuuuaugaccaaaugaugguucuuuauacgagaguaccauguuuucuucgucacucaucagcugauagauguugaggucguuucugcucuaggcuguugugaaugguauugauauguuuuuguuguuuuguuugauugucuuguuuuguuuuguuuuguuuuuuguuuccucuguguaauaguccuggccgucaugaaacuugcuuuauagagcaggcuggccccaaacuuccugagauccucuugccucugccgugugagugcugagauuaaaggcaugcgcuaccucugagcaacaugaccucgauucuucaccaccauguucagaaagcaauaaccuuugcauggaucaugcaacuuucuuuucuauuugugcuuuugggugaacaauguaaaacagagguccuguauuuuugggugauuuugagcccuaagugacuucugagccuuagcuugccuugugccuucuucccucuucagugggguuuuaaacuucacuaggcaugaagaaauauuuccaauccagugugagugaaguaaauucacuuaaguguggauucugguuugugagauauuuguggagauauuauagaacuaggugagggauguggggggaagggagagaaugcucaacgauauugaaugaaaaggaguucagcuaagaagaaaccacaggcaggcacguagcacaucuuccuacuugauaagcaggacaggccaaauuagaaggagauaccgguacucuuggccagggcugauuuaccuuauguagccagggcugcucucaaacucacuugcuucugccuccugggugcugggauuaaaggcaccauucagcucgcccagccugaagggugaucaggccauuggcaccucccuccucucugagucacgauuaucccuagauuugcccauaaaaaugucuaaggcaccaaggacccacugaaccccucuguagccuggaugcaaacuucccacaugguacccaguuauguuguuaauuuguucacaacuaaauaccaagauuaaugccggaccuuuucuuuuucuuuuccuuuuuuaaagaauuacaauuuugucuguuuuaguuuuauuuuaaagucguguuuguuugaauaugaucuauauaccaugaaacuuuccauuauuaguguagugguuggcaaaucuuauauaguacacucagaaaccagcagcauuuacuuauucuugggaauacaagaaaaauuuuuuuuuuuaaagucaggguuuuccuguguagcccuggcuauucugaaacucauguguguugcuauugccuaagauguuucguuuugaauaugugacaccuaauaaaauaauauguaauaaaaaugggauauauauauuucuuaaacuucaaauuuuacuuguacauguauguguauuuguauguacauauugcacauaugcauccugcaugcacacauguguaagugcauaucauacacccccugcagaggggaggcuuggcuccuuugcccauggagccucuggaggauguuggcuccacugguuuuguuuuguagguuuuaacugcguuguccaugggccacaagacuuugucucuggagcaguaaaguugagguggcagaagugaaacuaagagcuaauauauuuaauuacugagcaaauugcuuucagaaagaacucggagugauuaaguaaacauauuaaauagcuaauuaucccuugcugccugcucuucuccaucacaaccacccuuauacugccuugacuuucagcauauccacauuacagcuccauagcgagugagaggccagccugaguuaugugagacccugucucaaaggaaaaaaagaaguaggcauucuguuaacaaguuagaagucaaccuuccucgaagaagaaagcacauucccagacagccaguaggcagaugcacaaacuauaccacaaaaggugaaguauccuuugaaaagugcuuaagaaggaaggaacccugaugaaguaggaaauuaccuuuaaaauguagugugccucuuaagaguucacuguguccuggggccagagaacaacuucaggcaauuaaauuaauaaguaauuuucuguagauacauaaacacuaauuuugcuuaacauuuggggggcgcugggaagcuaagagcaguggaagcuggcuuguaugaugagacagagccccaguucuuguuaaaaugaaccuauaauuacuacuuaguagcuucucucucagaacaguagacagcucaggagagaggagacagcuucguauuuacgauuuccacucauguucagaucuagaaauguucacccccccuuuguaaacucugcaugcugacagcugccgcagugugcuuugauucacugugugccuuguccuuaccuugaccugcuagauucaguggagcuauaaaaggaaguucuuuggaaaggaccaucuuacagauagacucuuuaauguaggccucaucuuaugaucuugaauucacgcaggaaguaagagccauguaugagaaauagcauguacuuacccugugccuccacagcucuguagcugcucccaaguuugcugagggcagcagguacccaccagaaaugaguucgugcaggcugggacggggaacgggcaggccuguuagcagagagagaagcagugaguuuguucccugugguucuguaacucaaagccccaguucauucuuuugacuuuccaucaugaugauuugcgauuugagagcauauuccugcccuguuaauaucuugggaaacuaaaaacuuaacgauuuucucuccccuccugcuaggugcuggauaguuuacuaguccaguauggagugguggagagcugugagcaagguaccugucuucugaauugcuuuuaaauuuauaaaaggaaggaagugggaagaaacuaaccaauucucuguuuuucucuucuccccagugaacacggauucggaaacggcaguuguaaauguaaccuauuccaguaaggaccaagcuagacaguaagcagccugaaauuucuuaucuaucuguauuaacuagguuaaguuauuacagucacuuacauuguguaguccucuaaauugaagaugggcuggugggucauaaaaggaaacuuuguauguuuugacucuauaauuaaugucuucuaaagucuguauugcuauugaaaaucuucauagauuuaagguuuguuccauuuuuaauuuaucuuuaauaccauuuucggagugcuguaugaagcuaaacuacaaccuauuugcacaaagggcuggaauauuuuuccaagauauguaauuugccuccugauucuuuggugcuuuagcacuguguuaaacuaucaacacuuaaauguugucauuuuccucccuggaguuggucaugauuacacaguccacuaacugagcagacacugaaccaaugcaacuugcaacugacagcuuuuggaucaacccaugauaacuuugccagcaauuggagagaaaauaaggggcccacagacacugccuuugauagcucagccuggaccaugagagcagggugguacccuuacacacacagacacagacacagacacacacacacacacaaacagaaaaaacaccaaugcacauaacauaaaaauauguauuuuaaaaaaagacuuaauugaaaaaggagacauuauagaagauaucauugaaauuaagaaaaucauuugaaguuacuuaaaaaaaaaaagccacauauuccacugaguuggaaaaccuaguagaaauggacauuugucuauaugcuuaucaucaaacaaaguuaaacuaagaugacaugaagauuuuaaguagaucuguaacagccagcgagacugaaacacuaauaagaaaguccccuggcuaaaagcauucaggcucagacaggcccacugcugaguccugucaucuguuugaggaagacuagugcuccucaaacuaguccauaaauuagaaaaugugagaaggcuaccaaacgcuaucaagcuaguacuaagugcauacccaagcuagauaaagagagaguuacagcauucccuccugauaaauauagaugcgacauuucucaaucaaauauuuggaaaaucauuaagugucccaggugcuccauuagcucggcuccacuccagaugugugcugacgugucaacaugugcuaaucauucauuuccauacaugcaggaaaggcuuuugacaaaaauacaacaucucuucaugagaaagcccugaguauacuagaacuagaaggaguacaucucagccuaauacaggcuaucaugucagccugccauacucgguggagaaaaccucaaagcauuuccauuaaaaccaaguacaagagcuggguucucugcgcuuauucagccagagcuugaagucuuuauuagaacacucaaacuagagaggagaauaggcuuuacaaauccaauaggaagcuggacuauccucacugguagaucuuacuguccuacauguaaaacucuaaagacuccaccggaaaacccuuaaagaaaacccuuaaccaccuugagcaaaguagcaggacacaaaauauagcauuaaaaaaaagucaggcgccguccuguaugccaaugacagccagacugaggaagaaaccagggaaauaaucccauucacaauagccaaugacuaacuaaauaaaauaccuuuggauaaaccuaaccaaggaagcaaaaccaagcaaguuagccaaugacuggccgagugugagaaccaaucccuggcacuguuaaugauacucagccaugcuugcacaccggagccuagcauagcugucuccugagaggcuucauccagcaggugauggaaacagaugcagagaccauagccaaacguuaggcagagcucacagagccuuguggaagaguugggggacaggauugagcaagccggagaggucaaggacacuauaagaagaucuacagagucaauuaaucugggccccguggggacuuacagagacugaacuaccaguuaaagagcaggcaugggcuggagcuaggcccuacaaauauguacagcuuagucuucaugugugugucccaaccacuggagcaggggcugucccugacaaggacucugucaggugcuugcggauccuccccucccccccaaacugggcugccuuuucuggccucaguggggaaggauaugcuuagcuugggggaugggcagggaggggcucuccucugaggagaagaggggauuaguuaaggaggggaggggaggaggcuaggaauaggaggagagaagggaggggccugugauugggauguaaagugaauaaauaaauuaauuaaaaagggaaagacaggcagauagaauaaaacaaaauuaaaacaauaaaaguauuuagcuuuucuggaaaagaaaaacccgaaaaagaccuacaacaaaaaauuuaaaacacucaaaagaaauugaagacacuagaagauggaaagacuuuacauauucguagacuggguaauugauacugugaaacaaacuggcuauacuacuaaaagaaaucuguaagcuuaacucagucugugucauaauauacggaaccauaaaagacccuggaugaaaagagugauccuggccauggagcacagugcuggagcaucacaucaccagcugacggaugcaggcaagggcuuuccgaacgggcagcgcgguuagcacggaacagugggcccuccugagagacgcaguggcacccugaggcaguuuaccuaaguacaaagucuuugcuggcuauucauuugacacaggaguaauaucuagauacauauuuagauuagauaaugucuuauacaaugaaauuaaaaaaaaaaaaacugagcgagaagccaaacaauacagucaggaaaugaccacucuccaaagaggagcuacagacagccaauaaagagcucacuuuacuagugauucgauguaaagccaccacuaugucggaauucugucucuccuaguuagaagaucaaccauuaaacaaacaaacaaacaaacaaacaacaaaaucaaaaaacccacauaacaaauguugugagcagaagaaaagccugccucuugcuguuguucagccaguaugguaaucaauauauggcguuuggccuagaucuacuacucuauuuuuuuacuacucuguuuauuccagcguuauucacauagcuaggauuggagcaggcagagguauccaaaaacaggaaugcacaaggaaggagugguggguguauauacauagugaacuuuuuguuuguuuguuuguuuguuguuguuacugcuuguuuguuuguuuguuugagacaggguuucacuguguagguauccuggaaccugcucuguagaucagucuggccucaaucagucuggccucgaucucagagauccaccugccucuggguccugaauguuggaaucaguggagugugccacccuaucuggcgcacacagugaauuuuuuaaaggcauaaaaugaugaaguuacaugauuuauaggaaaauggauucaguuagagaucauaaaagugaauuaagcuaguaugaggaauaugaauauguuacauuucauuuaugguuacuagguauuuaauauaagauuguguuugcauucacgaugugaaaauagaaguguaucugugggaccaaagggggccaacaaccacauguguagcccauaucuuucuguaacucuuguugaaggaggaucugacaccucuggcaacuucgaacauacagucacaugaaauaauacaucuuaaacauuuucaagaaauuaauuuaacacauuccaaaaguugucuucgucuucuucuccuuuuuuccuuuccuuccuucuuucccucccucccucccucucccccucccucccccuccuccuccuccuccuccuccuccuccuccuccuccuccuucuucuucuucuucuucuucucucucucucucucucucucucucucucucucucucucucucucucucucugauucagaguucagcuagguuguucuccaaaggcagcagucaugggacuacuagaaaaggaaagaagcuagggaggaagauggagacuuguaugacucaaaugggacucuuacauugaugguguucugagucaggaugucuaagcaguagagauguguggggcuucccuccuuccagcaaugcugcagugaccuuggccucugugaggcagccacaagcaaggcagagacaugugguuugcucacuuuuuucacaguaacuacuguuuuguauauuuaaauaugccucuguaaauuuauuucccuaaaugcauaaaaugugauuauaggaauauguaaugccuuaguuaacuaaguccaaauuugguacuuaaaaaauucacuuuuuuuuuccaguuauaaacaguguagaaaaucaguuuuguagauauuuuauauauauuauaucauuuuguagauauuauauaucuguucuauauaaucacauauauguauauauuaacauguauaugagcauaucuauaggauaaauuaaaauagaacauauauuuaaaaauugauuuggggcguguguggagguggguggggaaggugaaagggggaaagagagaggaagugugucucugugaucacauagaggucagagaauaacuguauagagccaguucuuugucguagacuauguaaaggucagugaagaccuuuauguguauucuguggguuggacuuaggucaucagacgugugcagaaaacaccuucacccacagagcauccugcuagcuccagaccuauguuuuuaacugugugaucuucauagagcuuagacuugcuugaauuguguaacugcuucucuauauucucccagggcuuucugaaaccuugccagucuagcaggagaaagugguugugguaauuuuacuuaauuucauaagugaaauugaagcuuuuaacacguuuaacuucuuaguuuuccuuguuugcauauuuauuuauuuauuuaaauuacaaccucuuuuaugagaccuugagcauuauguuauuguaggauuguaaauucaauguuuuacaaguuguguucuucaacugccauguaagaagagcaggaagauaccaccucugaggucauguuguccagccauucauaccuguggugauagaagcaagugagcacaggcuuaacccucaggaaacucggaggccagugaggggagcaucuuauguuuacagugagcuguaugugugguugguagagccaaguuccuguugcauggaacauacaagauaagccugggaguuuuggggggggggggagauggcuggaugccuguccugugcuuaugucucugccuuuuuuuuuuuuuuuuuaaaucccuuuaaagcuaucuuuccuuuucuaccaucuggugauuguguacacucccagcacuugggaggcagaggcaggcaggacucugaguuugaggccagauuggucuaugaagcaagaucuaggacagccagggcuacacagagaaacccugucucuaaacagcaaaacauucuaccaucugauugccaucccugguucauccucaucucuaaagugggaaucgcuguucucauagcucacaaagcugcuguaacuaagcucuuccuucuaaaacacuuaacuuaaaagcuagaauguagggcuggagagaugguucagcggcuaagagcacugacugguccugaguacaaaucccgcaaccacaugguggcucacaaccauccauaacgagaucugaugcccucauaaguacagcuacaguguacuuacauauaauaauaaauaaaucuuuaaaaaaaaaugcuggacuguggugagagcucaggggagcagccauuguguuccuccaccauguuccuaggugcuggaaauugcucagcugcucuucaauacacucugcugcuguagggagugguucaccaucagucaguucuagaccuugguuguauuugagaggaguccucugauacagcuuugucuaagacagauuccaccuuggaaauuccugccaccuguggcuaagaaacuucagagauuguagcacagguauuaaaaauacaauaccuauuuuaagcuuaaaucuuguauuacuaaauaaugacauaaaaguucaaaagauauuuuaaaaacugcucaguacagagaggcuuagggcucuggcuccucucuaucuuccugucucagggaagcugagucagaacauucagauguggcuuccugaaggguuuguguguaugaaaaagaacuuucuagaguguguaugcauguugaucucacacacuccuuugcuuauacauccugauuucuguuuuuguuagagaacacaacgcagacaaggauguagcccaguuggaagagugcuugggguuuggugguagcccugcauagauggguaugcuguacacaccugccaucccagcagcucaaccuuggugcacagcaagugggaaaccacucuacaugagagucugucucaaaccaaaacaaaaacaaacaaaaaaaaaaacaaacucucagggcuuugaaaccauccuugcaaauugcuuuggagcucauaaagacguuaccauuacaaguauucaaaguguucaaaguggcuaggugacaguagcaccugccuuuaauccuggcacucaggagacaggcaggccugaucuauggaucaaguuccaaaccuacacagagaaaaccccuucucaaaaaacaaaaacagaaaaacaagcauucagaguaucuuggcuaauaacuaugaggaggaaaaucccguguagacuuaaaaauuauguuuauaaauguauuauggcaaagaaguguagaagacugauaaaagaggauuguugguucugggcuagccugagcuauauagcaagacccugucucaauuaaaaaaaaaaaucaaaagaaauagaaguagaccaaacaacaggacaaauuucaugucauucagaaaugugcacuguuaagauuucuaucuuuuaaucuuacuccuauauauuguagcuuucaaaauuaguauuacugcaaugcuuuguaugcuuuuuuucuuuguuuauuugcacaugugcauguauguacauguuuuucuuuuuucuuuauuuguuuauuugcacaugugcauguauguacauguuuuacuguauauggagaggucagacgacaacuuccaagacucauuuccaucuuucuauccucugggucuuaggucugggucuuggaucauuagcuuuggcagcaaccuuuacagaccgagccaucucacuggcccaccaccuuauuuuuggagacacagucucuugcugggacccggaacucacugagugcuagggauccuccuguuucugcuuccucugggcugggauugcacaugugugcuacuguguuuugccggcuuuugugggugcugggaaucaaguucagguguucguguuucuguagcaagugcuuucuuuacugaguggacugagccccugguauuggauuuuguuuuucuuguaguuuguacuuuacucacaaacacuucagucacgaagcccucugcaggcgagggauugugcuuugucuguauuuaagaugcauccaugcaaugguguuccuaggacuuugguuguuugugcuuaauuuauuaucaaccacuaauucuugguaugccacccugauuccugcaacugccacugagugcuacagauaggaauacaggcuuauaugauucauaaguauaagauuuaaaggucaauguucagggcuauaucugaugagguuuuucuuccaguggggguuuuuauauaauaccaaggcugugaaggacuguguguagcaaagcugaccauccuaguuguagugguuugaauaugcuuggcccaugggaaguggcacuauuaagaggugugacuuuguuggaguauguguggcccuguugaaggaagugcagcauuguggugggcuuugaaacucugcucaguguggaagagucagucucuccuggcugcagucagaucaagaugcagaacucuaagcuccuucucuaguaccauguaugcuugauguugccaugcuuccugccauaauaauacuagauuaaaccuccaaaaacugugagccagcuacaauuaaaugucugccuuuguaggaguuacuugggucaugcugucucuucacaacaauaaaaccuuaaaaagucagaaguugguaccagggacuggaguauugcugugauaggccugaccauuuuuuguuuguuuguuuguuuguuuguuuguaagaauguagaauuugauauuuuggauuuggaaauccauggaaggcuuuaagugggacuuaaugggacaaccuaguagaaauuuggaagacauuagugcugagauugaauucaacucuggagauaauuuuuaugauauuuuggugaagauuguggcugcuuuuugcccuugucugaagaguaccugaggcuaaaguaaagagauuucaugauugcauugacaaaguaagucucagaaaagcccaucauacauagccuuuauccucugguuuauucucaugaagaacacuuugaucaagcauaggaagcuuagaaagaaauaauacaaaauguaugguucaagcauuaaaggggcaccagaaaguacagugcagcuaaauccuguguucaaggagauacacagauggaguggugacuuuggggcaagauuccacccagcuaagcuuauuguuugcauguuugcgguugaacaucggauacuuauacuacuacgaccugguaauugcuuucauuuggacacaaagagauaugauugugugucaaauugacaugggaugacacaagcuuuugaacuggaucuugagacauagucacuauaaagagcuuauauccagguguggugguacaugcuuuuaauuucaggagacagaggcaagcagaucucugaguucaaggccagccugguacagugcaaguuccagguaaauuaaagcuuccauuugggucugggccggugcccugagccgaccuugugugcuaacuccacagccagucccacaacacccagaagaagcuccacucccaggcacucuaacacucccaggaccacagaauggaucacaggagcuuugucacaccaggaucucagggucccaaaggcagcuugaaccccaggagcuuugacacacccaggaucuugggaucacaggauccuagaaucacaggaucacagaaacagcugaacacugaggaguucuggcacaaccagggucacaggaaggauaggcuccaaucauauauagugaaggcagguagcacuagagacaaucagaugguaaucagauagaggggaggcaagcguaagaacauaagcaacagaaaccaagguuacuuggcaucaucagaacccaauucucccaccauagcaaguccuguauacacccagaaaagcaagauuuggauccaaaaucauuucucaugauggugauagaggacuuuaaggaggacauaaauaacuuccuaaaagaaauacaagagaacacagguaaacagguaaaagcccuuaaagaggaaacaaaacuuccuuaaagaauuacagggaaacacaaucaaacaggcaaaggaaaugagcaaaaccauccaagaucuaaaaauggaaauagaaacaauaaagaaaucacaaagggagacaacccuggagauagaaaaccuaggaaagagaucaggagucauagaugcaagcaucaccaauagaauacaagagauagaagagagaaucucaggugcagaaaauaccauaaaaaacauugacacaacagucaaagaaaaugcaaaaagcaaaaagcucccaacccaaaacauccaggaaauccaggacacagugagaagaugaaaccuaaggauaauagguauagaagagagugaagauucucaacuuaaagguccaguaaauaucuucaacaaaauuauagaagaaaacuucccuaacuuaaagaaagagaugcccauuaacauaaaagaagucuacagaacucgaaauagacuggaccagaaaagaaauuccuccugacauauaauauucaaaacuccaaauguacuaaacaaagaaagaauauuaaaagcauuaaaggaaaaaggucaaguaaccuauaaaggcagaccuaucagaauuacacuauacuucucgucagagacuaugaaagcuagaagauccugggaaaucucauacagacucuaagagaacacaaaugccagcccaggcuacuauacccagcaaaacucucaauuaccauagauggagaaaacaagauauuccaugauaaaaccaaauguacacaauaucuuuccauaacucgagccuuacaaaggauaauagaaggaaaauaccaacacacggaggaaaacuauacccuagaaaaagcaagaaaguaaucuuucaacaaacccaaaagaagauagccacacaaacauuuccaccucuaaaaacaaaaauaacaggaaguaacacuuuuccuuaauaucucuuaacaucaauggagucaauuccccaauaaaaagacauagacuaacagacuggauaugaaaacaggacccagcacuuugcugcauacaggaaacacuucagugacaaaaacagacacuaccucagaguaaaagguuggaaaacaauuuucuaagcaaauggucccaagaaacaagcuggaguagccauucuaauauugaaaaaaaaauaaaaucuugauaaaaucaaguuucaacuauaaguuaucaaaaaagaugaaggacacuucauacucaucaaaggaaaaaucuaccaagaugaacucucaauucugaacauccaugcuccaaaugcaaggacacccauauuuaugaaugcaacuuuacuaaagaucaaagcacacaucgcaccccacagaauaauagugggaaacuucaacaccccauucucagcaauggacagaacauggaaacagaaauuaagcagacacaguaaaacuaacagaaguuaucaaccaaauauuuauagaacauuuuauccuaaaacaaaagaauauaccuucuucucagcaccucacaguaccuucuucaacauugaccauauacuuggucacaaaacaggcucaacagauacaagaagauugaaauaaucccaugcacccuaucagaucaccacagacuaaggcuggucuuaaauuacaacaaaaacaacggaaagcacacacacacuuggaagcugaacaauguucuacucaacaauaacuuggucaaggaagaaauaacgaaaaaaauuaaagauuuuuuagaauuuaauaaaaaugaagacaugucauagcaaaacuuaugggacacaaugaaagcagugguaagaggaaaacucauagcucuaagugccuccaaaaagaaacugaagagagcuuacacuagcugcuugacagcacaccugaaagcucuagaacaaaaagaaacaaauacacccaagaguaguagaaaaaggaaauaauauaacucugagcugaaaagcugaaaucaaccaaauagaaucaacaaaaucaggagcugguucuuuaagaaaaucaacaagaucaauaaacccuuagccagauuaagcagagggcacagaaacaguauccaaauuaauaaaaucagaaaagaaaagggagacauaacgaaauaaaucuuaaaauaauuauucuguuuguuaagaguuaacaguugaaaaugcagaucucuugaguuuaaugucaaucuacagagcaaguuucaggucagccaagcuuaggcaaagaaggaguuggaaaacagaaagcggggguggggggguggggucaaggggggauuuuccagccccagcaagcagcaaaauucagcaacuuuggccacaaagcucuggcuugagagucaagaauagaagggauuacugggacaauugaugcuggugagcuggagcuaagaaauuagcagugauuaagaagagaccagcaucaccgaggucaaaucuccugggaguuguguuuugagagugcaaagaagccauguuucagagauagccaaaguuguagcucaugcuacagcuggacuugguguaagaaucaccccaguuguacugguuuugaaggcaugaagaaggugucauggaaagcagcugagguuuggcacugugaaaguccauggaaggccauugguaaaggugcagccucaguugcaguugaugucccaggacugggggucauacaaggaaauugaagcuugucaccaugaauggaaccuaugaaaggcuauugguaaauccuaguugcagcagaagaccucagcauauuggagaugucuguaccaugagaugaucaccaagaacagcagcagcaguguagugaagucaaacaaagacuagggugguacagagggcagagcuggagaaaugacccaagcccuuuagaggagcccagaaaaucaugugugaguccccaaaauuggaaaaagaauguauaaaguugccuuggauaccccacaauaguagagauaucagagccaugggauacuugcugaggaaagcuacuaacagggagucaucaacacugaaaggaauuggagauccacagaguuccuugacaucagacauggagaugcugacuuuggaguuugcccagcuggcuuuuggcuauucuuugguccaguauuucuucaauaugauguuucagaaugguaauguauauucuuugauguuggaaguaugugaucugcuuuuuuauuugauuuuauagguaauuacaauuaagacauugcaugaaucucagaagauggggacuuuugaaauuggguuaaauauauuuugcauuauguuauggcuaguuguggcccccauagacuuaugcguuuaaauaagccuuuuggggucagagagugaaauaugacccaugagaaguggcacuguuaggagguguggucuuguuggagaaagugcaucacuguuggcguggccuuggaagugccacccaguuggggaagagucugucucuccuggcugcagucagaucaagaugcagaacucuuagauucuucucuagugucaugucugccuagaugcugccaugcuuccugccaugaugauaauggacuaacuucugaaacuguaagccagcuacaauugaaugccuaucuauauaagguugcuugggucauggcaucucuucucagcaguaaaacuguaagacacuagcucuauaucuuuuuuaaugaaaucacaguucuguugaauuagggccuuaccuggucccuuuaucugguuccgcugcccccaaagauuucaucugcaaaugcuauaaguuuugauggcagcauuaaagcuguauugugguagaaggagagaaaugcauucgugacuuuccaaggugguuaaaagucaucuuguuagcacguaccucagcaguaguauggauguaagcagaagagaccuuauaggaucuuucuauggcaucuuucuguggaagaacauguacuuaguaggcacaagacacugguuacaacuguuagugagacagugaaacaacccaucagucuaaucuuuaguuuucuaugugggacagcaaauaccaaaccaaaaaaauggccucucuaggguagcauggguacuuauuagucaagcuggaugagacugcuagucagccauccauauucuuugucauucauaucacuguggguaagaauaacuucuggcuaucauuucuuuagucucuucucccucuuccugguccucaaguugaacuuccuauucugguaaggccuuuuuguguuaucccaauaaacuuaauacaguuaauuauuauaaaccagaaaaacacauuucauaauuuuaaaagguacauuuauuuauaauuggccugugaguaugggcugugucuuaguuaacguuuuacugcaaugaacagacaccauggccaaggcaacucuccuaaggacaacauuuaacuggggcuggcuuacaucaucaagcugggagcauggcaguguucagacaggcauggugcaggaggagcugagaguucuccgucuucuucugaaggcugcuaggagaagaguggcuuccaggcagcuaggacaagggggcgggguuccuuaaagcccaugcccacagugacauguacuccaacaaggccacaccuccuaauagugccacucccugggccacacauauucaaacaaccacagguugugucuguguuugcgaccagauguaugggggcacauauaagucugcucaucuguggaagucaggagaaaacaucaggguugauguugucuuccacugggaucaaaccccauucuucaaagaucuuuaaccauuaagccaucucauuggccccuucagcaucuucugaaugaucuagaauagcaacagagcuacaugagugcuguuggacaucaggauguaagcagcacauauguuggaugaggugcaggcugauaucuguugaaugguuaugucagcucuucucucaggucuuacagaaggcuuaaugaaaauacuacagcuuuuucucauguacuuagcagaucaccaccacaugacagagcuagauauccaacugugugugcaggaagauuucaacaguugguuuaaaauccauaaacaggggagcuucagccacugcucugcaucaggaugacuccuguacuuucuuaaguucugaccucauuuggaguguugugguuugagggagaacucagcuugugucagucauacacacagcugggugcaccugguauagcugcugucuucuugcuccccagagucgccugugcagagaacaugggucccugacuacacuggguacaacuuuuaugcuuucccacuucuccuggggaaucccuucccucagaugaacacuguuuaaagcagugcagcagaaugugcaaaccauaguuucugccaaguugagagaguuguuucuugggacuccugugucuuuguuuagaguguucuggaauacacagaagcaucuggcaacauauacuuuccucuguuuauccccaugaggaaggcuauguguguaucucucucacccuuuuuuguaacauuccuggcuucauuccaugguaauuuucugcuaacugcuaaagacagcagugcccaguuucauaaugaaggacaggcagugaauggucuccuuuuuaugucuauagaaggauuugugauuccuuuauuuaguugagauuuuuggaagaaucuuuaaugguuucuucuggccuucagaaugucuuuaaguaucuuuaaaucuuuaaaauuguugaaacuccaauuuuguagaguaaauaggcaucuauuuauuauuaaaacuucuccauuuucuccuucagaucuaggcaauguauuuuauagcccuuaaucuacauucacuuaagaagaaaucaaagaccagugugugagguccugcuacugaggcauuggugauaagucgaccucugguguuuguguaaagcaucaucuccccccccccccccccccccccgcccaguauauuuaaagaaaaguuagccaucgagccugcacaucauagccacaaccaggcuucagcagaugcuggagaucacuugcucccacguuugugaaacagacaaagggcugagccauuugcagagaugcuggacuuagcagcaugagaaacgugacagagcaccuugcuccugcuguauuuuggaacuccagaucuugacaaggguucauuugugugccagggaaaguagggcaagguagaaauaaggggaagacagaguucugugucugaagacagcaugagcuuucauggcgcccugcccgggccucccaucccguucucaaaccugugcagugcucagaccgcauaguauccuccucuuuccaccucagaauugagaaguagaugcucaagugagaaaaugaacugagaagccagaaauggcagcacggagcugcuggagagagcuuggaugcucuauguucaccugcgggagcugaguggcagcucaaacagaaucugaccaggaaagugggagagccccacccccuccauuaccguuugcugugcucugggaguuaggaaggcgugccuuaagagcucgaguguuugaacacuugaaaucuuggcuccauauacugcaccaguuucucauucagcgucccugucuaauguauguaagguaaugcauguaagguagacuguaauaggauggaacuuauguuacauugaaacaagagcagauaucacgggauacuuaauguauguacuuacauaaacuuuuuuaaaaggcaaaauuaaucuguauucgugguagaagaugaggaguuacugaagcagggcccugacagguuuccugugguacuggcauguccuaauucuugguuuggaaggacuaugggaugacgugacagguaaaggccuccccuagugcagccuuacaauuuaacuuuguuugauccucagaacccacaaagagagggaggaagaggucugacuccacagaguccuucucugaccgucacauacacccugcacacccccaccagcaauacauuuaacguuaaacucacuggacuguguguugcaauugugugcccucuugugucaauguuacaauaaagcugaaaaugugggcaaagccucaaguucucacauacaaaauguaauagguugaugaauagaagaguagcuucccuccuuccuuccuuccuuccuuccuuccuuccuuccuuccuuccuuccuuccuuccuuccuuccaccuucucucccucuggcuuguucccucccugagaucagaucaagaccccaccgaagaugagggaacuauugguguuuccugggugaggcucagcaugaaaucugacugaguauacagccaguguccucuaguuguagagaugucugcucagugauucuuuaaggccuuucgguaggaugagggauaaguuacuuuggagcugugggcuccuuuucuuggggguauuuccaagcuauuacuucuugauuuagccaaaucaagaauuugccaugauauuuuguuucuguuucucacuuguaaauggaaauugugugccuuugcaaccugcuagucuucccuagguguagacgucaaagaagacugugggcacugauaggcuuugcccugcgcagcgacuguauucaucagccuuggggcugagaguagcuaguggaggagcuggauucugcuguguacagguuaccaugucucagcuuuccuucccaaccucuguuucuuauaacuuuucagagccuuagacaaacugaauggauuccaguuagagaacuucaccuugaagguugccuacaucccagaugaaacugcugcccagcaaaaucccucgccacagcuccgggggcgccgggggccagggcagcggggcucauccaggcaggcgucuccaggaucgguguccaagcagaaacccugugaccugccacugcgccugcugguucccacccaguuuguuggagccauuauaggaaaagaaggugcuaccauucgcaacaucacaaagcagacccagucuaagugaguauguggggaugguggguaucugucuuccccuuuguguucaguaucaggguuggaugcaggaacuugaugucucucuggacaaagccaggaguucucuucuacaguaccugggacuguggcaggggaagccuugucaccugaucaugcguuguuggucucacaugaauggaaagcaaauggcacuugcugccacagcgaugggaaaggcccuagcagacugcagggcuguguguagucauucucugccacuugucccccccccccccccccagccugaacugcuccaccugucagagaugaugguuccgugaagaauaguucauccacuagguguggugauacacaccugccucagguuccugagcauucuuuagcuauguaauaaauuugaagauagcuggggcuacaugaaacaaaaccaaaggggguuggcaaguuagcuccgcacaucaaaauacuuaccauggggaccaaccaccaccuguguuacaucccugcaucuugugauggaaggagagagcaggcuccugaaaguuguccucuggcuuuucagaaaauguuuuacaucuaucuaucuaucugucugucugucugucugucugucugucugcacacucgcacaugcaaguacacgcauaugcgcgcgcacgccugcuuauaguagccagaagagagcacuaggucccuuagaacuagaguucaagguugugugagcuuccuggcaugagucccggagacugaacucaguuccucugcacgagcaaucuuuccagccccucagaccucuuuccagguacagccaggcaugcccacucccauacucaccacacacacagacacagacacacacacacacacacacacacacacacacacacauacacacacacacacagaaaaagguucugucuuccagucuaauuuguucugugauuaagcugagcuaggaauggccuuuuccugaggauguuugauguuauuugucaggcuguaagggagcagaaagucaugaucagacaucagaacucacuuggguggagucaggcaggaacuaaugucauuuucaucacagcuucaguguacagggccacugccugauacacaagaagccacugcauuuucaaaucaaaauagcugugcacgaauuauguuugaaaccuaaaucuaagguccugucucagauugcaaguuccaucacauaacagguuacuuuuuuuauccuucaaaccauacuuuguguaaucuguagauauuucgauucaaagaagcuugaugauaaacucugccuccacucuuuccucuguagagugccacacaacagacacaucgcuggcccugcugagccaugcucccuggagaacugaagcauucgcuagggaggaaguuaguggggggagggguuguaugcaaaccccaucuuucugcagcuugacccgucuacaggaaugacuggauggguuuacuuuuuagauuuaguaagaauaaggguuucaugugauuagagaaaucaaacauggucuuuuucugaaaauagcacgguggugugcugugucuaccugugccugaguguguuccaugggccucagagagagauucauauucaucacaggugccuugccugaagccaacugggagauucaucucaugcagaacguaaacgaauuguagcuagugaugggacauccuauuuugcucaccccugcuuugaagcaagagacacugaguguuggauacccaugugcaaaauuaaugauuccaaauucauaguuaguguguugggaaaauaauugaaccauugucuagguuaaggccuuucucaguuuuccaugugauuccuauuuaccuaagaaacuuauauauccuucagaaacuggucuguaagguucaaaucaagcauuuuuugauaauaaauccuuuaaaaaugcauucauugguauucaugugauuuugccaucaauuaaagaugaaaacugauuuugcacaguaaugagauagaugccuuguuggcugccgcaugaagaauuagaucuuggcagagugguugaccacuagaucuuggcagagucaggccauaggguggcuucagguuuugcacagcggaucggugcuuugauucucuccuccgugcugcgcaugcugcaucacauaaauauguaggacaaaauggcacaaguguauuuaggcccuucuaaaaguuguuggaaauucugucccaaucccaagccaaaaaucauuuaaugaauuuuuuuuuuaaugaaacucaaauugacaacucaaacaccaauuucuaaaaucaaauauucuuacacagugcaauucagaauaugccaguuugauguauguuggggaacgaugguaggaaagugucaaaagucguuguuuccucaauuaagguuuauguuucuaagaacaauggcucugcacauaacccugcaucugaggugcuggaggcaguguccgggcuguaaaggaaauacacacagggugcgugcgggucaaagugcgcaugugucugcucugaacuaaggcugcagugguuacaggauccauguccaagugcucccagaaacacaauggauucauuccacuugagauuaggaaaugaauuuuggucaccuccuguccagagaccuuuucuauuacaaaaauuuucacagcccucacauuuagugauggggcccaugugagguugugacccauagucuaagaaguuggaucgguuuaccuggcuuucaucuaacaauggagagagaggccuugucaccuuccaucccuuaccuuugggaacuuaguacacuguugcuucuugguguagcagcuucaguuccuuucuagacugcuaaugagaucugucagauaauggagucauaagcugaacuuaagguaggcagauggggcaaagcagaagggaguguuuuuguuguaucugaugaugcgguugcugaguggugcugguggauuuaaugcauucuugccgucauaacuaaucauuaccagaacccauguuucuggaauagucccaggggagggagcugaucacagagcaacauucgcuucucaggaucagaguuuuauagcccucagcccaguaaaaggguggaaauaaucaccaaaggaggggccaugagcauguuagaggacgaccgcauggcugaucgggacuagguuguaaaacugguuaggaagauaggauuggagcgauuaucuagacacacuuuaauguauuauauguuuauaguacuuacagguuuuaauucugagguaaguucuaauaaaaugaaaggcaagcuuaguuuuauuggcuuguugaaguggcuguuuuuguggcaguaaguccuuaagagaggaggaaacucaaaggaccacccagcaguugcuuagaugucccuaaaacacacgcuuagagguaguuaauguuuuuauaacagcaaucuuaauuccugguuaauuaaaauugaacaaaugcacaaauuuuuaaaagagugaauuagauucuugucaccccagucauuaaguuuuaggcuuuguaucuuuuuuguuuguucguuugaguuuuucgagacaggguuucucuguauagauagcccuggcuguucuagaacucacucuguagaccaggcuggccuggaacucagaaauccaccugccucugccucccaauugcugggauuaaaggugugcgccaccacugcccagcuagguuuuguaccuuuauauaggacuucuuaggugcaucugucaacuuguaacuagaucuuugacaaaggagauaagaccauccaguggaaaaaagacagcauuuucaacaaaugaugcuggugguuaucauguagaagaauucgaguugauccauucuuuuuuuuuuuuuugaauuaauuuuuuuauuagguauuuuccucauuuacauuuccaaugcuauccaaaaaguccccaauacacucccccccccccccccaaguugauccauucuuaucuccuuguacaaagcuaaagucuaaguggaucaaggaacuccacauaaaaccagagacacugaaacuaauagaaaagaaagugaggaagagccuugaacacaugggcacaggggaaaauuuccugaacagaacaccaauagcuuauguucuaagaucaagaauugacaaaugggaccucauaaaauugcaaagcuucaguaaggcaaaggacacuaucaguaggacaaaauggcaaccaacagauugggaaaagaucuuuaccaaucuuacauccgauagagggcuaauauccaauauauacaaagaauucaagagguuaguguccagagaaccaaauaacccuauuuaaaaaugguguacggagcuaaacaaagaauucucaacugaggaauaucaaauggcugagaaacagcugaagaaauguucaacauucuuagucaucagggaaaugcaaaucaaaaaacccugagauuccaccucacacuagucagaauggcuaagaucaaaaacucagaugacagcaggaugcuggcaaggauguagaaaaagaggaauacuccuccauuuuuggugggauugcaagcugguauaaccccucuggaaaucaguuuggcaguuccucagaaaauuagacacaguacuaccugaggacccagcaauaccacuccugggcauguacccagaagaugcuccaacuuguaauaaggacacaugcuccacuguguucauagcagcuuuauuuauaauagccagaagcuggaaagaacccagauguuccucaacagaggaauggauacagaaagugugguacguuuauacaauggaguacuacucagcaauuaaaaacaaugaauucgugaaauucuuaggcaauuggauggaacuagaaaauaucauccugagugagguaacccaaucacaaaagaacauacaugauauguacucacuuauaaguggauauuagcccagaaguucagaauacccaagauacaauucauagaccacaugaagcucaaaaagaaagaagaccaaagugugaauacuucaguccuccuuagaaaggggaacaaaauacccaugggagaaguuacagagacaaaauguggagcagagacugaaggaaaagccauccagagacugccucaccuggggauccaucucauauauagucaccaaacccagacacuauuguggaugccaacaagugcuugcugacaggagccugauauggcugucuccugagaggcucugccaguaccugacaaguacaaagguggacacucucagccaaacauuggacugagcacaggguccccaauggaggaguuagaaaaaguacugaaggagcuaaaggggguugcagcuccauaggaagaacaacaugaacuaaccaguacccccagagcucccaggaaauaaaucagcaaccaaagagcacaccuggagggacccaugccuucaguugcauauggagcagaggauggccuuuuuggacaucagugggcccagugcuccaguguaggggaaugccagggcgggaagcaggaguggguggguuggcgagcagggggauggggaggagaauuucggaggggaaacgaggaaaggggauaacauuuaaaauguaaauaaagaaaacauguaauaaaaacugaugcauggcauuuucaccuguuacuguggucuguaagaaguagcugcagguguagcucaguggucccuggucccuggucccaguguccugggcaccaucucugguaucgcauaagggaaaacagcuguaugagucauacagugguuuaaccaucgcuuucuaacgagcagaguaggaauuccaaagccgcuuuuguuuucuuaguggaauuaguccuacaaaaagcaucaccaccccagugguuucugaccagaggugacugauuucucugcaggaacauuuggcacuuucuagagaaguuuuugauugucacaucuggguggaggguacuauuauuaugucauaggcagaggcaacagcugcugcuagauucacagaaagaaugaacuuggcauaaaaugugugagugcugauggcgagaaauccacucucagucaaccugcucuuuggccuguuaggucagaaagggugaggaccugugagguggcucagcaggggaccggauuugcagugggagccuagccagaguuugacccugugaauccaagugagagcuggaugcaggggcagguaucaggccccagcacugcugcugggagaugggaggucuccagaaaacugcaggccagcuagcuuggagaacaaagcaugccagaaacaagagggaccucuuaucagugaaguggaacaagggcucggacuuucucugaucuccauccgugcauugugguaugugugugcccugcucauagacaucguccacaacaacaguacuuuuuaaaaucaaucaguguuauaccuucagcuggcccugccaguuugccaccaaaaguguggaucauccucguuacccuucacuucgacaguauuuuguuuuaugcaucucaaaauauuuacaggucuagaacaacaacaacaaaaaaucauguauuaauuggcauagauauaauuacuagcugguuuaaauaucgguugaguuuauuggcgacuugugcuugcucgcucucucucuccucucucuuugugugugugugugugugugugugugguguguguguguguauguguguguguucucagacaggguuucucuguguagcucuggcuguccuggaauucucucuguaaaccaggcuggccucaaacucggaaucuccugccccugggauuaaaggcaugcccugcugccaccugguuuuuucuuuuucuuuuucuuucuuuuucuuuuuuuuuuuuucuuguuuuuuguuuuuucaagacagguuuuuucuguauagcccuggcuguccuggaacucacuuuguagaccaggcuggccucaaacucagaaauccuccugccucugccucccgagugcugggauuaaaggcgugcgccaccacaccuggcuuucuuucuuuuuuuuaaaagccaguuagccaccucuuuaguugccuucccaucaccauuugcugcugccucucucugucaagaaggaaggacccuguuaacaaaagcuggaugaggaaagucugccacagagugacuggugaacagucugugucugacauggcaccaaccuggcugugggauucuggcucuggcucucuugacauacauaguucucugcaucucagucucucgacacuacacgauugcucugagcauauaaagggaagcucuaagcacacacagccuaggcagaaugagguccgugcuugguuggauugagaaagagagcauuccuggaauugcaguuugucuggggccgaggcugaaguucaguguugccuaguguauuaguuacaugucaguugcugugauaaaaccagcuuaaggcaaggcaggcuuucacugacucagguucuagggaagacgguugucguugccgugacagguuagagcaggagguggucugucacauuccaucacagucagguagcaaagaaggaugaaggcuccuauucacauugcuaucuccuuuuuacaguccagaaucccagaccaugaauggcauugccccuauuuauagugugcuuucuccaaucuauaaacucucaaacaugccuggaaauuuguuaccauggcgacuguaagccccauuaagaugacaguauuacccaccauaacaagaaugcaugaaacuucccagguuugcaugaacugggcgugguggugaaugccuguggucuuagcauucugcugucagaggcaggagaacuggaagucaaagcccuuucucacuuuguaggaaguuucagaccauccuggauacauuggaucuugucuuaaaacauaucccccacccaucuguaauguacugguguugacagcugaucauggguuucugcucuuuauuaaagcgggucauccuugauuccccuauuacuccuggggcuuacaguuuguaauugaagacuccuuguggugaauacacacugacuguucucauuuuccucuccucgugccugcuaucagaaucgauguccaucguaaggagaauacaggggccgcggagaaguccauuacuauccucucuaccccugaaggcaccucugcagcuuguaagucuauucuggagauuaugcauaaggaagcucaagauauaaaauugugaguaacgaggucuagccugugaagaggguucuuugcuuuguugcagauuucucugacacaguucuugggaauugcuaagcagcaaaggggaaugcuuucccgauaagauaguguugguuauucuugacuuggugugaaacauuaagucuuuuagaaacugaaauccuccauuuucauuuauacuuggauauggaacagggagccuugauggggaggagaugcagcuagaagaagccagcugggccauauagccagucgagggccucacccagacgggcccugggccguuccuggcagaccuugggcauucugucuuugucuguacccagcuccacuaugcacaguagggcagcauggaggugugaaagagccuaauccugugcuaagggcaacuggagcuuggucugggggaucagucuagagcugagugucucugccucagaaaguuagguugggucugugccacuuggauacacugaacagagcaaggaaggcuggaggagccagccugggaccgcauugcauuuacuuacuuuguaaaaguccacuguauguauguauguauguauguauguauguauguauguaugucugucugucugucuuagugauaggugcuuuguguggguauaauaaugcuuuuaggauaaaguaaagcgaagcccacugccguggaguccccuguggcguuuaaaaugcaggcuauguaacggggaagacguccagugggugaggugucugcugagugagcuucggguccuaggcucauggcaaagcuggcugcgcugguggccuuuguguaucucuagcuuuggggaaguagaggcagcagguccagcuucacugagagacgcugucucaaaagauaagguggugagcgauagaggcagacacgugacacuucuggccaacacacaugcacucgugggugaguacacaccuacaugcauguguauaaacacucauacugccuaaacauggaaagagagaaggaaagcagggcacaggacacagggagccagcuccauuucuuucugcucugcucuccccacgugcgaccacuguugaguuuguaggacuuguuuaucuccaaaugugugguuccagggcuauccuguccuugcacuuuggugcaauguuuuuuguauucgugcaguacuaugauuuauacauuguguuccacuuugacuaagagaaucuaucacugaguguagauauuaccuguuaugacuaaaagaaagacugucuuaaagaugaaccccuauguaaauaacugcuauuauuuacccccugacaugcaugaguugcgggaagguagguuaauggccagcugacuuuacaauggaacacguguaagguuucucacccugcagucuggaggaaauguuagcagaaggacauuugucuuuauccagugguuucuuuucccugacgcuaugaccauuuuucgauuuacagcacagaggagauucccuugaagaucuuagcucacaauaacuuuguaggccgucucauugguaaagaaggaagaaaccuuaaaaaaaucgagcaagacacggacacuaaaaucacaauaucuccguaagugccgucucguuugugagucagggacuuucauauccuguuuuuaagccucguguuuuguucacggcucccugcuuacagcuguuucugcucugcuguuaggcugagagcccguuucucagccugcugucugcccuguuucuaacaaucuugaaaguauuguguguucucacagggguggcaugcaucuuaauacucaacauucguauuuuccagccaaagucuuuaugguauuguuggcauuuauuucccaaguuggaauuuuaaccuaauuuauuuucauuugcuguauuacaaauuauucuaccauuugacagcuuaagacaauagucagcauguguugcguggcuuguuuauguggguuggcagcucaggaccucagcauggggccugggcacaggcugcucuugagcagcagagggagcgagccaagggagagaaggugcuggaagcugcaaugucuaugaugaaaccucagaagucaucacacggucuagacaagucagcccuuuuccauguguuuagggacuguagacuucuuuguggggggcauaauucuggagguguguaaucacaccuggguauaugccuacugugauaauaaggaaaaguuucucuuuuucuggggugauaauccuugguuucuaccauaggaccccagaaugugggaauuggccggugagcuggaaauggaugauaaaguuagaauacaaagugccugacuugggauggcuugagaauagaggcuugagugacauacuuccauggucuaaggaaacuuagacuccguuaaauugagcucaugccuucauuauauaauuuaauuuuaaacacauaugaggaaaaggaauaguagcccacccaucugacacaaguuuaguuucugccacguucccagcagcaaaaguggguguuuaacucugagaauauaaaagaugucacccacggccccguccuuugagucuagguaaaguccccuuccuguguaagaguugcuuuuccucucaaagcuguugacugcuguaggcaucagugugcacaguuauaacuucuccuggccuuuaaagcuucaguaggaccugagcgaagcaaagacuuuuuuaauauuguugucuguuuaggguuuaaguggggucaguauagaccauuuaaaaauuuagucuagaugcuugauuauguuacuuccuuuagguaacuuuaaucuaaacuccgaaaauauuggagaaaauugagcucacucacacagaugcugaucugccuuuggggagggcuuuacugcguccaccuccuuauuucaggaaacacaguugucagcggcuucugacuaggauugaccagaaaagucuaggugcuuccuggcagcaccaaacaucccuuugcucacuccuccucggcucacugucagggauggaaugaggggcucaacaaaugugccacgucuacaacacagacguaugaaaccaugugcccaguugcugcuauugagggaugggagggaggucacuacaagaucggauuugggucuuuggugcuugaucccacacuuucucauaaugcugagccagccauugugacagcugaaugacugucaccuguccuccugacauucuuguuuuuacucuccugcccauagauugcaggaacugacgcuguacaauccggaacgcaccauuacagugaaaggcaguguugagacgugugccaaggcggaggaggaaauaaugaagaagaucagggagucuuaugaaaaugauauugcuuccaugaauguuaguucugggguggggaggucauuguucugauggacagccaagaacugucuuuugcuaggaacucuuccagugcuucaaguguugugaguugucagcacagucccaagucccugagauggcacacaagccuuugcgcugggccuagcugucagugauuacuaacaaauuagguagcuuccgagccuuggcuucuugauacacaagggaugauuaauaccugucuaccaaaggguauuccuguguuaauuugaggaugugagcauuagagguaggagaauuaggcuuuauuucccgccaacaguuugugagccacagcuuucuucucuguaucagguagcugguaucuccuauuguacauggaaagcugagguggguggacugcaaggucaaguccacccugagaauguagagguccaugucuugaacaugguacagguugaggggccagugugccuucugugcuagagugcuugccuagcgugccucagcccugcacugcagagccauaaagcagaaacacaggcuugaauauuaccguguuacccacauaagccugcgagauugagaguucccuauggcaaagguagugaaggcuuugcaaauccuccugccacuauggcggaaugguucaggcaguggaacaguucagacgcccacuguguaaauuacuccuuaaaugugaggugagggauguaacgagcuucaguugggccugugguaggacauaguaacccgagaagggacagauauacaagcacccaaagcaucuauacacacaucuauaaacacagcggcucggguccucccaaaggcuuacugugaggcuggaccugacuugugaaggauucagcuggaggcucggaaugaagcuccugucccagcgcuuguucugaguaccugaugugaccucagaaguucuccuucagcagugcaggccucugaggcuguuuauggaggacccgcagugugcagagcaccauucugucuaaggugcucugagcugguggagaggggagggaccaugcuuccccuacuugccuugagacuccccagugcaguggaaaccugcccucaaauuuaacagugcugagaggcgucaacacuaccuauaauucggugggaauaccugcuguguuaaauaaacgagucuuaguguaguuuuuuuucuuuauuagacaaaaggucaccauuugaauugugacauuuacaaauacucacucccuugauucuuuugguggaaaacuaaaguuccucuuuacccuugcagcuucaagcacauuuaaucccuggauuaaaucugaaugccuugggucuguucccacccacgucagggaugccaccucccaccucagggcccccuucaacccugacuccucccuacccacaauuugagguaaguucuuaccgccacacugacgugccaugguaaugcugcaguccgagcuaagcgguaaaacguucaugccagcucuguguugugugaucuguuacuugucaaugaaaacuuuucauuugaucuccagauaauaagcaugaguuguucugaaguauuuggggugguagaauuaugcaaauaugucauuucaauaaaaaauaguuuugguggauuuauuuuguugguuugucuuuggugcaguacucuggggucaaggcugauaguuuuaauguuaaagcaaagagguuuuuaggagauuuccaugcuggacagugugcacacuuguaagugcacucuugcugagacaggaggauugcgagguugagauaaucugcuuuccacagcaagauuuugucucaaagaaaaauuucucuuuuauuuuuaccaccuagaauuuacuggauuuagaaggcccggauagacugggcuuguuuuccauuggguaucguauguuccuggucagugaaccgagggaguuuaucucacaguucuacugugcucauguauagaacauggaauagcuuguauucuguagagauuauauaacacauguguuuauuuauggagacaggacuuuuuaaaaaauguaugugcaugaguauuugcucucaugccugguacugacaggugucagaggagggguguuggaucuccuagaucuguagcuaugaauggccauuugggugccgggaauugaacccagguccauagcaggaacaauugcuuuuaaccacugagcuuucuuuccagcucuggcacagggauuuaauuguuuagacaaagucuuucuauguagcccaggcuuaccucauucgcguucucuuccuacccugcuucccuguguugugagccaucauacuuuuuguaaaucuuauuuugcuauccaguuuuugagaauagcuuugcagacgaaaugacaccuaucuaggaaaauucaucacugaguuugcaucauuggucuuuaauauucuagggucauccaugacggauuucuuucuccauuuguuugacgcucuuaauauagcuaccaugcaccuuaagagauguucaaguguuacaguuugagaauuuaacugugccacuaccuagaauaagguaaaucgacaaugguguucuucagggacucuagaguacuauccugucaacacuguaccauuucaaaaguaagaauuuccuuuucugucccugaaucuggugucacauuugugcuuuuacaugagcaaagccauggggagcaagccaguguuccucccuggucugcuucuguuccugccucuagguuucugccuugaaucuuguaucuuucucugcaacucaccugccauauccaguuauuuaaaccuggaaacuauguaacaaauugagguuggcuuuaacaguggugacuaaauaagcaccuggaagugauaguauguaugcacgguaucuucagccacuuggugggggugggacagacuaaagaagagaggacugcuugaacugacaaguucacaucacccugggcauccugaagaaccugcuccaguacaguguacacagauugucaacugaauaucaagucugaauggaucauacacaucauguaaagccuucagcucagauuuggguacuaugaaggagcuggcagcuuugcuccugauggugacuaucuugaggaaagaagauuggagucaccccaagucugaccuagcucugcuguaaauuuaugcugcugaaggucagacuccuuauugcccugggucuguuuucagaauggaaaaccuguagucucagccuccaguggcuggggcaugaauauugcugcgaguucuaggucagguugggcuacuugguggguccaggcaagccuaggcuacagagcaagaccucaaguugaaagcaaguaugguguaugggggauagagaggccuguguugaugcuaagcacuuaggaaauagaggcagauggauggaucucuggguucaaggccaguuaggucuacauagugaguuccaggagagucagagcuaaguacagacccuaucuccaugaucccccagaaagcagaguuuaaaacuacacaaaagcugggcagugguggcgcaugccuuuaaucucagcacuagggaggcagaggcagguggauuucugaguucaaggccagccuggucacagaguuaguuccaggacagccagggcuauacagaggaaccuugucucaaaaaagaaaaauaucccccccccaaaaaaaaaaacuacacaaaaacuuguguaauuuacuuauuuucuuaaagaauuuccuuagaauugccaauagaauuguaagguauuuuugugagguauauuuagguaucagagaaugcuaggacagguaaagucaaggccacaaacacucuggcuauaggaaagaaguguaacuuaguuuuugcuuuuuguaucccgauggugaugucuuuaaaaaacguugguuuuagggggcuagagagaugguuugguggauaaggguacuggcugcucuuccaaaggauccagguucaauuucuaggucaugacugccuguaacuucaguccuaggggaccugacaucaucaucuggccuccacaggcaccagacauacauacacacacacacacacacacaccaauaauaauaauaauaauaaacaaacaaacauugguuuuuaucaguccugugaaaguuagcaggaaauuuaagcuggaucuuggggugaggguucucuucucuuuuuccacccccuuguuuuuccagccuuccuuucuguacuugccuugcuguggucaucccucccuggugccuuucucacucauucacugcaguugucuguggaguucagcauuacuaucucccugccugaggugaaacuagcuuuucucuggcuauaauuucccccaggaauuguaauucuaguucccagguugauuagacuccccugggaagggcccugcccagcuucacuuugacagcuccccgggugacuuggucuguagugagacuggcagcagcagccacccacugucccacuuuccugaaucagaucucagugggagagggcagagcuugcacuguggcuuuaaguguugacaggagguuucuugcugcuugcucauugucaagagcuguuccacgagaguguuuacuaggcaggagaggagacacaauugcuggagguacacauauuuucuuuucacauuggugcaugugagaaaagauuugaggugagcacaaacacccugcugauguguucuucuuucuauccuguucuguuuuauuucagagaauaguuuaaaagccaccaccacgaccaaauaccuuuacccuuuuaucuugagagcagcugucauucaaacucuaggcauccaucaagcuaaagcaugucugugggagccgccacacguccauucucagucuucugaaucuacuguggucugcuguguagauggagacugugcuugccuguguguuaugggagcagagggcuagguccuggggucaaagguagacggcccaaagccagugcugagccuccuccucccaggacuguuuaacaccauucuccagcccaaaguaguuacucaggcucuagcuagugguuuucaguccagccagcaaagaaacaaaaaaugucaacgcuuguaagggcaguaucugaagccuguguugauauuuaacccuugagaggcacccagcuuugucuagcugcaaggaagcugggaagcaauuguucuagagguagcaguguuucuauuaaacauggguaggaaaauagauguuggagcagccauuccugucagucuagguggagugagccuuuucaccucuuaaaggaaacuccggagccugugaguucuuucagagagaaagcgagacucagaguuauaugggaggacauuuccugucauaguccccacaccuaugggcuauuuuuauugacgugcagaguauaaacagguguucugagaaucaucuuguguuuguggauaccaccugaaauaaauucugcuuucacauggaugucuaugauucucagcuuuauuucuaaauuuaaaucacugauaugauagucccccaguuugaauuaacccauaguugaccauugcuaauauucauugaggagacauaguacacucccuuguacagcuuuuuuucuguuuuguuauuguucuagugcauuucucucugguguaucucagaaguagcuauagagaaaccacaguguguauaggguuuugaagccucaguggccuucagcauccacuagaggacuugaaggcaggaaguaguauauauguaacuguacuuagcuauuuguacuugguaagugggacuacuuugggaaauacauuuuuuaaauuauuuuauaugcauauaaaauaauuggcuugcauaugucuguguaacauauguaugagaaggccagaggaggguuuuggauccccuggagcaguuguuucaaaagauuguaagacaacauguaaauucugggaauugaacucaggcugucuagagaagcagcaagugcucucgcaacugcuagccaucucuccaacccugaaacuagaauuuuuaaggacaacuguuaaauuuaccaaagccuuaccaguuuuguuuuguuuuguucuuuuuucagacaaggucucauauaauccagguuggccuugaacucacuguguagccaagaaugauccugaauuucuggucucaagcuucuuucucugaaguguuaggaucacaaguaugcacuacacuguuuaguuuucuguuggguggggauuggacucagggcuaugcacaugcuaagcaggcuucugcuaacugagcuacauccccaccccucagcauucccuugucuguuccuuuuguuauuaccucacugaagaauggaguguuguggguccugggaugagcuaaggguucccggcauuuacucugagaguggugaaggugacccucugccacacugaggugaccauauugugauaagaagcuugcuuucuuccuguucuuuccuguucugggcuagggagauagcucagugguagagcucuuuacugugcaaagcucuggaucugauugauguucaguuccaaaagaaagaccuugcuauuggcauuuaucucagagaauucaaaauacuuauuaaaaaccaucuucaucuuugauguuguguggguuaagagugaaucucugcuuuuauuauaaaugcauauugcuuguuaagaggaguuugugugugugugcacauaugugugagugugcauguauuuguagggugcacugcaucaaugugcacguggagaucagggaucgguuuugugcaucauccucuugaucucugcccuauuuuuuucuauuguauguuucuguguguucaugagucuauaugguauguguuuguguuucuuuauaugguguauguguacauguaggcaugcacauguguauggauguacaugcacuacagcucagguguggaagucagaguugggggugcagucuuagacuucauucuuguccgaggcagcugccugccucgccucggauccucaugcuuaugugacaaguacuuugggccacugagccaucucuguagcccuccaccuuauuuuuuggaguaaauuggaauaaaguuuuuuucacugaaucuggucucauuggucuggcucagcugucagccaguaagcuccagggaguccccuguguagaugaugcucagauguauaggugcaugcugcugugccugguuucucauaagugcuggcuuccaaacucaggcuuucauuuauugacuaacacaucucccuagcccugagaaguagauuuugauguguaaaccaccccccacccccacccccacgacuuuuuauggacuuuuagaauugucugucuucuuuauguagauuuauuuacuucugcugugugagaggaaugggcugucuguggauaaacuucuugccccuguuccauuccagaucucuacucacucauccuuccaaaguauucucucucccagaaccugugagguugauuucuccaaccagccaaagugauguaucuuucaaaagauuucagagagucucuaguucuugccuggaaccuaguucacucaguacuuaauuggcaagacccucguuuauaaaugacaggaaaugcuccuuucagaaaugcccaaacaguagggaagugagaguugccagccagaguacuagccaagagcuggagcuggcaacgugcaugcucggugucuucgcuggccauguuggcagcuugcaguuggguuggcaggaaucaaccugugggcucuugucuucauaaaccugguagcuucuuuacacucuucucugaaggcuccaagauaguaguuuggccuugagguggaaaguacaggggcaagaaagaugagugagcauucuuuguaggucaccagaggcacucuaagaaccagaccaaguuccugucuccuucuaaagccagguaggaucucguaguccuuaagauuuuucacugugggugcaguaaacauuucuaggcaaguaaaccacugcaucauacuugguuaugggggaaaacuuccuuuuucuuucuuucuuaagcuuuaguauucuguugaggucauagaguugaguaaacuucauuuuaguuccagacccaaaucuaguuaaaaacaacuccucccucccccaaguaccuaucuuagaggccaaaggaaaacaauggcacccugccagguuccugguggcugaucucuuggcugccaggcacgucuccaugccuuugugaugcccgaguuuguguugccugcagaguaaauacacuuaaccucacuguuugcugcugcguguaucuucucgauagcgggugauuaggaauuauucacuggcagacuucaccaguuacgcaaaugcucagccucacagcucugcucucguuauuucaagacacagagcagcgcuugccaagaguccgaaggaagcuuugccacaggcaucuggcagcaauccacugggaaguagcuugcgucccguggcugucuuucauccucaaagagucuaugcaggaauggguuuccuguguguccagggcagugaacccaaggagugagugugucagagaguguguguaggaacaggucuccuguguauucagggcggagaacuuguacccaaggagugagugugucagcaaguguguguaggaacgggucucauguguguucagggcggagaacuuguacccaaggagugagugugucaaaaggacgauguugaggggcuuuucuucugucugcuuaggucuguccaucaagacgaaauggugugcuuaucugggguagauccugaaaacagcuucucaaugcuggauuccgugugagaacacacuguacagacagucaaguggauagauguuuccacgagcugccugugccucagaggaaaauucccuugugaaauaauuuauggccagugagauggcugggggaacagaacugaagccaggggagaugggugauauucagaaacgcccucuuccagcuucagauggccgaugagucacugaagacauguugccaauagcgcacaugacuuacuguuugucuggggcaccaucuccuguaugaaaagcacaguuacuucagauuuggauugcucuauugggcaggcccucgugccuucagagcagcagcuucugucacgcucaggccagcagagacuccucacauugcacuuuguugcuguugugauauuguacucuggucauuucagcuguuccuuucccagagcuaauucaagagacaguucugaaauucucaccaagucauucauguuuaaaauucagccacaccauacccugcuucuuucuucuuugagacaggguuucucuaugaagcccuggcucugcuggaacuagcucuguauacuagguuguccuugaauucagagauccaaugccccaucuuuaaauuucuuacuguaaauagcuccuuccaucucuagagaugugaaccuauaacaucuucuuuaaagcacaaauuuguuuuauugcuuauuggugauuuaccuuuuucccaccauuguauuuuuauuucagaauuguugguggugucuauguguaugggugguuugcuugcauguaugucugugcagcacauaugcacagugcuuacagaggucaaaagaagaggguggaucucuuggaacuggugugggugcuaggaguugaaucugaguucucuggaagggcagccagugcucuuuaacagcugagauaugacuccagcccccacuauauauguuuuucaaaaacaaacuucuuacauguagcagguuccagaacaauaauuuauccuaacuauaggugacaaaaauguuuaaauaggaauagaaauagguccaauuaucucagccacaaggagcagguuccuuaagccugagcuuccuucuccaucucaguugcuugcacucuuuucugacaucuucauggcccaacaugacaccugugcccccccccccacccccgacucuuuggugucugucuuaggguuuuauugcugcgaagagacaucaugaccucuuguaaaggacauuuaauuggggcugucuuacaguuucagagguuuaguccauuauaaugguggaaagcauggcagcaugcaggcaggcaugguguuggacagguagcugagagcucuacaucgggauuggcaggcaucaagaaaagagagccacugggccuggcuugggcuugagcuucugaaaccccacagcccaucuccuagugacacacuuccuccaacaaggccacaccucccaguagugcccaccccuuaugggggccauuuucauuccacccccaccggugcuaacguuaagccuuccuggagcaggcuuccuguugucagaaggcgacuagagaagaagcugggggagcagcgguguugcuccauuagaacgcgcuccauugcuggcacugcaccuuggcauggccuugugaggaauuuggucaccgagcugucucugagugaccacugugugacaugagccuggagaaggcacacgugaccagugugaagcagggaagcacgaguccaucuguccacaaccuuucaggacuuagcuuucugauuucugaguucgaggccacccuggucuacagagugaguuccaggacagccagggcuauacagagaaacccugucucagaaaaaacaaacaaaaaaggacuuagcuuucaaaaugguuucuggcuauuuguggauaagaugccaagggagugcaaagaagugugcgggagggaagugucuuacaguguuuuguuacuaaaguaaauggguuucccuuuuaauucugucuuaugugugccaaguauagaaugguguguucucuccguauguaggagcuguuguuuaggaauuaaaagccuagaucaguagaagagccuugcaagcacaaguguucauccuugacuggggggggggggagggggggaggggaggcgagggagaaggaaggagagaaagaagggggcggcuaagcucuggacauccguauccuuuacugcugucuacuuugugauguguagucugaagccaccuugguguguagucuacauguuuuaaauauuaaaaaaagaaggcaaaggauaagucaaugagguuuugagacuuaggaaaacuuguguagcaaaggugagguuuuaaugacggguccuuuuaggaccaacuuuggcuugcuagguaagcuccgacuacuucuguacgguucuccaugaccugccgagcacuccuacuguaugagagugccugugcccgaggggaaggugccggggauuuaucuggcagcaaagaagcacucauguccuggcuuucuuuucuuacagcaaucagagacggagacugugcaucuguuuauucccgcccuguccguuggcgccaucauuggcaagcagggccaacacaucaaacagcuuucucgcuuugcgggagcuucgauuaagguacuguugugcacacuguggcucuccugguuauacaagaaagugaaaguggugggcugaaucaggacuaugacaggaacccuacagcaguggcuucauugugcuuaguuaacaucucucucagacaaauuggucuguggagaagccaacuggaccacaucuuggcaccucugagaucugacuuacaacuuccuucuagcucaucuccacuuuccgagcucuuaagagucacgucugcugggcgguggugugcuuuaauccuagcacucaggaggcagaucucugaguuugaggcaagucuaguuuacacagagaagccuugucuugaaaaacaaaacuaacaaacaaaaaccccaaaagcccuccccccaaaaaaaaccccaacaaaccaaaccaaacaaaaagagcuacauuugucacccagccaaugaggacaggggcauguagugaagucuuucccauaaguucauugcugugggauuuuuuuuuuuuuuugguauauuccauucuccgaacuuggccagucaaagcugaggagcagcagggaaaugaaguuuuguguugucaacuaagcauuuauugucuaaaugugggaccacuaguguuugucaaaagagaucacugucuaucugcagaaucuguauuuugauguguugaagcaauucauuauuagauaaaagggguguuugcaugcaugcgcaccgaugagagggugcuugagcauauguguauacauggagguuaaugucugcuggucccucagucacacgcacuuuauauucugagauagcguguuacugaccagccuacugacucagugggcugcugggcgagugaguuucaggauuccugucucugcccuuuccagcucugggcuguucauauggaugcugggaucuaaguauucuaccaacugaaccaugccccauccucggauucuugcauuaaaacaaagguugccaggugugauaaguucauagcuuucuucugaaaaccaucaguggaaacuuuuaaaagccccuuaauuugaaaaaaaaaaaaaaaaagauguaauacaauuucuguacaacauauagauuccacuucuggauaucuauccaugagaagugaagcuuagcauaagcuccucucccccaaagaaaacuagaauguuaauaauguuuuuauugguaacuauccuaaauguccuucaugugcagauaaaguguaauccuccaugcaaugagccugcacagcagaagccccugaguaacagagcauggagggaaccacgugagagaaaguucauguauuguggugauagaagucagaaaggaagcucucauauuauaugguccauuuauggaauaauucuggaaaaggcagagcuacagggacagcaaggacuucuggcugggccuggcuuccucuuugggugcuggguucacacucucguccuugugcucaccugccaucuccucuacccugaggcagauaucugguacuaccaaaucauaaucauuuaauguguucacuuauuuuuugacauugaaguuacucuuaauuuaucuacaauaaauaacacaacuuuguuucuuuaacagaagcuuauaugaauagacuugguuagucaaaggauaugaacccuuuuccauacuuuaagagaugguagccagccuggugguaggugcacauaucuuuaaucccagcauuuaggaggcagaggcaggcauaucucugugaauucaaggcuagccugcucuacagauaaaguuccaggacagccaaagcuacacagaaaaaaacaaccuuaaaaaaaucaaaaaggaagaaaggauguagaagccauauauauacugucaauguguacauucccuuagccuuggcucucuaucaugaaagaauuuaaaacaaaaaaaaccaaacauacaaaauagcuggaaugcuaaagaaugacaccuuuacaaaguuuucugucaacaaaaccccaggaauuuggacuaaaugcaaggaacuguuugcuuguuuuucagacucaaaacaagucagugcccugcauggaguaggucuagguaucagcuugacucuaggugacauguucuuacaugguuuuauaauguaacaauuagguuuuauuugcacagcaagugucagggucucucaguugaaccaagagcuuaucaauuaugcuguuuggcugccugguugaucugaguagcccauuucaucucuuggugauggaacuguauaagugagcauccacacuucagcccuugccauucauagcagacuuuuuacugagccaucuccuacacccaaauguccuuaaaauaacuccauaacuggguuacaaaccccuuucuugugacuuuggacaugcugguccucucccuauacauuucugcacuguuuccccagccugaacuuuugauuucauauacuccauggaaacugagaagucucaguuuaccugucuccuguucaguuaauacugguuaauggccuacauccuuccagugaguagacuugggagcaauuuacccagcagucuuagcaacagaaaguauacacauaguuuaagcaauccagagagucuuuuccccuuaaaauaagaagcaugcuaccuugacagcauuacccuuucucugaaagcuaaggagagaccauggauguguuagccucacaacuuaggagcccagagcuucuaacauguuaccgcacuucauguaccacuggaguuauaaccaagagcacaggcaguggacauauccagcucuuuuaacuauacaauuaugggucgggcccuuuaauguccccagcguucugugcucccauuguaaagugauuauucuuuagcuagauguaguauggguuggcucaguggcuguacaugaaguuuuagauuagagucaggcaccauuuuaauacucaguaaauagugugcuauaccugacuggcccauauuaaucauagccucuccauaauuccuuuccagaaggcauuuaauucugcagcucagucaaucaugugcagaugucaggcugguuugccuaagguuugucagugacacccgaaaguaucauaacuggcuggugaugggucuauuacagaucgcuccagccgaagcaccagaugcuaaagugcggauggugauuaucacuggaccaccagaggcucaguucaagguauguguuguggagggcacagggaacuggagggagcaagaugaugauguuaccuuccccagccccuguguaucaguggaaaucccaaagaucagacuugagccacacagaauuauuucacaaccaugaaccaagagccuuuaguuuugaguuuuguaaugguguugguuuacugucaccacugagaugguugggacuuuaacacuggcagagacacaccugcuugcuaaugaaccuuguaaaucuguuuuucaacaucccauucugucuuggagauggucuaaucuugaguuaaaguagccccuuuucucuuacuuucaccuagcacuguccuuggauuuugguuagaagguuagagcugugauggcaugagaucuggcuuuaacuacugaacauuuauguguaucuauggaccuauggagcuggaagaucucucuguucugaggugauggagacaaccuggcagcuagaccccuauuucaaauccuaguuuggccauucaccauuugugugaccuuagacaaguuacucuucucccauuccucaucuauagaauggacagaagcaucucucuccuagguagcuguacaauguacagugcuugacacaagcagcaccaccccccucugugcuccuggaagagccaacuccgaggcaguuggugaagccagucccaggugccuucauucuagugaacgguuaguguggagccguucuuaggcagcgaaguguugaguucugugaugguguugguuuacuaucaccauugggauaguuaggacuuucuauucauuaauccaguaccuacaucuuuuuauuuauuuaugggagaaaugggaggagcaugugcaucauggcauguuguggucagaggacgucugugagucagccgucucccacuaugugggucuggggacucuuuaccuacugagccaccuuggcagcccaacacuugaaucuuaguccuaugucccacuaacagcuguguaaagguaaagcauucucucuuaaccgcagucuccucugcugucucuuaacaccccguuauaccgcccaagcucaccccgcuuucucuacaugggaagaaagacuaaaccaggucuugcuaugcaggcgcucugccuugagcaauauugcagacccucuucuguuuugaaucagugaaaauccaaagcugcuucacaucacuuacagagagaacagaacaugcaaaugcuagugugaguaccacugccuccucaucaaagggacgcuuacccuaccccaccccagcagccucacaggccucagugcuugucauaaauuggaaauguuaaaaacuggcuaggaguacaauacagcuccuuucuagcacgugagaaagcacaggucugauaccugccauacgugcauguacguaugauacagauauacaugcaggcaaaacacucacacacaaaaguaaaauuuaaaaaaaagaauguauaaaagauuggagugugggaugaguuuugucuucuaauccuccaaaugagccuaauuagcauuucuagaccaaugaaaaucuggcuauuugggcuuuuauggcuuucuuggcaucuugucagauuagccaaccucccaacuuagaauuccuucccugaaguguaugagaacaaacucaugguugcacacaauaggagguuccuuauauaaaccaucucguuguacacaggacacauuaguucaguacuacaaguguacauuagcuugauuucuguagccuuucugggaggaaaugggagucaggcucuugcucuguagccaaagcaggccccucacuuguagcuacuauguucuuccuuggcuuccuaagugccgggacuacugacauaagagucauacccaacauguuagguucuauaaagcuguaaucaccugaggaagagcucuguuuaaguaaaaaauguuaauguuggccagugucugugcaauuuagacaugggcuuagcuccuugugagccucgugucucucacugugaaguucuuccuuaguuucuuuugcucaagaacaaugcaauuucugucuuauuuugagaguaggagaggcuuuaaagaccagagugugaauggucauuugccccaaagucauuuuuaauuagacuuccuuccuaaugccuuuauuuccagcauacagcuuacucuacacuguuacaaaugcauugaagcuuucugcccauacccuccucuugucaguaauugagucaccuugccugugaaaguuauugucaacccucucugagacuccuaacuacugucucugacgucagucuucauuccagauguugauguacaacuacaauggauauuccagguugauccaaacugucuucaaaguuaacugaccuuuuguuucaaguaugaaugauacugauaggauauauugucauuuguaggcucagggaagaauuuauggaaaaauuaaagaagaaaacuuuguuaguccuaaagaagaggugaaacuugaagcucacaucagagugccguccuuugcugcuggcagaguuauugggaaaggaggcaaaacggcaaguacccuagcagcagccugcugugcuggaaggaggcgcugcaggaacggagcuccaucccgggccuuuggcuaguuuauacaaagugggaccaucuugaccaagguugaagagguuuccuccuucugugaccugccaguauuucagacuaggacacuggcccgggacuggaaaggggcaugcagcauucucucacacacauaaccugaacuuucuguucuauaaaccuuaaaggacaggaagugaaguuuuacaaauauccucaaacugcaaaaaguaguuugcagccuuucucaacuaagccauuuccagaucucuaacuuuggaguaacauacaaccuacccugagcagaaccugaggaccugagucugguuuugcuguuuauuucuguaauggguuucuuaguuuuagucauguuaacaugggaacucuaacucugagaacuguuaguggauacacgagcucugugaaggcagagcuguguggcucacaggaggcgcuugggaaaucaacuuaaugcuuagugaugauuuuaucauugcaggugaaugagcuccagaguuuaucaagugcugaaguugucgucccccgugaccagacaccugaugagaaugaucaaguaguugucaaaauaacuggccacuucuaugcuugccaggcaaguggcuucuaaacugacagguucuuaagcuccaucacggugcuaccauuauaugugagccuuuaggugcucaugggucaguguugggugggguguugaagugugcuguuucugcuuuuacccaggcuagccuugaacuccuaggcuccagagacccccacaccucagcuucuguccuuaugcaccacugugcuuggcacaucuaguuuuccuuugagccagcacacuguuaaguauugggcacaaggacuucaacuugauguuguugcaguaacuuaguaacuuuguacugugcagauucuaugaaguucuguccuuuuguagguugcccagaggaaaauucaggaaauucugacucagguaaagcagcaccagcagcagaaagcucugcagaguggaccaccucagucaaggcggaaguaaaggcucaggagacagccaccacagaggcagaugccaaaccaaagacagauuugcuuaaccaacagacgggugcugacccauccagaaccacgugcacgaguuuuuaccuagcugguuguuuccgaggaccaggcacucgauccugucucugugagaauguauacuuuaugcucucugaaauauaugacacccagcuuuaaaaaaaaaaaaaaaaaaaaaaaaaaaguggggguaaggaaagagaacucugcacuucccuugugauaucaaaguauaacaaacgugcuaauuuuucuuaauaucccucuauaaugccagaaauuggcauaaaugguacauucacuaaauuuaucaaauaaauuuaaaacuagauuguuccuaaguccaauuguugaaauuggaucaaaguagaauugucagaggaacacaacauuaagccauuagaauagaagagcuguugucuccuguuucucuaacacuaacauggauaaccuaagggaagugccagccgcuguuggcaggguauuaaacgugcauuuuuacucaacuaccucagguauucaguaauacaguuaaaagcaaaauuauuccuuuuuugaaaauuuuauauacuuuauaaaaacuccaaccguuuuuuuaaaaaaaauaaaauuuaacaguuaucagcugauaggcaagucauugaaaaaguaauuuuacgucuggcuggugagaguaaaguuggaaaaauaauuuugcauuuuuugagccuuugaaaguuggaaaguccacuaacuguucaaagauaaggagcagugccuauucucaagagcagccaugccauguacuccuuuguuccuaucugggaagguuguugacgguacugaccaagcaggcaggggcugggacggccaguguacaggacagcuaggguaaaggacagcuaguguacagggcuccaggagacuuggggauuuguguuuagcuaugugugggaauuugcaaaugcuuugugcuuugacugucaccacgaaaaggaagaaauucaugucagugaagaaaugcagaauuuaaacaaaaucagcuugaguuuguuuuaccagaugcucagcuugcuaacacacuugagaucagaccauacucugagcagacauggaaaggauugcuuugugaagaccagggggagucaggugguaugacagggccgaagggcaacaaaaucuccauuuccuugugccuggcacugucucgagccuaagcuauuuuaaagauguuuuaaacaguggaagaauuaaguccaccaaaagucuuccaugaaauguagcagaguuucugucugcccugcauuaccugccagcgagucaagguaggggauccagcaaacgguuuugggaauucagacuguggaaacaucggacuucccuuugcccuuccucaacuuaguggcaaagcccuguauggauacuuguaggugcgggugauccucaaggccaugcugcuuucugaguuguucuuguugcuuuguucauaaugugguuacagucauauuacacugacccugaggguauuauguaacccuucagaaaaccacuuugccucauuguguuucaggauuaacuucuacaugccuuuaaguuuuucugaguaucagcauaucauuuagacauugugaaaaugaauuccuaaacauuuucauaaaaccgguuaauuuuguaguuuuagccaaaaagugcccccuuuuuacaacugaauucaucuagcauuuucauaugguggauuuaaacugcuuaaaaaagaaaaugugaccggcucuccugcuugggucucaggggagauaugcuuaaggccagagcucuuccucaguauuugauuuuuccaguguuuguuuuuuaaaaaacugacaggugcuacauuucuaucuguugguuucaauucugccauauuucaugucuagccuuuagaguggccaaucauguuuuacuuucauuuaagcacugguagucuggaguaccugguacugaguaacucuauaauuguguuuuguguucaccauauacagaucauuucucaucuguagugugccccaaaugcagcuucacuuuccagguacccugaugcagaauaaaguuuucaucauaaaccacagcuuc

SEQ ID NO: 2987 - RNA, 3869 nt, Mus musculus
cuccccccccccccagucaaggaugaacacuugugcuugcaaggcucuucuacugaucuaggcuuuuaauuccuaaacaacagcuccuacauacggagagaacacaccauucuauacuuggcacacauaagacagaauuaaaagggaaacccauuuacuuuaguaacaaaacacuguaagacacuucccucccgcacacuucuuugcacucccuuggcaucuuauccacaaauagccagaaaccauuuugaaagcuaaguccuuuuuuguuuguuuuuucugagacaggguuucucuguauagcccuggcuguccuggaacucacucuguagaccaggguggccucgaacucagaaaucagaaagcuaaguccugaaagguuguggacagauggacucgugcuucccugcuucacacuggucacgugugccuucuccaggcucaugucacacaguggucacucagagacagcucggugaccaaauuccucacaaggccaugccaaggugcagugccagcaauggagcgcguucuaauggagcaacaccgcugcucccccagcuucuucucuagucgccuucugacaacaggaagccugcuccaggaaggcuuaacguuagcaccgguggggguggaaugaaaauggcccccauaaggggugggcacuacugggagguguggccuuguuggaggaagugugucacuaggagaugggcugugggguuucagaagcucaagcccaagccaggcccaguggcucucuuuucuugaugccugccaaucccgauguagagcucucagcuaccuguccaacaccaugccugccugcaugcugccaugcuuuccaccauuauaauggacuaaaccucugaaacuguaagacagccccaauuaaauguccuuuacaagaggucaugaugucucuucgcagcaauaaaacccuaagacagacaccaaagagucgggggugggggggggggcacaggugucauguugggccaugaagaugucagaaaagagugcaagcaacugagauggagaaggaagcucaggcuuaaggaaccugcuccuuguggcugagauaauuggaccuauuucuauuccuauuuaaacauuuuugucaccuauaguuaggauaaauuauuguucuggaaccugcuacauguaagaaguuuguuuuugaaaaacauauauagugggggcuggagucauaucucagcuguuaaagagcacuggcugcccuuccagagaacucagauucaacuccuagcacccacaccaguuccaagagauccacccucuucuuuugaccucuguaagcacugugcauaugugcugcacagacauacaugcaagcaaaccacccauacacauagacaccaccaacaauucugaaauaaaaauacaauggugggaaaaagguaaaucaccaauaagcaauaaaacaaauuugugcuuuaaagaagauguuauagguucacaucucuagagauggaaggagcuauuuacaguaagaaauuuaaagauggggcauuggaucucugaauucaaggacaaccuaguauacagagcuaguuccagcagagccagggcuucauagagaaacccugucucaaagaagaaagaagcaggguaugguguggcugaauuuuaaacaugaaugacuuggugagaauuucagaacugucucuugaauuagcucugggaaaggaacagcugaaaugaccagaguacaauaucacaacagcaacaaagugcaaugugaggagucucugcuggccugagcgugacagaagcugcugcucugaaggcacgagggccugcccaauagagcaauccaaaucugaaguaacugugcuuuucauacaggagauggugccccagacaaacaguaagucaugugcgcuauuggcaacaugucuucagugacucaucggccaucugaagcuggaagagggcguuucugaauaucacccaucuccccuggcuucaguucuguucccccagccaucucacuggccauaaauuauuucacaagggaauuuuccucugaggcacaggcagcucguggaaacaucuauccacuugacugucuguacaguguguucucacacggaauccagcauugagaagcuguuuucaggaucuaccccagauaagcacaccauuucgucuugauggacagaccuaagcagacagaagaaaagccccucaacaucguccuuuugacacacucacuccuuggguacaaguucuccgcccugaacacacaugagacccguuccuacacacacuugcugacacacucacuccuuggguacaaguucuccgcccugaauacacaggagaccuguuccuacacacacucucugacacacucacuccuuggguucacugcccuggacacacaggaaacccauuccugcauagacucuuugaggaugaaagacagccacgggacgcaagcuacuucccaguggauugcugccagaugccuguggcaaagcuuccuucggacucuuggcaagcgcugcucugugucuugaaauaacgagagcagagcugugaggcugagcauuugcguaacuggugaagucugccagugaauaauuccuaaucacccgcuaucgagaagauacacgcagcagcaaacagugagguuaaguguauuuacucugcaggcaacacaaacucgggcaucacaaaggcauggagacgugccuggcagccaagagaucagccaccaggaaccuggcagggugccauuguuuuccuuuggccucuaagauagguacuugggggagggaggaguuguuuuuaacuagauuugggucuggaacuaaaaugaaguuuacucaacucuaugaccucaacagaauacuaaagcuuaagaaagaaagaaaaaggaaguuuucccccauaaccaaguaugaugcagugguuuacuugccuagaaauguuuacugcacccacagugaaaaaucuuaaggacuacgagauccuaccuggcuuuagaaggagacaggaacuuggucugguucuuagagugccucuggugaccuacaaagaaugcucacucaucuuucuugccccuguacuuuccaccucaaggccaaacuacuaucuuggagccuucagagaagaguguaaagaagcuaccagguuuaugaagacaagagcccacagguugauuccugccaacccaacugcaagcugccaacauggccagcgaagacaccgagcaugcacguugccagcuccagcucuuggcuaguacucuggcuggcaacucucacuucccuacuguuugggcauuucugaaaggagcauuuccugucauuuauaaacgagggucuugccaauuaaguacugagugaacuagguuccaggcaagaacuagagacucucugaaaucuuuugaaagauacaucacuuuggcugguuggagaaaucaaccucacagguucugggagagagaauacuuuggaaggaugagugaguagagaucuggaauggaacaggggcaagaaguuuauccacagacagcccauuccucucacacagcagaaguaaauaaaucuacauaaagaagacagacaauucuaaaaguccauaaaaagucguggggguggggguggggggugguuuacacaucaaaaucuacuucucagggcuagggagauguguuagucaauaaaugaaagccugaguuuggaagccagcacuuaugagaaaccaggcacagcagcaugcaccuauacaucugagcaucaucuacacaggggacucccuggagcuuacuggcugacagcugagccagaccaaugagaccagauucagugaaaaaaacuuuauuccaauuuacucca

SEQ ID NO: 2988 - RNA, 3869 nt, Mus musculus
uggaguaaauuggaauaaaguuuuuuucacugaaucuggucucauuggucuggcucagcugucagccaguaagcuccagggaguccccuguguagaugaugcucagauguauaggugcaugcugcugugccugguuucucauaagugcuggcuuccaaacucaggcuuucauuuauugacuaacacaucucccuagcccugagaaguagauuuugauguguaaaccaccccccacccccacccccacgacuuuuuauggacuuuuagaauugucugucuucuuuauguagauuuauuuacuucugcugugugagaggaaugggcugucuguggauaaacuucuugccccuguuccauuccagaucucuacucacucauccuuccaaaguauucucucucccagaaccugugagguugauuucuccaaccagccaaagugauguaucuuucaaaagauuucagagagucucuaguucuugccuggaaccuaguucacucaguacuuaauuggcaagacccucguuuauaaaugacaggaaaugcuccuuucagaaaugcccaaacaguagggaagugagaguugccagccagaguacuagccaagagcuggagcuggcaacgugcaugcucggugucuucgcuggccauguuggcagcuugcaguuggguuggcaggaaucaaccugugggcucuugucuucauaaaccugguagcuucuuuacacucuucucugaaggcuccaagauaguaguuuggccuugagguggaaaguacaggggcaagaaagaugagugagcauucuuuguaggucaccagaggcacucuaagaaccagaccaaguuccugucuccuucuaaagccagguaggaucucguaguccuuaagauuuuucacugugggugcaguaaacauuucuaggcaaguaaaccacugcaucauacuugguuaugggggaaaacuuccuuuuucuuucuuucuuaagcuuuaguauucuguugaggucauagaguugaguaaacuucauuuuaguuccagacccaaaucuaguuaaaaacaacuccucccucccccaaguaccuaucuuagaggccaaaggaaaacaauggcacccugccagguuccugguggcugaucucuuggcugccaggcacgucuccaugccuuugugaugcccgaguuuguguugccugcagaguaaauacacuuaaccucacuguuugcugcugcguguaucuucucgauagcgggugauuaggaauuauucacuggcagacuucaccaguuacgcaaaugcucagccucacagcucugcucucguuauuucaagacacagagcagcgcuugccaagaguccgaaggaagcuuugccacaggcaucuggcagcaauccacugggaaguagcuugcgucccguggcugucuuucauccucaaagagucuaugcaggaauggguuuccuguguguccagggcagugaacccaaggagugagugugucagagaguguguguaggaacaggucuccuguguauucagggcggagaacuuguacccaaggagugagugugucagcaaguguguguaggaacgggucucauguguguucagggcggagaacuuguacccaaggagugagugugucaaaaggacgauguugaggggcuuuucuucugucugcuuaggucuguccaucaagacgaaauggugugcuuaucugggguagauccugaaaacagcuucucaaugcuggauuccgugugagaacacacuguacagacagucaaguggauagauguuuccacgagcugccugugccucagaggaaaauucccuugugaaauaauuuauggccagugagauggcugggggaacagaacugaagccaggggagaugggugauauucagaaacgcccucuuccagcuucagauggccgaugagucacugaagacauguugccaauagcgcacaugacuuacuguuugucuggggcaccaucuccuguaugaaaagcacaguuacuucagauuuggauugcucuauugggcaggcccucgugccuucagagcagcagcuucugucacgcucaggccagcagagacuccucacauugcacuuuguugcuguugugauauuguacucuggucauuucagcuguuccuuucccagagcuaauucaagagacaguucugaaauucucaccaagucauucauguuuaaaauucagccacaccauacccugcuucuuucuucuuugagacaggguuucucuaugaagcccuggcucugcuggaacuagcucuguauacuagguuguccuugaauucagagauccaaugccccaucuuuaaauuucuuacuguaaauagcuccuuccaucucuagagaugugaaccuauaacaucuucuuuaaagcacaaauuuguuuuauugcuuauuggugauuuaccuuuuucccaccauuguauuuuuauuucagaauuguugguggugucuauguguaugggugguuugcuugcauguaugucugugcagcacauaugcacagugcuuacagaggucaaaagaagaggguggaucucuuggaacuggugugggugcuaggaguugaaucugaguucucuggaagggcagccagugcucuuuaacagcugagauaugacuccagcccccacuauauauguuuuucaaaaacaaacuucuuacauguagcagguuccagaacaauaauuuauccuaacuauaggugacaaaaauguuuaaauaggaauagaaauagguccaauuaucucagccacaaggagcagguuccuuaagccugagcuuccuucuccaucucaguugcuugcacucuuuucugacaucuucauggcccaacaugacaccugugcccccccccccacccccgacucuuuggugucugucuuaggguuuuauugcugcgaagagacaucaugaccucuuguaaaggacauuuaauuggggcugucuuacaguuucagagguuuaguccauuauaaugguggaaagcauggcagcaugcaggcaggcaugguguuggacagguagcugagagcucuacaucgggauuggcaggcaucaagaaaagagagccacugggccuggcuugggcuugagcuucugaaaccccacagcccaucuccuagugacacacuuccuccaacaaggccacaccucccaguagugcccaccccuuaugggggccauuuucauuccacccccaccggugcuaacguuaagccuuccuggagcaggcuuccuguugucagaaggcgacuagagaagaagcugggggagcagcgguguugcuccauuagaacgcgcuccauugcuggcacugcaccuuggcauggccuugugaggaauuuggucaccgagcugucucugagugaccacugugugacaugagccuggagaaggcacacgugaccagugugaagcagggaagcacgaguccaucuguccacaaccuuucaggacuuagcuuucugauuucugaguucgaggccacccuggucuacagagugaguuccaggacagccagggcuauacagagaaacccugucucagaaaaaacaaacaaaaaaggacuuagcuuucaaaaugguuucuggcuauuuguggauaagaugccaagggagugcaaagaagugugcgggagggaagugucuuacaguguuuuguuacuaaaguaaauggguuucccuuuuaauucugucuuaugugugccaaguauagaaugguguguucucuccguauguaggagcuguuguuuaggaauuaaaagccuagaucaguagaagagccuugcaagcacaaguguucauccuugacuggggggggggggag

SEQ ID NO: 2989 - RNA, 20137 nt, Mus musculus
ucccauuuucaaauuaacuuuuauuugaaauuacucuuccccacauguauuuuaggauccuauacaauaacccauguaaccaaugucccaauaccaaaauuucuaacagcaaguuauacaauuguucuaguuaauaaauaaagguuguccuucagugauuaagggaauacuuaaguuucuguaaauuuaacauaaaaaucacacuuuaaguuuauaagguuuaacauguaaauucaaauacaacaugucuuauaggaauuacaagcuuuuaauuucuaaaaggugacuuaauucuuagguucaaaguuauauucuucaaaagaaaugucccacauuuucuccuagagcuucaaacauucuacacucaacuauucaacugcuccaugccacuccagacaaagcuggcaugacugaccuacuuaaaguguuauuuaccuuccccaagaagauuaaaaagcaguuuaucauaccacagauuucuaaugucuaccacaauauccaucagaaaaaguuuucaaaagaugguuucuguccucaaauaagaagucaauccucuguaaaggcaaagaagaaccacaaagcagaacccgggcucccuuucacucaggauguucacuacugaaaagacaauuacaccuuuagaguauaacaaaggguggaaacagcaacacaacuggucaggcagagauuaaauaaaccagguuguuugguuuugguuuaaaggacuaggaagcauggaagcuugggaauccaaaaucaaaaagaagaaaaagcaaaguccucgggcacaaucacuccaguaucaauagcguccugaaauagaacaaagagaauuaauuacagucugacuggucuaauaucuucccaauauuaacagcaaccacauaucccaaaguacaccacugcuuagaaagaugguuucaauucuacagaaguaaaauuuacauacuuggacuauaggaacgggaucucgaucgugaccuguagcgacuguaguaaggagagggcgaccuucuucuguaagaaaugagagcugaauuaguacaucacauaaccacagucaggugaaaacaaaacaaaacaaaaaaaaaaaaacccuagccauuagaguagugcagguuuuuaaucucaauacuuggaagacaguaucuguuaaugaggccaggcugguuugcacagccaguucuaagccagucagggcuacauaauugaggccaugucuucaaaacaaauaaaccaaccaaaaacucaacaguacuaaggauugagcccaggaacauaauacuggagaaucauaguuccacugagugacacacucagcucuaaaaucuacuccagcuccugccuaccccacccgaaaauauauaaaaaaaaaucaccaaccacguugacagguugggcuuaaaugauccuaucuuuguuucucaaacaaccggcaccacccagcuaccagaccuggcucaaacauccaguuuuuuguucauacauauucaacauuaaagugcuaaauaaugcuacuauuuugcaaaguauauauaucccaaauuaaaauauuaccuguaccgguaaucauaaucuucguaucugucauagccucgaucauauccucuaucguaguaagaaucucgucgucuaccaccgccaccaccuccuccuccgccaccuccuccuccgccaccuccaccaccgcugcuacagaaaaaugaagggggaaagguuauuauccagaucauuucauacugggacaagagagaggagaaggaaccuccccuugcaaugcaaaugcccucacacaccucacuuugccaaugccuaugguguucgauucacagaacucucuggagagauggcucagcaguuaagaguaccugcuacucuuaccuguuugguuuuuagcacucacucacggaggcucacaacaucuggcuauucuagcuccaggggagcugacaccauuuuucagccuccaaggcuucuaugugcuuguguauacccucuccaacacagauuuaaaaaccaaacuaagugcaucacuuuagucccagcacuugggaggcagagguaggaggaucucugugaguuugaggccagccagucuacaaaguaaguucuaggacaaccaaggcucuguagagacacugucuuuuaaaaggaagaaaaacugaaagaagacauuaacagcauguaaaguagcuaaaacuacaucuaagaauaccugaagacaaggaagaaauagcaaguguagaggcuggaaagaugggccagugggaaaaggcacuugcugcuaaggcugauaggucugaguuccaccuauggaaccuacgaggauggauagaaccaaacucugcaagccuauguccccuuccuaagauaaauauuuaaguaaacaaacccugagcacuggagagaaugacuccacuaaaacugugucaggauccagauccgauguguuacaaccuuuagaggugaauuuaaauccagcccucuuucuucacguguuccaaauaagggacacuguuuaaagccuggccucugccuccuuuguauucuuuacaaggacuggagccaaaccacugugcccagcaaagaacacacacagauuuccuucacuugaaguauaugcauaaaauaaacguaauuuaaguauguucuaauuuggguccuaugugggacagcaaauguuuuaaacugaugagccaucuuucuaguuccugcaaaugaauauaugcugacaaaaauaaaaugauacagaagggagggggguguagauguuuucaauucccuagucaaauucugacaugcauuauuacauuucuagaguguaguuuaaucuuaaaauaacuggcuuuauuugcuuggcagccugggaccuacacccaagcccugaaucugcuaggcacguacucuaccccuauaaaacccaaucuuacugaguuggucugcccauguaaaugccuggugugggugugugcgcucucuuggugauagaauaauccacacggauucuucuaccguccagcuccaucccauuugcucucuccauagccuacaagagaaaaagaaagcaauuaauaacucacuaaucuugaagccauuuuuagcuaaaauuaagcaugaaguauucauaauccaaaugaaucuaccuuugaaaauagcauaguuaaugcacuuuguauuaacaucuuagauauacagaagagugaacuaagcuuuaaccuuuuaacuuuuguuuauaaccucagcugcucaccuuaagacuagauuaucacugucaccaugagugacuugggaauuauagcaguccuucugccucauacuggaauuacggguaugcaccaccaugcccucccuaacuuuccucuauucuugcucuucagcuuguaauucaauauuuguugguaaaacuaaguagccaaaaaacgauuuaaggggaugcaaacaauuguaacaguuuguaccccuuuguuuaaaaugaacaagucuaagccaauacugcccccuagugauuuccaaguguaaagggacauagccugucugugcuugagcuaaucccacuggggggauggggaggaaggaugcaaugauaacaauucuuuucucccauuuuugucccuauucugccugccuggauugauggcuguagccauccucuaccuaccuacccaccuggaucuauuuuugucgaucuaucucccaaguggugggacuauagucacauuauauaccaagccuggcucauauccuaacugaaauaagguaaaaaucuuucaucucagcaucaagagguagagguaggcagaucuccaugaguuugaggacagccagugaaucacugauauugugacuuaaaaacaggaauaaggaagucccaaauacacacuaguaaaaaaauaaauguucuaauaacugagaaauuagucugccuacuagauaauaaauguacaaacuaagaaucauauacaaucaucugggcuuauuaauucuacggucuggggucauccaguccacuacaggauucauccaagugcucuuucagccccagcucgcucucagcguucguuacacauaugacaugugccagcacacuagcaugcuaaauauccucacaccuccaaacgccauuaucagguacuauuuuuaaaauaggcacuaauuuucauuaugaucauguuugaauuacagagcagaauaacaaauacauuaaaaaguuagaaaagccacuucugcaccuguacauggggaauuaggcuaaaauuagauuaauuuaaacaugaauaugggcuuauuaaaaaaaaaaaacuuauauacccgggcggugguggugcacaccuuuaaucccagcacucgggaggcagaggcaggcggauuucugaguucgaggccagccugagcuccaggacagccagggcuacacagagaaacccugucucaaaaaaacaaaaaaaccaaaaaacaaaaaaaaaaaaacaaaaaaaaccccaaacccuuauacacuguaguuuuauuacauguauaugaguauacuguagcuguacagauggucgugagccaucaugugguugcuggaaauugaacucugcucuggccccauugcaccggcccaaagauuuauuauuauauguaaguacacuguagcugucuucagacaccccagaagagggcaucagaucucauuauggguaguugugagccaccaugugguugcugggauuugaacccaggaccuucggaagagcaguugguguucuuaaccacugagacaucucuccagcccacacuguaguuuuuaacauuaacuuauauaauucacuucauaaggucagauuucaaucagcauguaauuauaccagcauaaacugaaaagcaaaacuuuuuaacuguaacacugugagagaguuccaaucaggucacagaaucugaaggcauauuuacagaaauguagauuaauagaacucugacaguaaugcuauuacuaauuagaaauuacauacuacuacuacuacuaguaauacuuuaucauuaugcauaccaaaaaauuuuaaaugaaaauuguaaaaccagauuuaccuccuuagagucaucuauucucucaaaauacacaaaagcaaauccacgugaccucccaguucgcugaucauaaacuacauuaacaccacucagagguccauaucgagaaaacacuucacgaagaucucucucuguuguguacaaacugaggccaaauacucccaagcaaguguugggaucuggguuugccuguugaguaaaggaggaguuaaauuuuaauuagcacucaauacguaagaucaaaacacaugaagaucuuuuuuggaacacaguuuauagcuaucuauagccugcacaaaaacauccccacacccuagucuagcccagcaauuuucaggaaguacccaaagaauucaucuuucgccccccuaauucuucaaugcuuacacaacuuguucucuuuuuuuuuuuuucaggguuucucuguagcccuggcuggccucgaacucagaaauccgccugccucugccucccaagugccaggauuaaagacguacgccaccacgcucggcuacaacucguuuucacuuuuaccaguaaccucagugcugggauuagccaugcagcacauauccuaugcuaugugaugcugaagguugaagccagggccucauucacaacagacaagcgcucuuccaauuccguuacauucccagcccucuacuuucauucuugcaaagauuuuaggagcugacaagauggcucaaugguuaaggguacuugcugcucuugcaagggaucccauuucaguucccaguacccagaugguggcuuacaaccacuauaacucugcuuucaggggauccaacaccuucugaccuccccaggcaaacauggugcacauaaaagcaggcacucacaaacacagaacaaaaaacaaaaacaaaaaaccaacaccucuuuuuccacgcaucuguccgugugcaugcagagaugccagaugggacaacagaucccaacccacuccuauggcaaagcaggucagugcucuuagccacugagcuguauguaauuccuaucaccacuuccauucuguaacaggguaucuauccucugaauguuuccaggauccagauuuaaauacugacacacgucuaccaugcuugucaguaucacuggcuucauguagaagcauagcagaucaagaacuuuagaccaaagcaaccugguugaaaccuggacucugucaccuauuuucuaaaaaacagauuuaugcacugugugcauauauggacacacuuaugcuaugaaacacauucagaggucaggacaacucuuuauacaauguagacucuaguuuaagcucaggucaucaggacuggcagccaagugcccugauccacuuccugggcuuucuugcuggucccuuagccaacuacuaaauaaacuaaaacaaaacacuucagugucccauauccaaacaaccugucacacaaagauguuaagaauacacauguuaaaagaagagagcuacuuaagagagaucaguacagagagagcaggcaguuuuauugggacaguuguacaaagauagguuacaaagagagaacaagcuagacacagaugaaaacagaacaagccagagacugaggagccagcagauuagaacagauugccagaguuaguauggggucaagcagagcaauucagucagaguugcaagaagccaguuugaaucagugugcaggagcagccagccagaaagaacuagaagggggagcuuauucagcagcaagucucagaggcugaagacauucuaggcuuaaauaagauugacaaaggccagaaguuuuucauaaaaagcaagguauuuugccacgacuacacauucaggaaagagaaaacccaauuuccauuaacucuucuuauacacauacccugcuuccaguaugccuucugcgauuagacauuggagagugacuccggcuccuccgccgccuauacucggguguauaggaccuacuccgagaucgucuccuaugagagugugaccuggaucgaguguagcgucuaugcgaaugccuccuugaccuugaccuuugaaagaaauaaacuuagguaaaauacuggaucacagggcuggagagauagcucagcaguaagaguauuuauuggucuccaaaaagacucagguuugauuuuuagcauggcucauaaccaucuauauaauucuaguucuagggggaugacucuuuguucuggucucugaaggcacugcaugcuugugguacacauauauagacauaaaacauaauuuuaaaaaagagaaaaagaagaaagaauacuuuuaguaaguaaucagaucaggggcuggagagauggcucagcgguuaagagcacugacugcugcucuuccaaguucaauucccagcaaccacauaguggcucgcaaccauguauaauaggaucugaugcccucugcuggucugucuggagacagugacaguguacucauaaauauaguuuacuacauaaaauaaacaauucuuaagaaaaaaguacuaaaucaaauucccucuacacucuagauugcauacaaauaugacuuuuuuuuuagcucucugucauuuuguuaugugccaacaacugagauguuucaaugccuccuuugaccugggaaaauauuuuuaaaagaucuuuuggugguuagagauggcuuccuuguucaggaugcacacugcacucgcagaggaccgaacuuugguuuucaacacaacucucuguaaggaauucgauccucuuuuaaacaacaugggcaccugcuugugcacacacacagacccuuauuuuuacuuauguguauguauacacguuuguaaacaccuggcagaaguggauugcagguguaacuccugaugguaguuacaggugguugguuguaagcugccaaacguguuccgagaaccaaaaucaaauucaggucuucuggaaaaccagcaaacauucuuagccacugugccaucucucuugcccauauuuuuuuuuuccucgagacaggguuucucuguguaccccuggcuguccuggaacucacuuuguagaccaggcuggccucgaaaucagaaaucugccugccucugccuccuagugcugggauuaaggugugcaccaccacgcccagcucccauauugugauuuuuuaaaaauuccuauuuaguccauucacucucauuucaccucccauuaaaacaugaaacuuccauuaaacuugaaagacacacacagagagagagagagaguagagcaugauggcacaugacuuuaaucagggauaacagcuaauagauaugcuaaggaaggucucuaaaggucugagcagauggugaacuuucugugugaaauacagcuaaacggagcccuuacagggagagagcaguuuacaaaguuuaggcuuaccuggacuuugaucuugaucgagaaugggauucagaauguuuggacacccgugauggacuacgagauccugaccugcucucugauuuuacacgagcaggaguucccguuggagauuuugacugagagcgagacuccuaacaaagaagacaguauuacaaauggcacuggucaugcagaugccuaacaccuaacauuuaaaguaccguaauuauuuauauugauugcuccugaaaaacaaaugguuaggcaacacccuccagaaaaaaauuucagcucauuaauaucccauuguuaauacugcuaacuguccucaauaauucccuacuugaaccagaucaucaauuuucuauuaacuaaguaaucaugcaaauucaucuacaacuugaucauacagacacuggaacauaaaccauacauuuacuuaaccuaggacccauucauucuuccagauucuuuuaauucuacuucacucuugcuuucuacuucucuucauucuucauugaguuuuucauuuuucauacuucguguauucuuccccaauucaaacaauucaaaauagccuuaaaaaaauauucaagugcuucuaucugaccaaucuucuguucaauuuuuucccccauucaauuuuaauuuucugaucuuuaauacuuuucauuagccuucuuuuaucuugauuuaucuuccacauucuuggaaaaaacucuucaauuucuucacgaacauuaaccuuaauggaaaaagaacauuuaguauauuuaagcacguggggauuauaaaacucugcuggaguucagaauguuaucuaccaaaugggaaggccagcagguaaagugcaaauaacuaguuuauuuaaaaauaaauuaaaaaaaaaaaacaaauuuuauaguauuuaaaaauguucaaaaguguagucuaacagaauuuacugaauuucucuaaaguuuuuaaccauucucuuuacccuccuccccuuucauguuccauccuagucccuaauuuuaauauaaauauguaauucaaacauaaacugcaacucccccaccuaaauauucauuuuccacuauuuuauaggcuaaaggcucuuacugaucuuagaauuaacuuucaauaagccaaacuaagaaauucaggcacugcugaagcaaagcaucccaggccaaaauagcuguguccaucaucugaacucaugacagcacacaugccagaaaucagagacauaacaaauagcaacauuacaccuccccccaauuuugacuaccaacuucacuuauucugauuaaccagaaagauguguuuugaagcaagcauagagaaacuaaaaggaaagaacaaaguuuccaacagcccuuacuucaguuuauaaauuccugaaauacaugcuauuccugucuuaugagacacaauugcauuuaagaacucaggauggacuauacaguucacagaaauccuccgcucuaauaccacuuaaauaccaccggguacaaauaaaaaaauguguaccaugaugguugcccuugacuuuugcuuuugcacuuaaugcacauuuguacuccuugcaggggcaucuuaucucuugacaagaaacauaaaucuccuucauuacaaauugguuucugaaaaacuucuauguaaaaaaguuaccaaauaacuuauaacugacaagaaagcaugguaacuugacugauaugagaccuauacaaccaaaauagaaaccaagauuugguuucuccaaacaauugauaauggaaucuuacaaaaguauauauucauaccaguuuucauuuaugcaguaagauaucccacaucuucugccuuuaucucccaaguauacauuggcaugcacaaccaaacuuggccuuaugcaaugcugggauuuaaccagagccuagugcuagguaagcacccuaucaauugagcuauaucccuggaccccucucuuaguuuaauaucaaaagauuuaccuaacaagaacuccacccauuauuuuccuggucagugauguuuccauuuaguuacccaguguuaagucuuuuauaucuuagacucagaugccuagacagaagccuggggcaacauauuacuuacagaaaaagaaaauuauuaauguugcuuguaacugaagcaaggggcuggcucaaaaucugaaccaaagacaaugauucucuguuaccuuuucuuucuauaaaacagacccucuagguggcucagguuaagagcacuggcugcccuuccagaggaccaggauuuaauccccagcacccacauggcagcucacaacugucuguaacuccaggaucugacauccucacacagacuaagugcaggcaaaacaccaauguacauuuaaaacaaauuuuaguaagcugggcagugguggcggacgccuuuaaucccugcacuugggaggcagagacaggcagauuucugaguucgaggccagccuggucuacaaagugaguuccaggacagcuagggccauacagagaaacccugucuugaaaaaccaaaaaaauaaaaaaauaaacaaaaaccaacaacaaaggcccucagguauaucauuuguuuuugcugcugugaaaagcaguggucacaacagugucuggguaagcaccacagccuuuguuguacaauuaggcauuaggaggucuugcucugagauacuauaaaguguuagcuuuaugguuaaaaaaaaaaauccuaaaauaaagcauaaauuuauucuuaaaugauuaauaaacccuuuaucgugacaaaaauuuaauggcccagauacauuuuuuuaauuuccaaguuucuccucauuaaguauuguuacugaaaaaugacuucuuucaaaaugucaauuuaauuaguauuuuguggacaaagagcaacuuguuaagaguucaucgguacucaaaauucaggcuaugagguauagcaggaaaugccuucuuacucacugagcuaucuuauuggccuccaaaaucucuucuggagacuuaaauaacucaguaauuuuuuuuucuuuuaauuuaaacuucagucccagaucuugaguagcaacaaaauaucacugcauagcagaaugucuuuuaaaaauaaaacauuuugaagguguucucuucagugcuagaacccacaacuguuccacgcuaaguaagcacucuaacacugaucuagacauccaguucaaaagcauuauuuugacaagcaugugugacagcugacuaauuuuaaauuaaaaaaaaaucauuaagacuauuuagaauuuggggaccuaaauuacaacaaagaaaaaaaaaugcuggaaagaguuggucaucugucuugucccacuagacuaaccagcucuuaaagcugucucauugaagggauguuaacaauuccuuauuauccuggcuacaauauucaacaacccuuuacaauaugcugcccagcugaauaaaacauguaaaaggacucacauugacccauaucagauuauaaagaaaacacuacauaggcuucaaucuaccuuagauauuaaaaccagaaagaggucaggcagaaagcuaagcacugcucaaacaggcuuugguauuugcuauguggacaaauuguuacagaacauucacaaguaauaggaugcucaguaaacuguagauguaaaauacauaggcucaguguuuaauacuaaguaaauggaagcaaguuuauauacaguguauguauauaaauguauguacaucaugugaaacaaacuuccuguuauuucccuaguacuuuauaaaguaggaauuuccauaaaaauaaacuagugaauuuaaaucauaugccaaaaagaaagauaauguacuuuggcugcccaaauaccgcacuuacucuguuuaaucagucuacaaguagagacccuuuuugcuuucuuucucuggggacaauggagcagaucuuuuuuuuuuuuuuuuuaaagauuuauuuauuuauuauauguaaguacacuguagcugucuucagacacuccagaagagggagucagaucuuguuacggaugguugugagccaccaugugguugcugggauuugaacucuggaccuucggaagagcagucgggugcucuaacccacugagccaucucaccagcccggagcagaucuuuauuagaaguugggcuaauaaagcaaacauuuccagucucaaaccaaguugcuacuagaagcaccucuagaaaaccaaaguauguauuguuuaaaauuucaaauaacuucauuucauuuaagaucauccuugucagaugcacuaggaugucaauauggucuccauaaaggcuuguggauaacucuaacauacgucuguauauucucuagaguuuggaauaauuuugaaaacuuuuaucauaaaugccuuaguaacuguuagucaaccucauaacuguggcaugaguuuauaucuguaaacuuuauaaucuuuugguaaaaaauuuaaaugaugccauaacccugucagcuuauguguuuugaucagaugcuauguucaaaaagcugguauaaaaaugauuucaaauguuuagggcuugggauguagcucaguuugagagcuuuccuaacauucaagaagcugaguugaugcccaugagucauuuuucuccuaucagaccugcuuaccaacgccuccaaugaaagcaauagacuguagacagaagucuaugugcagcucacaccuccuacuggccuuccacccuccuaguauuuaacaacaaccucuuacucaaugugacuguuacuauuuuuucacuuguacuucgguucuacuugucuucacucugcguagagaaagugauuguaaugccugaacaucaacugaaaauaucaaacauuuuuagucagccagguucaaugaaacuacuaugcugauuaugucaauuuaauuuugucauacuaaguuaucaaacaguucucuugaauuaguuaugcaccaccaugccuagcucuucucacauaaaucuauaaagauacagcaauguacuauguagaguuacaggcauggcuuuuuccccccaaaagccuaccuuuucccuuuagcaaauuagaacccuuuagugaaaaaaaucuuaaauguaaaaacucaaguuuaaaauuuuuuuuuaaaguuugcagguuuguacaauuaaaaggagggguugcaagaacaguacaguaguacaacuaacuggcuuaaugauagcguuuaacacaguaggaaguaaacucaacacugaauuuagauuuaguucuauuccuauuauguaaaacagcuuuacuuucccuacuuuuccugguaguucagacuaucuggaacucacugagcuggaccuacagcuauucgccuauggugcaggucugagucagugcagcugacuagccauuagcccaacuuggucuucaauuccuguuccucuugucccuuucaagagggauugacugauuauaggcagguugaucaauuacaggccacaaugccugacuagcuuuaccccuuuucugucuguaaauuuauuuacuuacuguagguuguaaguacuaaaaucaggcugucaggguuaguggcaagugccuuuaauuaaccucuaaacauucucagagacuaaaaagauugacuuccuucuuucacuuaagguaccccucuguguuacuccagcucuucuaaaagucacuauguggaccaagucacuauguggacuuuccccuagagcgcuggaauuaaaggcaugcaccaccacacccagcuucaagaucuuaugugcacaugucuguauuaguguauguggguaccugcguaggccagaaaugagagcuggaguuagacagcugugcucuauuagauaugggugcugagagcacaacucagguccucuggagaaacagcaagccuauuaaaaaccagccauuucuuuugcuuccacucuacucacucgccuuaagcauauuaaucuaaguguuuaaaagcuagaagagggcauugguuccuuuggaaacuggagcuaaagugggcuacuuaaugccaguacaagagaaaaaaaaaucuggguccuuucagcugugccaacucuccaaucuuaaaccccaaauaaacuguuuuaaaaacaagucaguaagucaauuccagaggagugaaggaaauaccucccaucucuccuuuuuuuaaagacaaggucuucccucucauuuguuuagguuuucugaacaggguuucucuguguaguccuugaacuagaucuguaggccucgaauucaagagaucugccugggauuaaaagugugcaccaccacccggcucauaaauuguuuuuuuaaagauuuuauuuauuuauuuuauauaugugaugaguacauuguaacugucuucagacacuccagaagagggcaucggaucucauuacagaugguugugagccuccauauggcugcugggaauugaacucaggaccucuggaagagcagucagggcucuuaaccucugagccaucucuccagcccccauaaauuguuuuguaguuuguguguguggguguuuugccugcauguuucugaguacccuacgcauaccauauacccugaggucagagugugcaugaacccaugagacuugaguuacagaugcaaaugaggugggugccaugugagugguggguauugaaccuggguucaauaauuaauuaauuuaaaaaaaagauccuggguuuucugcaaaaagcagcaaaguguucuuauucucugagccaucuaucucuccagcucucagagucuugcugugucccuggcugacuucaaacuggugguuauccucugguuaucacacuuccugagugguggaccugucucuuccauuuccauuuguuaagauauuaauauauacaacuuuguguauauuugcacgcucauauacccguugacagaagguuagacaucucgcucuauguaucucccuccacuuaacuguuugagauaggguuggucucucacuaaacccagagcucaucuacucauuagcugaagugccuaaggacuccugaggauccuaaacauuuggauuagaggcaugcucugccaagccuggcuuuuagaauauuggccaggcuucagaacuuagguucauaugcucuauagcaagcacuuuccucacugagccaucuucuacagcacacaaauacaacuuuuaauuccagcggauacagguaaauuuguuuaauuuuucacuuuuauugacaaaucauuccguagcaaggugacuucauacuaggacuccuuuuuuaaaaauuggguuuuuaagaggccagaauaagaacuauaagaguuauguccauucuucucaauuucuccaaaggacauuaaggacauuucucuuaccuuuggauagguuugauaaagcagauaacucuuuauuauuauuaaggugacaaacagaugccagcacucaagaggcagaggcaaauagaucugaguuugaggucagccaggaguaaacaguaaagacacugaaagagagaaaugaaagcaaaacagagccaccuuucccucuuucccaguuucaaaagaacacugggugugguggccucuggcuauaaauuccaguaccgaggagaagcugaaaggaaagguuccugaguuaaggaaagcacgugauugagcuucaguaaaacccugucucaaaacaucucggcaucuuccuaaauugauauaugugcggaccaaguuaaguuguuuauggaccuguuacgauuuuuauuguuuuguuuugaggggcaagaccuuacuuacacccuggcugaccuggaauucagagaucugucugccucuggcuuccaagugccuggaauuaaugaugugccacagcacacccagaacuggauuuuuuuuuuuuuguaauggcacaaucauucuccuguauuucuugaaaaggguuucugccauaaauaauucaaguugcauucuacugcuccugugccagucuuuuuaaucauagguuuccaaaaugaagagcucauagauggcccuuagugagcgcuggauucaagucugaauccuuaagccuagaauucgaaacccuuuguuaucuuggcugcacauauaucugucacuauuucggcacuaauacacuuaaugacaguauuuuuguuuuuaaacccagguuuaaauuggcagucaccugaaauuaagacaaauucuugguaucucacaaccaccugcaacccuagucccaggagauaugauuuccucuucuggcuuccuuaggcauuguacaugugugguauacagacauauaugcaggcaaaacauccagacacaaaguaaaauauacaaccuaauauggcuugaauaaauacuuuuagcaaacucuauucaugggucaauacaguuaaguacaaugugcucuucacaaagaaaaaucugaacacauacaggacuguguauauacaauggacaguaaacuggggcuuauguggucuuccaugucuugguuuguucuuguacucucuuaccuuauuuccuuuuauaauuuuucuaacuuuuauuuuaugugcacugauguuuugucugcauguauguccgugagugaugauccuggaauuacagacagcugugagcugccaugugggugcuggaaauccaacccaaguucucuggaagaacagucaguguucuuaaccacuaagcuaucuuuccagcuccucuuuuuuuuuuuucucccuguguagcccuggcuguccuggaacuugcucagcagaccaggcuagccucaaacuccaacugccucugacccccaagugcauagguguggaccagcagcaccuccuggguaguucuucauuucuaaaauguugacagcacccuagcccuugcuauauuauuacaagcaauaaauaaaaaugcacccaagaaggcugaauucuaaaauauuguaagcauagauauauuuauauauuuuaucuucaguguuugguccauucuaggaacccuccaccuaaucuugaacacuuuuacugagaaaggauuaacaugcucccuguuacaccuaaagauaaaguccaaucauucacuuuauguaucagaugcaaucuucccaauaaauuccaacagaagggaaauaauaauaaaaacccuauauuaauaaucuuuuaaaaauacccaauaggcccagcauuugacuacugaccugucaaugccuccccuaguuuaggguaaugagaagaguuugaagucuaacuaccauguaaauaacuucaacacaucauucaaacaucucucuuaggaagcugcccucagacaccucuacaggcaaugauaaaggggcauagcaauuauggucaacaggggggaaaaagcauacaaccucccaccaaaacaaaaaaaacaaagcacuguauuuaaauacuuagcugcuuuaagaagaggagugguacagcacuugccugguaugcaaaaggccuggguuccacucccacaaagcucaaaaacaacaaaaaucaauaugaacccccccacaagccucuagccuucuaauucuuuauguaauuacaagucuguucaaucauaauuuaagaauacaaaacaaaaacuguuacaucuuaaagagcuguaacugacccugaaagcgcugauguaaacugaaccacagguacugcuguacuacuaauggcagaagagagggagcuagaaagucccuaucuguuaacuagguuguuaauaccuaaauaaacugaaaaguggauaggaaucuucaauaauuugugggaaggugguaauuauccacuacuccuuccacuagaggacaaaugggagaaccagagcagcaaucagagccaucagagcaacacugguacaagucccacagacuaaaccaggaacaauaacaacaaaacaacacacccaaaccccaaccgucuuuuccuaauuacuuaguuucacaaguaauacaacuacgugaaauauuuacuucauagucuuuaaaaguuguuaguacaauaaaacaauccuaaaaauaguaagcagguucaacucaaucguugugugcaaauuucauucaaauaauccaaucaaaguuaaauguaguuaugaccuuguccuagugcauuaaauaaaaaaauaaacaaacaaaaugcacccucuuuucucaagaucaaaacccuaacugaccguauaugacuugacugacagaguacaggugucuaaaucccgagcuuccaaaagggacaaauucuuuccuucagcaaagcccuccagcggcuuuuuuccacccgccccuccuccacuagaauaccaacacaacugccagcccucgaguaccaugggacuuuuguuucccuuuuuuuuccuuccaugguuuuaccaggacucacuuccauuaauuuccaauacuaggguaacuucggaauaaaacucaaaaaccgguaacguucuaauaauauacucaagcuuugugaauauacgguuuauacucacaagaccucagauaaccaaagucuugagucccuuuuccggggaaugggugagaaaaacgggggagggucuguaaauuucagguauaaucuuuugaguuaacaaugauuagcuuuuuucuuuucuuuuuugaaaacugaggcaagaaauuuguucaguuacguaagguuuaaaguaagaugucuuggcaguuuagccauaaagaucuguaaaggaguuuucagaggaauggucacaggaaggaaagcuuuggaaguugagacauaaagaacccaacaucuagcuguuaggaaaacaggcgucacugcauuuccacauucauuuagaagcgaaaggaaagaggacauuaaggggaaaggcucuugcguaguuuucccuuccccgcucgcucucgucuuaaggacucuuaagggucgcugcggucguugacuaaccacuucacugggcucgucccaccuucaaccucaaggcuuucgccuuuacagacgcgacgccgccgguuccgacggagacgcggccgcucacugcaacagagagccaaggagacaacaggccccagcuagucccgcgccagcgauuccccgcccggacagcagccccgcgcacuucugaccccgagaccccgcugcgauggccggaggagggguggugguggcccgagaugccaccgcaggaagcaccuaccacuauccggccggagggagcgccccgccgccuccugccccaccgcgccggggacccgcaccucggagcagagaugggaagcugagaggaaagggagcgacaggagaggauaggaccaggccagguaccagucagccgccagaaaggagcgcugcgggcuaguggggcaucugggcacgcagggggaccccgaagccaucuugggacgugacgcgcucgcgguggcccucaaggcugcuccugagggccccgccaccucgcccgaccgaccgcgcucguccccgagccccggagcaucgggccgccgccgaagacggcucccgcggcuuuguacucacucugcccucgaaguuguucuccucuacaucacucaugucggccaggcgcucccgagaacuaaauaagagauaugucucggcucgagggccgacggccuagucaccgcgcuguucggacuguggggaggaagaaggcgacggcuacaacggccagugcguuccacucccaccagcucgcacguucaggcaaaauggcgcccgugccgccagaaaccucc

SEQ ID NO: 2990 - RNA, 22318 nt, Mus musculus
cggagaaugggggaaggguggccgggaggcggagcggaaaccgggaguagcguccccgggugccgagcgcucucgguccuaccuccguccuggcccgcaggcuguugcggcgccgcuaacgcccucccguggcgggcuguggcuguacuuccaguuugugagccccgcggcggcggcccgcgugauugaaaggaaaccagcaggccaggucagacggaggagauuggggaggcgggaggcggugucccugcggccccggcuuugcuacuuugacagccucgaccgccgggccgggcuccgcggugcucugcggggaugggcagucucugcggccgcgcucauuugugcuccacucuugacagcucaauucucucguuaggagaaggacgugaaaugcccauuaaaccugccaaacucuucuccugggaggcuggggaggaacuuuaucugcuguagguacaggcgguggcaauugaauggccaggcagccaggauucgaaccccuggcgucccucugccugcugcuucauucaggcuaagcaauggcuccaagccgauguguuucauccagcagauggagaucucauacaguuuuaaguuguuagauuuauggauaauaagcuauuacaccuugaguuuuucauuugaugaaaagauguuuugaaugugauucgaaguguguggacuuuugguuaaucacuagguuguguguucaguuuauauuuuuacuucuuacaugcagagaauuccuuaagauaugcuggcuucuuaauuuccgccccuuuaagauggcugagaauguucuaaggaaauugaugacucugcuuuccuggggaucagcucuguauauaacuguacaaggacucaccucccccaccucccuagccuggucccauaggaaacccuuaaaaggagauuaaaggcuuuguccgucagauccuuugcagcuuugcccuaugucaacuuucuguacuguuucuaaugguucagucguuucucuccuccccacuccccuucucucauuuucuagacaggauuucucuguguagcccuggcuguccuggaacucacucaguagaccagaaaacuauaaauccccuuacgcauuuauucgugaccaggcuggccucaaacucaagagauccuccugccuccgccucccuagugcugggauuaaaggugugcgccaccaucaccugacacccacuuaggauuucuguucccagguuauaguuuuugucuggagacacauugagugaaugcaguaaaucugaucaggaacgacuucaacguguucagguucugucaguuguuuuuacccuugcuuucucaauguuauugacauuggguuuucaaggaaagcuuuauaaaacuuuaacugaauuucauuuuuauuuaacguguaugcccuguauguacuauuuugagucgagacaugaugauuuaugugacugugugauaucuuuagggaaaggggagccuucuaaugauugcuagaacaguagcaguuaauaauuguggaagggggcauacgcaugcaaacauuucugauuaaccuuaaaacgugcggcagaaacacucauuuugaagaaaaugucucuccuugguguuaugagugcaguagaggagaaggugagaaccgcagccuugguucuuguccuguucugccaccauccgcaugaccuuagcucugcuuucucugcaguucuccuuuccccgugucuacaguaaugaacagaucgauucgucuaucucagacuuccaaugcuaaggaucuuggaacauccauuuuacuauagcggaaaacuauaaauccccuuacacauuuauucguguccuuguucccugcccuuuacguuuuacaguucuuuccuuccacccugauaaaaagggauucucguggaagagcuaggaagcugcagaaaucaugaucccuaccaaccagcaucggcucugcgagcugcggcuccuuuuccuuccauccuagugguccuggguaccucuugccugugcacucuuagcuucuggucucacuucucuaacccguuuucauuuuuccuuuucauaaauucaucugcuucagccauuguuuucucucuggucucuuuauguagaaggccccuggcaggggugcccugugcuagcccguucaucuggaaagagguguagggccauaugacacaagcuaugauuggcuaaggcucugagcagcucagccugugaccgaaauaucugaugcugcauaaugugguuuuagauuaaacacucucuacagcacagugauaaagcacucuucuuuugauauagugcuuccuguuuucaaucccagccuuacuuuacccccaccccuaucucaccauagcucuggcuggacuggaacucgcuguguagacuggucuucaacucacugagcucuaacugcuucugccugccucaugcuggaauuaaagcccugugccaucaggcaagaguacuuuaguguacuuuauucucucucucucucucuuuuuuuuuuuuuuuuuuuugguuuuuugagacaggguuucucuguauagcccuggcuguccuggagcucacuuuguagaccaggcuggccucgaacucagaaauccgccugccucugccuccugagugcuggaauuaaaggcgugcgccaccaccacgcccggcuuuauucucucuuuuaagaucuauuuuuauaauuguuaccgcuguugcuucucuuccccaagaugccaucugaaaauguuaagauaucucugugucaccuuaguaggaacucuuguguagcuuucuucaaggcaguagauuuuauuuauuuauuuuucaaccuuuaguucuuagcacuguggauugaacucaguagcuacauacccccaggccuaagcaucuucaaguuuaggccuaauuauagaguugguagcuguugccuguguuaauucuuuuccaccagauauuugcuucaggcaguauuauguagagaaaauauuuuaggaauggacaguuuccagaaauuccauuccagggccaagucuggugugugugugucuguguguguagggcuuaguucugcaucuugcauuggagagagcuauguguacuucugacuguuggugaacauaccauaucuuuuuuauacucuacauaugccucuauggcugugaaguccuuuggagacaacaggcgggugugaugcuuauagcaccuuaggcugagugccggcagcucugcuuuuggcugcugcugccgcugccaccucuguuagauauuauucauaacagcacagaauguagcacugaaucaaggugaaauggguuuugaaugagagauuugaagguaggauuagccaucuguuaauguuuuuaacauuacaguugcuauuacaaugcuuucguuaaaaaaauauggaaauacuuuguaacgggcaguuuaaaaggaacuuguuuuuaaaaauacuuuuaaaaacugaaacucagcaagaaaucuuuaucuguagauuucauggacaugccugcaugccuguauguagaaauaaauguacccagaaaaagugcaaaauagucuguagucuguacauuuuucucugaugauuucugcuuuauuuuuuaaaacauugcuaauugcaaaugaucuguuuuguucccugcuuuugggaagcaguggggcccugagcugagaguuaggauguuuugaauguccugacucugugcucuucuuccuucuuuucuauaauucuaguuuaaguauuucgugguuaguugucuuucuuuuguucuagcaauaaagcuggccuaacagguuuaucuuuugguuuggggcuagggagaaaccacugaaauguugcuuaacuacuuggcuauuugcauggcauacugcuuggugagaugugugagagagagcuuugaacacugcagucuuuuaaagcagcaguucucaaccuggggcuugugaccuccagaaggguagcauaucaguuguuuacauuaugagucauaacaguagcaagguuacaguuaugaaguaacaauacaauaaucuuacgguugggggucaccacaacaugagaauuguauuaaaggguugcagcauuaggaagguugagaaucacagcuuuaaaguuuuuuguuuguuuguuuuuguuguuuuaaagucagggucucauuguguagcccuggcugcccucaaacucagaucuugcuccugucucuugaguacuggauacaggcaugcgccacuauaccugccuccuguaaagauuuuauaaguuggagugucaauaauaaacccuguaacaaauagagaaauuuagaaaaaaacuucugccagucuuugcugucugaugucuguacuccuuagggaauguauuuuucagaguuugacacauugugcuuaaaauaccucguaacagguuuuucucuguuaacauucuuggaauuguucccuagacuuuguuuugcaccccacuuccucuuaauccucuuccuauuagaaaauacaaguucagugcuuuccuguuuguaaagaucaucacaucaggucauuauugauccuguauguuacacagauagccugacaagcuccuaagaaaugggacauuaggccuuucuuugccugggguuucuuugcuauuugugaggggaaaugucuuuuuucuaucagagguggacaacuuacugagggccaaaauucugcaaaucucccacaccucucaucucucccaccuugugaaauuuuuaugcaaaucguuuacuuucuccauauuuguuuauacaaagacagccccuccccaacccuccagaauuugacagccuggggcagcagacuccuucccucuuucuuucauucucuuugagaugacugugagauuggaugccagcugauguggaaaaagaugcaggcaucaccugugucagaauggaagccggagcuugcuagccugguuuggguucuuagugaauuggcuuuugcaagaaggaauagcuuugcgaggcugcuuucucuuugauccuguguuuacuugugggauauagauauauucuuuucuuuacuuugauuugucuagacaaggccuuauuagggcuugugaguccuuuccugcuuauuugcuuguagccuguaguuucuacuaucccacuuuaagcucuggguagacuguucuaucaaccuccccccccacccuggagccacccuggauccaccaaaacacacacacacacacacacacacacacauaacuuauuuuuaauaugcuuuagcucaauagcuagguucuucuaagccuuucuuaaggcuuaagaaggcuagcacacccuucuguucacucccagcucagcacccuaaaucugcccucagcuuaguuguguuuguaaucucucgccugcuaccccaggcucacuuggggaagcagccagugaccacucuggcuaguggcucacauggcuaguggcucuuucucccucugaagcauggcaaauccuuuucuccucuccugcaucugcuaaccugccugugggaaaacuggaagucccaccucuucuacccaaccauuggcugcuagcaucuuuauugaucgaucaagaaccaauuggggaacaggaccuucaguguucauucccagucagagcaucaaaaccacccccugcauuugccuggguuuguuuguuuguuuuguuuuguuuuuaagauuuauuuugcacucgaguguguguguguguguguguguguguguguguguuuuccauccauguucaugguggccagaagauggcuucaaauuuccuguagcuagaguuacaaguagugagccaucauggauggcugggacuugaacuccuuuccucagaaaaaaagcagcaagugcucuuaaaaucaucucuccaguucugcuauuugcuuggagagagagagagagagagagagagagagagagagagagagagagagagagaggaagaagaagaagaagaagaagaagaagaagaggaggaggaggaggaggggaggggaggggaggggaggggaagggagagcaguuuccuucaagauucuggucagaaauaaauguuaauaguuuuagucgguaagaaauugggaccagauuuuguaguuggcagaccaauugcuaaccucucugagggauuaccuuagcccauaccucauacagacuucaucauacccagccucuguuucuguuuauucagagcagugccuuauuaauugucucacuucugcuaaggcauggucuucaggaaaacaggaauccuacuuccaccuuucacacugccaauuccugacacauaguaggugcuuuaauagauaaugugaaugaauggaugaacagaugaaugaauaaaccaagcuccuucacacauuaaaugaaacugcacauaguaugucuagauguuuauuucccucugauuuuuuucuauuuccuuuuuggauuuucugcaguugggaacuuucccauaggaauguuucgaagguuauuuuacacacacacacacaauaauggggauaaugauggaaauaguuauaacauauaguuuuaugcucuauacaccuuugcucagggaaguagccaugcuaccagcccccucucagcuucccuugaauccauggcuaaaagacacagacacauaguuguucaauuucaauuugccuucuuggcacaauuguugggcacuacuaucuccugccuggaaaagcaugcucuuaccagucucuuaucucugucucucccacauacccuaaacuucaguugcuaaauuccccuaaucccccuccuauaggagcggccugugugccacucuguuuugagaucuuacaugguucuuaguucuucucucuccaaagcauguuggacgccuccuccucuuuccuugaguccucugucugccucuagggaccuggagguccauccgucccuuccucccagcaauuggcccauggcguccuuuacugacagaucaagaaccaauuggggaccaggaccuuagcaucagagcugcuccuacaaauagugacaguaaucggaggaaaaaaagauaauuuuagauugcuguaauuuuggcuagcagaagacuguuguaugaugguggcccagaaauucugagugauagccugucagguugcuagguagugacucuaggcuuugagagggccaguacuugaaacauaaaagagaauggcagugucaaaguacagguucuguugucauuugaagcuucggacaccauacagaaaagcacauugaguccucuaaaauggaaacuucuaguucuuuggaaaguuaaguuaugucaacugaugguuugcuggugcacacaggugaaaggaguguuaguaaauuacuguuaauugcugaaaguucaaacucccugucacaucuugcuaaaguaaacaugugaaagauacaggugaaaggauguuuuguuauagcaaacacuugaaaggaugauugacgaaggaguauaaauaugaccccacagacagugggagaugagcacugagcuuggguuugguuuguuccaccucauuauucuuugauaaacacacauguauugguucaccuuacauagcauuguugaauucaacuuguguuaaugccaccacugagagaaacucaagaacugcuugugagguuccuguggcagcuuucagcuucagcaaccuuguugccucaggccuguuggcaagcccggugguuucuucaggauugaacuauagcugccuagugucugcuugccgagaggacuggaccaaagcuguugguuugugccuggugucugccuaccuagaggacugaucugcaguugcuaagucauauuuguuuuaugcuacgggaaugaacugcugccaaagaaaaccaggcucacccucaaagaacuauugcugaacagguccacuucucccauauccuacuaacuugucucuuuuacuaccucugcuggguggugggauagaggagugguugaguccuuaauaaaguagguugcaaaaauguaugccuauaguccuauuuuuuuccuaauugaggcuaauaauuguuccuucuguaaucacugaaggaauauaaauaaauuacuguuaguugcugaaaguuuaaacuccuugucuguccaucuuucucuaugaaagcauccguguaacucccaguggacagaaauguguacucauauugauacugaagugguucaguagaguuggcuuuucaccuuuaugcuugccuaguaagaguggggacuuggccacucuggcaguaagaacuuguguucugguaaaggucacagauuucuaccucccucaagcaccaggauucugaugucacacaaaaugaucugauuuauaacucagaauuuacaaugccuccccugcaaaucuuguugcugcuucauuucaugaagagaucugauagucugggcaggauucuucucucacuuugcuguacauugaggacuaaccuaguguucuuuuuaaaauauugguagccgcagacaugguagcacacaucuguaaucccagcccuuguaaaggcugagaagcaagaugauggaggccacggaaguccauauuauaacccugucguaaagcaauggcaacuguaaaacuagccauaccgaugcugucugggagcauagcucagcgguagggagaauguuugcccgccgucuaggaaugcucaccaacacaucauuaaaaaccgagacaagaacaaagauggagcuugguucccauccccauucucauuuaauugguguagggugugauuugguucugggauuauaagaaucuugcuaggugaguuuuugguaaaauauugccugagaaagaacaguggagauguguaccuuuaaagaccuaguuacuucuuccuacguugcuuggcguggcuugugguugucaggcgaauucucaggucuuggcauccaucagggaacugucuuggaggcuggaacuuucaacccuuggucaggccuaagcuggcuccugggcgucuuuuuaacucggggguucugggguguuccuuuuucuuuguguuguccaugccaugcuacuuuauuccuugauguccuuucggaguccuaguguagagugggauccaugcucucagccucucagacuuuuguuauucccaagacauucuuuucuguuucucaacuuaguguuuauuagcugugcagcacaguggguuuugucgacacuccguacauggaacagaguagcggagaaugcccuuuguagcgugaaauauuaaaaauccaaauccacacuacggccagcuaugcacugaccacuggucuuggucuguguucuggucggcaaacagaccgagaccacauuauuccuucuagccagggccugucucacccaggcuggcucugccugucuggagcucuggagucgcucucuccaccuggcucacuaaguucccacagcuggcugcugccacccccaccccacgcuuccaaauuccugaggcuggcuaggaugcaugcuuguacacccaagaucugccgccuuuaccuucucucucuggaacccagaugagugacugugugaaggaaaacaucacacaaucuuaguuuaaaaucaacagguaacgcaauugcugggcguggaaccuagcacccuaauuuuauaaucuaaccuauguuauaaauccuccaguagcugauccacucugacaaccucugucuuccuacauugugccugccucccuugcuccuacaguccagaaggaagucucuuucuccugcguucccucuuucuaacacagaaguccugccaccuucucgcccagugauuuaguucuugucgucuuuuuuucuuuuuuuuaagauuuauuuauuuauuauauguaaguacacuguagcugucuucagacacaccagaagagggcgucagaucucauuauggaugguugugagccaccaugugguugcugggauuugaauuuaggaccuuuggaagagcagucagugcucuuacccacugagccaucucaccaucuuuauuaucuaaccaguuagggaaaauuuccacaacagcccuucaucacauuuacuccaucuauuauacuuucuuugcccucucucuuuuuuucuuuuuucaaauuguucccccuuuuguuucuuucuuuuaaaguuaacuaucaccuaccagggagaaaacaacacuuugugagacuggccuguuccacuuaaugaugauuuccaguuccaucaaguuuccuguaagugacauaaacuugguuuugugugugugucugaauaaaacaucuacugugugcaucuaacacauuggcaaacacuuugcauaauaaauggcuucguauuacugugagaaaucagaggagacaccaccaaauuuccuuaucauuauuguguguguccaaaccccugacuccccauugagguucauucuguuagaggcugagcauugucaagaguagaaauacauguagaagaaugcauuagauccauauuugucacccugcauaaaacuaagaccaaguggauccaagaccucaacaaagaaccagauacacuaaaucuaauagaagagaaagugggaaagugccuugaaugcauugguacaggagacaaaugccugaacagaacaucauuagcucaggcacuaaggucaacaauuaauaaaugggacuuuguugagccgaaaagcuucugcaaggcuaaggacaccaucaguaggacaaaacggcagccuacagauugggaaaagaucuuuaccaccccuacaucugacagagggcuacuauccaaaauauauaaagaacucaagaaauuaggcuccaacaaaccaaauaauccaauuaaaaaaugggguauagagcuauacagagauucucaauagaggaaucucuaauaacugagaaacacuuaauguucaacauccuuagucuucagggaaaugcaaaucaaaacucugagauucuaccuuacaccaaucagaguggccaauaucgaaaauucagggcauagcacaugcuggcaaggauguggagcaaggggaacccuccucuauugcuggugggagugaagacuuguacaaccacucuggaaaucaauuuggugguuucucagaaaauugggaauagaucuaccuaaggaccuagcuauaccauuccuggguauguaaccagaagaugcuccacuauaccacaaggacacuugcucaauuaugcucauaguagcuuuauuuguaauagccagaaguagaaaaacaaaacaaaacaaaacaccucaaauguccuucaacugaagaauggauaaagaaaaugugauuuauuuacacaguggaauauaauucagcuauuaaaaacaaugacauuaugaaauuuguaggcaaauggauggaacuagaaaauauccugagugagguaacauggacacaaaaggaugugugugguauuuacucacuaauaaauggguauuagccguauagugcaggauacccaugcuauaauccacagacccaaagaagcuaacaaggagggcccaagggaggaugcuugaaucucagaaggggaauaaaauaaucagugggggugggaggagggugggaucuggguggcagagggaauggggagggguauggggguggacaggaguuuggguguagggagagccugggagagaggacucccagauacugaaucaccaaccaaagaguccaugggcuggacuagaaccuccacuucugcacauauguagcagaaauacagcuugguuuucaugugggucccucaauaacuggagcgggggcugucccugacuauugucugccuauggauccaguuccccuaacugggcugccuugucuggccucagugggagaggaugugccuaguccuucagugacuugauggccaggguaagugccucccccuccucagaggagaagggaggagguguggagggaggggcugugugagggggauacuaggaggagugggggagugggugcugccaucaggauguaaaguggauaaauaaauuagugugugugugggggaaagaguagacauaacuccugaugaagaaacuagaaucuguggccuggguggagaucuaccauucuaguugggcauggccaaggagccuaggaagccacguuuacuguaaggcaugguaaagagauagguguaguaauuaguccuucagugugacauuguaccugucuuucccaaggucaccccuugagcauuagcucggcaggccacagcuuccugaaccagcuggcugcucugaaucagucagaaaacucucacaucuccuuucuguucucuccauuuucucuuaacacuuugaaucuuuugugcuuucauacucuccuuaagcccaucccauucccccccccucccccagucauacugcugcuugucaguucucugucuagcuuucauacuagcucagauaaaucuguccacagcuugccuguccucagggguuucugguuaaaugcuaauaaaaguguccuuggacuuuccucugggucuguuuuuaaaaucucuuauuaauacaauuaagagcccugagaggagaccuggauuuugcccauaucaguacugagcagauagauacucuguagcguucauguuggaacguuccugccuuuaugaaggucucuuuucugaccaguggugaagucagaucuuguauuuagucaucugggauugaguaacuuauugagagguuuuugguuuuuuuuuuuuguuuuguuuuguuuuuuuuccuuuuuccuuaauugggaaacgguaaaagauuucucaacgugcagcauccggaagugaauucaaaaccaaauguguauugaacccaagguguuuguggcuguguuuauccugugcugcaucacguggcuucacuguagccuugguucugaacacacagccagccacucugcuccgcacuuauccucauguccucugcuguuuuaaacccggcucguaguuacgccccuugcguguuauauaucgcuguguuuucacugugcacacagauuuucugcccguacaguuuaccuauggaaaacaggggcuuugccgcuuuccuacugccgguccucggcacacaguguaugguugauaugccuucucucucuucuccuucccucucuuucuuagcugucauuuaacucuucaucugccagaaacaccuagcucgccguguucucaguucuccagugaugucacauuucuggcucugucgucaugccgacuuaucuuuugaacuaacuggagagucccaguguucuuuccagagggugcuagggauacacaguuuaaucugcagcuuuguuauacauaugugaggaacuggauuugugucaguuuaaggccagcuuugauuugauguaugucgugagucccagaccauccauaggaugcauagcuugucuccgauaaacacaaaaucuaaagcaucucuucuagaaagcacauuucuagggaagagcaacuauagagcaucccuugcacauagcucaguaugugccgaaugaacguuauaguguuccgaaggcuuuggguugauguguuugucuugcuguguagcugacacuggcuugacacucccaugcagccucagcugccucgccaugcugccuucccucccguguucugggguugcccaugugugcuccugcgccugccuuguuaccuuuacauuacuguauuauauucauuuaguuguagucucaaaguaggcuuuauuugguuuuguuauuuccuaguagguggauuaaauucggcauguauauuuguucgcacugcagaaaugaaagcaccccuaaagucuauuuuuagcaagcuagcuaugaaguagucaugggaaaugcacuauagauuuuuacuuggaauauugcccucccccuccggccccugugaugaaaccagagcuuuaucuccugagcauuuaggugguuuauaaacauuaaucuuuauauucugacucuuuccaaguucugugauuuguaaccuugcacuugauuccuuccuguuucaggguggauucuucauaggcuuagugcagucuuauucguaauaucaucaucuaguggcaccuuccauucaugugucagcacacaucuuauuaugggaauucugcuagcagcuguuuugauuuuccgucuuugcuuuuuucaucauuucucacuuuuauuuugacaggccuguuucuguucccuuuaggaaucgccuuuguguugaaguugguggccauguuugaacagacagaauuagaaucuuguauugucugucaaccuuaucaauggcuuuagugacagaugacaagucacucaacuauaugacuaugguggcauauuuuuucagcuauuaacagauuuauauuuauuucuaguuuaguuuugaaaagauaugaaauuuacugggcagugguggcauacgccuuuaaucccagcauuugggagguugaaaaaccaaaaaaaaaaaaaaaaaaaaaaaaaggaaaagguaugaaauggaacugauaaaugaccagggaacuuguuagguggcagagaacucugucacggaggguggcaguggcacaucagaagccggcgcuguccuuguccauccugguucagguggcacugacucuuugcucuuaauuuacaguugugugaugacagacgcagcccugcugaagauggacagacggcaguagucagcuguuccuccucucuccucucaaaagacuugaucguuuggugucuuguuuccagccacugcuccucgaucaagucugucugcuuccuucgucagacauguuccguacaaucucaaggaaaaauaugucccagaagcugagcuuccuguuguugguguucggacucaucugggggcugaugcuacuucacuacacuuugcaacagccgcggcggcagagcagcgucaagcuucgugagcaaauccuagauuuaagcaaaagauacgugaaagcucuggcggaggagagcaggagcacggcggauguggacagcggcgcguccauggcaggcuaugguaagaaccuggcgaugucuccugacuucuccuucccagcccaguccuguguaaauaacuuacaggaguugagcucagcagccacgugugcucuuuauacauugauuuaaaaaaaaaauuacaggugaauguuuucaaaugaaaaguagagauauaguacugauauauucuucacucagauuuaaguuauuaauauuuacauaaaauucauuauauuuuaaguacauuauauaaauugacauucaucucuuuuauauauauauauauauauauauggauauggauauauauauauauauauauauauauguauauaugcuaugguauguacauuuaaaaugaguauguaagaguaucauuguauauauugauuuuuuuuaacuccuuaauauaaacaucaaauagacaacaucuauuaagucccaagaaacaggauuuaccuauaguuccagcuuuacuuacugcaacucucccucucauagcuuaggcuccuguuguuucaaguuuucuguugcuguuuugguuugugagacagggugucuguauguaguucugaguucccuggaacucaccauguagaccaagcuguccuugucacagagauccaccugccuccaggcuuggaccacacaucuggcuuguuuuaaguucuuuaugugugccagucuuuuccuuuuagacgagaugggaagcuaggaagucggaaugaagccuguucauucggugcugggaaucaaauccagggccuucacaugaugccaggcuagcacacugucuuaauuaggguuucauugcugugaaaagacaucaugaccaaggcaacuuuuuuuuuguuuucguuuuuucgagacaggguuucucuguauagcccuggcuguccuggaacucacucuguagaccaggcuggccuugaacucagaaauccaccugccucugccucccaagugcugggaucaaaggcgugugccacuaccgcccagcaaccaaggcaacucuuacaaggaaaacauuuaauugggcuggcuuacagguucagagguucaguccauugucaucauggcaggaaacaugcagcauacaggcagacaugaugcuagagaaagagcugagaguccuacaucuugaccuauaggcagcaggagacugagacacacuaguuagucuugagcuaauagaacuucaaagcccaucgcugcauugacacacuuccuccacaaggccacagcuauuccaacaaggcuacaccuccuaauagugccacuuccuaugagccacacuuucucucaccugaguccuuagggacauuccuauucaaaccacuacacacucuaaaccaagcuauagcccuagccugucuuauuuauuuaauuauuuuauuugaggcagaguuucauguuucucagguuggccuugaacuuaccuuguaguugaauauggccuuggacuuuuguuuuuccuuuaucucccugguacuggaugacaggccugugccaugacuuuugauuuauguguugucagacuuaggguuuugugcauaccaggugagcaccucacuaacugagcugugugcccaacucuauuugcuuguaaacuaggcugaccuugagcucaauauuuuccuguauccugagugcauugggauugggcuucuguaguaaguuuguugguugaguguuugcuuguuuuuguucaagucaccuuuuuuuucuuucagcagagguguuugccucuugaggaaaggccuaacagcuaggucacaguaugucccaagggcugugaguucaagagugcaguaaugccaucccaaggcugcucuuacauucgcucuucuguaggauuuccugagccuuggaggaggagauacagaugccccauuuaugcuuucccuguuagaaagaacaggcaaggcaugguggggcacagcuguaguuccagcauuaggaagguggacacgaggcaugguggggcacaccuguaaucccagcauuaggaagguaggcacaaggggauuccuggggccugcuggccagcucaucuaacuggauuggcaaauucuaguuagguacagugugagacugucucaaaaauaagugaaggcugagacuaaguggcuguugaauugcuaagcuaugagagugccagcacucugaaccauggauccgucucugcagccuccuuguuuuaucuuuccaucagcauuucuuugauugucaaccauuuuccacuacuucuuucugaaaauuuuaaaacuuuacauaaaaucgugaacuugccauuuaauuauaauguaauucacuguuaucacuuauauucauagaaguguguguaugcuucacacuuuuucugauagcacagcuccuagcuaucaacuuuaucagcugccguuagaugauuuuuccuggggaucacagaccagggguggacugacuuuuugguucaggaucaucaacaacaacaacaaaauaacaguaucaguugccacuauugagucccuaaugucugugaaaagccuaugagacacgugaagggcaagucacaagagaaugguccuuuuuuuuuuuuucccuagcuaggaaaacuguaauaaagcccuccaccuuccacagagguuaagaaucuuucuggaagaaauuaaaauuagaacuaggugcaggccuggggcccuggccaggccuccugagugugcggugucagcaauagucacaguaugucuuucuacaaggucagaauucauucagugauaguaaauucacagguuuuguugguuuuauugacugcaguuuucuagaugguuccagcuguccugacagugaggccaugaggucuuuuauuccaaucuuaauugcuaauaaugcucagaucacauauuucaaaaaaaucgguuuauuauuguuguaugugcguuguauagcuguguguaucaucagggucgugcuuuuguguguguguguguggggggggguguuugugcacgcgugcgagcacguaaggcagaaacaagguuuaggagucaguucucuccuaauguggacccugguggguugaacucacguucucaggcuuuuacagcaggagucuuacccacaagccaccuugccugcccucagaccacacaucucccuucacaauuguguguaguuucagaacagcuacaaaagguugaugacaggguucggagaggccucacuaaguccgaggugagagcucauagaaacuagucccugaaaauuagacaagcucugagccucucagugaggagcugcagagaggccugcugaggcggagcugaggaaggagcugagaagccacggccagguccacaggauuagagcaucagucagggugcagggcggcgucuggauggaugggcagggguuugauuagggcucaucaagcagaggggacccugcugaacugaagugcuguggagagcuuggaguucucagucuguugcggcaauccuauacugcucugugcuccuggcuggucaggugugcaccugcccgggaccacacagacacacagacacacacagacacacacacacacacacacagacacacacagacacacacacagacacacacacacacagacacacacacacacacagacacacacacacacauagacacacacacacacagacacacagacacacacacagacacacacacacacacagacacacacacacacacacagacacacacacacagacacacacagacacacacacagacacacacagacacacacacagacacacacagacacacacacagacacacacagacacacacacagacacacacagacacacacacagacacagacacacagacacagacacacauacagacacacacacacaacacacacacacacacacacacacacacacacagacacacagacacacacacagacacacacacacacagacacacacacacacagacacacagacacacacacagacacacacacagacacacacacacacacagacacacacagacacacacacacacagacacacacacagacacacacacagacacacacacacacacacacacacacacagacacagacacacacacagacacagacacacacacacacacacacacacacacacacacagacacacacacagacacacacacacagacacacacagacacacacacagacacacacacacacacacacacacacacacacacacacuccaguuauucuuaaaaugccuuggcuaacucaaugacuggccacuccuaauccuuccccugcuaccccagacccaguugggaaaguggccagaaaacucacgcgguagguuggcuuuuuuccugcuguuacuguguucccuucuuccucuggaguccucugauucucucucugcauccuacccgcucaaguuucagugucccgcccuauacucagcaauuggcuacuggcgucuuuauugauagaucaaaauccaauagggggcaaagaccuucaguaucaguaaccacagauuccugaucaaagcuucagaaccgcccucuacauccguccugucuugcuagagugggaugguugcaccacaggugggugggccguugccaugucucaguguuaaaugucucucugccauccucccaggcgaggaugcugcauccaucaugggucugggguuugcccucuuguucauauggagcauuugccaguuaaugcuucaugguuagugcuggccaggcaguagcaccugcacacaaacacgaaugcaaagcccaaagccucugcauuuguccucagcauggagccagaggcugcuggaguagccuggaguaggucagagcaggucgccggcccugugcccuggcuccccacccccguuccccauggagcuucagggucuggcuuuuauggggguaauuugcuuauggggcucuccuguucugccuucacuaguucuccaccugccugguccagccuccuuauaccuacucagcaacucagcgucccaggagaugacucacugguaagagcguuggcuucucuucccgagaacccagcagcucccacauggagcucacagcugucuuuaacucuagcauggaauccaccacccuccuuggcuucugggcacuaggcauauacaugguacacagacauacaugcagaccaagugccuauacacauaaaauaaauguguuuuuuaacaguaagaaacagucuaaauguuaaauguuguugcuuacaaagggacugauguuuugagccagacuuucaauccgaugcacggcucucagaaguggagaguucuggugugcuuguaacucugcugcuuuggguguggugcuagugaugaucgguaugagacuuucccuguugggcuccaaguaucuuuucugaaacacuuuugcuuucagauauccugauaauuguuuaccucuuucccuuaaacuguaaagauguaaacauuaagugcucuauugcuauuuaauaugauugauuccaauuuuuccccauagcugaucugaagagaacgauugcaguccucuuagaugacauuuugcagcgcuuggugaagcuggagagcaaagucgacuauauuguugugaacgguucagccaccaacacuaccaauggcaccaaugggaauuuggugccgguaacgaccaacaaaaggacgaguguuucgggcagcgucagauagcagugaagggcaccuugcacggcuaccacuguggauuccauccaucgcagcgcaccucuuaaacugcugccuaggacagaguaauacuugacaauaaaagcucuacacaucuccaaggagcuugcuggauucauaggauguuaauucuguauauauaaucgcaggcauuauuaguuugcuuugacacaaagcucuuuaaugcuguucuguauucuuaacaggaauuugguuaacaagguugauaugguaagcagggaggucaucucuguacagagaucgagaaacaaaagcaccagaaagacauggaguccuuucuagaaauacuuaucuaaguauauaauauguuugucagauaaguggacaguaacguuggacucauucugucacccgcccucagcagugucccugugaguagaaaaugugcuuacuuccagaacuauauuuuguuacucaauuugcgagcagagaaaggaagugucauguugaaaaucauguuuugaaauagacccaaagaauguuuucauuugcacuauccuucaaaauuaacugaagguuaauuguauauuuuuaaaaauagcauuuguaagaauauaauuuugaaauggguagcagccacuguccauagcuaaccgucaggggacaauuuaauagaaaugggaguaauugcuaaucucauacuuuaaaauuucuuacauauauucugcagaauauaauaaauauuuuuaugaugaaaugaaaaauaaaauaugcaugauuuuucacaaucauggcuguugguuugaaaaugaaucucagugucacaugccuguagccauggaaccagggaggcugggacaggagagcugcaagcucaaugcuagccugggcagcagagcagacccuauguaaaaaccauuaggaaaguccaucauuuccauauucugguaaguguucuucgguuauuuugguggaagaaggaaagggcuugaggacuuuagccagauagauguauauaauaaauguuauuugugcugcacagaagugcuuggaaaauuaaugugaguugauguuauguaaguauauaaggaccacuuuacagaauuaagaacauuaaaauauaaauuaugaaaaugguuuaucuuuuuagagaaacagcuacuguauacagcacaagaaaucuugacuugguuaauucuaguauagaauaaaacaugucuuuauuuaaauagccuuuguagcaaauccaauugcuauauaguauucuauauuucguaguauuuauucuauauaauaacugcuuaugugcagcuagccucuagauuuagaguaaauugaauuuaguuuuugauauuuuucauuauuauaaugcuaccacaaaaguagcagugauuauaauauuuuguuaaaauaaguauaagaaauauauuguuucaugaaagauaacuuucugaaaugucuucccuguaccuuuauguaaagaaaugaugccccauugcccauagauucugcaguaccguucggucucugaggaguccugagcaucucugauuucauugcuuucagggaugaaauaaaauauauuguuuauauucacaaugguu

SEQ ID NO: 2991 - RNA, 73900 nt, Mus musculus
agggcuggagggcugaggguggagcgccugguauguggggccagcggcucuuugcugggacggcuguggcgcaaaguguaaggucagugguagucuuugguggcgagggcgacaggggccgcucccaggguguucuuguccacgcugcuggcguuuuaggucugggcugaggccuacuuccggcgagcucgaaggcgccgcagcuucucggugagcugcccgcagacccacuguguggacaaaucuuggugagcugcccgcagacccacuguguggacaaaucucggugagcugcccgcagacccacuguguggacgacuuucuuccccucuggcgacgucugugguuuuagccuuccaggccccccagaaagccagcaucuuuaccucaccuuggcccauuucaaggcgagauuugaauucgccgucgugcccuccaccucugcuuaaagucacuacaguuccuuggcaagucuuuuaacaacgauuuaaaauaaggcuagaaaaccaguuucuuaaaacaaguggcaggauuuccaaaguaaacuuuuaauuuuuucugugcccgugacagugguaacacaugucuuaauccuacuccauucgggaggcagaggcaggcagaucuuugaguuugaggccagccuggucuacagagagaguucaggacagcuacugagaaaccugucuucaaaaaaccgaaaacaaccaagaaccaaccaaccaaccaagcaaacaauaguguuuuccagagaaauauucuuucucacuaaaagacuccauuuuuuaaaaaaaauuuuuuuccauuuuuuauuagguauuuagcucguuuacauuuccaaugcuaucccaaaagucccccauacccacccacccccacuccccuacccacccacucccccuuuuugguccuggcguuccccuguacuggggcauauaaaguuugcaaguccaaugggccucucuuugcagugauggccgacuaggccaucuuuugauacauaugcagcuagagacaagagcuccgggguacugcuuaguucauauuguuguuuccauuuuuuuuuuuuaaaacagcuucuccacagcugaauuuuaaaacuacuuuuuaaaggaucccagauuugaagaugauucagugauguuauuugaaaaaaaauuaagcuagacaaaauuugcaaguuuuaaauuccuauaaauaagcuccauuauuugcugugaugaguuaauuacucuuuucauaguugagagcauuugaaaccuugauguagauuagauguucuuggaugaucuaaaagcucucaaaaaaugagucucaaaccauggcauguacccuacguuuuaagggcaguuuugugaaaaauuguuuuuccccuauuuauuggaauguguagaauuaccuuaaaguugaaggacaaaccaaugcucuaaccacaccccccagcuuuggaggguggagagugcgccuauuuugagaaugaaauaaaaucaguuggaauugaacagugaaguagauuacauauuuuaucauuuuaauuuaugaguagaaagugauuccuggauuuuugagaaucaaaucguaaaguaguagacacuucuuuugaaguacuuuuuuuauguaauaaacaugauuuuugaaguaauaggcaaauuugauauauuucaguuuuuaauucuagggcauuuuaaaaaacaaaauagccaauagccacucccaggcuagccacucucaggcauuuuauuauuuauuuauuuuuuuauuuuauuguggaauuuucuuguuugagagguuuuuuuuuuuguuguuuuuuuuuuuuguuuuuguuuuuguuuuuguuguuguuaauauggguuuagagagauggcucagcaguuaagagcauuguugauuuucuagaggacuggguucaauuccuuuccuccauguuggcauuugggacuugggacagcuuaguuuuguuaaacauugaacuuuaguucucuggaagcaucaacacagcaguuuacauggcuguaacuuuagucccaguggaucugaagcccacuuuugucccccuucuggccucaacaugcauugcauguacacagaugugcauucaggcaagacacauacaacacacacacacacacacacacacacacacacacacacacacugcauguuguuucaaaauauugauuuauauaagugaucaaaaucuguuugaguuaucuuacuuguaaaucuguaaagauuuggcuaaagauaaugauagggacagagauaauguguuuugccauugaaaacuauaauauuuucagaacaaauacaagaaacagucaugagaaaacaggaaguuuuuaguauagaguuugaguuuugauaaccaucuuagggcaaauacuuugaacauaugugguuuagauuuuuuucacuguuaauggauauaaaaaccuaauucaagguauugaauuguuaguuuuccaggacuuguccaaauggaugaagauacacauuacaauaaagguacuggcauuaaauauuauuuggggguauaauaacuaaaugauacugauuaacuucuaauuuguuuugcauugugauuuuauuuuaguugaagauguuguuggaagucauguagaagaugcaguaacauuuugggcccagguaaauauaauauugguuguuuuuucuuuucuaccuuccucuuaucaacucaaguguuuuccaacaaaaauaaaaaucuaauaauaaaugugauuuuuguuuucauucccaguaccuaaucuugauuaaaucauauaacacaagacauaauuacaagacaguugauugcaacaugcaguuuuccuauguugaaaaaaaugcuuacaauugaauuaaacaagaaaauuaucaagauuggaacuucagagucauguucaauggggucagaaagccacaugcuguuguauuuuuaaagcuauagcuccaccuaggggucuuuguaagauuguuuccugaaaauuuaggcuaaacacuuuuuaaaaaaauuacuuaacauccaaaaaaacaacaaaagcagaucuuagcuuucuggccugugugugucagaaagcuaaguucuguccucuuuuugugccuuuaacacauucacaauacuuuccucauuuuuauuaguucuuugaggauuuuauucaaaguauuguggacauagccaccucacacccuucuuccccucaaaauaaaguuuugcucuugauccugucguggaccaguguagcauaugugggaucauagucccugcugacacugaaggaauuguagguagcaccuuuccaaguuggccuaccuguaagucacacgcaggaauuuuguguuuucccgacuuucuugguauacaagugaauaguucuguugauggagguuuggggcaguauaguuuuaaaaacaacauuaauuacauuuaacuuauuaauuaguuaaauacaccauaucuuuauaaaauaaucuuuuagcauacuucuguuuuacauuuuuauuuuuuauucuuuuaucauuucauacaguauauucugauucuuuuauucccacucccaacuccuaaauccucacccaccucccuacccacacaacuucauguuccuuaaaacaaaaugaaaacccaugguguugaguuuguguugacugaaccugaggccugauccacagugugauugauguauccaggaucccuccauuaaggaauacugauuuucucuuucccagaagcuaucaauuuugaguagcuucuuugcuagggguacccacuuccccuuuuccaugcugggguuugggacagcauuguuuuguuagaaguuauguuguguggaagcucagauaauaugucaaacauuggaccauuuuggauacacuuacaccauuucaaagaaacuucuugaaaguuucuagcauaucaggugguaguagauuguaaagggaguaaagauagggagaggaaaagcuucuguacucuagccgcuggcaggugacaaagaaaacccagguuuuguuuguuuguuuguuuagugaucugcauuuuauuguaagauaaguauauaauucugaaaucuggagaacuaauaaagugugucuuauuucaaugauagacugcaaaucaggaaaguauauucaguuuuaaauacaaaguaagcagggugugauggcacaccccuuuuaucccagcaucugggaggcagaggcagguggaucuccaaggacagccaggucuacacagauguuuucucaacaaaacaaaacagcauaacaguauuaaacaccaaaguucuuggguuucagauguuaagaagugaaucuauaauguacuguuacugaugaauuuuugauucugcaaacuauacaugauggggguagggagaggaaauuguauuuaacuacacuucccauggcuuggaaacuccuuuauaaugaaguuaaguguacaguguauaaaguagaaguuauauaaagagcuauagaagacuaugauuaagaguucuuaaaacuacagaaauaucggcagaauuuaugguaaauuauauacuuacacacaaacuuuuuauuuuuaaaaauuauaugcauguguguuuugcuuguguuuaugucuguguacaacuuccguaccugguguccauggaguucagaagagggaauuggauucucugaaacuggauuuauagacaguugugaguugcccuguuggugcugggaauugaaccugguuccuuuggaagaacaaccagaacucuuaacagcugauccauuucuccaguuguacauacacuuuuuaaauggugcucacauguuguagaucuaugugggucuguauucuauauuauuuagcacaugugccacuuagugguaccccgcacugaaugacaaauuauauauuuaagguuuuuauauaggaacuauauguguacuaacuuaauacuuccuagguuagugcuguuacuguagaaauacaaugugaauccuauaaguaauuauagcuaguuuuagcagccacauuggugcaagcaaaagcaacagguaaaauaauuuuaauacauauauuuauuuaacuuaauauauccaaaauacuguuucaaaaucuuaucagcaaacugugccugguaauuccagcuacuugugaggcugaagcaagaggaccuugaguuugcaccugucuugaacacuuagucagacccuguucaauaaacaaggacuggggaugugguuuaguuauacaguacuugccgaauggaaagggguuccauuuccaaugauagaagaaagugcaugcaugcaguugguauaaaauaugaauaaggcauuauuuauuuauuuagguuuuuaaagguucuuuguguagcuauggcuguccuagaacucuguagaccagacaggucuuaaacucacagcaauacacacuacaaaaaguuagaaaacauuccuuagaugaaugcaauaaaaagauuaaaacuacuguugcuauuccuauauaucuaaugccuaucccaagaugcaaaucauaaaaucuuuuugagaugagguugagaugagagcagagacacauaaguagagauuuggaaauacagaggcaaaucagggugaagaucuauuguuugcuuccucagccugauuucugccacuuaaaagagaauacuaccaauugaauggucuugagcaaguuauuauuuacuuuuuuauuuauacuguaccuuuuauucauacuguguguucucaaacacuuccaaccuuuauaaucugauagauuaaaauuguuauauccuauaugcucaugaaaacugccacuacuaauaacaacaauauuacugaauaugugcacuaguagaaauauuaccuaaguagcuuauuuaacuuuuuggcuccucaucuauacuuuggagguaaguuauauugucauugcuaaguugaggacuaaauaaaugaaguuucaaaaaguuguaaaaacuugcucaaggccauucaguugauaguaauggaacuggaaugaaguuuugguaaucuucacaaaucuuaauguauaauaauuaucuuauacugcauuuauagaaaaaaaauguucauugcaguauaauuuuaauaaauauaaaccauaaaccauugaauaucaauugcuaaaugaauguaaaaccagucaugauacacccagacaauagaauuguaggaaauuauuguaaagaaaucagaauccuuuucuaaaagagcagaucuccaaguuaaaacaacaguacacacaucuaaucucuagcauaguucgcaaggaacuacaagcacuaguguuuauauguagggaaaaauugggggaacagaaggguagaaagaauuauuagucauauuguaaaauccuugguacugcuuggauuuuguauuacuuaucuauuugguauuuguuuaauaacacacacaaacccuaaaauuuaaguaaauuacugaguaaaaaaagauauuuucuuuaacuaauauuaauuauugcaacucauaauguuguuucucaagucuucauauacuuuauuauucaucuguucaagcagcagaugcuguuguaucacuaugugcuaggcacuggagcauguacgggaaaugaaagauuaguauaagguacacaccauaucucugaagaucuuaccuucuaagcauauaaaacaaguuauucaguaaauaauuagcauuuccaaugauguucaacaagaggggacuaaaagaugauagaauuuaagcuugaaaguguccucaacaacaacuugcuggaauauaugaauuuuuacaaauuaacauaaaggaugaguagaauuaugacagaagaaagugagagaaaaaaggcagagguguacuucagucacacguaagacugaccaugugugaaagcccugaagcaagaaggaacacaaccaauuugggaaaugaaggaaguguaauaugacuguagccuacagagggaaagcaaaaacagugaucugagacuaaaguuaguguauuuugagagcagugcaaacucaugagugguuuaggauaaacgaagacauaguaauauuugaguuaagaugcuuacuaauauugugaacaguggacuggagaggagcaaaaaaaaauacuuaaggauugucaguauuuuuagucagaugaauggcaacuaaaggaaucuuaaguauuuugccuucaccucuuucuuuucuucuucccuuuacuucauuuuuuccuucuuucacucccuccauccccucuccccuucucccccaucccucucuacucccuccucuuuuuuuuuuuuuuguacuggggauugaacccagggcuucauguauucuagauaaauauguucuaccaacaguguuauuaccacaacuccuaguucuuuuuuguaugaugacagcgacauucaucaugaucucuuggaacuguucuuugagagguuuucuaucacuagacauuauagccucauugaauauuuuuucuuggguuucuauaaagcuugauguguguguguauauauauuugauuuuauuuguguucuugaggcagcaugucaucucagagcccagcuggccuccaacucaagguacuccugcauucccuacuucucaagugcugggguuacagguguacagcuucacucccaacuuauauuuaauuucuucuaauuugaagaacuuuauucacaguaaaauuacagaaucaguucaaaggcuucuuguguacuucucacccagcuucuguuaauguuaccucuuguaguaaccauagcacagcgggguaaaagccagaaaauuaauauuggcacaugguugccaauugaacuauauauagccauuauuucaaauuuuaccaguuuuuuuuuuuuauguuccaggauccacuaaaauuacccauuguauuuuuaagaggccucuaaccuuugcuacuuuaucaaauuucuugacuuugaauguuuuggaugagucccaguuguuuuuauaaaguauccguuuaauggguuuguuugaugauuucucauaaauuggcuagaauguccaaaaaugauguuguguccagugugcauuguauugggcuuccuggugucauugaauauguuaacuuuaaucuacuuuguugagauguucauuucuuaaaaauauaauaaauauuuuuauuuuuuaaaagauuuauuuauuuauuuauuuuauuuuacagcuacacuguagcugucuuaagauaugccagaagaggauaucagaucuuauuagagaugguugugagccaccauguaguugcugggaauugaauuuaggaccucuggaagaacagucagugcucuuaaccacugagccaucucucuagccccuaauauuuuucuuuuguaauuauaaauguuuuagagaaagacacaugggauugacuagucuuguuuuuccuaacuuuucacugaaaauuuuuaucuuuucuugguauuguacuggucuagugauggccuuucagccuucuuuauuccuacuacaucuauugauugucuuucuguaaggaagagucauuucuuuucugugacuagugugacuaguggauaagccacagguuguaagucuuuugcuguugucauuuacuuuugcuguuugaauucuucauuucuggccaguggagcagaaguuggccaaagaacauagguugguuccaugucuccuagacaugucuuagucuuucuuugagcacuugcuuauuuucugucacuacaauuacccaguuuguuucugaggaaccugcuuaguaugauuuaauaauauuugguacuuuauuugaauucuaucuaagcuuagugucauuuuuuuuauaagaacucauuugaauuaugaagaaaaugguagcacaauaauaugauccagccaggugugguuuaugccuuuaaucccagcacuccggaggcagagacaggaggauuucugaguucaaggccagccuggucuacaaagugaguuccaggacagccagggcuacacagagaaacccugucucgaaaaaacaaaaacaaaaacaaaaacaaaccaaaaaaaacaaaacaaaacacaaaaacaauccaauucccaguacuuuaaaguuucuuaaauauuaggcuuaguagaacccuuaauuauauaugauaucuucagaaaauaauuuauugaaucucauauuuuuucuguuuuauucuuagaaugucaguaaaaauaaggauauuaugaagauugguuguucacucucagaaguuuguccucuugcuaauucaguuuuuggcaaucuugauccuaagaaggugagcguuauuccuggaaauaaucauucaucguacaugucagcuuuuccagauuuuagaaucuagauuuuggaauuuggggccuauuugaauagaaaagacagauuuuguauaaacuacauaguaaauuuuuugaaauuuauuaauuaaaaauaacuuauggacagaaauucugauauaaacuauaauaugacuuuugauuaagcauggggccuaguacaucuuaggugaguacuaacagaucuacaucuucagcccucuaaauuguuaugagucuuuugucuucuguauguguggcuaauacuugcuucuguucuguggcuaacuuaauuaccuuuugaauaucauuugaaaucugauacauauugcuaucuuccuuuuugauaugugauuucucuuuccugcuuuaacucuucaucuacagagagaugggagauagggaaggaaggcagagugggagaaugaaugaaaaaaaaaagcgaaaggcaaggaaagacacgacugcuccuagggaugguggaggagagaguuuauuauagacauaugggagagcauguccagagugggcauggccagacugagcugggccuuguggggagaggaaggagacggggaccagguauagcagcuaggaguccaaagguacaaaaggcaggugaucaaaaugucuagauuauauagcaaagagcccuuugggggaaggguagcaaaggccugggcuagagaauugggguagaggacaggagaauugggguagagggcaggguaugcuagccauacccuguuacagguagggacugugagaugcugggagaaccuggaggacaaauaggcaccucagcuacuuguccuggguuugaaacuuaacaaagaggagagagaugaagagaggaagaggagaguggggggaaggcagagggagagguugagagagagggauagauagauagauagauugauugauuuugguugauugccuguucuuguagaggccagagacuguuuguccuucuugauuguuuuccauuuuaguuuuucuuuucuuuuuucuuuuuuuuuuuuugagucaggaucugucauuaaagcaggaggcucaauuauuuuggcuaagcuugcuuucuuccuuuuuaaaaauuauuuauuuauuuauuuugguuuuaugauggcugaguauugcccucucccagaagacaagaagggguacuuuuucuucuucuucuucuucuucuucuucuucuucuucuucuucuucuucuucuucuucuucuucuucuucuucuucuucuucuucuucuucuucuucuuccuucuuccuucuucuucuucuucuucuucuucuucuucuucuucuucuucuucuucuucuucuucuucuucuucuucuucuucuuccuucuucuucuuccuucuucuucuuccuccuccuccuccuccuccuccuccuccuccuucuucuucuucuuccuucuuuuuucuucuucuuccuucuucuucuucuuccuucuucuucuuccuucuucuucuuccuucuucuucuuccuccuccuccuccuccuccuucuucuucuucuucuucuucuucuucuucuucuucuucuucuucuucuucuucuucuucaacacuuuaucuaccuuuuugagagguagccuaguauaauggacucuggagucagaaguuugaaucuugguucugcugaagacuaggcuaugacauuggauacguaacgguauaaacaaaguaccugcuucacagguguguuaggagaaguagauaaguuauuguauauaaaguauuuauuaacauaaaauagcacaugaugcuaacuuauauccugaccuacuuaguaugcuuuuuuaucauagugacaauuuuuuucuuuuacagauuuaugguggauuguuuucugaagauaagugcugguacagaugcaaagugcuaaaaacuaucagcgaugauaaggcaggaaauauguauucauccuuugggcuuaaauguuuauuuuggucacaacacuuuuuaaaaguguaguuuuuaauuuguuuacaaauauuuauuuuuguguauauguauauauauauguguguguguguauacacacacacucacauacacacauucacacauacaaauaguacauagcauaugugaggccugagggaggugguucuuccuaaccagcaucuggaauugaacuggaauugaacucagguccucagccauagcagcaaacauccuuaccuacuaagcuauugcuucugaaacuugaugccuauugagucuauuaguguuaauuaauagugaugucuaguuuaauaaacuuaacacuuaugaaaguauuuuuuuacuggugaauaugaagauaaacuaauuuaaaacuagauaagauucaaaaauauucuucagaauucaaguuucuguacaaucaucaggcugucuaaaaauagauauauuucauaauguauguaugugguaaauauuuuucuuggaaaacuuagugggaaauuucaugauuucucugguugguaugguuuuaaaauaugauuuacuagugcuacaauguuuuaucuuugugaaauugacuuuucuaauauaaaauuuccauaauuugacaauugaagaauauauuuacacuugucauuuggauuaauuuuaagauuuuaaauuaaggcuugagaugauugauuuuauaauauacuuuuagaaaaaauuuuuucuuuuucuuuuuuuucuuuuuuaauauuuuuuauuagguauuuuccucauuuacauuuccaaugcuaucccaaaagucccccauacccucccccuaccccacucccuacucacccacucccacuuuuuggcccuggcguuccccuguacuggggcauauaaaguuugcaugaccaaugggccucucuuuccagugauggccgacuaggccaucuuuugauacauaugcagcuagagacaugagcucugggguacugguuaguucauauuguuguuccaccuauaggguugcagaucccuuuagcuccuugggugcuuucucuagcuccuccauugggggccgugugauccauccaauagcugacugugaucauccacuucuguguuugcuaggccccggcauagucucacaagagacagcuauaucaggguccuuucagcaaaaucuugcuaguguaugcaauagugucaguguuuggaagcugauuaugggauggaucccugguagaaaaauuuuaaaacuuaaaaaaagugugucugagaguucucucugcucuuauguaccauguguaugguguguauaccgugcauauguaguguccaugcguauguaguguccaugcguauguaguguccaugcguauguaguguccaugcguauguaguguucaugcguauguaguguccaugcguauguaguguccauguguaugguguguauaccaugcguauguaguguccaugcguauguaguguccaugcguauguaguguccaugcguauguaguguccaugcguauguaguguccaugcguauguaguguccaugcguauguaguguccaugcguauguaguguccaugcguauguaguguccauguguaugguguguauaccaugcguauguaguguccauggaagccagaagaagguguuggagcuggaguuacagaugguugugagcugccauguggauguugggaacugauccugggucuuccggaagagcagccagugcguuuagaugcugggcucucuauauaacuccuggaaaaaaaaaacugaacacauagacacagggccggaaguaaggguaaauuuggucagccucaaggucuagacagaguggguuuaauuuuaucaaagaaaguuuuuuuuuuaauuguugggggaccccccccccccagguucuacuauuuucaauuugaacuuaagaauguagauugauuuuacuauuagauuaggaaggaucacaaugcuguaugcucauguuuguauaaaaacagcagugguuaaaaaaagauaaaugacaaaugguacucuuggaaauuagucccaaauguuggauuuuucuuugaaguuguuauuagaacuauuucuaaagguguucaucaucugagguaacauuuauaggucuuguuuauaaauuuguaaucuauguuuaguacuaguguuugcuuccaauuuuuuucuagugccuggugagguacauugacuauggaaauacugaaauucuaaaccgaucugauauaguagaaauuccuccggagcuacaauuuucuaguauugccaagaaguauagacuuuggggacuacagauuccuucuggccaagaaguuacccaguuugaucagguaagucauacauuuaaauauucuuguuaauguauuauaccugaaacuauauacuugaaagcauaagcacuauuaaauauuuaggaaauuauuaauuuuuaaggaaaauaaauaaaauuuaugaaaauauaaaaauaaauaugaaaaauaaaauaugaaaagguaauucagguuuauggauacaguuauaguagaacacuuaguaugaucagacccuggguuugaucccugguacuuaccaaacacacacacacaaaugagcauaaauacuguuaggaaaagcauuggcucaggacucucaagaccaaguucucagcacaaaggagauguauuuguuccauagggacagagaacauggaauaagugacaaagacaggagacagaagaugagggagaaagggaacaaggaaaagggaguagggauaucugucuggagaggggcaaaggacucccuuggauagagaggagacagacauagcacauaggaaaauggcaguuuauagagguacgaagggaaaccuguuaauuaggugaguguaaggggcuuuugauugcuggacuuaaauaguuugauaggugggccuuggugaucagccucaggaggaggcagcagccaaauaagggaauagaccuugguggauaguucuaaguuuuuagcaaagcagaaggaacuggggagaagcacacagccugccagagcaauguuugcuugcugugcucuagcuggccagaccccuucaaaugcaugaaaaacaauuauguauuuguccucgucuuugguagguaaucauucuuaaugaucaaauaaguggauguauguauguaagugaauaaaacaaauguggaaaaacagacaacaauaacaaaacccugaaugugaauaguuucuucuguaaaaauuuaaaaggauugucuuuuauaugaugaaaaaauucuguugacauuugucuuugugaauguauugguuuguuuuguuuuagaauacuggggauuaaaucuugagcaccccucaguggucuuuaacccuguccauaaauaucaguaguuugaaauuauuaguauuacaaguaaucagauuuauauuuuaggcaauaugauaguuuuaauauagcuggacacaaacuagaauaaccugggaagagagucucaauugaggacaauuaucuagaucaaguugaccuguggacauuugagagcuuguuuugauugcuaguugauguggagaggcucagaccguacuugugggcaguaccauucccugguaggguaucuuaagugagauaacuagaugagaggaauaaggaauaagcguggguauauucauuucucucuacuuuauuuauuuauuuauuuuuucgagacaggguuucucuguauagcccuggcuguccuggaacucacuuuguagaccaggcuggccucgaacucagaaauccuccugccucugccuccugagugcugggauuaaaggugugcgccaccacacccggcuuucucucuacuuuuaagcaaggaaguggguauugcuggcuguuucagcuucugugacuucccuacaguguugaauacaauguggaauuguaaggcaaauaaacuuuuuuccccuuuuguuuguugugugacaaaacuuuucuggggagacacacacacgucuauucacgacagauagggagggaucccaugacagaccaaagugcgaauaucaccaaaguccaaacuuggugaaccaaagaguuuuauuagguuacuuacaagagcagaaaugagucaccaagcucaaaggcuugauuaccaaagccuacccagugugggugacagcucacaaagcugggaacuuggagugcccugcacacccugcaggcagcucagcugcuuucucagagaauauccuuuccaggugccuuuggucuaaaccucuuugagugagcugggcuggauuuugcuuccucaggagcuauuuugguaucaaggacuguuuuuuaaagcuuuuuuccucugagagucuuuuuuguaguuuggcuugucugagucuuuguggcagcucaucucagagucuucuugacaguucagcuuccucuucugagagggacucucagcauuuauugcuuacucaggcaaggaggggccugaugaaucuaguuaguuucagagauuuccugaagcuauuuugaguuauuuaccuuuuugcuuaaggagauuccuacagaauggaaacuauuacacaauacuauaucccuuccuuugacuccuuuguccccucuucaacaaugauuccugagcguuaaaagguuugacuauagaugucuacuauaggucaccaugucacaguaacaaucacuugaucucaggaguuuucucagggguuaugaguugaggcugauacaucuaaauacauguguuuagaugagaguuuaacaggcacaucauaaccaucuagaaaaaacuucuccuggcacuggaguuuuuauuuaauaaccuuauggucucuggaauguccuuuuuuacccauguaggguaacuuuuggauuuuuuuuuuuuaauuaacccaccccaguaggguuguaagguagguagaaguauacuauaucugauuguuucuccagugacuuuacaaauuugcaaaauacagguaagcauuauguuaucuauguaacaaaaccuuuuccagugaaugggcaggacaaggcaacuuccggaacuacuaucucauaacagaucaguggguuccaaagauaaccuuggugaaacaccugaaagucaguugucauccauccucagcaagugucaggugagccuagaaguucacaacuaagaugauaacuaagguugaaaugagcaaggucuaauacagcauggaaagguuccaucaauuugcuuccuccaaagaucaaggucagguacaaagcauagauaggaggugcuaacuuaauuuguucucuguaauccuuggcgauucucucugaacuauuauguuuacaugaccuggagccuguucugggagccucccucauuucuccacaccugaucaacucaguggauuugacuuagucggcucagacauacucaaggccaaagguaaauguggcccugcuuucccgcugcaccucuggcucacuaggucagagugacccuggguuggcacaugccuccagccucccauucaccaucccuggcugucggggcaguucuagcugggcgaacagucuacaccccagcuuuaucuuuugcuguguccccuccuuggucugggggaucacccacuccugggacaggcuugugugcuucaucuguauucugucaaggaugucuucuccuuaggcagaugcuccuuagcacacaaugccuuucuaucagauuuuuccuuagcaacccuagcucaacauaaauacuacuucaccuagaagaaccuagacaggccucuuuuucugcuuaaccuuaaaagaauauuucuccuuuagcuucuuuuauuuuucagauacucuuuacauguuggucuaaguuacugacaucugccauagccuuucuuacuuuauaaagaucuugcuacaccaaaggacucagcaaagacacuaaagcuugauacuagccuugaggucccuuugcuuaacuucucugugaacagaguucuaucugggccagugaacugggguucaaauauagccucccuauucuuaguucccuuaauaguaccuuccucuucucuacgaacuuccaguuuuugauauuuauggagacuuuggauagagauaacuguaggcuacuugaaccggguuccugaaagggaggcuggggcugcaugggagaaaauggugagagaaauaacgagaccaagacaaagauacugaucaaagcccaaaauuuacuuaagagucugagcuuauaaaguggggggugggguggggggaacccaucccaucccccaucacaccaggaucuccuuucaucuggauagagucaggagaacagguucagcaucucagcagguagcugcaucuuggagaaaauggcagagguggcagaacaauagaccuaucuagguuggaagacuccacccuagguggucuuguucauagaggaggaacaggucugagccagccugcucaaggcugggggaggcuacaauuccucccuaauuauauaauaaaaauuagcuguacugggacuuaaaauuuacuuaugcuccaugguccugccugggaauuaugguggcuggcggccacgcaugucuuaggauuguggucuucaaauaacuuauucuuauccauccucgggagcaugugcagcuuguuuguguuuauuugcacaaacacagcucugugguguuguuauguacauauguauauauagacuauuaguauauaaauuaaagcuugauuuuucaacauuuuaaaacacuggcuacagcacacaauuuaauuaucugugcugaagcaggaggaaacucaaaagaauaaacaugugauccaaucacauauacuuuucucccauagaagggcuguuuuuaaauacaguagauguagucuuuaugggaugcaugcaugcauaaauuuacagaaaauacaaaagcaugcauagaagcaaucuuuaacaacuuaucuuuuggauaauaauuaucaguuuuaccuagaaagucuaugcaguaggccaaauaucaauauucugcaauaaccaauuuaauugcuguuuggaacaaagaacagaugccucgucagguuuuuaagacacauuuuuguuguuguuguuguuguuuuucuaaaauuccuucaugauuuuaucuuacaauucuuuauuagcaccacagcaaugucauaauaggauguuaaaacuuuacuuggagaugaagaaagaugauuuuacauuaauguucucuuuugccaaagaauugcugugggcacacugaguaacaauaacuaaaauaagcagcuaauauuugauuaccauugauuaaaauugauaacaauuaauuauaaaagcuuccucuacuuucugcaaagccuuuuguuucucaccaguuaauuugccucuccguugauaacauccaacaaaggcuuaagucaccuuaaggcauuaagguaaggucuuagccaauuaacaucuccuggaagcuuuugaaaauaauuugaaguaagcaaaucaucuuuucuuucuuaaauuuucuguaccacaaucuuucuaggauaacuaagacccuaaauauuaaaaagauauugccuuugaauauuuucuggcucaucagcuacucuccagaacuuuaaagcucauugugugagaggaaagaguugaaguaauauauuccauuuaagaaacaauauacacugaaggauucaaagucuuaucuucuuauauugaaguagagacagaaaaaaaauuuuuuuucuuauauaacauaaggcuacuagccauaccuagaggcaaaacuuuccaaugaucacaagcucacugguagcaaacccuuuacaaugcaaaggaaaaaacaaccuuccaaaucuauaauaauucuauauguacuaggcaagccagauuguaaugccucuauaagcucuacagccucauugacuuuucauaaaucuaaaauuuaaacuuuauuuugaauaauaccuggauagaucuguaauaauguuuuagcuuaaaaauaauauuccccagaggcaaggagaggugaggucccaagaacuucccuaggcaggguuugcaaaacagaagaaaugccacacaagccucucugaagcuccccugagcuuugcauuaauucaaauguaauuauuucuuaaucugagcauacugccugaguccuggcccaaacaaagauuauuccucuugcagugaggacagauuccagaauuuuaaaguuucuuuugcaauauuagaauauaacuauaacuuuuggaaagcaaaacccaauuuuaaacaauuuuucuuaaaaaucaauaccagaaacaucacuuucacauuacaaaauuuggcugccaauuuguacauaugaaugcaugacagugcaaauuuuaaugauuuauuaaagagacauuguuuuaaaucuuaucucuuauaagucuacuuucuaggauaaaaauuacauaaaauauuaucccaauuuagaaguauccuuagaggucuaguuuccugggcugguuuaugccacgugugauuguuuaaaaugacucuaacccugaguuaccaauuuuaagcuaacuuucuuguuaccaauguuacaccuuuuuaaucauacccaauaacuuauaagccaauacuuugaccaagacaugcagagcauguuuauuguuaacaagaauuaagguucucaacaguaaaaguuccugguaaaaugaagucuuaagaugcuuuccaaucucaaauacauuuuauuacaccuuuucucagugugguguguugguaauaaugaaaaguuaggaaguagcuaguuucucauaugauggugcugauaaauggccuccuuaaaguucuguuuaagggagauuugaauaaauguuuccuaguguuucacauuuuguaauuuaaauuuggugauuuaaaaaaagauccugguauuuuguaauugaaauucuuuaacauuuauuuacuauauguauauguacauguauggggaagcauguggcauggcauauguggaaaucagaggacuugugagaauuguuuuucuccuuucaccauguggcuucugaagauuaaauuuagauugcccgaugugguagcaagcccacugagccauaauguagcaucuguuuuguguuuugagauucuacuucuuuguucuuguuuuaguuuaaaaucaaaguaucugacuuugccuuuaaaauaauuauguuuuguugaauuccuuuuagaggugccagaauucuuuuuaaaacgauagcuccuuaggacaucaucccagccaggcaugcuggcaaucacaccuuuaauuccagcacuagggaggcagagacaggcagguaucaaggcagaguucaaggccagccuguucuacagagcaaguuccaggaaagccagggcuacacaaagaaacccugucuugaaaaacaaaacaaaaccaacaaacaaaagaacagcauuacauuuaguuggagccaagacaguaacauuuuuuucuaguauauuuaauuagcauucauuaaaacauuuauaaauaugguugaauauuagcuuuacuucuggaaaaggauguuuucacacacauuguaauacuggaaaaaguauaacguaaaagcaaaauucugggccuuuaggcccaggcuugagaaugugaccucugugacucaaugcuccaagguaugcuaaucauaaaacagauagcgacauuccuccacccaccagcuuccuggguucaaggaguguucauucaaagaaagucacccugacccacccugaccauugcuggaaccugcuaugcaaaugugcuauuguuaggggcucuuagaaacugucuugaaaaauaacccauacaauuaccagguauuccucgugacucuugugacuuugcacuuccuugugacucuuaacugguaauuuugguauuuuccaacaaugcucucccuaccuccuugaguugugguuucuuccuuuaaauacccccuuacccagcuacucuccuugaguugugguuucuuccuuuaaauacccccuuacccagcuacucggggugccaugguccucuaccccugggugguguaugacugugggcccgagagcgcucuugaaauaaaaaguccucuugcaguuugcagcaagacuguuucucgugagugauuuggggugucaccucuccugagucagaaagugggagaguccucacguugugggucuuucaauacauuggauacauacuuuaauaagucaacaacaaacuaagauuccuuguauauagguuuuaggaaaaagaaauacaaugcuuggaaacaauagaaacaaaguaagugagaaaaguaucaauggcuuaugucuuuuuuccuaucuuuuuaggguagaacauuuuuggggaguuugauuuuugaaaaagaaauuaaaaugagaauaaaagcaacauaucaagauggaacaguuauugcucaggcugaguauggcacugucgauauaggggaagaaguggcaaagaaaggauuugcagaaaagugcagacugaccucaggcauugaugccugugaggcaaagaaaccugauccuaaucagcuugcucucaggagucucaagaacccuaucccccugugggggcgcagaucaaaccagucaaccuucagcaggccaaaggggcauuuuaacgggaggcugacucuugaugugaaguaugagaccagugcaggcaaucacgugacauuuccaaaguaagacuguggugcuguuuuaaauuuuuaauugauuucaaauuuaugguaguagccuuuauagaauucaguucuuaggcuuuuggaauccuuaacagagcguaugguuuugugaaugaucuuacauaauuuuuguuuuuuuccucaucaaacacuuguuccucuguucuuuagcagggauguuuuccuuaaaagccaguuagaaaauauaauuguucuugaauuauuuaaaguucccuugcuaacuuuucauuuuauucuuugaacaucuuuaacaaaaauaaaaauuguccccaaauauuaauuaauggaguacaugccuaguaugcaugagguucuggaugcaaucuccauccucuuaaggaaaaaaaaaugauauuuuuccccuucuggcuguacgaauauuuuucauguguuuaagagaucuuuugugugaaaguuuguggugagauuuuaaggaauuaggauuuuaaggugcucuguuaaggaguucauuucuuuuaaaauauuucuuuuuuuuggcuuuuuuuuuuccuagugcuugcagggaggagggugucaaaccuaaggucuuaaugcaugcaauguauauacuuuaccaauugaucucuacccuuaauauguauuuuuaauaauuuaacuggucaaauaauuguauauacuucuaagguaagguauguuucaauucauguguguuauauaauuaaaagaucagaggaaguguaucuguuaccacagguguauauaauuugagcuacaauuuuagaucauuuugaauuaucuacuugagucagaaagucagucuagauacucaugaauaccaguauauuacuuaaagauauuauuuuguguguugguguuuggauuaaauucauauauaucuguguaccacaugcaugccuggugcaguuagaggccugaagaggguauuggauccucugggccaggaauuaaaaaagguugugaguugccauguaggcacugggaauugagccaggguccucuacaagagcagccagcaucuuaaccacugaguaucuucucuagcucuaguauauacccguguauucuuaccuauggugaaucaagcaaugaugucauggcaguuugauggguuuuuauuggugguuuagaaacuacacaaaugaaaagguacaagggaggaagaauuagaaaaaacggacagaacaauuugauguucaugauguugagguagauagugguauaacagauguggauuaugagacauuagagaaagcguuuuugaaguaugccccauuaacauaaacuaguuugcauuaaacuaguuuauuuucauguuugauguagagucucacuguguagcuaagacugcuuucagacucuguauggagcuuaaaguggccucagguuuuguaugcauucacuuuggccucccaaauucagggauugcagguuuaugccaacaugcucagcuuaaauuauuuuuuaauguugagcuaggcagugguuuuaauauucaaaauuaauuguaagguauauuauaaaaaagcucaugguaauuucaguuuuugaguucuaauagccuuaagcuuauuuucaaaaauaaaugaauuuguuuuuaacagggaaaguuuggcugcuggugacuuuaauuuagggucuaaugucagcuuggcaaaaauuaaacaggaccagaaacuuauugaagagaaugaaaagcuuaaaacagagaaagagguucuucuagaaaauuacaaagcauuagaauuaaaaguugagcagacugcccaggagcugcagguaggucaguggcuuugguucuccugugaaacgugcgcacucaucgcuuauaaaguaacuuuuauucaccggauguaagugccgucuuacggccucugucugcuaaccuaagccuaguccuagaaaccacuagccucgguauacucuaaucuaggccuagaaugcuuuagccucugagacuugcugcugaauaagcucccccccuucuaguucuuucugauuucuagcuggcugguugaacucaacuguucuggcccaaauuccucuugacugauucgaucugacuucucuuggccacuacuagauuacucugcuuggcuucaaacuaacucuggcaaucuguucuaaucuucuggcucccucucauucucuggcucauuuuguauucaucuacaucuaauauguucucucucugcaaccuguuucuauaugacugucccuguaaaauggccuauuagcccugcaacgcccccuuaaguagcuucccuuuccuuuuucuucucaugagaguuggacauacaccauucugucaaaucuuugauucauuacuaugucugccacucaauuagaugucauuuucccacaugggugcuuccuucaacaaacuaauuuuaccuucauuguuugggauuaaagguguguacuaagggugugucuauauugcagucagaggaauuaaagguaugugcuaaauaugagccacacuacaacuagaaacagguuuuuuuuuucuuuucaguaaauaacauaaucuuuggguucacaguguaaucaaauacccugcaacaagugcucuuaguuguuauugacacagugucuccaucuguuuucauuugaaaccuguguaaggagaaaacuuuuuucuuacauuucaagcuaaccguguuuauauuucauaggcuguuugaaauuuaauuauucucucauuuauauauuuccuuauguucuuuaaccuuuuguguguauauugauuguguguaugcaugugugcagguacauguacaugugugugaccagagguuaaugucagauguuuuucucauuuucaccuuaguuuugaggcaggucuuuuacugaaccaggagcaugcugauuuggcuggacuggcuggacagcaagccccaaagacucuccuguuucugccuccccagugcuggguuacagaugugugccacugcugugcuuggcuuuuuaauguggugguggggaucuaacucagguccucaugcuuuuuggcaagcuuuguacugacuaagccaaugcuccagcccauaaaaugccuaaauguugaaaauaucucaaaacauuccagaaaggauucauaauuaaucauguauugcucauuaccauuuugacaguuuuuguuucuucaaaauuagccccaucaaaauauaguauuucauauuauuaagaaugugucuugcagggcaguuauggugcaugccuuuaauccuagcacuggaguggcaaagacaggcagauuucugaguuugaggccagccuggucaacagagagaguuucaggauaaccaaggcuacacagagaaaccuugucucgaaaagccaaaaaagaaaaaaaaaaaaaaggacuauuccagcacuggaguagcuaaggcagacagaucucagugaauuugagcccagccuguuccacacagcaauuucuaggccauccaaggcuacaaaaaagaauaauauaucuaguuuaauauaagcagacauuuaagaagcuagaguugaguguggugggacaugcauuuuuaaucucaauacucaggauauagagacagguagaucucugaguuugaagucagcugauuuacguagugaguucuaggcuagcaaggguuacacagugagacccugcuaucaucaccucuaccaccaccaccaccaccuccuccuccuccucuucuuccuccucuuccuucuucccuaugacuucaacccccuccaccacuucuuccucugauaccucuuccuucaccacauccuccuccaaagaacuauauauacagguguccuggguuagaucacagcccuccucaggcuaaagccaaucaaaauauaaccauaguauauaggucaaaguaaaguaagcaguaauugcacuauaucauuuauaucacauuucccauauugcuuuauggaguauuuaaaaguuuaucucuuuaagcuaggauuccagaccugguacuagcuagaugucccacaguucaauucaguucuaacacuaacauacuaacauuguuuuuaacucuuaacauuuaacuugaaucuaacuaaaaaguuauuugaaugauagaauuaugguauuaguucucacgaagauauauauauuuuuaauguuucagcaagagaaaacagcuaccauggaucugacuaagcauuuagaaagcacucugaagacguguguaggaaccaggcugaagaauuuggcagcuaaaguagaacuauugaaagaaauuagguacuuuccaauuauguguauuuuuuuuuuuguaguucugguuauagaacccagagucuugugcauacuaggcagauaauuuaccacugaucaaaaaauuuagcuucaaagaauauuuuauaugugaauauuuauguguguucuugugcauacaugugugugggcacguguggaagucagaggacagcuuccaguauuauuccacaagugcuuucuaccuugguuuugagacaggguuucucacuacgguaaccucaccagguaggcuauucugucugcccuccuagaucuggggaugcaacuggucuucaccuucuucucacugggauuacaaugaacacugcuuggcccagccuuucaguguuggacuuugccuauggcuaugguuaaacaauacuggauauguuuaacauuuuuagagaaauauuuacaaauuuugauauagaacagaaauuaaagguccuuuugacauuuuaaauuuugcauauuuuggaagucaucuuucuauacaaaguuaaaaaaguagauuucuuucuguuagauaugguagcguguguccguacguacaggguuauuggaggcggaggcaggaagaugcuugggcaggaagauguucugagaccaagcugggaaauacaccaaucucuuuguuuguuuguuuguuuugagacacaaucucacuauguagucccagcuggccuugaacucacuguauagaccaggagggccucaggcuuacagagagcugcuuaccucugcuucuugagugcucagauuaaagguucacugugucugacuaauggcaauauuuuauuuaaaaauauguauagaauuauuuguuccacauuuuaaaagaucuaucuauuauuuuauguguaugaauguuuuuccugcguguuuguaugugcaccacaugcaugucugguuccuguggaggccagaaggcauuacagccccuagaacuggcauuacagguaguucugaccugccaugugggugcugggaacugaacccaggucuuuugcaauggcagacuucuuaaccacugaaucaucccucuaguucucuacacaauuacacauguuuuucuguaaaguuuuaaaaaggaccuaguugucuuagguaugguuuuauugcugugaagagacacuaugacaaaggcaacucuuauaaaggacaacauuuaauuggggcuggcuuacagguuugaagauucaguccauuaucaucaugguaggaagcauggcauuguccaaguaagcauggcauaggaggagcuaagaggucuacauuuuguucugaaggcaagcagaaggcuaccuucuaggcaguuaggaggagggucucaaagcccacccccacagugauauacuucuuccaacaaggucacaccuacccaacaaggcaguaucccuaauagugccacucuuugggccaagcauauuuaaaccacuauaguagucauaggguaguguuguaaauaguaacuuugagauguuuuaaaugaauuucucucauacaaacuuggcaauuucuugauguuuaccuuuuuccuuuuuccuguguuuuuaaauaggcauauuaacaucaguauucgcuuuggaaaugaccuuucagaugcuaugcaaguguuggaugaaggguccuuuacuacucuagcaucuuugaaugaguuagagaaaauuugggcugaauauaauguugcucaggagaagauccaaacuugucuuaaugagguggguuaagaauuuucuauguuagccgggugugguggcgcacgccuuuaaucccagcacucgggaggcagaggcaggcggauuucugaguucgagaccagccuggucuacagagugaguuccaggacagccaaggcuauacagagaaacccugucucgacccgcccccccccccaaauaaaaagaauuuucuauguuauuguuguuguuuuuuacuuuauuaagacacugaguuuauuucacauguauauuuugucuuccuaccauuuccacaucugaccaacacuaugacuauguccuaucauaacauuccauacauacuuaaaaccaaguaaaggguggaguuccauccuugaaaacuagacaggcauuuuagacaacacauucuuaucaauugaaccuggacaacauuuaucagacacaguagggagaguucucacuuugcauuauaaaaaggacagccagguaucaacuauuacagaaaugaaguaagacagaauauuucaaacuguuuaaacaauuuucuuaaagagacuuccuccacugccagagaucuuaauagccuccuggucagucaucuggaaacaauucuucacauaauuaaugaacuugacuucuacuucggaagagaaccacuuuuucuauacuugcuugcaauuuugcuuuaaugucuucuacagaacuagguccuuuugguguuuugggaguuuuuuccugguuuuuugaaggacucuugacccuuugaucuugguguuaaagguuuuaaguugaugguuugguuuuugugcauuuuuggcugggguaucagguacagauuucuucacuggaaccuuuucuucaguuuccucaucaucaaaauccuccuccucaucgucuucaucaucauccucaucaucuucaucaaguuuuacuuuuuucuguggaaccuuguuaccaccuccaggagcagaucacuuuccagacaugccuaagaguuuuacguccuccucaucuucaucuucagacucugcaucuuccuguacagcuacuaggugcuguccacuagugugcacaggcccugaaccacacuucaaccuuaagaccacaggugguuguaauuuugaagcccccaagggaaacuguugguuguacagacaucuucaaaguugccagugugacuuuaauuggacugccuucauacauugcuucugccucuacaauguguaacuugcuccuaaaaugauucuuaaugauaauugguguucauuuuuaucauuauccacuuuaaagugauagucuuuaucagccuuuaguucgcaaccgaaaagguaguucugaggccuaagagggcuccggugcauguccaucgaguggacuucagugugggagaaaucccaccagaaaacaacugcuugauguuccacagaacagacaugcagaacggaaucacgcccauucuuuuuguuuuuuuaaucuuguugaguguuuuaagaaagcagagggucugauacuguagugauacuuuauuuacauaaaauaaguguuuacuuuaagagaaaauuagaauagguaauuggcgacuagacacaguuuaaaaaucuuuucuuguuuuguaugcauauuuaauauuugaguaacugucuauucuccugaugugauaaaauguuucaaccauguuaauagucaauauuauuuauuguaaauacucaaguugcaucuauauuaggaauauuauaaaacacccaaugaggacucuuacaacuggguacauccuucagggcuccuagaaguuagacucauggaggacucaacagaaauacuggcuuuugagggccucauaugagauuuuuaacuagggugacuucuaaaccugcuaacauggaccuuguauuuuggucugaguaguauauuuuauguuacuacaguauaagaaucugacaaauuauuauauacugacuauauacuauauuauuacuauauaucuuauuauacucccacaguguugggagguaguuaauaugaagggaggaugguaaaaauaauagggaaaaaucagcuuagcaggauuguugaacuuaaauguuguauuguaguauuaagcuuaagaaaucacuauugucuauauagugugaaugugugaaauuacuugguaucuugacuauccuauuuucuauucuucagaaugaagguaauauuuugauugcugaaagaaaugaaguacaacagaagcuguucguggcuguagauguuuuuauucuggaaguagaugacuuaccacuugauaaacgcuuaaaaacauugcagguuggaauuaugauauacauauauauuuuuuaaaaauuuauuuauuuauuuacaucccaaauauggccucccucucgguccuuccucacagaguuccucccccacuccccuucccuuugccuuugagauggugaaguguuccccccauauguccccacccuggcucauaaagucucugcaggauuagguauauccucucccacugcggcaggacaaggcagcccucugcuacauacgugugggggaguggggugguaucuggaggacagugcucgggagaccucuguccagccuguguaugcucuuugguugcuggcucagacugagagcucccagagguccaggauaguugacacuguuggucuuccugugggauuccaacccccucguggucuucaauccuuccccuaauucuuccauaagacucgcugggcucugcccaauguuuggcuguggguuucugcaucuguuucagucagcugauggauggagccuuucaaaggacaguuaugcuaggcuucugucucaagcauaacagaguaucauuauuuuacuaguauauguauauaccccucccuuuucccacccaggucccugccucuuaugacuauuaugugcccccuucugagugugauucaagcauccuuacuugggucuuacguuuuguuaacuuauuugggccuguguggugugucauggguauucuccacuugucagugaguacacaccaugcaugucuuuuugggucuggguuaccuuacucaggaugguauuuucuaguucuauccauuugccugaaaaacacaugauguccuuguuuuuaauagcugaauaguauuccauugaguaaaugaaccauauuuucuguauccauucuucaguugagggacaucuagauuguuuccaguuucuugcuacuacaaauacagcuguuuaaauauaguggaacauguguccuugagguauacuggaauuucuuuugguuauaugcucaggaaugguauaccccaagucuugggaaguagaacuauucccaauuuucugagaaacugccagauugauuucuacagugguuguacaaguucacaaucccaccaacaauugaagaguguuccuuucuccauauccucaccaacauaugcugucauuugaguuuuuugauuucagggucauuuugauuugcauuucccugaugauuaaggauuugaacaugucuuuaggcauuucuaggccauucuggauuccucuguugagaauuaucuguuuagcucuguuccccauuuuaaaaauuguguuauuagguuuguuggaaucuaacuucuugaguucuuuauauaguuuagauauuagccuucugccagaauagaguuagugaagauucuuuucaucuguuggcagccauuguguccuauugacaauguccuuugccuuacagaagcuuuucaguuucaugaggucccauuuaucaauuuguugauauuagaaccugaaccauugguuuucuguucaggaaauugucuccuguaccaauguguuaaaggguauuucuuacuuuuuauucuaugagauuuaguguuugcaguuuuauguugagguucuugauccacuuggacuugaguuuugugaagggcaauaaaauauggaucuaguugcauucuucuguagcuagacauccaguuagaucagcaccauuuguugaagaugcuuucuuuuuuuccacuguaugguuuuggcuucuuuaucaaaaaucaaguguccauagguauguggguucauuucugggucuuugauuugaguccauugaucaguguguuuuucuguaccaaauucaugcaguuuuuucucacuguugcucuguaguacagcuugaggucaggaauggugauuccuccagaaguucuuuuauuguucaggauuauuuuggcaauccugguuuuguuuguuuguuuguuuuugauauauauugaaguugagaacuauucuuucuaggucuauaaaaaauugcauuggaauuuugaugggaauugcauuaaaucuguagaucaccaugagcaugggagaucuuugcaucuucugauauuuucuuuaguuguuucagggacuugaaguucuuguuauacagaucuuucacuugcuuuguuagaguuacaccaagauauuuuaugugauuuguggcuguugugaagggugguguuucccuaauuucuuucucagcccauuuaucauuuguauaaaggagggcuacugauuccuuugaguuaauuuuauauccagucauuuugcucaaauuguuuaucagcuguagaacuccucugcuagaauucuguggguugcuuguguuaacuaucauaucauccuugacuuuuuccuuuccaauuuguaaccuuuugaucuuuugucgucuuauugcucuagcuagaacuuuaaauacuauauugaauagauagggaaagaaugggcaggauugucuuguuccugauuuuaguuugcuugcuucaaguuucucuccauuuaauuugauguuggcuacuggcuugcaauauauugcuuuuauuaugucuuuauuaauaauuacuuuauuaauauuuuauuauuuuuauuacuauguuagguaugugccuugagucccugaucucuccaagacuuuuaacaugaagggauguuguauuuugucaaaggcuuuuucagcaucuaaugagaugauuaugugauuuacaguuuauguaguagauuacacugauggauuuucauauauugaaccaucucuuaauuccugggaugaagccuaguugauaguaaagaauaauguuuuugauguguucuuggauuugguuugcaagaaauuuauugaguauuuuugcgucgauguucauaagugaaauuggucugaugcacucuuucuuuguugagucuuuaugugguuuacauaucagugugacuguggccucauagaaugaauuagguaguguuccuucuguuucuguuuuguggaauaguuugcagaguauuaguauuagcucuucucugaaagucuaauagaauuauguacuaaaaccaucuagcccuggguucuuuuugguuaugaggcuuuuaaugacugcuucuauuucuuuagggguuaggggacuguuuaguuuaccugaucuugguuuaacuuugguaaguggugucugucuagaaaauuauccaguuuguuuagauuuuccaguuuuguguuuuguggaguacaggcauuugaaguaagaccuagugauuuuuuaaauuuccucaauuuuguuuguuuugucucccuuuucauuucuguuuuguuaauuuggauauugucucugugucuuuuaguuaguuuggcuaaggguuuguuuaucuuuuugauuuucucaaacaacucuuguuuuuuuuuuuuuuugauucuuuguauuguccucucuguuucuaauuuauuucaggucugaauuugaguauuuccugaugucuuggguguuuuugauuuuguuauagagcuuucaggugugcuguuaaguugcuagaaugagaucucuccacauuuuucaugaaggcacuucauacugugaauuuuccucuuagcacugcuuucacugugucccauaaguuuggguacguugugccuucauuuucauuaauucuagaaagucuguauguuuccucuagaaaggcuucuuguacauuuauagccaucucuuucuuuagguuauggaaguuuucuucuaugaaauuguugaaguuguuuucuggcccuuuguccugggcaucuucucccucuucuaugccauuaggaguugcuuuaugguuauguucacuuagcagacagaauaguaguggguuuuccccaaggguaaugcucguucuaguuuuugguucuuggcuucauuaauuaaacaaugucagcuguaaguuucacuuacuaggugggucuuaaauccaacuaaaaagugguugguuauucccauaauaauuugugucauuguuguaacaguauaucuuucagguagguugcuguuguuguuacaggguuuaucuucuucucuucucacguauaacacuuacuagcaucaugaaugaaacuucuaguugggcaccagcuauauuucuccauguuugaacacauaaauaaguguugucuucagcaguagauucuuaccaucaucauguuguggagggcagccaaaacauuggucagugacugcaagauguagcucauuucugguauuaggguuuuuuuuucuugguauaauaauaucuaguuggggcauuuucuuuccuauuacaugguaacucuauuaaauuuccuuuuaucuaauuuaggaaacuuacagaauaguagucaugguuuuucaaaaggccuuuaguguuaguuaucccucugcauauucucuccuuuauucugaccucccuucuccuuucucacuuaaucuucccauucucaucuuuccucuuuauucccuuauaacacuguauucuaaaucaucuuccuuggaagguccccuucucccccuuugucaccaaugagcuaccuaaugucuguggauagucuaaaugaaauaucuaaagcuuaaaagcuaacaucucaauauaagggaaaacaugcaauguuuauguuucagagucuagguaguugcacaaaaaaugauuguuucuagcuucauacauuuguuugcaaauuucauaauuuaacuuuuaaauauggaauaauaaguugaauaauguuccauuauauaaaugaacuaugguuucuuugucuauucauuaauugacaucugggcuaauaccaguuucucacuauuaugaauagagcaguaaugaacauggcugagcaacuauucuguaauaagauguagaguucuuugaguauaugccuaagagugauagguagaucaaauaguagaucuguuucauccuucuaagaaaccuccauacuuauuuucauagugguuuauacaaguuugcacuuucaucugcaguaaagaagugguccucauccucuacacucuugcuagcaucugcugucauuuguuuuauuaauuuuagauguaugacuggggugagaaggaauuguaaaguuguuuuaauuugcauuucccugguggcuaaggacauugaacauuuuaaaaaaguguuucucagccaggcggugguggcguaugccuuuaauccuagcacuugggagacagaggcaggaaaauuucugaguuugaggccagccuggucuacagagugaguuccagggcuauacagagaaacccugucucgaaaaacuaaaaaaaaaaaaaaaaaaaaaaaaaaaaaaguguuucucgaucuucagagcgaacccagcagagggucccaaggucccgagaggacucuccaggcugcaggcccccuagcacacccuggaccuugggaucauuggugaguggaaugcaacaucaguuccaaagaaucccagagggucuugugccagcaggaacagggacaaaggaaccccgcucgaccagaggcugggauucauucugguuggggccagccccgcgccaucuuaggugcgaacccaucggagggugccaagguccccagaggacucuccacaccacaggcccccuagcacacccaggaccucaugaucacuggagagcauguggguggcagaaacaacagagcuucuuggacagggucccuucgggccuucaauccucagccaggaggcagagcugagacccagaccccugggcaccuuccuugccagaggagagucugccugcucugacccuaggacucaggagguggaucaaagcuccagacuucuggauaccucccuacaagaggagagcuugccugcagagagugcucugacuacugggacucaggugagaguuggagugcuugacaggcuaacagaaucacaaggaagaacaaguuccagccagagacagcuagaacaucuaacaccagagauuaccagauagcaaaagggaaacuuaagaaucuuacuaacagaaaccaagaccauugggcauuaucagaacccaguaugccaaacacagcaaguccuggauaccccaacacacccaaaaagcaagacucagauuuaaaaucauaucucaugauggugguagaggauuuuaagaagggcauuaauaacucacuuaaagaaauaaaggagaacacugcuaaacagguagaaguccuuaaagaauugcaggaaaacacugcuaaacaaguagaaguacuuaaacaggaaacacacaaaucccuuaaagaguuacagggaaacacacccaaacagguaaaagaauugaacaaaaccauccaagaucaaaaaauggaaguagaaacguaaagaaaacccaaaaggagacaacucuggagauagaaauccuaggaaagaaaucaggaaccauagaugcgaguaucagcaacagaauacaagagauagaagagaguaucccaggugcagaagauuccauagaaaacauggacacaacaauaaaagaauaugcaaaaugcagaaagauccaaaccccaaaacauccaggaaauccaggacacaaugagaagaccaaaccuaaggauaauagguauagaugagaaugaagacuuucaacuuaaagggccaguaaauaucuucaacaaaauuauagaagaaaacuucccuaaccuaaagcgagagaugcccaugaagaagccuacaggacuccaaauagucuggaccagaaaauaaauuccucccaacacaaaauaaucagaaaaaaaaugcacuaaauaaaaacagaauaguaaaagcaauaagggaaaaaggucaaguaacauauaaaggcagaccuauuagaauuacaccagacuucucaucagagacugugaaaaccagaagauccuggacagauauacagacccuaagagaacacagaugccagcccaggcuacuauacccagcaaaaaucucaauuaccauagauggagaaaccaaaguauuccaugacaaaaccaaauucacacaauaucuuuccacgaauccaguccuucaaaggauaauaaagggaaaacuccaacacaaggagggaaaugaugcccuagaaaaaucaagaaaguaauccuucaacagaccuaaaagaagacagccacaagagcagaaccccagcucuaacaacaaaaauaacaggaaacaauaauuacuuuuccuuaauaucucuuaauaucagugaacucaauuccucaaugaaaagacauagaccagacuggcuauguaaacaggacccaacauuuugcugcauacaggaaacccaccucagggacaaagacagauacuaccucagaguaaaaggccggaaaacaauuuuccaagcaaauggucugaagaaacaagcuggaguagccauucuaauaucuaguuaaaucaacuuccaaccuaaaguuaucaaaaacaacaaggagaggcacuucauacucaucaaagguaaaaucuuccaagaggaacucucaauucugaauaucuaugcuccaaaugcaagggcauccacauucauuaaagaaacuuuaguaaagcucaaagcacacauuacaccucacacaauaauacugggagacuucaacaccccacucucaucauuguauagauccuggaaacagaaacuaaacagauacacauugaaacuaacagaagcuaugaaagaaauggauuuaauauauaucuauagaacauuuuauccuaaaacaaaaggauauaccuucuucucaccaccuccugguaccuucuccaaaacugaccauauaauuuuggucacaaaacaggccucaaccgauacauaaauauugaaguuaucccaugcauacuaucagaucaccacagaccaaggcugaucuucaauaacaacauaauagaaagcccacauacacguggaaccugaauaauaguauacucuacucaaugauaccuuagucaaggaagaauuaaagaaagagaugaaagacuuuuugaguuuaaugaagaugaagccacaacauacccaaacuuaugggacacaaugaaagcaauccuaagaggaaaacucauagcucugaguguugcccaaaagaaacuagauagcauacacgagcugcuugacagcacaccuaaaagaucuagaacagaaggaagcaaauucaccaaagaggaguagacaaucaaacucagggcugaaaucaaccaaguggaaacaagaagaacuauucaaauaaucaaccaaaccaggagcugguucuuagagaaaaucaacaagauagauaaacccuuagucagacuaacuagagggcacagggaaagcauccuaauuaacaaacucagaaaugaaaacaacagaaccugaggaaaucccaagcaucaucagauccuacuacaaaaggcuauacucaacaaaacuggaaaaccuggaugaaauggacaauuuucuagacagauaccagguaccaaaguuaaaucaggaucagauuaaugaccgaaacagucccauauccccuaaagaaauagaagcagucauuaauaguuucccaaccaaaacaagcccaggaccagauggguuuagugcagaguucuaucagacauucaaagaagaccuaauuccaauccuccucaaacaauacauaaaauagaaacagaagauacuuuacccaauucauucuaugaagccacaauuacucugauaccuaaaccacauaaagacccaacaaagaaagagaacuucagaccaauuucccuuaugaacauugaugcaaaaauacucaauaaaauccucucaaacugaauccaagaacacaucaaaaugauaauccaucgugaucaaguaggcuucaucccagggaugaagggaugguuuaauauaaggaaauccaucaacguauuucacuauauaaacaaacucaaagacaaaaaacacaugaucaucucguuagaugcugagaaagcauuugacaaaauccaacaucccuucaugauaaaaguguuggaaaguucaggaauucaaggcccauaccuaaacauaauaaaagcaauauacaccaaaccaguagccaacaucaaacuaaauggagagaaacuugaagcaaucccacuaaaaucagagauuagacaaggcugcccacuuucucccuaccuauucaauacaguacuugaaauccuagucagagcaauuagagaacaaaaggagaucaaggggauacaaauuggaaaggaagaagucaaaauaucacuauuugcagaugauaugauaguauauaaaagugacccuaaaaauuccaccagagaacuccuaacccuuauaaacagcuucagugaaguagcuggauauaaaauuaacucaaacagaucaguggccuuucucuacacaaaggauaaacagucugagaaagaaacuagggaaacagcacccuucacaauagucacaaauaauauaaaauaccuuggugugacucuaacuaggaagugaaagauauguaugauaagaacuucaagucucucuaaagaaagaaaucaaagaagaucucagaagauggaaagaucucccauguucauggauuggcaggauuaauauagucaauauggcuaucuugccaaaagcaaucuacagauucaaugcaauccucaucaaaaucccaacucaauucuucagaguuagaaagggcaauuugcaaauugaucuggaauaacaaaaaaccuaggauagcaaaaacuauucucaacaguaaaagaaccucuggcugggcagugguggcgcaugccuuuaaucccagcacuggggagucagagacagacagauuucugaguucgaggccagccucgucuacaaagugaguuccaggacagccagggcuauacagagaaacccugucucgaaaaacaaaaaacaaaacaaaacaaaacaacaacaaaaaagaaccucugguggaaucaccaugccugaccucaagcuguacuacacagcaauugugauaaaaacugcaugguacugguacagugacagacagguagaucaauggaauagaauugaagacccagaaaugaacccacacaccuauggucauuugaucuuugacaagggagcuaaaaccagccaguggaaaaaagacagcauuuucaacaaauggugcuggcacaacuggcgguuaucauguagaagaaugcaaauugauccauuccuaucuccuuguacuaaggucaaaucuaaguggaucaaggaacuccacauaaaaccagagacagugaaacuuauagaggagaaaguggggaaaaaccucgaagauaugggcacaggagaaaaaucccuaaacagaacagcaauggcuuguucuguaagaucaagaaucgacaaaugggaccaaaauauuuuguuacuugaggcuuuuguguaauguguuguuucccugauuucuuucucagucuguuugucauguguauauaggaaggcuacugauuuuugugagcuaauuuuguauccagcuacuuagcugaaaaugucuaucaacuauaggauuuucuugauggaguuuuuagggucauuuaugaauacuaucacaucaucuacagcaaagacacucugauuuuuucuuuucuaaauuuuauuaccuugaauuccuucaguuuguuuuagcuaagaauucaaguaauauacugaauagguauggagagaauugauaaccuugucuuguuccugauuuuaguagaauugcuuggaguuucucugcuuuuaacaugauguuggcuaugggcuugcuguaaacggugauuacuauauuuagguaugccccuguaucccuaauuucuccuggccuuuuaucaugaaugaauguuagauguugucaaaagcauuuucugcaucuagugugaugauuaugugguguuugacuuucaguuuacuuacaugcuggauucugcuuauugauuuacauauauuaaaccgucucuucaucuuugggaugaaguuuacuugaucaugauggauaaucuuuugauucuguucuuauauuuggugcaucaccgaaacuguucuguaauuuucuuuguuggauuuuuauaugguuuagauaucaggguaacugugacauuguaaaauggauuggacaauguuuuucuguuucuauuuuguggaauaauuggaggacuauuggcauuaacucuucuuugaaagucugguaggcuuguguacuaaaauuuuucaggcucugaaaaauuuuugguugggagacuuuuaaucacugcuuguuuuacuaaggcuuauaggucuguuucaauugcuuaucugaucuugauuuaaguuugguaaaaaaauuauuuauuuuaguuuuuuccuauuuaguggaguauaaguuuuuaaaauauguucuuuugauucucuugauuuccucugugcuuguuguuaaaucucccguuuuauuucuaauuuauuuggauauuuuccuuuugccuuuaauuauauuuauacauuuuuuaagaguaggcauucaacauuaugauauucuaucucuuuguucauaacacagugcuuaaauccuaacauugucuuuaggacuuagcaacuucuuuagaaucaguguauggaaaggccaaagaaggaacuaauaacucugaagaaacacuuagaaaguuuuaugacuggcaguguaccaaaagagaagaguucgccaguauuaggagugaaacagaggcaucucugcagcaccuuguggcaugguuccagagcagccagaagguaaggagagcucccacuagcaauguuugccaaaagaagcagagauuuauguuuguucuaauucuguuccuuccuuguucaaaaguugacauuaugugcuucuagcuaucaaaguuaauacugggcaaucaggauuuuucaucacuagugaguuagauuguugguuuuguuauauaaaaaauccaucuugcuuuuguuucuguuuuucucuuuucauuuaaauuagcuacuugccuuaaccaccaguuuucuuuaaaaauacuaugcuuaugcaucuucuuuugguuuuguauuuaaguuuuaugaggguguauccuuguucuuuucccagaauuuuccuuuuuuguuuugguauagcuuuaugugcuacaacagguacaaugaaugcuaacugaacuacuuaauugaaauaccucaucuuuuuuauuuuugaaaauaagguuuuugaucuguccuuggaugaaccauugacuucagaagaccugauugguaauauugaugaaauucuagagaagacugagucaugugucugcaaagagcuagagcugucucucauugugaguaaugaugcuauguauuauuaaauagauuuuguugguuuuauaagacuugauuuuagaaguuguugcugagagacaguuucuaaaaauaacaagguguugaaguuuuauguauugcuuauucuuuuauuuaaaauauugauuguccugauauccuuucagacagcuucagaaauaauuuaugguauaauuagguuaacauuuugccuaugaguaugcauugaugccaguauucuguuuagaaaaagauuugagaaguauuuugauaugauacagcaauuaucaaagacauuuucacuuuuaaguuuauuguuuuaaccauauuguuuuguuuuguguguuauaauuccaucuaggagcaaggugucauagacaaggagauuauuuuaaguacauacagucaagugcugcaaaagauccauucugaggaaaaguucauugccaccuugcuguccaaguauaaggacaguguugagguuggauuuugcuuucucugauuugucugaugaauugauauuuuguguuuuuuacuuguugaauuuuucucaaguaguuuaacauccagugugcuaauuaguacuccuacaaaagugguauaccauuguggucuggcauauaauugacuucacuguagaauaugaauguugauuuuguugauaauauacauuuuacugaaucuuggaauauuuaaauuucuuaugaacuuaaaauauguuugccacaauuuucuguguagcauauguauguauuuaugucaguagcauguguguaauuucauaucucaguugaauuaaagaguauuuccuuugguaccuugagcaccaaaccugcgauucuucuaaacagaaauguggacaauuaggaaaaucaguugauagcauuacuuuuucaaaaguucuggaguuuucuuaauauuuacuuuaaauccagguacucauaaaauuaugauguucggugacuguuguuucauguguuugaaaacaugguauuucuuucucucauauaguuuaaaaagcagaugauugacuguuuaaauaagaaccccaauguggauuacuugcuuucuauuaagaagacauugaaaggcuuaaaagcacaacugagauggaaauugguugagaagaguaauuuggaagaaguaaggaaaaaauuuuucuaauuuauucacauugguugaacucuuuuauaaaucuauguauaaauauacucucuaaaaccagagaaccauuguauucauauuuuguguuauguacuuugauaguuuuacauuuuuauuuuaguuaguguauaugugaguguauugguggccuguaucacuguguacauguggauaccagagaauaacuugugagagucaauucuuuauuuccacuauguguguuucaggaauugaauucaggucacuugacuuagaggcaaguuccuuuacacacugagcaaucuuacaggcccaguaauuuaucuuuuuaucuuuguauauggaaauaaauuugaaaugacauucauaccaaauacaugucucccauggaauuaaauauuuuuguguacauacauguauguguguucauauguacauggaggucagaggacaaccuuggguguaauuauucaggacuguacccuuuauuuuuauuuuguuuggagauaguguguuaauggcuuggagcuuaccagauaggcuaggcuuugcccuagggaaccagcagucucugccucccuagaguaagaguuauucucacuacuugcuucccccacccuuuuucuuuauuaaauaugagauugaauuuaggucuucguacuuacaaagcaagcacuuuacugauuaaguccaucuccaaggguagaauuuugugauaaaguauuuuuaaacagcauggucuuuaacacuggauauaauauuucuugcaaguuuuaaaaguuguuuucauaugacacuagagcuaaagggauuaggauuuucuaauuuugacuauucuuucauagguauaaagcuuugugaauaucuuaguaauucuauaauuuuucuuggggauuuuauuuaaaaucagaagagaucugaaguaugucuucauccaacuugauaauucuauuccucaucuuagauuuaauuggaaccaaggugggagcuauucuaaagccaauugcaguuuaagaggcuuccuguucucuuauauucuagguuguggagaaggaagucuuuuucagucuuaauuuucaucuuuuggagaaacguaacagaugaaauugggcacauucaauuaacuagggcuauagacauuguagacauaucaaacuauuuaaugcaguuauaccuuugaggcaauuuguuuacuguuacuccauugaagucauauggaacauuucuaaaccagauuuuucucagaguagauaauuuagacauucacccaucacuuuauugagugugcuuuuaaaaaucugauuucaaguaaaaauuucacagacucuaauucaguugcucuucuuaauauuuauuuuaauauugaaguuaguuguuuuuaccuucaagaaaaugugcaggaacuuaaaauauuuuauaguuacuuuuuauaguuuugggaaaaguuaguauuaaaauaaauggauuuauuuaauguuaagaagaacugcuauaugcuagauacugaaggacaccugagacuacuguacacagacuacuguagaaauugcauuaguucuuagaggaagaauuguuuucauucuaguguaauaaccccauugauuacuuuuuuuuuuucugauaaagucugaugaccaugauggaacugaaauugagaaaauaaagcaagaaauaacucaauugcgaaauaguguuuuccaggaaauuuaucaugagagggaggaauauguaaguauuucucugaaauuuuaaauuagauuuuacucaggaaauugaauuuaaagucacagauuucauauaaccauauacuagagguauuaucuuggcaugguaauguucauaugaauuuacaaguuaauuucauaugacaaaauucuagaaaguuguaccaauauagaaauuucagguuaucguaaugaagaaacaucacuugucauguucucagugguaaaaauaguaaguuaaaauucaacuucuugauagaauuuuucugcuugauuuuagaauugagcuuguaauacacucacuuuugcauuuuuuuuuuguuauuuaacacaugacauagagauucucacagauuuacaugaauaaccuuuuaacuugagaaacaauugaaacacaaauggagcagcuugauccacaugagaaauguaaccagaaaggucacaccaucgucuccacucuccuaaguucuguggccuuagaaagucagcagacuacuuuuucuucacagaggaaagaauacuaccuuuuaugucugagagauacuauaaggaagaguuaguuaaggggcaguuguucaaaguaaaaauacuaugcaaauaauagacacuuuaaguacaauuuacuuacuauuauauauaccuuugaaucuuuuaauaaaaucugauaaauguuuagaaguuuuccuuaguaaaaauguugauacaugacuuuucuuuauaaaauucucaguuuucucacuuaccucaaaaugcuuuauguaguagacucacauacuuauuuuuuuaucucaaggcuuuuaggauuuuuuucuuaaguugucauucuaaaaauguuauuuauucuuaauacuuugagaaaugacagcuuauuauuaagauuacaauaucuuuccuuuacuuugaauaugaagugagucauguuuuguuugauaguucuugaaguagaaguuaaauauuaaagauuagauauuuuauuagagguaaaaaggcagauggaggggcuggugagauggcucaguggguaagagcaccugacugcucuuccgaaggucuggaguucaaaucccagcaaccacaugguggcucacaaccauccauaacgagaucugacucccucuucuggagugucugaagacagcuacaguguacuuacauauaauaaauaaauaaauaaaucuuuuaaaaaaaaaggcagauggaaauauauuuuccugaaaagcaacauacuacaguugaauucauguuaaucuauaauaaaaauacuuucuaacuuuaggagaagcugaauagcuugacccagaaaugguucccugagcugccucugcuguauccugaaauaggauugcuuaaauauaugguaagcuuuguuuccccugagaauugccaccaggcagagaguguaaagacaugguuauguucauaucauuucagugucagaucuauaguaucauuuuugugaaaguccucccaauaaauauuuaaaaggguuaauuuggacugcuccucaagacugucuuaaaccaaauaguuuaaaguagagauauugaugugagcuucauuuucuuggcaagcaggagauuaguacauuaaauaauucaaagaagaacuuggaauuaacuuuguggggagaguuaucauaccccuggugguaguaaagaacuggaagaagcacuguuuuucucugauuuuuaaaauugcccccaauacuccuuggauuccagaauacaacauguaagaguucuugacauagaaugguauaauauuugaauauguguuuuuguuuuugauuuuugaaaaagagucuugggacacagccugggcuaaucuugaacuuguaaucuuccuuugacccugccauaaguucuaggauuauaaacuugaguaaccauauccuguuuucccaguauacuuuaaaaucauaucuagaauacugacaauaccuaguaaaauguaaguuuuacacaaauuaaccagcauacaguguuuaagaaaugcaugacaaaaaucugcauucuuaugcagauauuuuauuuugaauauuccacuuacaauugauuggauauaaggaagcagaauccacagauagagaagacaauuguguuuguuuauugagacugucauuagugcauggccagggccagggccagggccagggauauaauucaguaggcagagugcuuauuuugcaugcaugaagccuuucuuucaguuuuccagcacugcauaaaaugcauuuagugacacacaucagcaaucucaguauuuuggagauagaggcaggaggaucagaguucaaggccagccugggcuacaugagacccugucucacagaaaagguguuauuagguaaugaaaauagcuaaaacagucuuuaaagaaauguuuguuuaugaguucauuuucauaaauguguaaaaucaaaguuucuugaauuauugguuuuguagcuucauggcuuccagugaaacaaaaacaaaaacauucuuuaaauaguuauuauaagauccucccauauuauauuuaaaaaagaugugugaacugaguaucauaacucaguucauaaucucaaauuuugggaaacugaggcaaugccuucaguuugagggcagucuggucugagugaccugaguuccaggauagccugggauaccaagugagagcugucuuaaaaacccaaacaccauacuaaaacaguaaaaaaccaaaacaaaacaaccucccccccccaagaaaaauccaacagcaaaaaaguccauuucucuuugaagcuaguaacucuaucuuuagagauuaucuugugucugauaaacuauucuguauucuuaauacuuauguuuauaccuaccaguacauauaauacaguuagaaauuauuaugggaaagugacaguaguaguuucaucacaauauggauagaggaaaucucacaaggcgcaaucuuagauaaaaagcuauaggcaauuagugacucauggaaggaaaaucagucuuccccagggauagcccccggaugcuauuccauauaaagugguuagcacuaaaaacauacacaugggagcaacaguaaauggacucaucacguuguauuuagguauuuacuugugaauguguguaacaaauauuaaaaacaaagaggcuaugaauuugagaguaggaagacauaggguuuggaggaaggggcauaauguaaauacaguacauauauaugaaaauuuaaaaauaauuuaaaaauaauccacuaaagaaaaaaaccuaguuuuaauguaaacauaaaaaugauagaauuaaaauuuuugaaauuaauuucuacauuuaagaauguuaagcaggauagaggagucaauauuuuguugucauaauuuuuagauuucucauugcuguucuuuagcuacuuuuacuugucuuuauuuuaauuuuuuuaaggccauuguauuagucaggguucucuagagucacagaacuuauggauagucucuagauaguaaaggaauuuauugaugacuuacagucggcagcccaauucccaacaauuguucagucgcagcugugaauggaaguccaaggaucuagcaguuauucagucucacgcagcaagcaggcgaaggggcaagagcuagacuuccuucuuccaauguccuuauauugucuccagcagaagguguagcccagauuaaagguguguuccaccacacccuuaaucucagaugaaaggcauagcccagauuaaagguguguuccuugaacucggagauucaaucuucuggaauccauagccacuauggcucaagaucuccaaaccaagauccagauaaggaucuccaagccuccagauaagggucacuggugaaccuuccaauucaggauuguaguucauuccaaauauugucaaguugacaaccaggaauagccacuacagccauauaugagguuuuucaaguaaguauugcaguuccuauuaagcuugucuucuuaaucucauuuguuucuacagucuggucuaaauuuacagcagugacuaaaugucugguaauuacacagaagacaaaaaaaguucaagagccaggaauuaaaaagaaucuaaauuuuaguaagcacuuugguuuucuuaguuugauggucuuucacuucauuuaauguaugcccuuaacaauguugugauuugaaagcccuaagucauuuuugauugucuaaauggaauaaaaauuugugucuagaauucugguggucuucuuacuaugagcuuagagcgggaccuucuugacacugagcccaugaaggaacuuagcagcaagcguccucuggugugcuccgagguuaaugggcagccaguucucuuaaagguaaguuuaaauucugaucuauggaaguuucagaaguauaaaggaaguggugaguugacuuuuaaggaagaaaagaaacccacuauuuuuaaaauauauguugacuaguaugaugauuauauuagagcuaauuuugacuuuaaaguuccucuucuuuccuuaaugcguacugucuuuucuaggccuauuaauguucuuuuuuuuuuuuuuuacuacacuuuguccaauagccuuuaaaaauuccuguuuuucuuagauaucucuugaaagcuuaccuauaucgccaacacagucuugugcugcuuaguuucuuuaaguuuuuuuuuuuaauuuuuguuuuauguguauaaguguuuugccugcauguguaucuuuguuacauauguaugccugaacauguguuggucagaagaggacauuggauccccuggaacuggaguucauauaggugugaaccacuaugugggugcugggauccaaauucccaucuuucacaagagcagcaagugcucuuaaccacuaaccaucucuccagccccuuaauuucuucuuguaagcuaagacugugaguuaacaucagaagaucuucaaguuccccgauugcuaccuauuugggaauauauaguaggcugcagguagaauuacuccuuuccauaauauagcauucaaugcagauggagaagguacuuaaaaauuaaaauagaaaaauaauguaauuuaacuuauacuuaaaaucgaaauaauaaauuagaauuagguuuuuaauguugaaauccucaaugcuguuuuuuguuguuuagggcuauuccguggauguugacacagaaggcagggugauucagagagcagccucuuaccauagagcuuguggauaugcuaaagaagagucuggguuacugccauuaauauucuuguuuuuguguaagguaaaguucuuaagcuaaucuauuguagaaaugauucuuuuaaaaauaaguuuuaaaguaguuauuuauucuucuuaauguauaguaguaguuaccucauagaauuagugcacaauacaaauauaaugaugaauuguucacuuaaguuacauuuuccauuuugcuucuuagucugauccuguugccuaucugauggucccauauuauccuaaggcaaaccugagugcaguucaagccaguaugccuuuaacuucagaaguaaguaaaaaucauuucauaguuguaugauuccaccucacaccagccagaaggcuaagaucaaaaauucaggugacaacagaugcuggcgaggauguggagaaagaggaacacuccuccauuguuggugggauugcaagcuugugcaguaacccaaucacaaaagaacucacaugauauguacucacugauaaguggauauuagcccagaaacuuagaauacccaagauacaagauacaauuugcaaaacacaugaaacucaagaguauuacuuuucuauugcuaugauagaauagcaugacuaaagcaacuuauaaaagaaaaaauuuaauuggauuuaaaauuccagaguguccugaugacagacuaagacauggugguggcaacuguugggagcuccugucuugaaaggaagguaggaggcagagaguguacuaggaaugacucaagucuccugaaacguuuaagccugccccuaagugcuauacauccuucaacaaggucauccuuccuaaaccuucccaaauagggcuaccaucuagggacugaguuaccaaacauuugagccucuggaggccauuuuuguuugaaccacuacuuaguuaagcuuuaucuagccuuuaauucuuugucuauguuuaucuuuaacuugaaggaagcuuuacuuuaguucuaagauagucuuuuaauagagacaagauuuauauauuaaaaugaggugucaguuuucuaaacuccacguuuucaauguguauuuauuugcaggaagcuuuaaaagucaugaaagguguugcccgaggacugcauacauugcauagugcuaacauaauucauggaucacuucaucagaacaauguauuugccuuaaaucgugaacaagggauuguuggagauuaugacuucaccaaaucugagguaaaauaccauagcuuuguagaauagaaacuacuuacuaaaguuguucagcauuugcauacaaugugcugauugaucuuaagauuuguacuuucaguuaagguguaucauuuaguacaaauaguaucuguaacagucaucuagggggcuggugagauggcucaguggguaagagcacccgacugcucuucugaagguccagaguucaaaucccagcaaccacaugguggcucacaaccauccguaacaagaucugacucccucuucuggugugucugaagacagcuacaguguacuuacauauaauaauaaaucuuuaaaaaaaaaaacaaaaaacagucaucuagaugguagugagcagugugugguuuuuccauaaauacagaaacaaucuaauuuacucaguggcauugacaacauugaucauuacuuucucaucaggaaacaguuucuaggaucauguaagaaccucccucugcuuguguuccuuucuuucacagauuaaauugaaauauauauauacuuuguuauuaucaauuuaguauaucuuuggaagccugaauggguguuuuuauuuaguuuaggucuagguucaacuauguggcuuuuaauuuguugccacauuaucucccaauaagcaguuuguagaaauaacaaaguccuggcaauuaagagaauguaauaauuuuauguguauguguggaauagaaagccugagaauauauaugaucucaaaggagaaucuuucuauuuuaauugacagauauauauguuuauuguauauagcccauuuaaaaauauguauauaauguaaguggcuaaauaaacaguucccguuuaaaagucaacagcuuuauugagauuucacaaggagauaauguagaauucagugcuaguuuuuaaucauauucacauagugguauauugaucaucacuguguaaguccggauaauuuuuaucacauuccaaaguaguuacugauuaacaguuaauuuucuuuccugcuuuuuuuuagaccuuaggaaccaguaauauacuuugugcuucuggauuuacuuauucuguaaucucauauaaguaaaauuauguaauaguuggccuuuggugaaucuauuuuguuaucuagauuaacauuuagaguuauucuauguuguugaauguuugaggacauaaauuuuuuagggccaaauguauuuaauuggauacauauaugauacuuugguguguguuuucaucaguggguagauauuuggguuuauacuuuuuuuuucuugagacaggguuucacuggcuagcaaauccugucuuugaacuaucuuuguagcacaggucuugaacucccaguucaacugccucaaccuccuacaugcugagauuacaaguauguacccugaagccuaucucuagguuuaugcuuuuuuaauuauuauguuagguugccaugaacauuaguauacaaguuauuuaugaagauauucucauugcuuuggggaauugucauguaauucuguuccuuccuuuugaaaauuacuaguauuugauagaacacuuaauaagucauaucuggguugaguaauaguuuguauuacaguagauauccacauaucucaaaacucauuauaagcaaacaaaacuggcuugcaaaaaaaaaaagucauuguggugguuucaauaugcuuggccaagggaguggcacuauuaggaagugugucucugugcuagugggcuuugagauccuccuuguagcuuacugggagauagucuucugaucaaaaugugaaauucucugcuucugcagugcuauggcugccugguugcugccaugcuucccaccuuaaugauaauggacugaccucugaaccuguaagccagcuucaaugaaauguucuuaauaagaguuggcuuggucaugguaucucuucacagcaaaggaaacccuaagacagucauaauuuuauuuuuuauuuuaugugcauugauguuuuaccuacauguauguuugggugagcaugucagauuuagaguuacagacaguugugagcugucaugcggauguggguauugaaccuagguccucugaaagaacuuucagugcuucuaaccacugaaucaucuuuccagccccacaaaauguuuuuagcggcaagaauucuugaucaacuaguuuauuuuccuaucaugcaagauuaugcucuaguguugaauucugguugaauuuuuuuuucaucuaaguuucaagggucccaaaacuuuuacugccaaaaacuauuagaaaaauugacuacagcagaaauuguuccuugcucuauuccagguacuauggacucugggaauaagaauacuauauuuuauucuuuucucaagaggcaaacguagaccauuuuuaaaaagcagauuuuagauuguuuauaguaaugaacgacacaaaaauuuuaaauaauguauugauucugauagguuuauaauaaauauauccaguuuacuguuugccuucuugagaaacuuuucugaaguaccucucuuuuuuuuuuuuuuuuguccucauaagcaucagauaaagguccaguuucuucauauacauuccagucauacauugcuguuaugugcuuugguuauuugguuguuuacaaguuuuagaauaaaugcuggauauauauagucuuagugguuuucauaugauacuucaaaaggaugaaaaauaaauuuaaagcuaaucaaaaguuguacaggguuuauauagacuaauuuucugaaacauucuauugucccacauuaauuuaucugagaauuaugauaacauaagaaaauagagaaaacccagccugaccagggucacaagucccuucugguuggcgccaguacugggucaccuugggcauggagucgguggacacccccaaggucccuagaggacucuccaugagaucuuaggaccucuggugaguggaacacaacuucuguuccaauccaaucacgcgggacccgagacagcauuagggaagcagaaagcccgaccugaccagggucacaagucuguucuggucggugccagcaccagaucaccuuggguggguagucggcggacacccccaaggucccuagaggacucuccauaggaccacugaccagacagcuccacgcuccucaaaggagacaccacuuucaggcacuguaacguguaggauaaaaagagcuuggucacaccaguauuucagggucucagaggaacuugacugccaagaacucugacacacccagacucucagguucacaggagcccacaagcaaaggaucacagagaaagcuggacucaggauccugaaucaacugggauuauaagaaggacaggcuccaaucagauauauuggggacaacaaauacuugagauaaucagauggcaggaggcaaauguaagaacagaagcaacagaaaucaagguuacuuggcaucaucagaaccaaacucucccaccauaacaaguccuggauauaccaucacaccagaaaagcaagacauggaucuaaagucacuucuuaugaugaugaugauggaggaccuuaagaaggaaauaaaggaagacacagguaaacagcuagaagccuuuaaagaggaaacaaaaauaccuuagagaguuauaggaaaacaauaccaaaaaggagauggaauugaacaaaaccauccaggaucuaaaaauggaacuagaaacaauaaagaaaacccaaagagagacaacucuggagauagaaacccuaggaaagaaaucaggaaccauagaugugaacaucagcaacagagcacaagagauggaagagagacucucaggugcagaagauuccauagaaaacauggacacaacaauaaaagaauaugcaaaaugcaaaaagauccuaacucaaaacauccaggaaauccaggacaaaaugagaauaccaaaucuauggauaauaggaguagaugagaaugaagauuuucaacuuaaaggaccagcaaauaucuucaagaaaauuauagaagaaaacuucccuaaccuaaagaaagagauggccaugaaccuacaagcagccuacagaacuccaaauagacuggaccagaaaagaaauuccucccgacacauaauaauuagaacaacaagugcacuaaauaaagacaaaauauuaaaagcaguaagggaaaaaugucaacguauaaagacaggccuauuagaauuacuccagacuucucaccagagacuaugaaagccagaagauccuggacagauguuauacagauccuaagagaacacauaugccagcccaggcuacuauacccagccaaacucucaauuaccauagguggagaaaccaaaguauuccaugacaaaaccaaauucacacaauauccuuccacaaauccagcccuucaaaggauaauaacaaaaaaaccuagccgggcgugguggcgcacgccuuuaaucccagcacucaggagguagaggcagguagauuucugaguucgaguccagccuggucuucagagugagcuccaggacagccagggcgauacagagaaacccugucucgaaaaaccaaaaaaaaacaaaacaaaacaaaacaaaaaaaaccaaggacggaaaaaaucaagaaaauaauccuucaacaaaccuaaaagaggacagccacaagaacagaaugccaacuuuaacaacaaaagugauaggaagcaaugauuacuuuuccuuaauaucucuuaauaucaaugaacucaauuccccaauaaaaagacauacacuaacagacuggcuauguaaacaggacccaacauuucacugcuuacaggaaacccaucucagggacaaagacagacacuaccucagagugaaaggcuggaaaacaauuuuccaagcaaacagucugaagaaacaagcuggaguagcaauucuaauaucgaauaaaaucaacuuucaacccaaaguuaucaaaaaagacaaggagaggcacuucauacucaucaaagguaaaaucuuccaagaggaacucucaauucugaauaucuaugcuccaaaugcaagggcauccacauucauuaaagaaacuuuaguaaagcucaaagcacacauuacacuucacacaguaauagugggagacuucaacacccaauggacagaucguggaaacagaaacuaaacagagacacauggacacuaacagaaguuaugaaacaaauggauuuaacagauaucuacagaacauuuuauccuaaaacaaaaggauauaccuucuucucagcaccucaugguaccuucuccaaaauugaccauauaacuggucacaaaacaggccucaacagauauaaaaauacugaaauugugccaugcauccuaucagaucaccaaggacuaaggcugaucuucaguaacaacauaaauuauagaaagccaacauucauuuggaaacugaacaacacucuccucaaugauaccuuggucaaggaaggaauaaagaaagaaauuaaagacuuuuuagaguucaacauacccaaacuuaugggacacagugaaagcauuucuaagaggaaaacucauagcucugagugccuccaaaaagaaacuagggagagcacacacuagcagcuugacaacacaccuaaaagcucuagaacaaaaggaagcaaauucacccaagaggaguaaacggcaggaaauaaucaaacugaggggcgaaaucaaccagguggaaacaagaagaacuauucaaagaaucauccaaacgaggaucagguucuuugagaaaaucaagucuaugucuuugagauaaacccuuagccagacuaacuagagggcacagggacaguauccuaauuaacaaacucaaaaaugaaaagggagacauaacaacagauccugagaaauccaaaacaccaucagauucuucuacaaaaggcuauacucaacaaaacuggaaaaccuggacgaaauggacaaauuucuagacagauaccagguaccaaauuuaaaucaggaucagauuaaugaucuaaacaguccuauaucccauaaagaaauagaagcagucauuaauagucucccaaccaaaacaagcccaggaccagauagguuuagugcagaguucuaucagacauucaaagaagaccuaauuccaguucuucucaaacuauuccacaaaauagaaacagaagguacucuacccaauucauucuaugaagccacaauuacucugauaccuaaaccacagaaagacccaagaaagauagagaacuucagaccaauuucccuuaugaauaucgaugcaaaaauacucaauaaaauucucgcuaacugaauccaagaacacaucaaaacaaucaccuauccugaccaaguugguuucauuccagggaugcagggaugguuuaauuuuuguaaauccaucaauguaauccacuauauaaacaaacucaaagacaaaaaucacaugaucaucucauuagaugcugagaaagcauuugacaaaauccaacacccauccaugauaaaagucuuggaaagaucaggaauucaaggcccauaccuaaacaugauaaaagcaaucuauagcaaacuaguagccagcaucaaaguaaauggugagaagcuggaagcagucccacuaaaaucagggauuagacaaggcugcccacuuucuccauaccuauucaauauaguacuugaaguccuagccagagcaauuagagaacaaaaggagaucaaggggauacaaauuggaaaggaagaagucaaaauaucacuauuuguagaugauuugauaguauauauaagggacccuaaaaauuccaccagagaacuccuaagccugauaaacagcuucagugaaguagcuggauauaaaauuaacucaagucaaugaccuuucucuacacaaaggauaaacaggcugagaaagaaauuagggaaacaacacccuucucaauagucacaaauaauauaaaguugugaaagaucuguaugauaagaacuucaagucucugaagaaagaaaucaaagaagaucucagaagauggaaagaucucccaugcucauggauuggcaggaucaauauaguaaaaaauggcuaucuugccaaaagcaaucuacagauucaaugcaauucccaucaaaauuccaacucuucaaugaauuagaaagggaaauuugcaaauucaucuggaauaacaaaaaaccuaggauaacaacaacucuucucaaugauaaaagaaccucugguguaaucaugaugccugaccuaaagcugcacuacagagcaauuguuauaaaaacugaaugguacugguauagugacagacaaguagaccaauggaauagaauuggagucccagaaaugaacccacacaccuauggucacuugaucuuugacaagggagcuaaaacuauccaguggaaaaaagacagcauuuucaacaaauggugcuggcacaacuggcgguuaucauguagaagaaugcgaauugauccauucuuaucuccuuguacuaaggucaaaucuaaguggaucaaggaacuccacauaaaaccagagacacugauacuuauagaggagaaaguggaaaaaagccucgaagacaugggcacagggaaaaaaauuccugaauagaacagcaauggcuugugcuguaagauggagaauugacaauugggaccucauaaaauuguaaagcuucuauaaggcaaaagacacugucaauagacaaaaaggccacgaacagauugggaaaggaucuuuaccaaucuuaaaucagauaggggacuaauguccaauauauauaaagaacucaagaagguggacuccagaaaaucaaauaaccccauuaaaaaugggguacagagcuacaaaagaauauucaacugaggaauaccgaauggcugagaagcaccuaaaaauguucaacauccuuaaucaucagggaaaugcaaaucaaaacaacccugagauuccaccucacauuagucagaauggcuaagaacaaaaacccagguaacaacagauacuggugagaauguggagaaauaggaacacuccuccauuguuggugggauuacaaacugguacaaacagucuguaaaucagucuggcgguuccucagaacauuggacaugguacuaccugaggauccugcaauaccucuccugggcauauucccagaagauguuccaacauguaauaaggacacaugcuccacuauguucauagcagcguuauuuauaauagccagaagcuggaaagaacccagauaccccucaacagaggaacggauacagaaaacguguuacauuuacacaauggacuacuacucagcuauuaaaaaagaaugaauuuaugaaauuccuaggcaaauggauggaccuggaggguaucauccugagugagguaacccaaucacaaaagaacucacaugauauguauucacugauaaguggauauuagcccagaaacuuagacuacccaagauacaauuugcaaaacacaugaaacucaagaagaaggaagaccaaaguguggucacuuugccccuucuuagaauuggaaacaaaacacccauggaaggaauuaaagagacaaaguuuggagcugagucgaaaggauagaccaccuaaagacugccucuccgggauccaucccauaaucagccuccaaacauagacagcauugcauaugccagcaagauuuugcugaaaggucccugauauagcugucucuugugaggcuaugauggugccuggcaaacacauaaguggaugcucacagucagcuauugaauggaacacaccccccaauggaggagcuagagaaaguacccaaggagcuaaaggggucugcaacccuauuggaggaaccacaauaugaacuaaccaguacccccagagcucgugucucuagcugcauauguaucagaagauggccuaguuggccaucauugggaagagaggccccuuggucuugcaaacuuuauaugccucaguacaggggaacaccagggccaagaagugggaguggguggguaggggaguggggcggggagguuaugggggacuuuugggauagcauuugaaauguaaaauaagaaaauaccuaauuuaaacaaaaagaaaauaagaaguuuacaaguaaauuuuaaggauucaugucaguuuauuuuugagcacaucauugguacaauuguggacgagucuauucugaccaucacucguccucuuuuauauccauuugucaucugguauucuuucccagcaugcuauuuuaguuggucauuuaccauucccaguugaugccuuagcuucuagauuuuagacuacacuuagaguaaguggagaauauauacaauuaagauuuagugauauaugaaagcacugugccaacaucuuuaugauaauuuuguaaugcagguguuaaaaaauaguuuagacuuggagaaauuaaaauuuaaaucacagauaauaaaugugagagucagaauucuaacuuuagggcagacugaauuuagguaucaugauuugguauccuuugauuucuuagaaaaugguauauuuagaaaauggucacaaagaaaaaguaauuuguauaaguucauuuaaaauauuuagaauguucagaauuagaaaauaguacuucuuugucaguuuauuaaacuauaccuguagggaguaggggagauggcuucauggguaaacuguugucugugcaagcuugaugaccugagugugaucccuggaaaccauguaagaaguugagaaaacccaauguaguggccucuccuugcaaucccagcacuucuccagugagauggaagguagaaacaggagaauccaaaguuggcuacccaguuugccugaaguaggcaggguaguagcagaaagaacaaaacgacccugcuucaguauucagaagcuaaaggcuuucuccagaaaguuguucucugaccccacauauguucagcgacacaaaugcuugcuuauccaucuauacauagcauacacacaaacauacaauaugcacauguguguauacacauguuagauuaaaauuaaaaaaacacaaagcaauaucugugauaaaaacaccagagucagucauuuucaguccacaucuacaucucaguauaauaaaaguaaaauuuguaagaauagaaaauuauauaugagagguagaccgugaaauauuucaaaagaauuuuaaaauugagaacagaggcuuuuaaccccaaaccuucauuguuuaaaacuguuucuguagagccagcgagcuucagucaacgcgaugguugguggauugaguuugcucucaccugaauugaaaacuggaaaaccuccuucugcaaguucagacuuauaugcuuaugguugccuuuucuuauggguauguugcuuuaaaaucauuaacaguuuacauauauuucagaaggcaaaggaugauuuuuuguuauuuucaaccauuuuucugggugacgaauaaugcuauacuuuucaaaaguagaauuuucuuguguguguguuuguguguguguguguguguguguguguguguguuguguuuguauguauuuuuauuccccucaacuccuaucucuguucucaagggaucugaaauggaguuucccauuuucuaaugcaggaagucugucuauauuauuaaauuugucuuuuagggugauuuacuaugauuugaugauuguucaauaucuuagaggcuccugcaucauuuuuauuucugggcuugaggcucccgcugcuuuggcgucuccugagucucuuuggacagccagcugaacuugaaggagagaaaccaggaaaaugucuccucugugaauuucugucagaugucuuccuguccucugcgauauuccugucaguuguccucuguucucuggaacauugguggacuuucugcaaucacguuguggggcagauguuuccugucuucugcaacauuucuaucagauguccccugcuuucuacauuguuggugggauuucuucucuaguuacauuguuuuuuguuuuuuguuuuuuuucuuccaaacacguuaagugccagauguaaaagcauuuuuuuuuuuuuuuuauucucuugagugucagucuuaggccuaguucuggaaccuucuagccucuguacaaucuaaccuaggccuagguuucuuuuuuugccucugagacuuacugcuuugccucugagacuuacugcuaaauaaucucacugcuucauaguucuuucucaacucuuccuggcugguucaauucagcuguucuggcucaaacuucuccaagaugacugauucuggcuucucucucagccucugauauaucuugauaucuuugguuguguauauguguaaguauuaaacuaguuugaaugggacuuuuucugauaucuuauucagcaaaguuuuuauuaguguguaucaacauuacugauucucuugaauauugaauuugcaaccugauacuaugccaaaucuuuuuaucagaucgcggagucuucagguugauucucuaggaaaauuuaaauauagagucauauguaugucuucuuuuucuucggggacauuggucacuugcccacaagggcagaaggaacagaagcaguuaagcaggauucagauggccuguguguggaagucagagguugauauuacaugucuccuuaguuguuuuacacuauguuuuccccaccuugauauaugguuucucauggaauauagaacuugcuuauuuugcuagccuggcugacuagcaaguucaagaguucugucucugccucucuaguacugggaugaaaggcaugcauugccuuagcugacuuuuaauauuggugcuggagguucuuaugcuuauacugcaagugcuuuacuaagguaucucucagccucucugugauuuuaauggucugucuggacauuauaauaugcauauguguuuuauuauauucuaguaguacauuaguugcuuuaauucucucucucucucucucucacacacacacacacgcgcacgcacacacacacacacacacacacacacacacacgcacgcacgcaagcauacauuccuaaauacaugaauacaaucugcuuagucuguauaaaguuaucugcauguauaugcucucagggccaaccaucuuauuauuagauaacuaauuggagaguucuuccugcaugcuagcacagaaggggaaaacugacuagguuucaucuuuagacaaagaacuacaggcaacuggggaaugcugagagugggaucaacaauuuuucaaguauuguugcacuaguuuuucuuuuuuucuucuucuuuuucuuuuucuuuuucuuucucuuuuucuuugugguuuugucccgugauuugcacaucuagaauuaguuugauuggauuuuaaaaaauacccacuuucuuccaguguguuugcauuguucaagagggaugacuuuguugaaagguuggagugucauuuuacuguuagacucauguucaggccacuugucucugguacuucucugaaaguagacugucacugucaaaugcuagauucauuaugaacguacaauaauaaucagauaaacaucacccuuuaaaauguaaucaaguaaaagacacugguaauacaguauauaguaagacgcuaauuacugugguucugaauggaaauuaggaggaguguaagaccagugguuaauuauuggguuggcgaggaaggaaaagcaaauacaaaaagggaauaaagggaugagguggcuugggcaugaacuuggcagacgaucccauggcccuagaggacucuccacgcugcagguacccuagcaugcccaggaucuuaggaucacuggugaguagaaccaccaccaguaauaauaauuacaccaaucaugacaggccugugacagcaggaacaaggccugaccaguggcucggguucauucugaucgguucugguauaccuugguuucgaacacaccagucagccccaugguccccagaggagacaccacuuauagacacuauaacauguccacgaucuuaggauuucaggaucccaggaucccaggagcuuggucacaccaggaucucagggucucagagggagcuugacuaccaagaacucugacacaaccagaaucucagguucacaggagccuggaaucagaggaucacagagaaagguggacucugaggaguccuaaaucaacugggauuauaggaaggacaggcuccaaucagauauauugagggcaacaagcacuugagauaaucagauggcaggaggcaagcauaaaaacauaaucaacagaaaccaagguuacuuggcaucaucagaaccaaacucucccaccauaguaagauacacaccaucacaccagaaaagcaagauauggaucuaaagucacuucucaugaugaugaugaugauggaggacauuaagaaggaaauaaauaauucccuuaaagaaauacaggagaacacagguaaacagcuagaagcccuuaaagaggaaacauaaaaaucccuuaaagaguuacaggaaaacacuaccaaaaagguaaaagaauggaacaaaaccauccagaaucuaaaaauggaaguagaaacaauaaagaaaucacaaagggagacaacucuggagauagaaauccuaggaaagaaaucaggagccauagaugugagcaucagcaacagaaugcaagagauggaagaaaguauuucaggugcagaagauuccauagaaaacauggacacaacaaucaaagaaaaugcaaagugcagaaagaucccaaaaacauccaggaaauccaggacacaaugagaagaccaaaucuaaggauaauagguauagaugagaaugaagacuuucaacuuaaagagccaguaaauaucuucaacaaaauuauagaagaaaacuucccuaaccuaaagagagagagaugcccaugaacaaacaagccuacagaacuccaaauaaaaaggaccagaaaagaaauuccucccaacacauaauaaucagaacagcaaaugcacugaauaaagauagaauauuaaaagcaguaagggaaaaaggucaaguaauauauauaggcagaccuauuagaauuccaccagacuucucaucagagacuaugaaaaccagaagauccuagacagauguuauacagauccuaagagaacacaaaugccagcccaggcuacuauauccagcaaaacucucaacuacauagauggagauaccaaaguauuccaugacaaaaccaaauucacacaauaucuuuccaggaaucaagcccuucaaaggauaauaaagggaaaaguccaacacaaggagggaaaugaugcccuagaaaaagcaagaaaguaaaccuucaacaauccuaaaagaagauagccgcaagaacagaaucccaacucuaacaacaaaaauaauaggaagcaauaauuacauuuucuuaauaucucuuaauaucaaugaacucaauuccccaauaaaaagacauagacuggcuauguaaauaggacccaacauuuugcugcauacaggaaauccaccucagggacaaagacagacacuaccucagaguaaaaggcuggaaaacaauuuuuccaaguaaacagucugaagaaacaagcuggaguagcaauucuaauaucgaauaaaaucaacuuucaacccaaaguuaucaaaaaagacaaggaaggguacuucauacucaucaaagguaaaaucuuccaagaggaacucucaauuuugaauauauaugcuccaaauucaagggcauccacauucauuaaagaaacuauaguaaagcuuaaagcacacauugcaccucauacaauaauagugugagacuugaacaauccacucucaucaauggacagauccuggauacagaaacuaaacagagacacauggagacuaacagaaguuaugaaacaaauggauuuaacagcuaucuacagaacauuuuauccuaaaacaaaagcauauaccuucuucucagcaccacaugguaccuucuccaaaauugaccauauaguuggucacaaaacaggccucaaccgauaaaaaaauauuaaaauuaucccaugcauccuaucagaucaccacggacuaaagcugaucuucaauaacaacauaaauaaaacagaaagcccaaauacacguggaagcugaacaacacucuacucaacgauaacuuggucaaugaagaaauaaagaaggaaauuaaagacuuuuuagaguuuaaugaaaaugaagacaaaacauaaccaaacuuaugggacacaauaaaagcaguccuaagaggaaaacucauaucucugagagccuccaaaaagaaucuagagaaagcacacacuagcagcuugacagcacaccuaaaagcucuagaacaaaaggaguagauggcaggaaauaaacucagggcugaaaucaaccaaguagaaacagaaagaacuauacaaagaaucaaccauaccaggagcuguuuuuuugagaaaaucaacaagauagauaaacccuuagccagacuaacuagagggcauagguacaguauccuaauuaacaaacucagaaaugaaaagggagacauaacaacagaaccugaggaaaucccaagcaucaucagauccuacuacaaaaggcuauacucaacaaaacuggacaaauaucuauacagauaccagguacuaaaauuaaaucaggaucagauuaacaaucuaaacagcccauauuccauaaagaaauagaagcagucauuaacagucugucaaccaaaacaagcccaggaccagauggguuuaguguagcuaucagacauucaaagaagaccuaguucaauacuccucaaacuauuccacaaaguagaaacagaaaguacucuacccaguuuguucuaugaagccaaauuugaaaggaagaagucaaaauaucacuauuuacagaugauaugauaguauauguguucauauacuaucauaucauauauauaagugacccuaaaaauuccaccagagaacuccuaaaccugauaaucagcuucauugaaguagcuggauauaaaauuaacucaaaucaguggcuuuucucuacacaaacgauaaacaggcuaggaaagaaacuagguaaacaacacccucacaauagucacaaauaauauaaaauaccuugguuugacucuaaggaagugaaagaucuguaugauaagaacuucaagucucugaagaaagaaaucaaagaucucagaagauagaaagauacuuugucucuguccagguucugccuugcugcuuacugcauagguaugcuucauaguuucuucuuagcacauuguccugugacauauacguucuuugaauuuccugacuguauaguuuauaguuggaggguggggguuugcgguucuggggccaugaagccacugaccaaaaaaagugucucuuuuuuuguaguaaaauauuuauauguaaaauuaugaucuguauaggauuuacuucaaaagaaauaaauguggacuuucggaaagguauaucaauugguaaagugcuugcuaugcaaccaugagguucugaguucaaucuccagaacucaugugaaaaagccaaguguuugguggauauguauaauucuaauacuggggagguagaaacagguggaucccuguugcucacuggcuagccaggcuagccuaaucugggaguucuagcauaaggagagacccuuuuucaaaacacaagguaguugaugacuccugugguuugaaugagaaagguucucauaggcuuauauguuuggauucuuucucccuaguuggaagaauuguuggggaaggauuaggaggucuuguuggaggaggugugucacugggggcagacucugagguuucaaaagacuuccaccauucccagugucuuuuuccuuuaucuuucauuuauguguggagaucugaguauacagcuacugcuauagugccaugccugccugucuacuaccaugcucacugccaugauaauuacagacucuaaccuuauaguuaaacacuuuguuuuacaaguugucuuggucauggaguuuuaucauaacaauagaaaauaguaaauauaauuuguaagaaagaauaaccaagguugaccgcucugcuuacauaaaugcacaugcacacacauguuguuuaccuguguuccuccccaccaaaauaguaguaaauauggaauuuggauuugcauguaggaaaagaacagucauugguugacgguuguuagggaugggugaugaaacauauaggaaucagaauaccuuugugaauguaagaaaugugguauauuuaguaguaucuuagcguucuauugcuguguuaaaacucuauaacaaaaggaaacuuuggguggaaaagguuuauuuuguuacacuuucauaucagaauccaucaucagaagucagaagucaagacaggaaucuggaggcaggaacugaagcagaagcuauggaagaaugcugcuuacuagcuuguuccucaugguuuacucuguuuucuuaggcccuccugcacuguuggugccacucaauguugucuggguccucccacaucaauuauuaaucaagaagaugcccaacagacuugccuauaggcuuuuuauuuuuuuacuaagaacuuuuauccugcaugagaagugugcuuucuuaugagcucuucucuuuucaucagaaucuggggguauccaguuuuuggacauugugguaugguguaauuuacaaaguguuggguuucauuucugguuauuccaacauacauguagccagugaacuauggguugauuauaugugaaagugguucaguuuagacucucuaggauuaguauuuaauacuaaaccucccuaaugcggugacacuuuaauacuucauauugucuugacucccaaucauaaaauuauuuccuugcuacuucauaacuauaaauuugcuaucguuaugaaucauacauauaaauaucugauaugcagccccuguagguugagaaccacugauauuaccuuugaagccuuuucacuuuuguguucuuuugcagcuuucuguucaaaaucaagaguuugagacaaaugaagauggaauuccaaaaguagaucaguuucauuugguagguuuccuuuggcuauuuacacauuuggaauauguaguaauauaaauuuagaagucuuugaaaaugaucucugauuucuauaaaaagucaagcuugcauuagaaauaaugaaguauagaagaaaauagaaguacccuacuugugugacugccagauaauuaacaaauugucuaaauaaggaaauacaguauuuauuauauauuccaaaguuauuuuguuuugaaaugaauguuuaauuuuuguaagugucuaagauguagcucuuuucuuuaaaauucauaugugucauugauaguuuugucauccauauauauuuucagacaacuuauuuugaacacuugucugggaccagcaauugaacuagcuacuagguauuaggguauuagggagcuagguacaaggauugaaacauuggaagugaaauuucaaauuuuucuugacuacaauuuuuuguguguguaugugucuuucuaguucacuuuuugcucucuugcauuguagaucugaauggaaaaagucaccaguagccauuccacagcuagaauguucuucugucuugaaauuucccuugccagauacauuaguguaucacuuccuuguucagguucuccucacacucagguucucaggguaugggaagaaugcacaguuuuguuuuuguuuuucuggaguaucacauggagugcaucuagccuaauuauuaagaauccuguuccccucugaagccucagggaguagacugccacugucugauguccuuuuaacucccacuagaagcacagugugcucugcuucuaacacuccaggggauuuuaacaccaaagacccaagaacuacagggucaggugacugaccccugcucucaguauggaauuucucuguuaguuauuuuuauugcugugaucaaaugcaugccaagaagcaauuuaaggaaggaaagguucaugagguauuuuuuucuguuggagucuuuuuuuuaaucauaguucauucauaguuugauauuuuaauuuucuuaaaauuuuaaugcaucuuaaaguuuaauguuauauagcaugccuuucuguaaaguguuaaauaacaaagacaacaaaaagauaacuaacuuuacaguuuauccaccucaaguguauaacuuagugguuuuuaguauagucauguguccaaccaacaccacaaacucauuacacuguaucugccaccucucaguaucuguauuucuuuaccuuaauucuaauuaacaacuaauguguuuucuguuucuguuuaauuugcuauugugggcauucauaugaauggaaucauaauggcuauagugugcuuugcuuucacuuagcaugcuucaagcuucauacaaauucuaguauuaauauuucaucccuuuucauggcuaaguaauauuccagugauagauuuagauuuaccacaauuuauugauaccuacuuauggacauuuuaguuauauauaccuuugguuauuacagagaaugauacaaacauuuauauacagacauuugaguagacauguuucauuucuuuggguauauucuuagagguagaauuaaugggccauguggcgacuguuuauuuaguacuuugaagacacacuagauuccaagaaguuaucuuacauuuguaguuucucugcauuaacacuaguuauaagacuuuuugauucuagucaucaaaaugggaguacuaucucacucacaggcuuuauuuaaauuuguucugucuuccucagagaaaugcuuguucagacucuuauuuuuuacaguuuaaaaauuguguugcccuuugauuuuugaauuuuaaugguuguuucuguauuuuagaaacaaauaaaauauuggauacuugguuugcaaguaguuuaccucauucuaugggugcuauucucuuuuucuugauagugucauuugaagcaaaaguguaauuuucaaugaacuuuguccauuguugcuuguacguaagggauuauuuucaagaguucuuuauuaaaucuaaaauuggaaagauuuaccucuauauuuucuuccuaaaguuguauaauuuaagcuuuuauauuuagaucuuuggucuauuuugaauuaaauuguuguauauuuuaagaaguaauauuccagucucagucuuuuauguguggcuaucugucccagcacuauugguggaaaagaccauuuuguaaucauuagagcgucaugucauugcugucaaaaucaggagaugauagacucugaauucucuucugcugucuuacagaaguuccucuauuauuauaggauuauggcuuuacaaacauauuuuaaguuuaaaaugcauaugguccacauuaccugcagaguuuacagcuuagcacacgauagacugcagagcauugcuugaugaucuugaugagcacaugcugauuuagagugcagaucacagaggaugcccagcaucacugagaggauuauacuacacauuauuugggaaggaucaaaauuugaaauuugaaguauaguuuuaguaugugucuguuccuuugccaguauaauguugucuugauaucacuguuaauagauaucugaaauugggauauaugaguuauacauguuguucuuuaaaaaauggucagaauuauuauucugaucuauaaauuucagagguagcuugccagcaucuacaaaagagucaguuaaucuaaggcuuuuuuccccugugugguuccuuauuaguguugauugcugauccacaaacauugaugauuccccauuuauuuagaaauuuauuucuuucaacuauaccuugugguucaaaguauauguguuugaaacucuuuuguuuaaucuucauuuuaauuuauuuuauguaugugaguacacuguagcugucuucaggcacgucaaaagagggcaucggaucccauuacagaugguugugggccaccaugugguugcuggaaauugagcucaggaccuuuggaggagcaggcacggcucuuaaucccugagucuccagccuccugcguaauuauucuuaguuauuaguucuaaugcuuuaacauaucucuguaucauuugcaaauagugaugguuuuacaucuuucccuucaauuuuuuguuuuauuuuuauuuucccugccuaagugguuggagucucccauacaauguuaggaaguaguggugugaaauuuucaugugaaacucugaccacugucccauaaaaaggggaaaauuuuguucauauuucacucauuuuauuguagcuauaauucucauugcuuuugcauuuccacugguaaauagauucuuuuuucuuauuacuggagauauuuuuuccaauguagauaaacuuggaaagaaucuaaaaaucuagauagaaaacugauguuagccuaugucaguaacuaaaagguuuuuucuuucuuuuguuuuuguuuuuuuuaaauuggagucucugucauugucauuacagauuuguucuuuuugccauuaguuuugauuuugauuuuuuuuuuuuuuuacuauuuacguacuuacuuacuugagacaggguuucucuguguagccuuggcuuugauucuuuauguuucuuuuuccuugcaggaugauaaugucaagucccuccuuuguagcuugauauauuuuagaaguucaaugacugcugagcagguuuugaaugcugaauguuucuugcuuccaaaggggaaaucaguuccaaucccagaaaaagagauugaauguacucagcauagcagagaagaugaaucaaagauggagagucuggauagauauagugaaaagacaagaaauggugaagccaacccuugacuaacaaauuaauccuuuauuguugcuguauaugucccuuuuaaaaacuuuguucuguuugcuuaguagacaaaaauguucuggaacuaguuggauugcaucuuuggauuuggguuguaaaaaauaaaagaaauguuuugauuacaccug

SEQ ID NO: 2992 - RNA, 6813 nt, Mus musculus
ugugggcgacccgcucuccgcaucccaccgguggaucucuucucucacagaggcacccagagcagagcacccgccgcucagcgacgacugcccgcccgccacggugagugccaggaucaacugggacaggggcgcgggcucccagacgccagugaacuugccccgcagccgguccccugagcuugcucugccagcuugacacccagcucuuuggggcgccuaaauuucacuugcuggacucagguucuacuguccaccugcccuuccccgggacccuccaaucugggcgccccgccuccgugccucuuaucuuuugaggguagggagaagaaccugggaacaccuaucccagggcagcggugggguuuuguuugguuguuuguuuguuugguugguugguugguuacaaccaggaacccagauugcaugugugcuccuagugggagauucccccaaguauugucucuagcacggugagcucuguugccuccaaaauccgaacugagccucuggguauccgacugucacagcgcuuguagccacacaaaucaaaagcaacccagaagaaaaguuuucuccuccaagggugauuuaggaacgagaggagaaaaguggucauucuuuaagauagagggcagaacuuccaauucuguucugaaaaggggaccucugccucucaccaggagaaucggaggaaguuuucugaaauauguggacggggcagaagauccaggucggggcaaguggucuucuaaagauuuggaaguggcgccugcccagucugggcuuuuauucuagggucugggaugggauuagaugagggucuagagugauagcuggaauugggacaaagacgagcaaucucagcaucuccaagucugagccuucuguauccacagaugcuagguaacaagcgaauggggcuguguggacugacccucgcucuaucucugcucguguguuugggcauucuggcugagggguaccccuccaagccggacaauccgggcgaggacgcgccagcagaggacauggccagauacuacuccgcucugcgacacuacaucaaucucaucaccagacagaggugggugcauacgcggcugguaccuagagccgggaaaacuugcgguucuggagaucuuggacaucagggaucauuucuuucuccuuguucauagggcaggaucagacauaaauucagcucuagauaaauaugugagcuggguacacacuccacaaacuggauacauugucuuugucacuagacuuucucuccaagacccaagcccaagguucagugccucuaggcuguccucugucugccacuuaccuuuccugccuuuuuugcuuacaucaguuggagauuuacccagcacauaucucgggggaaaggccugcauugggcaggggugcagaaguguaaagguguagggagaagaggaacccugauuuagaguaaacaaccacagucaaagaaaaccaaggacacaauccagcugucaaaaggguggagagaucuuugagccugcccagggcaaagggaguggcugcauuuagggaaauaaauaaauaaauaaauaaauaaauaaauaccaugggcuucuucugaacuaauaaaaaggcugacuuuucccauuuuauagcaacugaguucugaaaagaaagugccccauuaagaagaaacaaaagagaacaaagccuuuacauuagggacucugauggcuacagcuccaacugccugggaccugagagacagaccacaaucuguacuuuuaauguccagaaagucagaggcgagccuugccuuuccucucagcauuaaaaucaagcaggaaaaauaaaauccacgcuauuuuacaaacaauaugggacuuagucugcaaaauuggugcaucuuaguucuaaaucauuuaacaacacauuucaauuacugagaauuacugagaaccuugaaggaccauauaggcaagcccuuuggaggcauuaauguucuuuacuuagcauguuucaauuaugcauaguagauuuccagagagagguuaaacugcucgcgacccaggggauguuuggaugggaugcaaaagggagguugugcuucuaaaacaguuguguauucuuaauuucaucagaaagguauguggcauucugaaagcccucuggggaaaacaaucccaauguauacagaauugcuuaaguaauacaggcucauaaucuuuugaaaucugaccauuuugacuagcaaaaagcaauuguguuuuugagccuaauaaaaagacuucccagaaagucaaugacuucagguuuguuuguuucuuuuuuuaauccauacagaucaaaaauaaauuacacaauugaaaugauagcauuaucaagauuuauguauguauuuuauguauagcauucugucuuaaugcaagccagaagagggaaucagaucccauuacagauggguugugagccaccaugugguugcugggaauugaacucaggaccucugguaguuaagccagugcucuuaaccacugagccaucuuuccaaccacaacaccaugguuuuuguuguuuguuuauuuuugguuuuguuuggcuguuugguuauuguuuguuuuaaaaaaacaaacuuuauuauuuagauacgacauauagaacucucucucucucucucucucucucucucucucucucucucucucugcaaagacugcugcuauaugacuuugccucaguguauggaaugaucccauuucauguuucucuaguccucccauucagucuuuucuucaaaacuuugaagugaauuucauugucuccacuuugcagaucacaaagcuaaggacauuuuaagaaagcuuucuuggguuauggagcuagaacccucugcugagcuucuguggaugggaccacaucauuaacauucaauggaaucuccaccaucuuugagggggggggagaaacaacagggaaaggggcuugcaugucacaggaagaaaaccugguucaauucugaaaaugaaccuguaucauccugguaaaaguuaucuuuagaaaccacaagaagcuccauuugugcacuuguugacuuuccaccaaagauucaugcacagaaguccacgccuuugaaaauuaccguguuaugugugacuguuuuaucuauaauuauucucuuccuuccuucugccagaccuguuuguaacuguucuccuguagcugugcaugcugcugacuuacugccucagcaggccaaaucauuuguucuagucuaugggucuuguuugugugguuccuuagaacaguagcucucagguggaggugaguuuuacucccuaggacauacagcaacguugaggggagacuguuuugguacaaccagaagugagugcugcugguauauaguguggagcuguuagagaaagagcccugagcccagccaccauuuggauaagucuuaugagcaugcagaaacugccacaauacagggagaauuuugacuggaaaauagggaaaccacuugccuguccuuuugacucucugaagcauaauagagguaaaugaauucagguugguugcccaaagugugaagaugaacaaaaucaacggaagggcagguuaaccaagugcaagccaccagcucgagucuaaucuugcagaaaaucuuaacaaaugaugugagcguugggugaugaggaugagcauuguuugcuuuugcuccccuugagucucagcacaggagcaaugagaaaucucgccaacguauuuggauuuaguucugcuggguuggcacuuagaacaacaucugucagcuuuguccagcuguugugccuauuuguuaauccaucuggaccaggccaaguuuucauuuggaaauggaguggcugcugauguuccacgccuuuccagugaauggagaaaauuguguaauuagcuaucaacuugucaacacccuuagcaguguucuguagcagguaguuuauuuuaucuuuacagaggaauguaaccucagguccauauauuguccuuaccauauccuacuauuucuguuggccaguaggaccccaucaugccucagggaaagcauuagugucuccaacagagaggggagagugcaagauccaggguaugucgggauguguaaggggggagcagugaugaccgggauguaagugugggugcacucgggcagcagcuucauuugugcaucacugaugaccugaguucaauccccagaacccagggaagaaacagaaccaacuaugacuuccaugagcugggggaagagguaugugggaggguuuguagggagaaauagaaggggguaaaugaaguaauuauaauauaauuucaauaauaaacuguauauaaaguacuucagaaaaauuaaguauauguaaccuuuaaauuguaucuguuuagcgagugcgugcaugugugugugugugugugauguauggaugcacacacuugcacauggaagucagaggaugcuuauccagaguuggucucucuauucccucuuuggguuuugggaauuaaacugaagucauuaggcaugcauggaaagaacucuuaccuuccggaccaucuuaccugguuguguguauauguguaugcauauauguggucaugauagaguugcugaugacauaugcuucacacucugagaauacuuauuagcacaugaacgacugggaauaacauuugaguuuggugggacacuuucccucucucuccuaugguuaccccuaagcuuacuuuauaaaaaccuugauuuuacuuucuucauguuucagauauggcaagagauccagcccugagacacugauuucagaccucuuaaugaaggaaagcacagaaaacgcccccagaacaagguaugacaaagccugggauggagauguuacuacagagcuuaugaugccaguggaggggagcuaggggaagcuggugggagucuguguggacauuaggauagcagcauccagaaaagaagggugaggauagagauggggauggagaaccauaccugaaagaccuugcauuucaugcauucacugcaaaucuuaauuuccaaggcauuuuguuuucuaauacauauuauuuggugucccuuuuuaaauauggcugacuuuuaguucagaaguuauacucuauagaaugccuugccuuauuagaaguaagggagcauagagcaagcccccaacucugaauugaaaugaccaaucauccauuuaggcuggacaaucucguuuuuauacacuagguggcauucucaaauguccuagagcccacggaccucaugugucugacucuguuuucccuagcuuuacccaaagcuaaagauagucagguguuccuggcuaccuuuugaugucuuuugggucaaaauacugaucuauuuuauucaacgaaucacuauugaguaauguauuauccuuaggugcuuaucuguaaucuggaaccuuucuuggaguauagauaagucuugagacagcugucugcccagaucauugagcuaagcagguggcuccuggccaaggaagggauacugcagaaagaggcaaucugucucacuuucauaaccccuaaccucaccugcucacaugccacaucaccgcaagaucucaacacaccaauccuaucgcaucccuaguuaguuagauagauagcuccccaagacccagaacucuacaccaccaaaagcccuguuccccagaagaggucacuagcccgcuaaaucagugagugugacuggaaaguggcaggagguucaugagguuuccccauggugaacccaugggugacaacaggaccugccaccuccagauaguuucucugagggaagcaaauaaaguacaaugcuucugucccuggaggcaucaacugagaguuagccagugaaugcuaagggauggugggaaacuauaagcauugcucuugauacuaaacaauaagcaucuuucugugucucauugauaugcaugggauauuugccacaguaaaaguuuaggcuaggcuauguauacuuaggauuuggaagugaugauccagaccuacuuagaacuccacuggcugcuuuguuuuguagcccaaaauaacacaguuagugcaggaaauaaaguuaauugcacccugacugacagacucaaucaugugcaauuagaaggagacaaaaguugauagccuuggaguugcauaugaaugcuguuuuauuaaaaggggcucuuuauagucuaauaaauagcaucucacuacauaaaagacuugcugggaaacaacagaagcauauucagaguugaauaacacugacuuucuuguuauaguuucaugugguuccuguaguuuugaucuucagaaguauuucggagucccucagcuccuuugauauagacagaggcuucuaaguacucccuuagagacuccaauucccaugggcaaaagcugacaaacugggucuucauuaugcugcuguucuccguagcguccuauuuagagugccaacaggaggcuucacaauagcuucugaucaucucguagcucaggauggagagucucacucuuguaagacccugggaagcuuccaugauuugccucuuguguuuuacaggcuugaagacccuuccauguggugaugggaaaugaaacuuguucucccgacuuuuccaaguuuccacccucaucucaucucauccccugaaaccagucugccugucccaccaaugcaugccaccacuaggcuggacuccgccccauuucccuuguuguuguuguuguauauauguguguuuaaauaaaguaccaugcauucaaaaucau

SEQ ID NO: 2993 - RNA, 4014 nt, Mus musculus
guguacuccgacauguccuuuauuuagcaaucuucagugguuaaaaugaauauguaaguguaacggaagacagauggugccccugcccaccuaaaaaagacaacuuaaacucaacagaugaagcaugguaaaaucaaagggauugucuaaaucaguguucagaaaggcaucagaauuuuaugugcauuaauucuagauucucagaaggcaagugcuuaaacuggcugguacuaguucuaggucaaugccauaaauacagcagccauuagcuacuucaucaacccacauguacuucauggguuugaaagccacaccaggguaauggacaaguaugucuaaaagauccauuacaggaaggacuaugggguagagcuuuucuaagcauucugaaugcagguggaacugagaagaaauucaucugauuuuccuuuaugguaucacugaacuagccaccuacaaagcaacuaagagcaagcagaucagcuagaguggucccacuuccugacuuguaaaaucaguguacagagacuguccccuuucugcaucucacagguuuaccuucuccaucacuggguaucuuacuugagucuagccuuagaacacaggagguuccaucuguguaacacaggccuuagaugauguauuagguauagauacagaaauaacaacucuaaguuuggucaucaguagggacccuuuacuugggcucccagaaaagguugccugucaggaaauaagucaucauggcuucaccacuucuggguuacagaaucugaguuuauaaacuauaggacucacacaaccugcugcacuaacgaggccccuuugaauuuauauugaaagcccaauguuauaaaaucuuaagccaaaugucuauauauucaucucaacggcuuauuaugacuuuuuuuuucuaucauuuccagaauauaagaaaacaaguccagggcuuuauuuuuauuuuuuguuuuuuugagacaggguuucucuguguagcccaggcuguccuggaacucacucuauagaccaggcuggccuugaacucagaaauccaccugccucugccucccaagugcugggauuaaagguguaugccaacaccacccggcaauuccagggcuuuauuucuuuacacauuaguuaaaaugugcccuggaaaguuguuacaaaaacuugggacucaucaaguguuauuacaaagcuaucucugaaggaccuacaaaguaaaaagcuuaucagggcuggagaggacucaagagcacuggcuguucuuccagaggacucagccuggacugcgcccacugcagaucccgcuguaacaccagucccaaggaauccaacacccuggguuggccuucaaguguagugcacagauauacaugcagagaaaacacccauacauacaaaauagguccaaaacaacaaaaaaaaaauuccuacccaucagcccaaaacuccaaauuacagaaaacuuuccaaacuuguuuccagauuguccucaauuucuuguauaaaguaagauuugucacaaagugcugccucugaccugaggcccaguuaaucaucuucuacacgucugaagucacgaugaggucuuucuccagccuuuucacccccacaaagacaccacuaucacucauuucccugccauucucuauaaaauuuaggaccacucagcuaauacauaauuauucaccuuuauagaucucauucuggccaaagaacgaaggguaaagcguggcuguagucggaguugcccgagauaucaagguaagagcaccuaguaccuucacuagaccauggcuuuauaccagggaacauuuaaacaacuaaagauauguuaacugucauuaaacaaagcacaaucaaaggaucacgaucugugguuguuuuaauuaucuucuuucugcugauacaaacuauuuccuuuauuuccaucuuuccaucuaguaaguuagcaaagagugccauuccuaaucgaauuccaguuauguguguuucugaguggguauuuaaggacaauucugauuuacaacuuagucuuagaaaauagagaauuuaaaaggccuaacuugcuuguuucuaaaagcauuuuaauuugcagaucaacuauaaagaaguguuaaauacucuuuauuugauaucauacauaaaccacaguaaaugccuuucaauaguaaaaggcaacauccuugauguagggaauucuaauuaaaacugcacugucaagaauagacaguugccuccuggugguuagccaugaccugaaagaggccagugaacacaaacugaaacacauuugagucuucuuguuucugagacagugauagaauuuucccaguguuuaagcauauucauaugcccaguuauauaaaucuaaguauaaaaccauuuaguagguuugaggugacaugccccuauuuauggaaaguaaaacauugcuaauuaaguccaaucuuaucuugagaaagggagagccgugguagcauguauacaacuggaacuguugcuuuaauaaagaccguacccacuuuaugacaagucaguuuuacuuaaaucaggacuguccaacaaaaacauugcuagccauucaugaucugaauuuggugugugaauuaaauuaugguguacauuaaaagccaugagacauuuguuuuguaauaaauaaggcaguggaauuacucauuaguagccuuuuuaagauaagcuauuaggucugcccuuucucccuucuucuuaauuccagcgaagaucauuuuuguuccagggauguacuuuuugggauucuccaaauacuccaucaggguauccucuccccaggugaugccuaaacagaaagagaugcagagguuaaguguuuuacacaccugguaauucugcacugguuaacccaagcaaccugugcuguggcugacagcagcuccccccguuaccuuuguucuuguuggcaucuguguaagagaauccagcagccuggccugucuuccgcccgaacagaccguggagauuugguccagucuuaugcuugccucccuuuuccacaguguggcacugggcacacuucugaacaaaaaucuucuugccuuuuucaacaucacccauuuuuaauucuaaaagggaaaagauccaacaguaaaacguacuacggaucccaaugaccauucaaaccgcuauucuuauguccucuuaacaccaggcagggugcuaacucaguccacuugcaauauucuucaauagcaaauacaucaccuaggagacucuccuuuaaagcaagucugugcucaagacagguccaugccaagggaaauggaaacccacagcucaaaccccaguuuccgaagaaggcaaggucaaaaagucacaaauaugaaaccggacucauuaaagcaaaaccacuacaacucuuaacauuucagaaugcuaaacugcugucagugcugccgauuaaagucacuuccaaagauaagggaggcugggggugauccuaagugcuuccgccugcuccggucucauuaggagguuaagucucuucucucuugcuuuaguccggcacgggaaggcgagggaggacuggggaaggaaccgucucacucucacguugagaucccaggggugacuacgacuuuacaaacccacccucccagaugcuuaaucaggaaaagaacuggcccaguccugaaggaacagcagcuucugcucucagaaggggcggcgggcgaguuccuucuagaacuccgggccccgguccuacacccacgccgccuccagccgugccacaguucugcauggcuuuguagguuaggccugccccggccuccucgccccguucccgguccgcauccccgucgcgcgcucaccguuccgggcuggucaacaccacgaacguucggacucgaagacagacgucccgcgcucuagcccaaggacacgccggcccgcgccuauguaccggugucggugcaaccacacuuguuccgcccguccgcggcccgacgugcgguagcgccgucugcu

SEQ ID NO: 2994 - RNA, 4014 nt, Mus musculus
agcagacggcgcuaccgcacgucgggccgcggacgggcggaacaagugugguugcaccgacaccgguacauaggcgcgggccggcguguccuugggcuagagcgcgggacgucugucuucgaguccgaacguucgugguguugaccagcccggaacggugagcgcgcgacggggaugcggaccgggaacggggcgaggaggccggggcaggccuaaccuacaaagccaugcagaacuguggcacggcuggaggcggcguggguguaggaccggggcccggaguucuagaaggaacucgcccgccgccccuucugagagcagaagcugcuguuccuucaggacugggccaguucuuuuccugauuaagcaucugggaggguggguuuguaaagucguagucaccccugggaucucaacgugagagugagacgguuccuuccccaguccucccucgccuucccgugccggacuaaagcaagagagaagagacuuaaccuccuaaugagaccggagcaggcggaagcacuuaggaucacccccagccucccuuaucuuuggaagugacuuuaaucggcagcacugacagcaguuuagcauucugaaauguuaagaguuguagugguuuugcuuuaaugaguccgguuucauauuugugacuuuuugaccuugccuucuucggaaacugggguuugagcuguggguuuccauuucccuuggcauggaccugucuugagcacagacuugcuuuaaaggagagucuccuaggugauguauuugcuauugaagaauauugcaaguggacugaguuagcacccugccugguguuaagaggacauaagaauagcgguuugaauggucauugggauccguaguacguuuuacuguuggaucuuuucccuuuuagaauuaaaaaugggugauguugaaaaaggcaagaagauuuuuguucagaagugugcccagugccacacuguggaaaagggaggcaagcauaagacuggaccaaaucuccacggucuguucgggcggaagacaggccaggcugcuggauucucuuacacagaugccaacaagaacaaagguaacggggggagcugcugucagccacagcacagguugcuuggguuaaccagugcagaauuaccagguguguaaaacacuuaaccucugcaucucuuucuguuuaggcaucaccuggggagaggauacccugauggaguauuuggagaaucccaaaaaguacaucccuggaacaaaaaugaucuucgcuggaauuaagaagaagggagaaagggcagaccuaauagcuuaucuuaaaaaggcuacuaaugaguaauuccacugccuuauuuauuacaaaacaaaugucucauggcuuuuaauguacaccauaauuuaauucacacaccaaauucagaucaugaauggcuagcaauguuuuuguuggacaguccugauuuaaguaaaacugacuugucauaaaguggguacggucuuuauuaaagcaacaguuccaguuguauacaugcuaccacggcucucccuuucucaagauaagauuggacuuaauuagcaauguuuuacuuuccauaaauaggggcaugucaccucaaaccuacuaaaugguuuuauacuuagauuuauauaacugggcauaugaauaugcuuaaacacugggaaaauucuaucacugucucagaaacaagaagacucaaauguguuucaguuuguguucacuggccucuuucaggucauggcuaaccaccaggaggcaacugucuauucuugacagugcaguuuuaauuagaauucccuacaucaaggauguugccuuuuacuauugaaaggcauuuacugugguuuauguaugauaucaaauaaagaguauuuaacacuucuuuauaguugaucugcaaauuaaaaugcuuuuagaaacaagcaaguuaggccuuuuaaauucucuauuuucuaagacuaaguuguaaaucagaauuguccuuaaauacccacucagaaacacacauaacuggaauucgauuaggaauggcacucuuugcuaacuuacuagauggaaagauggaaauaaaggaaauaguuuguaucagcagaaagaagauaauuaaaacaaccacagaucgugauccuuugauugugcuuuguuuaaugacaguuaacauaucuuuaguuguuuaaauguucccugguauaaagccauggucuagugaagguacuaggugcucuuaccuugauaucucgggcaacuccgacuacagccacgcuuuacccuucguucuuuggccagaaugagaucuauaaaggugaauaauuauguauuagcugagugguccuaaauuuuauagagaauggcagggaaaugagugauaguggugucuuugugggggugaaaaggcuggagaaagaccucaucgugacuucagacguguagaagaugauuaacugggccucaggucagaggcagcacuuugugacaaaucuuacuuuauacaagaaauugaggacaaucuggaaacaaguuuggaaaguuuucuguaauuuggaguuuugggcugauggguaggaauuuuuuuuuuguuguuuuggaccuauuuuguauguauggguguuuucucugcauguauaucugugcacuacacuugaaggccaacccaggguguuggauuccuugggacugguguuacagcgggaucugcagugggcgcaguccaggcugaguccucuggaagaacagccagugcucuugaguccucuccagcccugauaagcuuuuuacuuuguagguccuucagagauagcuuuguaauaacacuugaugagucccaaguuuuuguaacaacuuuccagggcacauuuuaacuaauguguaaagaaauaaagcccuggaauugccgggugguguuggcauacaccuuuaaucccagcacuugggaggcagaggcagguggauuucugaguucaaggccagccuggucuauagagugaguuccaggacagccugggcuacacagagaaacccugucucaaaaaaacaaaaaauaaaaauaaagcccuggacuuguuuucuuauauucuggaaaugauagaaaaaaaaagucauaauaagccguugagaugaauauauagacauuuggcuuaagauuuuauaacauugggcuuucaauauaaauucaaaggggccucguuagugcagcagguugugugaguccuauaguuuauaaacucagauucuguaacccagaaguggugaagccaugaugacuuauuuccugacaggcaaccuuuucugggagcccaaguaaagggucccuacugaugaccaaacuuagaguuguuauuucuguaucuauaccuaauacaucaucuaaggccuguguuacacagauggaaccuccuguguucuaaggcuagacucaaguaagauacccagugauggagaagguaaaccugugagaugcagaaaggggacagucucuguacacugauuuuacaagucaggaagugggaccacucuagcugaucugcuugcucuuaguugcuuuguagguggcuaguucagugauaccauaaaggaaaaucagaugaauuucuucucaguuccaccugcauucagaaugcuuagaaaagcucuaccccauaguccuuccuguaauggaucuuuuagacauacuuguccauuacccugguguggcuuucaaacccaugaaguacauguggguugaugaaguagcuaauggcugcuguauuuauggcauugaccuagaacuaguaccagccaguuuaagcacuugccuucugagaaucuagaauuaaugcacauaaaauucugaugccuuucugaacacugauuuagacaaucccuuugauuuuaccaugcuucaucuguugaguuuaaguugucuuuuuuaggugggcaggggcaccaucugucuuccguuacacuuacauauucauuuuaaccacugaagauugcuaaauaaaggacaugucggaguacac

SEQ ID NO: 2995 - RNA, 10175 nt, Mus musculus
agacaccucagugaucccuccacccagaauuuccuuuuaaaguagcacauacaacaagcacaguaccauaucucccaugagucaucauuuucccuuuuaugggacugccuuaauuucacuguuuaaaaaacaauugugugagacuuuauuuugcuuugaaguccaaaaacaaacucuuaauggcgacggguauguguaugagacucacaugcagccuugucuggaacauagccuuuaacuucccaagugcugggacugagggcaugcacaacacuaccuaauggguuugcuagcuuuucuagccaaaagccaaguauuuagaaugacuguugauacacuuuacaagauguuaagagcucacauuuuuuagccauugacuuaccuguauauauugcuuuauuggcguaagcaaaugaaguuaacucugguuguuuuaaaucaauuucccauuacucuuaaaccacaguaccuuaaccacugcuacccauucacaauuggaauaaaaaucaguguuuugguguucugcaaaagugguaacucaaaacacuaucugguuaaaauccaugguuucaaaaugccaccauuaguguucagcaucaaguuguagcagugcacaauucauaguaagguauauuuuauuagacaguaaauaaugccuauuaaugcuuuuuucuccuauuaguauugaaugagaacuaaauguauaguucugugcaaaacuagucuagcauuuauagugucgaucuuguagacaacugauguugauagaacaagauucacacuuauguguaagcauuacaccaaguaauuuggauacaaaaguauuuauuuuauaaaacuuguauuuaaaauagagcucuuaucugucuacucacaaauccuaaaacaauacauuauccuuugcuaauuugauguuacccuuuacaaucagcauuuuuguaauuuuauuaagaaccuguacuaaaugaaguuuuaaaucagaaaacauucccuuuucuuaaaagugcuucuuaaaugaaggcaccaacaagaacuacuuucagaugguacagaauuucuuauuucuugaagacucugugguugaccacuucuucauuaguuaccugcagcaagacaccuuccugccaaaggaaaaaaaaaguaucugaagaaguuuaucauguuuguccacagaaccuaaguaacuucagugguggguuuaggauuaaagcagacucacugauguguauaauaagcgcucaauaucacauuucugaaaaggcaauaaagccuagaaaucaagagggcuguuucaggaaauuucaauagccaaccuacaacauuuuagggcaggacaaugggcaaaaaauuaccacauuuuaccccaacuauuuaguacaggguacauagaggguuuugcugcugcuguugcacagaaacuucuacuguaagaaaacacugucagacucaucccugauaagcauguauaguuguuaccacaauaaacacaaugccuuuaaaugccuaguugacucaaacugcuugaaccaggauaggugaaugaauacacaaggguggaaugauagguaaaucucauuuauugaacuugcagccuaacuuuuaccuaccauuuuacuaccaacaccacugaaggaagcaagaaaagcuuuauuaaugaucacuuggcuugccucagcuguugaaaugaagcacuuuacagucuuuguggcagcagaauauacuuguccaugguucauaucaaugcuaaaauuccagcagggaaaaaaaugauauguuaagcaccugaaucuucauggaaagggagggggugagaaagaaggaaaaaaagggaaaacaaccaaaauaauuuaaguaaaugacagauuggaaaacaggguuuauaaaauuaucuugaguuuauuguuaaacucaauuuauaagcuauguuaaacuacauaagaacuauacugaaaagaccauugaagaguuuauuaguuuaucuuuuaagggaggaaaauuaagaaagaaaaaguaaauaaguucuuaccuaaagaaguuuaacugaagcuuagaacuacuuugcucuacacccucagcuuucguuggcauccuuaucaacuacuguaguuaaagcuuuguagauacagcacaguuuuuuaagacuggcugcgauuagucgucaagaguucucuuguacuagaccugugucccugaagaguaccucgcugggguuauuuccuuuccuugcauugaagaagcagcaucuaaaagaucuaaaaagguguuucucuuugcagagauaucccuuaaguuaacuagguaauuuauuccugaugaauuucagacaacacacuuaaaucugaccagcauuuuuaucuuacacaaauacaacaacagcuuugcaauggaccuuaauuauacuacccacuccuuaacuuauuuaaaauaaaaagucuauaauuacacaauuuccuuuagaauuauuuuauuaaaucauaaauguacaacagcuucuuaacucuacacacgcacuuaaaauuuuuaaaggaaaaacguuaugucuuauuacaccaugauccuggcuaauagcuuuucaaaacuuuugagaaaaaucuuaaaaaagguuucacaugucaccugaaacuuacaaauuuaacauuaucaaagaaggaaugcuucuacacucuuacaaagaccacuagaaagaaacaacaauuaaaaagcuaagaaacugucucaaaggcauuuuuuuuuacaauccuuccuccacaguaagguaauguuauuaaauaauccaauccauucacaaaauggcugucugcaucugcucuggugucuucugccauaccacugcauauuuaugcaugacugagauaagaguuuccuuaacauuguuauuuccauaaccugaagcuguucuguuaccucugggcucucauccucuccuauuuauacagugaagccuguuucaacagaaguaaagaguaaaaaaaaauagguuaugaaauuauccaucuaaccagauuuuaaggaaagauaacaugauccuaaaaugcuuuuaacuccugcagcuaguucucccaagauaauaauaauuguaaaacuuaaaaacuacuuacccaugguaaguaggaagaagcuuaauaucugcuccuuccaccauagccaccacuuccuccacuuccuccaggaccauaguucccugcaaugauugaaacaagaaagcacacuuagaacauauauaaaucugaagguuuaugucuguauuguggaaauuaaguucucuuucagccuugugauagucuguacacagaccuggcugcccuacaauguaaauaaagugauuuuacuccuuuugaguacuaaugauuaaaagcacgugaaaagugugacacaccuuucuaagucuacuacuuucaaacacaagcaagcuuaaaauagguuggaccuuaugaagcuaaauggcagagcauauuugagacaugauuucauaugaaggacaaggaagacugaaaaacaugaucuccaucuccccauugccaggauuacugggaguaaaaugauugcuaaauucaagagcuaaucacuaaauugggugugguagaaauccuagaauaagagacccuaucuaaaaacaaugccccuccaacccauacuaccaacaaaaaucauuuaacaguuacacgaggacacucuccuuagcuagcaucuauuagauuccucgcuuucugagaugcagaacuguauggacuuccaugacuucccaaucacccagaagaacuguguuuaauaauuaccuccaccauaugguccucccauguuccugcuacccccaaaguuuccacucuucauuggaccauaguuagaaggcugcugguuauaauuuccaaaaucauuguaacuuccacuuccauaauuuccuguaaaagaauuggaauaccagcuaaaccucugaaaaauacaagcaucgaagccaaacuaauguuuaauuuuuaagacaaauauuuuccaaaacaaaaguacacaauaccuaucuauaauccuacaauuuaagaaaucuaucuaaucgacaguaaaauaaaugucauuaauucuaauccaaauuccaacauaaagguuguagaugaauuuauuaccuccuccauaguugucauaaccaccuccguagcccccacccugguugccauauccagguccuccaccaccauauccuccucuuccuccuccauaaccagggcuaccuccaaaauugccaccuauuauaaaauaagccuuuaaguaauugcuuaaauuuuucaauuccauuugaauugucucuauuacacucauuucugguuuuucaaaacacauaagauauuuguuauauaaagucuauucuagaauagacuccaaggcaaaguaaauaccuauccuuggguaaacacauaaagcaacuuaagaucccagaacucuccuuugaauugcuaaguauuucaaauucauaugcuuuguaguuuugaggaagaaacucuggcaggcagaccugcauuuaaagccaauauggacuacaugaaacccaggacuaucuaagagagagcuccuaauauugguaacuuguauuaucccauaucacaccauauuccaauuccaauauucuagcuuuuuuuucuacaaugcacaggaacuccucaccuaaauaauuuuaaguuuuaugagaugaaacucacaauuuuacacugguacaguaguuaggcaaauuuguuaauaacucaaaaaaaacaaucaccuuccaaagccaaauaaccacuuuguuaggcaaaacaagugauauacaaauuuaaccaagcaccaaaugcaauguuauuaaauauaucaagauacauaaaucaaaauuuaauuaaaacuaaccuccagguccuccuccauacccauuauagccauccccaaauccacguccacuuccguauccaucuguuuauaaaaaguaguaaaauuaaacuuaauuuucuccacauuaguaucuaucccggaaugaugaugacugggaucucacuaguugauuuguuggggacauugagggaaggaggguguaauauuaauucaacucuacuaccaaggcaacacauuuuuauuaauacuaaguuuagaccuaucagaaagccuuacuucaaacucaacuuucuuaaaacgaagaaaguauacaaaguuuuaucauaccacaccacauucauuuauauaaacugaaccuaaaaacacuucugacagcauuuuuagacagggacuuauagccuuagcuugccuuaaauucaauguacaucuaugugugugaccuuuuucuuuaaucauccugcagcuuguuaccaauuacuacuaaaguugcagguuaucuugucugguuuucggauucauccuugggcuaagugcaugcuaagcacuauauaugcucaucauguguaaccuauauucaggucauaauuuccucauaauuuccaauguguguacacguagcugauuccugugagccuuuaggacccugcuauuucuuuuggcucuuuuugaaagugucuuacuuauauauaucccauacucucuguccauuuccagaaugcugagagcucaggccuaugcuaacaacauccagcaguuuagaacugcuuuaaaaaauuuuaaccuuauugguguguugacaaagcaugaguacacuacaugaaucaguuuacaugaugguggucagagggcaacaucuuaaccuugucugagcacagggucuccuuucuuucucgcacuacacacuacaggcuaacugcaaaauuuaucucacugaagacauucuauucaaaaugcaaucacacccuuaagaaacaaacuuaccagaucccccccuaaaguugcuuccugguccugguccaaaauugccaccgccaccacgagaauccccaaaaccaaaguuuccuagaacauaguaaucuaauuagcagcaagaacaagacaaucacauauacauacauacacacauaaauaaauaacauuaccuccucuuccacuccuagaacuuuggacuuccugcauuucuugucuagacaaugccuuucuaacuucugcauugugaccauuuauggugugauauuuuugcacuggaauaaaaacaauaccaacaguaagcaauuccuauaauguaagcaacauuuuuuuauacaaagcacaccucaugaacagacacuuacagacaauuuuauccacaggaucauggucaucaaaaguaacaaagccaaagccucuuuucuuuccagacugccuaucgguaauuauuucaauaguaucaauuuuuccauacucuucaaaguaaucucuaaggugguguuccucaguaucuuccuuaauuccaccaacaaacagcuucuucacagucacaugggcuccugguuuuccagacuccugcaauaauuacaaaguuauccugacagaaaaaaaccuugauuacaucuaacuuguauuuguacaucuuaggacgaauuccuccagauaauagguuuuaagagguuggucuuggaauaacauguacccaaaaaaaaacaaaacaaaaaaaaaaaaaaacaguacaagaaaggagaucaauguguuuggguuuuccuuaccucucuugcuacagcacguuuuggcucaacuacccugccaucaauggaauggggccuugcagccauggcagcgucaaccucggccauggaugagaaaguuacaaagccaaauccucuugaucuuuugcuugcaggaucccgcauaaccuuuaaauccaaaagauaagcauuuaauuucccggcauuagguagcaauauaaauuagaauguauugauacugguauucccuaguauucacacccaaacauacagccagacuuucagaguuaacguacguaccacacagucugugagcuuuccccauugcucauaguaguuucucaaacuuucuucugugguuucaaagcuuaagccaccaauaaagagcuuucggaacuguuccuuuucucucugcaaagggaaauaccauuucaauuuuuauuuacacuuucuuuguaugcaggaaauuaaauucuuaaauaugaggugaccugcugguagaguaccuuuuuccucuccaaaggaacaguuucuaaaguuuucugggggggagaaaaaaaacuuacaucaaauuuaaaccauauguuaaacugcauauuaguuguguuacaccaaaaauugccugagcuauacaaguuucaaagucacuaauauucgaucuaacuucuaauucacguaaacuuucuuagauuuucuucaaaaaaauucagaaaaaccauacccagcucuuaggucauuuaaaggguauuaaagaauucuuuuguaauucauuaaauucuacaacccaaguccaaaauuuacuacuuuuuagauuuaaaaaaaauuuaaaaaaccuguuuccaaauucaccacuuccaagauucaguuucugaaaaguggcauauuugcuuuucccugagcugcccccucugguguuaauuguaaguaucucaagaugaaaaaaaaaaauccugcaacucugaaacaagcuccaugaagaaugcugaaacuccagauaucaccuuaaaucugguuuugucaggcacuuaauacuggcuuuccaauagcuaaguacaaaaacuuaucaagauguucauaaauuaggucauacuauccaggaccuaugacugcacaacgaaaugaaaaagcaaaauuauaaaacaaauccguuauuuuacuguauagccuaaauuuguaaguuucuccaaaaugugcucaaaaagccaauguuuacaauuuuuagguuuugaaauguuuaauaaaaacgaccaaaauuguuuuaaauagucaaaauaguuacaaaagccuuaaucaggacuccaaauaguguuucugguagcucuacuaaaaugucaguaaauuggcuuuccuuaaacuaaguugcaaguauuaaauacaccuuguuuuuucauaucacuaacgaaagcaaaagcucuuuacuuaccucggguuuuuuccaaacuuaccagacguccacuaucgauuauaaacaagguuauuuuauuuauaagugugcuuagagucaaagaaaauaaccaaggagaccccuuucaauucgaaagcuaaugcuuaucaguguaaugaugcaucauaauuucaaacaaauaaaaaauaaaaaaaccgaaugaccacgcucaaacacugugaccccaaacuaaguuuuuauauagccaggacguggauuuucguccacugaaccaggcuuuaagcgaaggcuaacuaugaaaagucagcuauuucacuuccuuaaagugaacaccacgugcuaaggauccguugacuuuaccaacaaauucgaagauucccuuaaaaaugcuuauaauuugaauuauuucgauccgaggauccuuuaagcagauaaaaguucugcaauaaaaggaaaguaacccugcacucaacauagccucccuagcuuccugaugagcgcucccauuuuuuccacuuugacuuccuccuacuauacuaaugcucaagugcuuuacuacagcacccguaaucuuacguauuaugaaaaauaaaacggucucuuugcagcgacgcugccuucagccacccgcccaggccucgguuguacuacguucucucugccuguuccaguaaagcucguggagcgccgccaccccgcccccaccccgcgccucgguggcuucagaaagcaauggcgccauuucgucgaggggaaggcagagagccuuuagcgaggugcgcaggacgcugaagacccaagcucaaaacgcuaaauccaccucgaaacgguaugaagacuuccaaaagaaaggaaaaucgcuaaacacgucuacgcaguggugaaaaaagaaaaccaaacuaguaaaccuaaagcguugaaagcaaaaucguggcgaggaaggagacgggaaaauggcggccgccaaauccgguucccgggagaggggggaggggaagcuucgcagacucgcuccgggaagccgggggggccccagaaacguuccgccgcgaacacaaccgagccccuaggcccgcgcacaucgaaaggccagcgauggcccgcucacgcgcuacuuuagcgguccagcccggucgcggcgggcacuucccaucccccaccccaacugagggaaauggcgccgggcggcugagggcggggaaggcggucggacaaucagaggccuccuccaacgaccccucagaaacucgccaaggccaaccgccacucgaguggccgcauccccuccgccggaccacggaggcggguggccgguuuccauugcggugccuacggccucgccaugccauuuuuaauaacucauugauuucaaacccguuaccuccaucgcggacucagucgcuucagcccgauuucccgcagccgagcgagaugagaaagaccuccgcggacggacgcgcacgggacucguccuggcgcuguggggagagcaggcgauggccaagaaacugggccgcaaaggagcuccugcacacgggaccggcgccgcugcuacugccgcuggagccgagaccgccgcuuuucuagaaccuuccccccacuaacgcgucuccgcuuacgucacgccguuacguaaacgcccuaaccgccgccaauggcgggaagggccuacacucuccuuacgccaaguacgugacacucccccuuuagguacagcgggacugcuuuacaucacuugcgcaacuguguuccgugaauugcggaaggcucgcgcucggcguguuacuacguccggaacuagguccggcccccaccuccgcguagggagcggagaaacggucgcgcaguuugaaauaacgccgucgggaggggcuuaggccggcgcuggggcgugcggcccucuccacccaagcgugcucucugcagcuacgccuuugccaagcccguccgcacaaauauucucgaaccacacaaauauuucuacacgucccaaagggguucucacucggucccucccagaaggacuuuuaguccaaguaccaccccggaugccacaagccuugggaucccgcgccuagugagagguggugcuuaaagaaccccgcuguuuaucuccccggccuucaagauccgggcaaggagguggguggagccccgcuuuggcgcgcuccgagacgcagagaggccuccgcgguccu

SEQ ID NO: 2996 - RNA, 2323 nt, Mus musculus
ugcagaagccagcaggcucugagugucauagcgcguggauuucgacucuuaccuggaccuucuuuauagcucagucccccacccccgugggccucggcucagcagcccucaagcuccugccaucccacgcaugcucccgcuuccucgguuggguaacccauggcaaccgcccugguaacccauagcaacugcucugcggaacugagugggggaugggaggaagccauuuggagugggcggguggagagcgauuuaccauggcccaccugccuccggcaccgccagcgucccgcacccagacagugaggaccaaacaaagccaccgcacacgugccgggcgugggugggggaggcacgugggccuuuguucuucagaccgccgcccuccgagagagugcacauggcuccaucagcuccagccuuagcugaccccacgcugcgcugugcgcuuauucccaggagccuggaaccuuccagaccggagcccaauacgcuaaccuuccucucuugccugacccgguugggcccaggagcggaacuuucgucccugggaaagaaucgcgugcguccagguucugggucgcgcguggggagauguagguccccaagcugcugagccaggucacuugaagcugaccugcggugcgaggccacggguggacggacggggucgcugucgggcagcguggcgcguugauacccugcagucuaugcccagagcaucaucugcuggcuugugcucuccagacucuaagccuguggugagaugguucaggcuaaaucugcaucgggccagaaagcaagacagagggggugaagggggagauggcacuagguguugagagucaugucacggcagaucacagucuaccuagcugugacucuaagcucauuuggacaaaagaaaaaagaaaagaaaagaaaagaaaacauuugaccuggauaauuuugugguccucugaguccucaauucuauuuucuguagguacauaucaguuauaaaucuaaauagcaaagccaucaggagcauccuuuugggugaugcuaaaacuacacauguaccauauacucuuguauaaugugccucucuuuucaaguuaacuagguccaauauggguuacacacuuaauaguacucuuaacaccugacgagaagcuggacucagauuuuaauccucucauuuuaaaaaaaggcauauucaaaggucuauauuugcuaguauugaucuuggggaacuggguuuauuuucacaaacacaaccuucuggcuucuuccugcagagcaugggugccaaagagucuguauguccugcuagaggcagagcagaggcgucucaccguccaagcgggugcucaguacaguuccagcccucagcacgguacuguguuaggagcccuguacuuuaaucuuuuuuuuuucuuuuuuuaacaaaagcaauuacagaaaagugcacauuuaacgugugacauuuaacauuuuugccguggcaggcagccuccacuuaaauggggccuuucuuuggaacaacaggagccaaaaggccuugugucacggaguaauguaagacacaaucagggcugcaaacgcacaaugaaucgggaaggauuuauguaauuaauugaccagucuuaaccuguuaucgugauguaaggaauuuggaacucauuaauuugggcucugacagauuucauauuagaacuggcaaauauggauugagccucuuauucuuguagcagcuggaauuuccaugacagugaggauuacugaagaagaccuauugcuagaggcaaacugcuuuuuuguaaucaguggcccugcucugcauuaaagggauaaugaaaaauaaaauuaccuggcaugggaaguggaagggggcgaggucaccccaccgcugugugugacgagggcaagcauuugcagccgaaaaaaauauacuaauuucaaucuuaaaguuaguugguuucucaaguauccugagauagaggagucuugggggucaagguucuuuuguugucaaaguuaaaaaggaauuaaaagagggagacuuggaaccuccuccauguggacagagacuguauaaaaaaggagucucuggggcuggagagauggcucagcaguuaagagcacugguugcucuuccagagguccugaguucaauacccagcaaccacaugguggcucacaaccaucuguaaugggaugcacgaagacagaguacuccuauacauaaaauaaauaagcaaaucuuuaaaaagagagagaacagaagaaaaagaaagcuuuccagggacaggguucugccgauccacccaugagcaguuca

SEQ ID NO: 2997 - RNA, 10738 nt, Mus musculus
ugcuuaugggcauuugaacugaggaggcuuuuuacaguuuucaaugcuuuaguaaaggacuaggagcuggcaaagguuaaaguaggaucaagagcaaaaccgagacgcucuucaguuguaaagugugugaucugggaagcaagaauuagaaccuuccuggcccugccuugugacggaguacagcuggagugccaggggcugcguuuuggcuucagcuguucaccgagggaaagaaggcaaauaaucuuuuucugguggagccguaacacaccugagcuuggcuugccgucucggggugaggacagauugucagcugguguaugagcugcccgaagguaaacuccuguaauaaagaaaccgauagcaugauagauagcggugagauaagggcuauuauccacagguaaaauucuuucaacaagcgcuaccgagucucucauguaacccucaguggaagaaaaacagcucgacggccccuucuuaaccucuaagcgagcucugacaccuuaucaagcagacagggauuugucuuuguaccauggacacaugucaaauaaaauaccccaggaaagggcaaagcauuuaaagcagaagugauggaucuuaguuguguaauauuugguaauauaguaaguguuuauuuugaugauaggaucaggggaaguuucaucuuaggcuuuuuaagcuuagaagccacacgugugggacuuuaugcugucauuuuggugugaaaccuugguuuucccacugaagauagaucggaauaacuugucagcccacaccacagaucaccucuguacuuagaaauggauacgccugagaaauucaaauguaaaauuaucaguguucagccaaggcucuuuuguggacugaaugaaaugucaacuauuuugaauuuauguuauuuaugcugcaaggcuuuacccgaucccugacuuuuaugguuaaugaagaucucauauucucaaucucucucucucuccuuuccuuuuuucuucuuucuuucuuucuuucuuucuuucuuucuucuuucuuucuuucuuucuucuuucuucuuucuuucuuucuucuuucuuucuuucuuucuucuuucuuucuuucuuucuuucuucuuucuuucuuuucuucuuucuuucuuucuuucuuucuuucuuucuuucuuucuuucuuuccuucuuucuuucuucccucuuuuguuucaaagacccaggugagaggcagguauagccacccaaccguaacccagcacucagaugaugggggcagaaggaucuggaauucaaggucauuccuggaaccugguaaacucggguuggcuugggcagcaucugaaucugucucaaaaaugaauaaaagcaaaggaacaaagaaucaaaugacagaaaaaugucaugaaauuauuggcugcacuuuguuaacgcuggugccgaguggaggacagggcagacguaggaacgugaugugguaggauugacacuuggcaacuucucuggccucagcucucuuccgggaaaacagcauuuuauggaggugcuuacuaaacauagcaaggcucuuggcauuuggggugagcuagggcauauuuugauucuuuuguuaccuuaggaaccuuuucugagguucacugagaaacuuuuugcuuuuuguuucuguuuuggggcagugugucacuguguagccaagguuaguguagaauucaccaccaccugccuguguggugaggcuacaggcaugugccuccaugucuguaaaaaaaaaaaaaaaagaaagaaaaacauuuuucaauucauugaacuccaagugacucuggaggagacaaauuagaacguuuuccucuaugaagauggcgaaguauaaaaacauuaaauggaagacacuuugucuuugucccauggacacgugucagaugaaaacccaagaaaacagcuucucuucuuuuccucucucucucaaauucuuagaccagaggacaaauuucaggagcuguuucucuuguuacgccauaugaaacccagggauugaacucaggucuuuaggcuuggggggcggcggggguggggggaggcgagcaaaagccuuuacuugcugagccaccucagcuacccacugcgccaccuugccugucccaauuucaagcuuuugaaaguaauuuuuuuuucaggguucaaaaggugguaauuucagaaauguggauuaaaagcuuacuuaugcaugagccugaggagccugggaaucaugaugaacagauuauauuuucccaagcaguccacuuagacgcugauuuaacagcacacuucucugugcaccaguggagcacuguugcucuuuuucucuuuuucuaagacuuuauuuuuaaguguguguguguguguguguguguguguguguguguguguguguaggugugugugugguuccugaggagcccagaggaugguguuggaucccuugcagaugaagugacaggcaggugugagccaccugacaugaugcuggagcccccucagcaacaugcuaagcacaggcucggcagcugagcugcauguuggccccgccuggcucacaucuauaaccuggucucacuugucacagucuuacucaagaacccauuuuucuguuugugaggcuggguuugaccaauucccugaggcuccggugauguggaguggcaugaauugaacacauucuagcauguuacacuuugugccagggcucucuuuacuggcccacgucucuuuucccagcuagcaugcacuucugguaccaacugacuaugccuuguuuacaaccaagucugccacugagcagugucaggaugugggaaacacagaauaaaagaugcacagcugaggaagcucacuaaauaccauggcguugguuucaaacaaugugguuuuggauauaagccucucuuuggucauaaauacuguugguauucugucuggacccccacaguuaccuggcaacagccagguaggccugacccacuauaaaaggggcugcuugcccccuccucccucucuuacuccugccucucuccucuggcuuucuugcccucuugauccccaucucuccucauucccuagcugcgccccacccccacguguucauggccggccucuacuucucuacucuccacuucucucugccuuucucugccuguacuacccucuuaacuccccuccccaugcccuaaauaaacacuauucgaugcuauaccugucauguggcuggucccucaggaggaagggaugggaccuuggcaugggcccacugagacauccucuuccccuguaccucaccacauccccauagaacauacucuuauauuucuuuaucuuuuuauaauuguaacaaauacaaaucuuggaaauauuucagaagggagaggagacagaugaugcaucacaguccucugcugaggggcuggggauaaggcucaguggcuaagaggguggacugcuuuuuuaaagaaucaugacuugguucccagcacuugauucagguagcucacgauugccuuaaacuccggcuccaagaaauccacaggcaguugugcucaccugcacacaccccacaaagacaccauguaugcacaucauuaaaaauaaaucccagggcuggagagauggcucagagguuaaaagcacugacugcuuuuccaaagguccugaguucaauucccaacaaucacaugguggcucacaaccaucuguaaugggaucuuuuuuuuuuuuuuuucugauuuuuuuuauuacauauuuuccucaauuacauuuccaaugcaaucacaaaagucccccacacccccccccaacuccccuacccacccauucccauuuuuuggcccuggcguuccccuguacuggggcauauaaaguuugccuguccaaugggccucucuuugcagugauggccgacuaggccaucuuacacccucuucuggagugccugaagacagcuacagcauccuuauguauauuaaauaaauaaaaucacuagagagaauccaugugaguaaaauaaucuucaucaucauuuuguuucuacccuuaacuucuaagauaugucuuuauuaauccccauaauuaaauuacaucauuugaccccaaauuucccagcauuuuauugugaaaaucuucaauuguccaugaauaggauagcgcugugugcaucauaguauaggucuaucacauggacuuuacgugucaggcaagguguccuaucaugcuggcuuagacauaaaauuauuauuauuauuauuauuauuauuauuauuauuauuuugguauucuugagauagagucuuacuauauagcucugacuguuuuggaacuauagagguuagccuccaacucacagauauccuccugccucugccucccuaguacugggauuaaagucaugcacuaccaugcccagcugacauaaguuuuaaguuuguauuuuuaccauaauuaaagagaaaaguguauuaugguaguuuaccccuuuaauuuaagcacccaggaggcaaagacaggaaaucucugugaguuccaggucagcuugauuggucuauauaaagaguuccagaccaagucaggguacauagcaagauucucaaauccaaaaaaaaaaaaaaaaaaaaaaaaaaaagacagauuuuuaggauguugaccauauagucagaauugaguaaaaaaaaaaaaaaaacuuuuaaaauguuaaccacaagagauggagaaaagccccauuuuaaaucaaaauggaaaauuuauuguuuccuguaguguuuccuaagugaaagugccaggguggagccaggugagagucugguugugucuggcccuucccugugguggcggauacagagagugauagcggaccaaguccuccuguauauucucguuaauuuagccuucucucuuuuugcuacuaaacaguaccagugucuucacuguaaauagcuuauucuuggauugcaaguaacagggaacuuccuccagaggcagaguuuguacauauggcaauuuagaaaagagacaauuuagcugcagagugcaaauugccauggcuacccuggucauguuuccuggacugggcaggugggguggaaguucuuaugaaaucaccguugggcuuuauugaauuagccuuuuauuuuuuuuucugaaagaaccccaaauugaguuuaucacuuagccuaauuggagauaguuaacaagaucccacccaaacucacagaugucuuuguguaagaauggcugccaugcugcugagcuggacggagaacaggccuggcauuauagacagacggacagugagcuuccucaaaauuaaaggugcagaagaccagcuugccaggguugugcacagacgccaccacgcugacucugacacugaggaagcacugccuucgacaucaccaucauguggccugcagugccccagagaacugguaaugguuguuacauugucuuccugccacaggcuacagagaaauacagauacuucauauaugugagccucugaggagcaaggaacaacuguccugucuuaagauuugaauguuauccuccauuuacaaaacuuuucaaaaagauuuauuuauuuuaugcauaugaguacacugucacugucuucagacacaccagaagagggcaucggaucucauuacagaugguugugagccacugugugguugcuaggaguugaacucaggaccucuagaagagcagucagugcucuccagccccaaaacuuuuauuuuacauauauauguauauggaggcuaaaggggaacuuguggacaacagcucuccccucuaccauguaggucccagggauugaaucggguccucaagauuggcaccuuuaucuacugaguuaucucacuaggccacacccuuugcuuuuaagacuaaaaccucaaccauccauucaaagcagucaacuuugaaaagaagugaaggaaggcaaaugaagagaauugaguaagacuuuuaaaaaggauuuacuuuauuuauguuauguguauggaugcuuuugcuugccuguaugucugugugcuauguguaugcacugcucaagcaggccagaagagggcgauggguccccuagaacuggaguuacgggcaucugugagcugccaccaggaugcugugaaccccugcaaguacagcaacuguugagccauuucucuagcccacacgagaauuuuauuuauuuauuuauuuauuuauuuauuuauuuauuuauuuauuuauacagggucucuacauagcccuggcuaucugggaacucacuauguagacaaggcuagccuugaacccacaaaaauuugcuuaacucugucuucugaguacuggguuuucaagcuuguaccaguaugcccaguucaagaacggguuuuuaaaaggagguuagaaaacauacuuuccugcuuugcaaaaauccauggauaaauuaauauuguugcaaaguauuuuuugauuuuaagaaaugucuugaaauugaauuaaaauguuuacaaaugcuuugaaauuagcucuuaauauguuucuguaaacucagaugcauucucuuuggucuuaugugaaguuuuuguuguugucuuuaaagauuguuuuuauuaauguguaaaugugugcauuuguacacuacuugugucuaaaagucuugugaccuugucaggcagaagagggugugggucuccuggaauuaauuacagucacuuguucgaugagucaccaggcuggggacugaacucaggcacucagcuucucuggaagagcaggcaacucuuaccucggagucaccuuuucacaaggcuugaugugucguugaacuaggcugcccaucuugaauauucaaguuauuuuucuguucuuccuuuccuuggugacauuugugacuucacucauauuuucuugccuguggaucaaaccaaaaacuugaacucuaaguucauuuagauaugaauaguuuguccauagguuggcuauuuaaaaagucugugguaaagcucuuuaaaauaguaaguauggcuauuguaauauaacacacacacacacacacacacacacacacacacacacacggagagagagaguuuaaaacucccacuuuuuaaaaacaaggucugaagaaaugugucucucuagagucugucuggaaugacuaaccauagauuucuuucagucggcgcuucagucucugaauguuuggaaccuuucuuggugagcgugguggaaauguucuccaaguguugucacagauccuguuauugauguuaguggcagagccuucuaacucuaaccccugcugagccuuuagaaaccugguagauuguuaacaagguuagcaggaggucaugaacucugcucuguagacaugcaaagucucagagcuuugauauggaauuggcagggaaagcauucucauauuuuagaaacuaaaauuguuuaugaaggacaaacuuauaaaagccuguuaggucuuaauacaguuucugcuguauacacauugcauuuucaaacauaacgugcuuagagaauuguuaggaaaagcucaauucugacaguauguauagcaucccccaccagccauuuaaaagaauuaacauuuuuuucuauauguuaauggaagccauuuagaaauacuuaguuauuuccauaaagaaggugugugguagccaugcugugaaacucagucauuugacgaugaucaaaaccugcagucauuaaaaaguauauuuguuacuuauauacacuuaagaaaauauuuagaggaacaauugcugcauuggagucgcaguuaugacgcccaguuggauacacugugacuacaguggugugguauuuuuuccagcagguauuuggguauggaagaauuuucuagugaccacuugaacaucccuacacuuagugcaagugaugucuacuaaaucaggaaaaagacaggaggaggcagagguaggggugggaaguucacugaaguuuaaccucuucaagugcucccuaagaauacaguucugaagaaaguuguauguacugucagaauuuagccacggggaggaaaagcucagagaauccccaagcaugcgcauuugauccacucuugacucuugguccuacacucucucgaucgaucguucuuuuaagcuaaaggaacgcguuuugaccucauuccagcuccuggcugauuucuagggucagacuccaccagccugaauagcucucuccaggaaagggaggcacuuccuggugggugcagggcuucuuugugugcaaagcugauugucuucccacccauuagcauuuauugaguauuuggugaacagcugggcacaccagaagcggggagagcugaugcuagcaagucuuucaggagucuucccccauuuguccaggaagacaacuguacaagucgguucuugaaguacgucuucuaaugcgcccuaguagaucuauggagaugaucccacccuuuagaaaugaauccgaucgguuggugaaggaggagcccaccuggcaggagacagcauuuccuacagagggcacggaacaaaagcaucacgcuguguuuuugaaggcaagcaaggagccuggugugacuuagagguugaagcaagguuuuggggaugucacaaucacaguuauaaaagcuuugucacuggacauuaaaaauuuuuuuuuuaauuuuuuuagcaaagggcucuaucagauguucuaaaaaguuguuaaaagaagagcagaagagaucacuuugauucaaggacugaucagaaaauaggugagaaacagagaaauuaggaauccaggugaaagccccuuagugguggcgcaugccuuuaaucccaggauuuggaaggcagaggcaggugaauuucucaguucgaggccagccuggucuacagagugcguuccaggacagccaggguuacacagagaaacccugucuccaaaaacaaaaacaaaacaaaaacaaacaaacaaacaaacucagagaaauccaggugagaagugauucaagccucauagaaaaccuuccccacgggacuagaagcgcacaacuggagagagaaucagaagacgaagucaacaggaucuggcgauggguuggaucugggagaagaagaagcaauggauggcuuuagaguugcugugggugcauacaguguggauggugcgaagacagagucaccagccuaaaggcgauagccaagauggcuuguggguuuuagaagaccggauggguuaacggugugcgcuugcguguaaucauuacucaagggguagggcaagacccugaagagaguaaagauagcggcaaggaggaaccccggggaaggacagacagacagggguuauguccggagagccaagaccuaggaauccccaggaaggagcagucaguaauacugcuuccgguaggcaaacucuccuccuaccuuuucaucaaaccgccucugggaagggacugggugaucuccugagggcagguuaaggagaacaacagcagccugaggagagguuuccuucuuuuucuccuucugccuuaaugcccccacuuuaaauaacagcuccuuucugcagugaaguuggguccccugaaaaccacuuggcagugguucgcggugaaccgugaaugcugaacugagccgugauugauuucacuuagaaccacacagaacugacucuucucuauguacagugcagcucaccugacaucucugcucccaaaaccugcuuacuaacuuaauaagccaguccuccuccccgccccaucccccagcucucaagcccgggcgucauuggcugaggcuuggguucaggcugcccugaagucuguacugaaccuugaagccucugacuagcuuggggucacauuacuugaggcuauccaaguagaaccaacucuaauaaggagaaaccagauauuccucucuucuaguucccagauuccuagaaauuucuuguaaaaacaguuccuugcaucuggagagacgguccagaguuaaaagcacgugugcucuuguacaggacauuaguuugauuccuagcgcccacauggugggucauaacauccauaacuccaguuccagggaauuggaaggccucgucugacuuccuuggguguggggccauauaugaugcacauauaucaugaugcaggcaaaacaucgcuacacauaagacaaaauaaauaaaaccaaaacaagacaguucuuuaugagagcaacagcaaacucauucuuugaacucagguagcuguggaguccaucggcccuuguaccuggacaucuaccuacuucagguguuuugaaauuuccuuucuccgaaucugugaccaacaugaguaagaagggcauuggcgcaaacuuacaucagcugugaagggaagaacugggaaaaacaagacgcggaaagauaaaaggaaagaaaagaugucgauguauucuuacgcugguacccagagacacucgcaccugccuauaauccaaucccaucacuggggaggacgaggcaggaggauggggaguucaaggccacccucaaucacaugagcgucuaucucagaaccccaacaaaccaacagauaacaaugagagagagagagagagagagagagagagagagagagagagagaacacaauauugcuuacuuucuucagcugcugguucucagcuacuuucuucuucuuuugucagccaucaucagucagguuguaucaccuccgcccacggucuccca

SEQ ID NO: 2998 - RNA, 1181 nt, Mus musculus
uagcagcacgacguggccccgggcgcagggagccgcacuauaaaaagcugcuggaauuuacuggcagcuacaaauauuugcuuaacuugcgucuggaguugggggauuuuccgcggagcagcagaaccaguaagggcuggaagcugggucucuggagccaagguccaaaaugagacagggucuggaggcuagguuggggucuuucuuuuccagaagaagcuguggcgucccuuuguagaggcugaggcuuucugagaucuugggggaacucucaaaagggcaaagggucgucauuuuuucuccaauccucccauaaggauucauauuugccucaaagaucuaugauggucagacuuccuuccuagccagccuuugccuggaacucucaaaggagguuugcacacacacacacacacacacacacacacacacacacacacacacacacacaggcaacuacccuaucggaucaugauggaguuuggaagcugaguuuguuagacaguuagccuguucuaguucagggaagaggaccaaccgccuccaaaugaacccuauaaggucaagaagaguguggaagagaaaacuuuugaagaaguuucucucucucucucucucucucucucucucucucucucucucucucucucucacugugugugugugugggggggggggggucuucccaacuccacccucaagucacaacucaaaucuuguaacuuucuauacauuuucucccauccuguuuuucaggcaauuugaaacaagccacuccaaccucuuuuucaaaguuauaggagguucccugucuugaagucuccugccuuggauuuucugaggugcugcuauucugggcaacuaucaaaauccuaccuguuaaaacaugauggauuagagaaaaaaaacaacccaccaggaaccugaaaaaccggcguucaucuccaugaccacggcuugaacucuccuuccaacuuaacgauaauagguucugucuuagaaacugcuauguaauuugauguaugggggucauuuggcuccagaggaggcauggaagcacaaaccauaaacuccugccagacuucccugaucuuuguauacuuuuguuggucauauuuguuauuugguccauuuuccugcuucagaaauacuaaguaaagaaaaacaucuuuuuaaaaaac

SEQ ID NO: 2999 - RNA, 7366 nt, Mus musculus
gccagagcagcugcggcugcagugccaagaaaauuccaggagauggcaguguggcuccacgcaagaggcuuucucgccgccaucuccggccgccgagaccuaggaagcuccuaaaaugucgacuugaagcgagccuuucuggaaugggauuugugugagcagcagucguauauuuucccugcugcucaugccagccugaaagccuccaagggacacagcaugcgccggggcuugccugaccuucggcgcucgcuccuccccggccccauuccgagaccgcuguguugcguggcagcagcgacgccgaaggugcggggcuguggcugagaacgccaguuccauuucagggucacaguccucaucccagcagagaucuagggacagcgaggcgcacggggaacgggucguucacgaucgaagaacaagggaaugaacaccuacggccccaggaccagaugaacccacagagagcgcauccuguggccacggguuccgccgacccgugagguccccaaaccugguucaggguggggggguaccaggccuagcuagccaccaccaguauggggagagagagagagagagagagagagagagagagagagagagagagagagagagaucggggacuuggucgguuugaauaccugaccuuaaaauuaggcggcugaaaauugguuauaaagucauacuugguggcugucuuguguagaucuucggggaacuuggccacgcugggguaacuuggggcauagucuaggaacuguuagguuguucgaaaauaaaugaucuauacguuuaaauaaguacauuaacacucuagcuucaaaacgcauucauaugguugaagucguucuugcuucucaggccgugguauuucuuuggcauugaaaggccaaggcuacucuggugucgccgguugaggaggcuagaagaaagaaaaaaaaauccccauucauucucaggcuacuuuuaaugcuagauguccccagcuucagagcaaggcggcuagugugugggaucagacucugggguaggaugguuucggaaagaaaacacaagagcaaaaagaaaacuaacccuucgaagcgccgugaauauagaccguacagugcauuuauuugggucguaauagucucggccaagcccacaaaauguuuaugacucgcaucuccgugcugaaugcgcuguaaaaccagggacucgauccuggcugacguaucuccugggucucccucucuuucucucucuuacucccuuaaaaaaaaaucuuccugcacacacguagguacuacaggcauauauccucguuauauuuccguauguaauucaugcuacuucacagcaucugauuguaggaaggguuuuauagcuucuuggagagagcaccaagagauaccuauccuaauccugagaaaucuauauuuauguuacugcugagcagugggcacaaauagaaugcuccaguuuucuaacaauggaagucacugguuggcagcagccgcuucccuccacggaucacagaggcccuagguaggugcaggccuccaggagcucagaggccuggugaaaugacuaggccagcagccucccuugcccuuggccgacuggcggcggggcaggcugcucucuggucuucgcugcugagagguuuuucacagccugucgcugucuucguccggacaagacccggcaaggaacugggcuuauuuauucgcuucggguaggaauugguggccgcguccaagucaggcgccuuucacuaagucgggggacauagucuccaagcccaauagcugaagcccaccaucuucucaggggaggagacuagaaagguucaaagucccccaaacucagcaccacuggacucucuagaaggcgccguuuugcugcaaaggucugcguuuacauucuaaaccuagauuuaaacauugaggacuaucuggccacaggaaacggaggaaacaaacucuggcaguagguuugaaagcuaguucugggacagcguugggaaauauuuagauagcagauuaaaaacugggucugggcucaauagugugugaauauuuucacacauaacagauacauuuccauuaaauaaguagggagccaacagucagaaaacauauaauuaaauaggccuugcugagagucugauuuuguucaaagucugccaagggaaaagagacacagaaacgaagugaggguuuuuggugagucuugaaucccacucagagggaagacuugugcccagaagugccaagaccuugaaaacagcagaauuugggaccuauuuggccuuggcaaacuagcacagagucucuugugggaaccacuuaguccuuucaggccaaauucagaugaccuuccuagguguguuagugucguguuuuuccuguucaacccaacuccgaacucugguugucaggucuccuucuaaagagaaguuccacuuuagacacgugccuuuggacugcuccagucuccugagucuagacagaccgccugggccugccuggccuuucacugugcgcccuucugugucaccccaggaacaauuuauuggucuaaagcagucuaauuucgccucuuugaucuccuagccuucuuuugguuugcuucaucuucuuuuagcuauuuuagaauuuuauuucucucuuagaagacacuguuauuucgauuucuacccccucccuguuucaccucuucuguuucccauccugguccaccauaaaguggaucccggauauugccgccuuaggguccuuaugcuccaggggagauagcccagcucccaccugcccuccuccccaccaaaaccugagcccuuuacuagguaggagcugggguucguuccagcgggauuugaacaucccucugucuuuugugcuuccaagaccccccugagaggaugcgguaaacgggggugggguagguggaggcagccuggacccacugaaagugauaagaaagugcuuuguacaccaggaaccaaacucuauaauuuagaggagaauuuccggggcaauuccauugugaagucggguuuaugaugugcaaucgagcugagcaguaaaaggucgccagucuuccagcauggccugagcaguuuaugaggcguuuaggggaaggguucacccaaauauccuccagagagcguugggcagcagagccuucacccgaccuaucauugcagggggagggggucugaagcccagcaagguaagcccccagggugggcuacuauuugggagagaacgaggcugugcuuagcaagcacacagugcuuagaaaggugaagccgcgggaucuggguggccccuagaaagggcucccuuauucgcuuuuauugucuccuaaagaacugggguuccacaaugagcuacagcacccagguccugagauuaccucuccugucucuaauccagcucuaaaacuguuaccggcccacaggguggaaggcuugcuugccugagagccgccaggaguguaugacggauguguuuuaaaauuuguggagccgaguuucucccaaacugaaugaggauaccccaguuuuuugucaucuaggggguaacuagggguuguggcaaggacaaagcggguguugagcuaucucuggaguugcugccagccagccaggugcccaggagcaaaugcagagaaacugccagggccgcaguguccgggaggagaaaaggaaucccauguuaguauaucuguuggcaaaugaggcucauuaauagauaaauauuucacugcuuccuuuagggcagauaaacagugcgccgccgauuaaagaaaggaagcugagagacguugacuuuauucgaaccacaugguuccaguuuguggcagcggucucuccgcucggcuagaggagacaccgcgccugcgguguuggcgcuggagcaucaaaucaggucuuaaagguuucccugcuuauagagagaggugggcaaagaguggauuucccucucuagaccaucuuugggcggacagguuacagagacccugggucuuggacccucagagagggcccgaacagggggaauccacacaguggaucugggguucaggaauagguaugagguugucgggggagggggcgagaucccugccuccaggcuucggcggcugggacggggcucuggcggagccuaggggucugauugcgucgggcgcccuggcagcccggugcaggcaggccgcgucugugagccucuuccccuuccauucuaggaggcaggcggcccguggcgcgggaccaccugugagggcugcugagauuggcggaggcggucaugugggcggucacgugccgcggcgagcuccguccaaaagaaaaugggguuugguguaaaucuggggguguaauguuaucauauaucacgcuaccucguaaaaccgacacugaaagcugccggacaacaaaucacaggucaaaauuaugaguucuucguauuaugugaacgcgcuuuuuagcaaauauacggcgggggcuucucucuuccaaaaugccgagccgacuucuugcuccuuugcacccaacucgcagagaagcggcuacgggccgggcgccggcgccuucgccuccacugugccgggcuuauacaaugucaacagcccccucuaucagagccccuucgcguccggcuauggccugggagccgacgccuacaaccugcccugcgccuccuacgaccaaaacauccccgggcucugcagugaccucgccaaaggcgccugcgacaaggcggacgagggcgugcuucacggcccggccgaagccaguuuccgcaucuaccccuggaugcgcaguucagguaggcucaguggucggcggggucggcgagcgggaggagcggaggggcgggagcagggcgcggggggcugagagagcccagcccggcggcuuccagccggcggccccgcaaguccccguggcgcugccuuucugguuuuaauuagagcugaggcgccauagcguggagagacccguagcauuguauguaaaugaggcucauaaaacuuuuuauggcccaauuaauggguucgauccucguaaauuuauuuaacuccauuugccuuggaauuuuuacaauaaguuucuccgcuauucucauucucauauucucucucuuucuccccccccucucccccuucuucccuucccucucuuuuucucucccucagucuuucuuucuaucccccucuuuucuguccucuaucucuuucuugacuccagcucucucuccccuccuucccuucuuucggccuggcuuucuuucucaaaggcaaggagaauugagaccuccgggaucccucacucaucacuguaccagaggccauuuccagaacggggcugaagccaaugggacagagggugggaaagucacaggaaggucuuguggauggggcugcugaugagggucgcccacuagcaaggcuggggagcagccaggcucgccuuugaauggcaaaagcgcagagucccccacuugccacacucuauauugacaauuucccuuugucagggggaagcaggacauuguggaaacguagccggcuggaaaggccaguuguaaaguuggaauucugcccuaaggcuucucacagauguucuugcuugucuggcccuggggccuuccgcucacaauuucccucccccagcucaauugagggugaugaggguugcaccuggauuugggcaagguggaaggugcagguucuugggcugcuggccugacuaaagcacucuucuguccacauccuagucugcuugucuguuuugucuaucuauauguccaaauuucuguuccuaggacccgacaggaagcggggacgccagaccuacacgcgcuaccagacgcuggaacuggagaaggaauuccauuucaaccgcuaccugacgcggcgccgccgcaucgagaucgcucacgcgcucugccucacugagcgccagaucaagaucugguuccagaaucggcgcaugaaguggaagaaagagcauaaagaugagagccaggcucccacugcagccccggaagacgcggugcccuccguuuccacagcugcugacaaggcggacgaggaggaagaggaggaagaggaggaagaagaggaggaagaggaguaaagggccaggcacaggacccuggcugcacaggacaguuggaaaagcgucuuuaagagacucauugauuuuaguuacaaaaauggggggaaauaaaguguaaaaaaaaaaaagaaagaaagaaagaaaaaagaaagagaaaaaagaaagggaaagaaaaaaagagggaaucaguuccuacccucauuccauucaaucacccacuuuagcucccagggaaauuaggucaccuuggggacccucucugccucugaggaacccaguagauacccacaacccugggccaguguugugcgcaggcacagccaaaauacuaccuagcacaggccucuuugagaggcacucccaaacuaccuaugggcccagccccagugggccaccauuccuaagaagccuccuucaugucccaacacuggcagacacccagcaccugccccacccccaucacacacccggccaauaccugcaaaccaugaucaauacuaccuacuacuagcccuaaacuaccuauugugugcuggcuagcucaccugcuucucggugcccaucccucccaggcuggaccuugaugcuucuaacugauagucuuuggggucaccaaggcuucacugacaaggcaaugagguucagggaccaggguauuggcuucuauuuaaauugaaaaauaauauauuuauuccaaagcauaccaagugcuguaaccuagaaucccucuuucucuggcuuugacacaaggucagggccauuaacccuacuucaggaggggagcauucccgagcuggcugccauccucuggaauagcucuggguuuuguuuuugugggacuaaggagauguucccagacucacuguccucucccccuugcuuuuguguccuacuguucagccaugucaaauauguauacccugacuuuuccuacaaggacaaauacuguauauuugaaccagauuuuuuuuguguuguugucauuucuauaaucuuggagcucauuuguaaaggaaugucuugacuuuggaaggauguuuuaauggggugacuuuguagcaugguguguuguauugaacuaauucuguagugggugggggaaguccagcacccaccggggccaucaucucccuugucuccucaugucccgucccaccccccagccugggguucagagaaggcacgcuucccagcccagcuaccuguguuuuauguaacaauaaagaugcuuggugacaaagaaac

SEQ ID NO: 3000 - RNA, 4276 nt, Mus musculus
ggaaaaaacagaagagggaaggauaccagagcgguucauacagggcccagaaacuaggcgaggugaccccucagcaagacaaacaccucuugauguugacuggcgauuuuccccaucuccagucuggggagcgggacuaggcauacagaugauggagcuuagaacccgcuggcuagggaauaaaauucgcugggcaguuugugcucaaagaagugggccagggcgcuugugacacaaucagggcguuugugacacaaacccuugaggguuggcaguucucuccuuggcgguugcucugguugcucuguggggccuucccuguggagcaagggugaucuggccgaugugcaagcgccuggcuggcuuuccagucugacuagggucgguagcccauuuuaggugguuguaucaucgacggugcgucgcgacaggggcgguggucacucuguuugagguggagagagccuuguauuugacuuuucuaggccggcccugggggcgcgcgcgggcggggggcucacaucucugaggacugcaaggauuauuuacaggguauucaccaaccaaacacaacagucuaauuuaaccuuuccaaguccucauaaauuuuuacagggagccacagcgaggcaaacgaaucuguuggucgcuccugacuuuccaccagccuguguggcuuccgaaacaauaacuccuuaugaaauaucauaaauauagauuuaaauacaguagagugagaaugcgauuuggcugcuuuuuuauggcuucaauuauugucuaauuuuaugugaggggcucugcuggccgugcucacacgcgggacccgcgccuuccugauggcgugauuaauugugauauaaaauaguccgcuuaagaagugugugugucugguauguguguguguuggggggguggcaagggagaguacagaggcaaggccagauuugaucuuuuaaucuucguuggccacaauuaaaacaaaccagaucguggagcugcgcgaucccuuugcauaaaaacauauggcuuuugcuauaaaaauuaugacugcaaaacaccgggccauuaauagcgugcggagugauuuacgcguuauuguucugccgggcggacacgugacgcgcguggccaaugggggcgcgggcgccggcaacuuauuaggugacuguacuucaccccccccuggugccaccaaguuguuacaugaaaucugcaguuucauaauuucggcgggucgggcugggccggccaggcgcgggcuacugcaauggccaccaccggggcccugggcaacuacuauguggacuccuuccugcugggcgccgacgcugcugaugagcugggugcgggacgcuacgcuccagggacccugggucaacccccaaggcaggcggcagcucuggccgaacaccccgacuucaguccuugcagcuuccaguccaaggcggcgguguuuggugccucguggaacccagugcacgcggcgggcgccaaugcggugccugcugcaguguaucaucaccaccaccaccccuacgugcauccccaggcgcccguggcggcggcggcgccggacggcagguauaugcgcuccuggcuggaacccacgcccggugcgcucuccuucgcgggcuuacccuccagccggccuuauggcauuaaaccugaaccgcucucggccagaaggggugacugucccacgcuugacacucacacuuugucccugacugacuaugcuugugguucuccuccaguugauagagaaaaacaacccagcgaaggcgccuucuccgaaaacaaugccgagaaugagagcggcggagacaagccccccaucgaucccaguaagugucuccuuccugcaaaccggccgcugccuccacgcaggccaccaggaucuaccagcgcgucagcuuucucuggagccugccuucguccucgaugggugccucuggaucuaggguccgagaaccagaaguugguguuuggaacaccucugauaggggccccaaguccagagaacuguguggagcacccgggccggcuaggggaaagggaggaggcugcugcagugagggggcggggcgggcgggcgaguagagcggagacccgccgccccucuccuaagcugcccuggccuaggacagacagacuuugggcgguucuucgaaagcagcgcagagaagucuuuugugcagcuagauuguucacaaacuguggcagcaacgucagucgggcaaucugacccgggaaguuuggggagaccucagauucccuccauuucuugcuuuuggaagguggcggcggaaauccugcccaagaugaggaugcgggcuuugggucccuuugccagauuuauucaaauaaaguggagaugugaucaaaggcccuggggcauccugccuuccguggaguucccacggccuuccgggaaggucaaauaaagaguggggacaguugcaaggaagcugggaaaggaagacaguuggagagagaggggaagagagggaaagagagaggaaaagagaggugggagagguuaagcuugccacaagaacucagggcagccugcucuuuucuuugcuggcaaaaaaaaaaaaaaaaaaaaugguuuccagauuucauccuuucacaauaugcagacugugggaggaagaagaagaggggaggacgggagagaggagaaaggaggguggagaugggagggggagcugagacuuucuuggcucuguuguaagugacccuccguggaucugucugccagggcuucauuguguuuccucuaaccaauucagcggcauccugcacuucggccagagacccccaagaggcuccuucagacccuaccgggaugcuccuucuaaacccagugucucucucccuccgcagauaacccggcugccaacuggcuacaugcucgcuccacucggaagaagcgaugccccuacacaaaacaccagacgcuggaacuggagaaggaguuucuguuuaacauguaccucacacgggaccgcagguacgagguggcccggcugcucaaccucaccgaaaggcaggucaagaucugguuccagaaccgcaggaugaaaaugaagaaaaucaacaaggaccgagcaaaagacgagugagccuuuuaggggcucauuuaaaaagagagcaagcuagaaagaaaaagaaaggacuguccgucucccucugucuccucucccccaaacccagccuccacccgcacaaaggggcucuaaaucccaggccucaucuccccacuggcaguccgugcucaggcuggcucuuaggccugcggcuuugauggaggagguauuguaagcuuuccauuuuauagaaggcacacacacacacaagggagggcauuagcgcuauuggcuguaugugcuagcuuguauauauauauauauauuuaaaaaaaaucuaccugcuucugacuuuaagcaaaaggaaagaaaacuaccuuuuuauauaaugcacaacuguugaugacuggcuguauaguuuuuagucucuguagcuaauuuaauuugcucuucguguggcagaucauucugccaaaauacuugaacacuguguuuuauugugguaauuauguuuugugacucaaacuucugugcugggugaaguacccauugugauuguggaagcuagaauucaauuugaacucagguuguuuauggggggagagaagcuguggcauaauguauagcucuguagucuucuguguagcuagacuguuaaccuacgauuguaaacuagcuguaaggauuucccagugaaaucagauuuggaaagaaaagagagauaguucuccgggaugcauagauucaugauuuaucuacuuuugaaaugugggcuucuucaucuuuacguucuagacuccaauuuuguccaauguauauagaaucuccauauuaaagaaauauucauaaucagaaagcuugaauauuguuuuugcaccagaggagaagugaggaaauucggagcuauacgugugugcagaggguugcuaccuauggguuuacgcuuaauuuuaauugggagaaagugagugcuuauuguaauggaguuaauuuuauugauaauaaauuauacaccaugaaacugcucuugggcuacuguagauuuguauccuuggugaauuugggguucccaucggauugaacauacacuguauauuuugcaauaguuaccucaaggccuacugaccaaauuguugugucgagauauuuaacuuuugccaaauaaaauauauugauucuuuuac

SEQ ID NO: 3001 - RNA, 6446 nt, Mus musculus
caaaggcaauuagaccauugggaccauuuccgaccuggcgccgccagcccgggaagugacaagguaauuuggaccucugaccgacgugcaaacuggucggagggcugcagcccuccggagaccagaguccgccacgauuuuacgguccuuuauauucuccgggcuuccgcgccuccuugugccuugcuccccuccagucaaacugcccggacaaccguuugaucuugcccuacccgacggaugugucuuuccgucuuagcugaaucauucccacaaaacucggggguugggagguuggggugcguuuuggaccccucaagucaagacuugugccaacgcugacauucguccaggcacaacugucacucuaaugggauaacacgagagcccucacacacacuaaggugcagagagcaaaagaguuguucaggugcccccgccccacucacccaacccccagccauccugccccaagggaaaggagcaucuugcaccuggccugagaugaagggaacuguggguggagugggcggaccggggagcggaggggcaagguggcuaccuuugcugugcugguacucggcguucccgguggcgcagucuggggugcagcucaccucgauuucuucauagaaauccgauucggugucugagcuacuagguugcccuuggccagagaggcuguccgcggaggggacugggggucccgggccaagcauggccgcuccagcagaccguggcucggcgcccagcccugcagcacugccugcuaguccaucgaccggcuccuccuccuggccucccccgccacgcucccgggaagucggagggccggcucgcgggcucaggcaaccguggggcaccaucuucucuggcgguucaggcagcgggcugcucacggcuucggacaaauuagagacccucuuaccaaccagagugccaagcugacccccauccagaaacauaaccauguccuuucggcucuccauccccggacucuccagagggggggagggggaaaacccccaaguaagcuccuaaucccaggcucccugggaucuuggcugagaagaggagcuaaggcgacaaggcaggcgccggguagccccagcgccgugucgacggcgaccgcggagauggcaguggggagcuagggucaccuugugaugcgagcgcuccucugugccgcaccgccucugggaggaagccccauugcccucuucuuucuaagcugucauccuccugcugcaaucgucauuacaguaccgcuggugacgccacucggcgaacgcaaguggauaaauagaaacgucugccacagugaagaugaaaggagacccgcagcuaauggcucggcagugaugcgccaggugugggccucgcucgaauggggaggagagugugaaaacagagagacacacacacugggaaagggagacacccagacacagaggaugcaaauggaauuccgcacacagaaaagggagcgcuuaaggcgcgcagcgaguuccacaggggcaacaggacuugguaauugaaaaaugcuuuugaaauuuuauuuuauuguuguuuugacuucuguuuucuuaaccuggugucuagaucuaauacuaaugaaagaauccauagcuacucuuuggaagcuguuuacaaacccagguuuucugaguauuaauacaaccgcuugucuuuuuuuuuuuuuuuuuuuuuuuaaccagcuacugaaaagguacccuccaccucaguugucuggggagcuugagccuaaaguacccguuccucccucaucuccccaaccccaucugucucccuccuaagaaccaaacuuuauuuucauccccuaacagccaaaagauaucguuuuccccuuugagaaccggccuugugugcuaacacaguguuccucgauuuuagaagaagaagaaaaaucucuccccacccagaucaccuggcuaaaauucgaaguguucaaugaguuguuguuguuaauuaucucuaucuagauggccugauuugaauuuggauuggcucuucauagaagaaaacaucuuuugguuuggcuuaucuccgggcuauuucagguaugucgguuagggaaagggucuaagauuggccuuucuuuuucugucuguauuuuagguauuucuacagagucaacgaauucugccacaaacggcguguucuaaugaaaaggagcuggcaauccggcccccugcucugguaguacggaaggagcccagguagaaggugcuggccuucucugaugguuuuagggcagcuguggguagauuguguggcaaagaguaucagcaggguuugagcuugcaggguccucuccugggcucuacccaaaagagauuuucuguguccaaagcuagagguaggagagaaaguuguugaaaugucauggggaaaacaaaaaacaaaaacaaaaaacaaaaacaggcaguaggcggggugaagggacuaggcuaauccucugaggaggugaaggucuggaccuguggaauucugggacuugguguuugggagaaggaguagaagaaucuccugcggagccuggcaggugggccagauugaggggcagaggugagcacccuccgaguuuagcuccuccaucccccucucuggcucccccugcaauauuuuccacuagugagcagccugcccucuuagcugaagaagcgggggguggggauaaaaacuccugugucccaaggcaaagccccagcuucuaagaaaguuccugugauucccucauuguccucugucuccuacccuuuucucaguuucucucuacccuucccucaaucuggcugauuuaggauuauggaaauaauggaggaagccagagguuuaggaaaacgacucuggcuuuccauuucucuccugaugcagcaaauguuuguuaaucuugccuggggaacaagggcagaugacaagaagggugguauccaagcaaauguguccacucccuauuaacccccaaagccagcaguugcugaacacugccagcccagaaaucuagagaaagauuucagaggccaaggcagagauggggucaaggggauagugaguucucggaucuucuccugcccugaggagauauccaccaauucuggcuuguccuggcuuucucacuccagccagagucugcuuggucucucuguucucuagacuccugaaucugucucagggcugcugcugcugcugcaucuucuggggcugggccugugagacacccacucucccagccccccccccccccccccaugaacuagccacuacuucacugcccucccucucagagggaggcuggucugacuucccugccccgcccccagcuuugcauucaaugggaauguucaacguuugauccccuuuuacucagcauuuucccuagagaugaaagcagaacagaauugugagaucaaggggugccauuuagucuccuuccugggucagucggauggagccaggcuuuccuuacaucuccaggaggggccucagacucucugaaggcugcagccuccugucugcuccagaucugagcuucaugaaaaucccuucucagcccacccccagucccaaauuccuccccagaccccagcauagcuuuuuaaagcagccuccaucuacuuagcauccuaguuuugaggucccuacuugaaccucucccuaccuaugccgaugcuuaaagagaaaaaaaaaaaaaaaagaaaagaaagaaauccaacuaaaugucacuucuaauaucagcaauuggccgacuucaaaugaagggaguagaauuuuucacugcagaugaaaagagagugcuggagaaagacacgguuuggggguuuuuguucuguuuugucuuggguuguuacuguuuuuguuuuucuuccugcuugggaaguguguuuuaaucuucacuaucguuguauuaugaagguuauuuacugagcagcggaagaaggaaggaaauuucuaauagcgcgugaagcaagguaacccuucgaaagcaaagagaggugacagccaccuuaguggaguccgccccggugcaucucuccgcugcagccccgccgacuugcaguccuucuccugcuggggcgaucggcucagaugcggccaguucuucgaggauuggaauucucugaacuucaaacgcuguggguuuggcuuccgcccggcuaggagggauagaggguggcugagaauccuagggagccaaggggagauaagucgcgccagucguuuuaaauggaaucuaaaccuuugcuugggccaccgaauguggauccccacggaaacagcuucgcuucgcaagaaaauccggcuugggagagaggcggcugcgguugugggagcugucuaagugacccgaggcccguggggcguggucggcagugguccugagcgguccagagcaccuuugcacauggcuggcugaaaggcaagggugaaaguccagggaccugcuuucucccggggagaaggggugaaugcgucgucuagggaaagaaaaagaaaugaacuuuucuuucgucaaauguaagaacaaagagagcauccuucuaaauaguaagagucucccagcugucguagauacuguccccugguccucugugaccuuucagguugugacagggauuauuuccgcaaaguuucugugacucugggucuucgcagcuagagggguuggcagugggaguaucuaucagucagcuccacuucucccaauacagcuguccaggccucuuuuugagcccagacucacugaguggugcgccccuugggggaacaucccccgcccgcgagaaaagguuuacugaaagccaaacuccagagguucaggcuuccaggaguccagagaucaaauaaucuggacggauucccuuccccuggaggcaguguuccgcgcagugggcaacagagaacaguucuccucuucagaagguugagcuggagucuucgcaaacgcaguuaggagaagugcucagccucugggccuccugauguaaagggcacagguaucugaggcaagaaauggggugcuucauggcccccaaugccugauacuucucagaaccccaaagguauccaguccugccuauucuuccucuggaucuguuugcuuagucuacugaaaaccagcgucuaguggcuuccugccccuguucugucucugcagucuagaagcccaucuccccacccccacccccagcucacugugaauacugacagcaguggggaacagacccaccauaggacugacaccccaggcucuucucaccugaggcuaacucugucccuuuggacaaggccuggaugagcccaguguaguuuguucccucccauucaagggaguucuucaaugucuucaugguacaaaccauagcuagcucccucccgccuugcccuaacagaaguaucacagccucuuucaucauuaccauucugauacuugcuauuauuacaaggcuaguugacaucuacgucucuuucagcuacauaagaguucuuuacggguuuuaauagccugcaaggcuuuucucccucaguuguagggugaccaguaguccuaacaaguggccauggcaaggcugagugucagaccuaggauccuccuccugagucaucuuccuuccuguccuugggggaaucucuucugcuaucauguugagauaacaccccauagccuuucuggaaucuagauaggucugugcccucagcagguccucccuacccucaagagcacacuccucuggagaaaaggccccuggccacauugaugccaauacuccccaacauagauccuuuccaaggaggacaaagaguccugugguaagagcagccacaguguaagagcagcaccauuuuaugcauuuguguuuuccaacgucugcagacuuggguuggggguagguauaugaauuaucccuggcuugcagcugagaagacgaaaugaggagaaauacaugcaugaguaagaggauucugcccacccuacucccagcccuccccgccauaaagacaacucucagagcagcucuuggaagcugggcugugugguagaaugcuugccuggcuaccaugagguacuaggcuuggacuaagaagccagcuugggcuuuucaacaggguccuuuugcucccaccucacucauagaagaggggacaauuccugggacucuggguacuccccuuggaccugcaggugagggagaaaaggcugcaaaccacuuggaaauacuccuucuacaggauagaggccagcagcugggugaggacuguacaagggacuguagaagaaaaaaacaacaacaacaaaaccccaacccauguggucaugugcaggccacugguaccugaaaguaaaaccucugaucuucguucagaaccaaaugucaauauaauuacuuacuuuggaccuuaaagcaccggcucauuccauggca

SEQ ID NO: 3002 - RNA, 4883 nt, Mus musculus
augcuaaaguaagaaucauguucagcuuuuauugcaauaugguuaacaaaucauaacagcaaauucuuugggcugcaaaggaaaaccccaaaccaaaccaaauucauucccugcaggaaggaccacuuccucccaguggagggaagccugcauuggaugauugaaguuguccuuuuccucaaacacuggcuauaaggaugaguacaggaguuccuaaguggcuccccaauaaaccccagugaaggggagagacaggguccuccagaggcgcugaagguuuguacuggcagcugaaagccaaggcccuguggcaauuuggggagacaaugagagaagaauguaagaagucuccguucccuaagcucuucccagggcgccuuguuagaccggcucagcagcuccgggcuugguggcccagcagaguggugaucauuauuauacauacauucaacauucaaaaaccccuccucacccaucacuugcuaaucaggcugugugcuggguuaagggagaagagguucgccccacagaagcugccuagggacccuggagccccugccccuucccugccaaugucaaaccggaagggagaaggcuggagcugcacaggucgggucgugagaugucacaaagccagaaauagggaaagaagucaguggcugguagaggguaccacuccccagaugcuguguaguugaggcccugggaaggugagccggcucccagguuccucgccaaguggcaagcaucucccuagcaguaaaucaucucuccccuaaauggcugggauguugccaucaacaagcccccugccaugcguuggaaaagcuggugaagauuaauuucuaccugcucugcauacacagcauuuuguuccaagaaacagcgaguucccuucgcagcucuugcccuugacaggagagugggggcccaguugaaggguacgaggggcuugggaguggguuguucccggguagcuguugaaccaaggccucgaccucugauagaguggugguuucgguggagaauggcaaggccuggccaccccaggggacgcuuucccaccccauuccugcuccuaagcagccaaugucgcuucuggggcuccuggauccucuaggcggaguccuuuaugguguccccccccccaccuccaccuccuuuccccugugcaucugagaagagaggugacaggugggaugcuggaggagccccgaaggcucccccgaccuccaccccacgacguccauccugcagucggcagccccgagggcgcccccuuaucuggugaggggcaccuccucucucugguccaacgccgccacggaggaggccuugcugagcacagagggggcgaacgugaggaaggaguccgagcgggagguggaggcacaagugaagucugaggcggcggcagcggcggcggcccugggcgccagcccguuggccgggccgcuguggcaggcgaggcaggagcagggcccggcggcagcggcggcggcggccgaggcgccgaguccgugcgccgggccgggauagagcggcggguggcggaaggcgcacagcaguucgggccguggguagggcugcgagagcacgcggaaggugucgagcgggcgcagggggccgcugaagggcgaggcggcggccgaggcggcggacgcggcgcccaggcccacgggcgaguaguagggcaggggcaggugcgacgggaagggguagggcaggccgcccgcggccgccgcguggcucaucauguagguguagaaggcagggucggccgggugcggccacgucauggccagccgcugacgcuuguccuucaugcgccgguucugaaaccacaccugaggagaggaagaggagcgccuuggagggcugcgccaggcccaggcccauggcuggggguggguggggugcgagggccaugcucgcagugaggggggcuggggaguggggggagagucaaaagcaacuccagcugacaagggcaggccaccaacccagauggaaacccucgggagcaggacugggcagccgcucagccugcccaccgggcuuagcaucacaagcuggagugaggguacuaagaggaaggccugccucaauggaucuggggaggcaaaagacauuuucccauagauuuagggcucccuguucuuuggggacacugucacuugcagucaccugucuccguagucuguuugccuaggaaaaggacgggaaucuuggcagcaguggcugacuauggacugucagagggaaauucugaguguaccagauuggagaguccaggcccagacgauucagcugcaguagaccguugacaucuccuuccuacuaaccuagguacauagccaccucgaggauccuagcccagccuaccuugaugguaguuucaggaagguuuaaggcugcugccaguucgcaucuccgcggucuugaaacguaguucucccuguagaacucuuucuccagccuugcaaucugcucccggguaaaggccgugcgguaucggcgcaucuggucacuggcgcugcaggccagggugccuugagagccgcugccgccgcugccaccguuacucuugggggccucgcugccacugguaggacugcuacccagagcaucggagccuggcgcugcacaggagcccagagcacacaggugcacauacagagacacaacacaaauacacaaacaaaugcugacuucaggcuggaggaggggcauuagaaggagaaccccuuagcuuccucagucacugauucugcuggggcucuggaagcuucaccggagaggucuugacacagaaaagguuuggggcaggcuuaaaguggcuguuuggaagaccuggaccuaaggcauacugggucuaaaggcuucccuuccgcuugccccugggugcagcaaagggcauauccccugaacucucugcuuguguugguagggauggguaaggaugugccggaacacugaauucuugagguuaauguauuguagcuuguuggacauacagugagcuuccucgaucuugugugugugugcaccaguaugccaguaccagguguggggauguguguuggguugcaccuauugcaggagugguauauuuugaguauggguugugaggacaugguaugguagagaagcuggguuagauagaugauaagaugauaggagauggagguggauacuuaacaaggugguguuggcugccuaggccuagagguagaggcaagccuuucccacccauucccaugguuuuguggaggugugucugcugaugggcuuccagucuuucauuccuaggaguggauauuguugguauagagagacucccuucugagcuauccacccccacucccauuagccccuggugagaaggagcaguguaauuaaaguaccaaccccuuagacccaccccagaggaggguggggcuccagccccccugcagcugcuuuuccuuuggguggagaagugagacugagggaaagagggagggggagggcccaauccccgccuuuucaaaugcaaccggagaccaaaggcaauuagaccauugggaccauuuccgaccuggcgccgccagcccgggaagugacaagguaauuuggaccucugaccgacgugcaaacuggucggagggcugcagcccuccggagaccagaguccgccacgauuuuacgguccuuuauauucuccgggcuuccgcgccuccuugugccuugcuccccuccagucaaacugcccggacaaccguuugaucuugcccuacccgacggaugugucuuuccgucuuagcugaaucauucccacaaaacucggggguugggagguuggggugcguuuuggaccccucaagucaagacuugugccaacgcugacauucguccaggcacaacugucacucuaaugggauaacacgagagcccucacacacacuaaggugcagagagcaaaagaguuguucaggugcccccgccccacucacccaacccccagccauccugccccaagggaaaggagcaucuugcaccuggccugagaugaagggaacuguggguggagugggcggaccggggagcggaggggcaagguggcuaccuuugcugugcugguacucggcguucccgguggcgcagucuggggugcagcucaccucgauuucuucauagaaauccgauucggugucugagcuacuagguugcccuuggccagagaggcuguccgcggaggggacugggggucccgggccaagcauggccgcuccagcagaccguggcucggcgcccagcccugcagcacugccugcuaguccaucgaccggcuccuccuccuggccucccccgccacgcucccgggaagucggagggccggcucgcgggcucaggcaaccguggggcaccaucuucucuggcgguucaggcagcgggcugcucacggcuucggacaaauuagagacccucuuaccaaccagagugccaagcugacccccauccagaaacauaaccauguccuuucggcucuccauccccggacucuccagagggggggagggggaaaacccccaaguaagcuccuaaucccaggcucccugggaucuuggcugagaagaggagcuaaggcgacaaggcaggcgccggguagccccagcgccgugucgacggcgaccgcggagauggcaguggggagcuagggucaccuugugaugcgagcgcuccucugugccgcaccgccucugggaggaagccccauugcccucuucuuucuaagcugucauccuccugcugcaaucgucauuacaguaccgcuggugacgccacucggcgaacgcaaguggauaaauagaaacgucugccacagugaagaugaaaggaga

SEQ ID NO: 3003 - RNA, 94165 nt, Mus musculus
cggaguccaagccgagcaaggagagcgcgugcgcgagcuguccuuacggaggugcgggccaucccggcugcgcacacucguaguucacaggccgugugugaggcggcggaggucacggcgcggaggcggggcgggggacagcauggcagccuccuugggguuccggggagcagccuccggccucugguacuggagcggccggcggcggcccgugggcagccuugcagcggguaaggaccucgcgccccaucugcucuucuuccucuggucauccgaggagggcuuuucgcccgaagggcugcgguugguuugaggguaaaagcgacaauuguggucgccuccuaggccugggcccccuuguaacugccuccugagccgucagccuuccacuccugcccuaugcccggcuccagauuguucagcguuuccucugcgggacccaggaacagcuugugaugaagggaggaauguuugggucccuggcgugcgcuuuggauuuggggcuccuaggacauuuggagggcucagcuccagaggugaccccaccgcacccaccucugggaccccuggccuuccagcucccuggcuucacccuaagcgggggcucccucagacuucaaggccuaauuuguguuuuaacuacucuagucgguggcauggcgguauccuagaaauccagcaaaguuugucacccuugaccagcaagcagagcgaacuccauuaugaaauggaguugugcugccucaaagugguggacuuuugucgaaauauuaaccacaauucuuugccucaaaguugugucuauaaccuaaccgacuacuaugcugugcugcaaguauggaaagugaccagguuuuaagcuuuuagagcgacaugaauaucugagaacugcuuuucacaugaggaucucccaaggccuuagaaugaguaaauugggacuucuccaacaagauccaggaaguaccccuuguuucucccugacucuuggauuuucuaggacaucaagacaccucuuuaauuaagaauugguugaaauggucauuaccaaggcuuuuagaaugcaguuucucauuugcuguggacaugaccauaaagaaaaauucccaugaggguuuucauaugcuacuugucuagcaguuaaccuguugggaacauguguugaaaaaaaaaauugguugauuugugggagauaccgaaggauuuuuuuuuuuaaauguaaaaguuuauuuuaacaaugugcugguuagcacuaucauauacaggacuagcaaacaaaacaccguugccuuugcuuagcaugcaggaggcucuggauucagggugcuuguguucacuuguuuuaauuuuuguguaagaaauauguugggaguugauuucugagcagcucccagucuuugcccucaggaaaaacuuaugaaauuucuuucugcuuuggaagagcauuugugugcaauagguagcagaugacagauaaggaauugugauuagccagaugcaaacacaugauuuuggauauaauuuuuuucuuuuuaaaaacacuuugaagggagcagcaguuuucuuaucaguguacaacauuuugagaucugauuaguucaggaugauauauuugcuguuuaguguuuuuacaaggugacuaaugauaguuucuugaaccauucauguaccuuuuaaggguuaugaaaguucuuacaauucaugauaggagagucugaggccaaagcuuauaauccuaugcucugacagcaggaaggaccugucucccuggugcuggguaaacugccuuaccaagccaucuugugcuugggcugcucuggcccaaaggcaugugucuaugaacaauuaauuuuaagaaaaaguucuuuagugaugucuuugaaacacucaaacaaucccuuuuuacuuuggaguuauuuuaaauuaguuauuuuaaacuaauauuaaugacaaauaguaaacuaauuacaaaaaauguuaauuuuuuuugagauuuaaaucuuuucuaaaaauuggggaaaauaccucaucuccaugcaacuuugaaguguaggaaaauguagaaaaggaaccauguucaauuacuaauacuugauguucugaauucuguggagggauuugccuccauauuauguuuaagcuauuuauagagaauaguugauaguguuauaaagacccauguacuuuuuaaaaaaugagacuuacaaggugucaacuuauggcagcuguaauacauuuaaugcauaccagaagaaacagagaaaauaauuucuuuccuguuucauaauucauuuaauaagcaaauuuuguauuuuuuauaaauauuuuuuauuacguauuuuccucaauuauauuuguauuuuuuaaaaaagauaauuguacuuagcuuuaggucuauuuuuuaaagaggacacacacacacacacacuuucuucaacuaacuuauugggacuccucaacauguacauagaaaaauuguaucaggacauuuuuaaagaccacuugaccaaagguggggugggaaauugaauagcacuguauauagaguugcaaauacuaaguuuaaaaaacuacagaugccuuuuguguaugugcuuguauuucuuguauguuuagauuuaagcuuuuuuuuccucacaguuuuauccauaauacagcaauuugugauuauauucacccacauuccccucuguucuaccuccuccuuucccucugaaccccuucuugccagccuguuccccagucacaccauucacaaaaugauaacccuuccagcaacacccauuagcaggcagaagcacuacaggaaggguggguccucaugggaccaccucugugcaugauggccuguugaagggucaggugaccacgauuguagcagcuggguggugucuggauggucuuguucuguggcauuccucaucauccucucacucuucagcgcccaugguccgcgauguucccugaggcuaggggaggagaagugauaaugguuuuguagaauguacuccacuuuuuuaaaaaaaagauuugaaucucaaaaaaaguuaacauuuuugagguuaguuuacuauuugucauuauuauuaauuuauauaaacacuggcauuuaaaauaauuccaaagcaaaccucaaguccaacucugagguuguaaccucagaguaaucaaguauauaauguuacuguuuuccauuuacauuagcgucacuuaguuugggacaugcaggucugaaaguuacauguggccuugggacuaaaguugaccuugaacuuacaagaguacccaccgagaaauacuuauuacugaaguaacgugagaccuucccagaguccgccaucauccuuagcugaggaacuuuuacuguuaaggcaaacaguguuuguuacauuauuguaugcaacagaggacaaaauuugcuuauuaaaugugcguaccgcgguucuuucuuagccaguugugcuuguuucacuuccaagagucacucaccauuaaacacaggcugaaaauacuacauggaaagauauuuugggaucaaccacauuuguauaacuucaaaacauguuauaaauuuucuauauuaucgugauuauuuuuauuugucucuuacugugccuaauuuauaaauuaagcuuuauuaugggauauauacauauauauuuaugaauuaagauucaucaugggguguauauauauuauauacauuauuuucugcauauuauuauauauauaggaaaacauguuugacauuguaauuucagacaucuuaauuucaaacuauuuccuucagauaaaggaagaacacaaucuuaugacacaaugaaaaauccauuuagaagcuuuaaaugauuauuuuuguauaaugaaguaaacuuuuccuuaugacuuuauaguuuuuaauaguuuuuuuauagucuauauucauguguuccuuugauuagguagauuuugaaaauguaagauaauuuuuuuuuuuuuuacagauagcagacugauuucugguagccaaguuaccaagauauaauaacuuugcuccuauuacauaaucuguaaauuuaaaaaccaguguugccaaauuuucuaaccaguuucuccaccaaucagcuagcaucagcuuuaugcugacuguguuuuguuuuguuuuguuuuguuuuguuuuuuuccggcuugauuuuaucuggcaucugacauggcugucucugcacacugcuguuaagauagguggguuucucuuguagguuugcagguguuucuagagucccacuaaauucccugggagcccugaaccuuugggagucaauucugugcgccaaguacuccaucagaagcucccuucacuggaagacgucacuccccaagugacuccugcugccuuuaaucugucucuuccuucuaacccacuagguuaaaaaggccguuggguguaggacuuguuccucaguggcacuuucugacccuucuaauacaaguagcuacuguuuacugacugucaugugcuaggcauuguuuaauguuuuacauaucuuauuucaaauaaucuuuacaguaaccuucugauguuguugguucuguuguugauaaagacaucuagaggaguuaguaacuuuaugcuucaagggcuuacaaccaaaggugacuuuacauggaccuccuaaacucagaauuuaaaugugaucauaaccaaugagcaacuuuccuuugggcaauacuuauaccaauuucauuucuugucuugccccaaugaugaaaugaagagagcuaagcccaucacugacaaccuguuaugauugaugcucagauaguuagcccagauaacauaggccuccucguucuuggcuccuuagcaucugcagcgaaggucugcacuguccccucagcucuuggauucugucacuuggaguuucacaagaacuagucuuuugguagauagucugugccucuugccugcuagcauuuugccuguuugccuguuuuacacccagcccuuugacacuuuguucacacuagacaaaugauuuguuccuucauuucauuaagcaccucucuagcuuuuauccagucugaaauucauuuauaaacaggaauuuuacugauaccuuuguuaaucuuaauuuuuuuaaaucucuugcucaaauucugaguauuacguaugucccucagguaguaauauugaggguuauagaaguuugcucauuauuugcaaugcuuucauuaacccuugguucacuucuuauuacauuuuucacggcacuuccauguauuggcaggauugguagcccuggacuagacaguaucugaaucugggaugaggaacgucagagaguuaaccuguguaaugguuacaacccagcucaccuuugccgaguccacuuuaucacacugugacucuguagcugcuucagaccugcuuauauuccugugugcccauuuagcgaaaccucuuuagagcuagaacucauucacauagcacuuaacauccacugugccaguaccuuuauuuccuuuucuuacaaaaguaguuauaaagguuaaauguauauaguuaaaucagacacaugacucuuaccacuugaacuaugaugacuguuuuuuuaaaauauauccauacaaaacccaggaaaauaaguccauauauuuuuuucacugcauauucuuguguuaauguuuugcaucuugcuauuuuucuuuggguuuuauccuggaggcuuuuccucugccuuagacagauagaucaugguaggacaggacagaaagauagacaauuaaggaccugugggaggaaaagagccuccucacucggggaucugcuuaaaacuuucugacagaugagucaagaugguggaaauccugcaaggcugcacucguacaugcagagcuaaagcuaacucauguuugcuaagaggggcagccgaucuucucuaggaccagcccucugauagguuauccaguccugaguggucaacucuaacaaauggaguaaucaggcugcacuuacauaugugcaugcgcaugcaugugugcagguaacaguaauuaaaggagaucaugaacuugagugaauguaaggggcacaugagcuggagauggggaaaaggaagggcagaaaugaaguaauauaguccucauguauaaaauucucaaaauuuaaaaauguuacuuuucugaaaaaaaaagaaagaaauccagcauaauuaacauuuucagugacgauuaccuuuaagagacauuauaccuuuuauguagaaguguuucaaguaaaacuuaagaugacauauuuaaagccuaaacauauuaauaaccuucauguguggucuuuuuccuuuucucaacuguaagccugaaguuuucaauugcaaugggaauucacaagaauucccacuuacagugaaagauaugugcugaccuguguauguaggccuugugacuccgguuuuuaccuuaccagauuucaguccuauucaguccaccucuggagccacucuagaaucucauuuauggaaagaaggaaagggggagggauguuaacaaccuuugagauguaacuugagagccaccaaaaucauacacgugacagcuguggguugguguguuuuguccuuucuaugagugccucucuaauaaccacugugcuuggauuuauguuaaauucucuuaguaagucaagaauccuacccaagcuucccccaguugggaguucugaaaggaacacaggcugcagcaggugcaaguguggagccccacaaauauaagaguaauauuucauugcuuuggguuagugugaauuauugugaauuaaguacucuacuaauauguuuuuaguuauuucauuuuuuucugcuguaauaaacagugcuauaauaaacuguuugugugguucagagcuuaguguauaucaggacccugcaaaugauaguccauauucauguaucuguuuuuauaaauaaaauuuaugugagagcuaaggcuuaguagaugagcacuugccaugcaagacugaggacccagauuuggaccccaagaagcauacacauaagagcugcauggaugugguggccuaccucuaacaagcucgcuggcuccccaucacucccaagcuaugacuaggcuagccuaaucaaaaggcucacaguucaggagaucuguaaauaaauacauaaaguggagagggaucuggaaagacaucaaaugucaaucucuguucucuauaugcacccacacaugugugaacauucacauacacuugauacucaaaaacucuuguauuugaaucagccaugcacuuuuguuuauuauuuauggcuauuuuuaaacuagaauagaugaauggaauaguuccuuauggcuuacaaagcugaaaguaauuuauacugauccuuuuaagacaaaguuuauaacccuuguaaauuucuagaaaguagaauugcugagucaaaaauuguuuuaaauuaaaauguagauagauuuucaaaaaggcugaucugauauauuuaauaauguaugagaacacucauuuccauaaauccucacuugcugaugauaguuuuuguucaaacuucgguucauucaguaguuaaagaguagugucauauuucuuuucucuaauuauaacaaguugaauauauuuucauaguauuuuuucugaagauaauugacauuuucuguugucauuuugugauuucugccuaccugggucauucauagauauaguugggauuuuaaaauuauucaggugugaauagugcuguuuauauugggugcuagcagucccuccuuaguuacuucguuuuucgucgucuauaauaguuuuuauguguaaauauguuaguuuucaccucgugaaaaaacuccaauugagaaguacuaaguaauauagggaauucugaguagucuuuuguguagaguucagaguuuauuauuuuugucauuuccuuuauuuccacuuacauauauccuuauccagcuugcaucccuugaaagacaguagcagccaccauaauauuuccugcuauuuuagugugcaucucagaagagugaggacguuccauguuucuagaccaaaugaucauaaagaguuucaaguccuaagguugaacuucugugaaaccauaagaugcaaguguguucagaagccacagcuagcuucuggcacugcaaaaccaaaagcagcucaaacaaacccaaacacuaagucaggccuuggccauuuuccuuacgcuugcuaagcaucuggguucccaagugaaagaagauaaaugaugacgcuuaucaauaaagagcuuagguaacugugucuggcauaaauauuaacuguuaacuguuuauuucuucuggcuuuccuuguuucuugauuguacuauucccuuuucuuuucuuuucuuuuuuuuuuuuuuuaagauuuauuuauuuauuauauguaaguacacuguagcugucuucagacacaccagaagagggcaucagauuucauuacagaugguugugagccaucaugugguugcugggauuugaacucagggccucuggaagagcagucagugcucuuaacugcuagaccaucucucuagugcuuguuuuuuguuuuuuguuuuuguuuuuguuuuguuuuguuuuuuuguuuuuuucaagacaggguuucucuguacagcccuggcuguccuggaacucacuuuguagaccaggcuggccucgaacucagaaauccgccugucucugccucccgagugcugggauuaaaggcgugcgccaccaugcccggcuauucccuuuucuuuauguucccuuccuguucuguuugaaacuugauccacuuuaaaauacacaaguuaaauguacuuucuuaauauuuucaaaccaugaauucuguaccaccauuuuuuuuaacaauauucucgccugucuuauauuaauguuuuauuguguuuauguccucuuggauuuuaagguuauugcaaggcaaggauuguaucucauuuguguucagugguuccgucuaguguauaccuguaaugccaacaccgggcagcugagauuggaggaucagaguuugaggcugcccucuggcauagcacauagaggugucuacuuaaugcuugugguguaugugaguccucacucuuccuugucgugcuuguuacugucucacuuaggguaguugcuauuaaacuaacugcccuuaaaaugcaggguuccuugcuuguaauguuucuggauuguuaaauugcaccuuucuaacuugaacacagugguuugauguaauagugcuccauuuucucuuuuuguuaauuugcuuaugggcaugagcgcucguauauaaaauguacuucucauucuauuucauuuuaaauuaaaauuucaauuaggugucauuucucuguauuugaaccuccaugggcaauaaagaacaagggcuccugucacacacagcaaacguagcauuggcaccgugauguugcacaggaaggacacgcuugauggaagugguagggucaguggugaagaggaacucaauaaacugcuaacccaguugagguuuuuuucuuaagcauagagcuucaaauaauuugccuuuaggaucucacuguacucacauacacucauggugagucggaacacuugagaggauuugaaacuuaaaaauggcugagcuuaguugucacacagagucucaaaaccacagucauugaaagagaaaggaagaauaagaccuguaaaugcuagggcaaguggagcucuuucuaauucuuucaguagauuaucaacuuuucaggggcaaguacugugucuugugucuuuuuaaaacccugucaguauuucaugcagugcaccuuuagugagugguauuuguucaacgucacugugaaauggagaaaguguauuuaauguuauuuccaaggugaggcaaagcuuucuuacccucuaaagcacuuguuuaugagguuaagccaauuuuuuugauuauuauuuuuagcauauaugaauauuuugccuacaugcauguauguguaccacaaauuacuuuuuuauuuauaaauguauugaaaucaguguguucuaggucaauggcuucuaagacuccaguuggauucauuggacugggaaacaugggaaauccaauggcaaaaaaucucaugaaacauggcuauccacucauccucuaugacguguucccugauguaugcaaggaguuuaaagaggcuggggaacagguaaggcuuggcucuggauuugcuuuagauuuuguuuuuaaauuuuuuuuuuuuuuuaaucaaagaagcaaguacuucuuagaagcauacccaacagaguuguaaaaccuaauuguugcugucuuucauuuuuaauuuaauaucaggucaacaucuggauccacaucaaaagagcagcagagcugccgagaggggucuguuuucugcuagguggccagggcauugccuguucagucauuuccugagauaauaucaucuuugauuauguugaugaaacacuuauuuuguggaauuagccuucuuguuagauuaagucagggauaauugucuuaggacaggaaucugcuuugggacuuaagcuuugcccgagucccugaucaaauacuuaaauuuugucuuaaugggagaaguuguucccucagcugguuuccacaucugugaaaugugaaugaugacuaacuucugugucauuagauuaucaaacucagaggagaauauaugugaaugaacuuuauaaauaucgcauggcagcacucugaguccaucauuaguuauugacuguaaaccaggagacagccuaaaaacauugugggcuguaauauggagcugaguuaugauugagugguaguauguugcuuuuaggcugccauuuacauuucaagaacugggguacuagaguuuaucauguuuuaugauagcgucugccugguaagucuuguucuguuuggauuugucaaaguuuauuaguaacucagaugauaagagaucauuuuuuuuuuagccucugaauuuaacagauaugcucuuuuuacaauaugaaggaaauuuugcacaagucauagaaugauaacuaagggcaagauaagguccugggacuggaagcuuccaagaaacagaaaacugugagaacagaauaaagcagaacaauagacauguggauuacuaucgacgcaaacacugagacacgcaacccugagaaagaaaauggguuuggugacuuagaagagcccuugucuuucguggccaugcucugugcacugucugacucuggugguacugcaugcaugagaaggugacugaaaucuuggggcuuuucagugucgcucugaagcugcucuugcucacguggucugaggagacugacaucacacuccuuggggcucugggcugaagugaaguaaccuagacucuuagcauaacuuucuggaacgaucugaugacuuacuuuacuaagagaccgagaagaaggugaccuuuuauuaucuuuaauaugauaaguacuccaaguugguuugucuggaguuaaaucaguuaguagcuaauugauugaaggagauaguauuaauuuuggguauaacacugauauuugauguucaucacuauauggugacauguguuugcaaaugcugcuagaacucuaaauuaagggaauguguuaaauacagaaguugggcagaaagcaagguagagguugaauggagacccuccagcggauuagaaguaagaacuggcagagcacaaacucaggggcuuuaaaaugcccacaccguuguccguccucccaugccucuagaauauauauauacauacauacauacauguauguauguauguauguauguauucuauagcuuacuuuggaacaacugaagugguugucacugcauucuauaucuuucaguuuuuccuagacuuccagaacuuucuuguguucugccugaguuauugacuucucugaaguuaccccucugacucuauucuauuccccaaugacauucuuguucuuuacuaauuuuagguaggccugaggaaagacuaucuucauaggcuugucuaggaauaagggaaacauuaacacuuuaaaaggaaaaacaaggaaccuaauauuuaguuagaaacugcuauaucugggcccuuacucucagcucuccaagcauuuggauuaugggauuguaacacaacaaagagcagcucugcacucugauuuuguuuuuguuuuguuuuguuuguuuuaaguuuuauucauuuuuaaguaugccuaugugugagagagugcaaugcccucagagacuaggaguggggucagaucugaagcuagcugcucuccucggguuauucaaugaguucauaguaggagccaaggacugaacaaagguguaguuuugacaccuuugaauuacaagaugcacagcuacuaauuaauaaaaguuaauguauaaggcauuugucaguaugcagcauggcuuuguuuuugcucugaauuguagcuacuacuugucuguuuauaaacugaauaauugguauaaguugccugaauuuuuaaaacaucaguaaugccaaaucauaaauuguauaugcuuuuccucuuuuccacaugcuucuuguacuuugaagaguguuggaauaauaauuauucuuuacaauaaguuguuuaguggauagcagugguugaaaaguggccccagaagggugucuuauacaaaucaaaaggaaacacaaggacuagagagaugguguagcaguuaagagcacuuacucuuacagaggaccuagguucaauuuccagcaaccacaugauggcuuacagcugucugaaacuccaguuccaggggauaugauacccucuucugaccucauuggccauuaggaacauacauguugcacagacauacauguaagcgaaagacuuacauacauaaugagauaaaaugauguaaauaaauaaauaaguaaauaaaugauagugcaauagugaaucuuuaugaucuagaauuuggcaaaggauucuuagcuauaacagcaugagcuuguguaacaaaauuaauagguaaauugcaauucacuggcauuaaaauuugcuugaucuaaauaacaccaguaaacuaaaaagauaauucaccaugaaacgucuaaaauauuuacaugucauauauuuauuugauaagggacuuguaucuaaaauucauaaaggaaucuuacaacuuaaccauuaaagacaaguaauuaaaugggcaaaggaucugaacuucaaggcaguuagaugaaagaggccagagaagcaugaaaaggauauacuagucuagccaugaggaggaggaccaugggcgcugggacagucagaaugaagaauccagcagacaaagcagaacacaccuuucuauugugguaaugcagggaaauugggaaacucaacaaugguggcagaagauaaaaugacucagccauuucggaagacaagucuggggagugucucagauaaugaagcauagagcuaugauaugacugaagaguucuuacugugugugguguacuugaguguaucuucacguguguguguagccugucuuccucuaucauugccccaccuagacuaaaccggaggucacugauuuaccugccuuucucugccucuccaaccucugcugggcuuuuaaaugcauacuggaauaccuggcuuuuacuuggguacuggaggucuaaaccaaggggcauacaguaguauggaagaacuuuauucauuuagcuguuugucuccccacuuccuggccuagcgauaaaagagaaccuagaucuaagcuaggcauaagggagcacgcuuuuaaucccagcgcuggggaggcagaggcagguggaacucugugaguucaaggugagguccagcgcagccagagcuacauagucagaccaugucucaagaaacaaaacaauacaacccccucccaaagugacagcaacagaaaacaaaccugugucuauacccaggagaaaugaaaacauauauuuacacagaacuuucuguauaacaguauuguucauaauagcuaagaaauggaaacaauacccauguauaucaguggaugaauggguagaugaagugucauauauguacuggaauguuaucuaggaauuaaggggaaaaggugcugauauuuacuguguugcagaugaacuaagcacacuaaauuaaagaaauuaaagaagccaguugcaaaagaccaugcucuaagcaucucuuauuaucugaaaaaaaaaaaaaaugaagagaaugcuaguugcuuagugcuuggagaagacaagcagccuugggcauagaggaguggcgggugguggcucauggauauacaguuucuuuuugaagagauuaaacacuugacugguaaugguuacucuuaucugggaauauaaugaaagccaaccaauuauucauucagucuaaaugggaaaauuguauaauguguguaucagugaagccauuuaaaaaugagagccaggggccuagcuaguggcaggugagaaccaggacuaagggucacggcaaggaagaagacacagccagaggagaaugcugggaagagggaggcagacauugcuguuguguugcugccagucauggaaugccaccagccaucgaaguggaagaagcaaagaaagagccuggagggagaguggucccgccgacaccuuguuuucagacucagaccucugccuuccagcucugcgaauucauuucuguucuucugacacuauuguggagugucuagaguagaguauaacagagcacuggcuacaggaggcauuggcuuggaaccugccuuugacguuuaguuagcugugcagucuuuggcaagcuuuuuugguuuuucucuuugucaacucguuuccuaaugcauagaauaagaacagaucuuuucauauaguuguuaaaacagaguuuagcacauaaauacuauuuuaguguuagcugaaaauucauguaagccauguucccaucucugcuauacaaaucuacugauaagucacugguugaacagcuguuucuugaguauauucagagugccaggaacuagaacucuuuccugaaugaagcacagucuuuacuaccuugagacccaguaguagguaauacauuaucagaacacacacacaguagaacucuaaauagggaaguugaauguaaaaguagaagagguauuagucuguuuuagauguaucacauuugugaaauggcauauaagguucuuuguggaggcugagagaagaguaugaacaauuuauucacaguaagaaugaggacaaaggaauccucuccucuccucuccucucuucuccucuccccuccccuccccuccccuccccuccccucuucuuucucucucucucucucucucucucucucucucuuucuauuaaguuaaagcuuuauucaggcucugagcuuccagacuguucccaagugaaaguaauguagcaccccaagaaggaaucugaauuuuuaaaaaauuuauuuauuuuauauauauaaguacacugucacuuuugcugucuucagacacaccagcagagggcaucggaucccauuacagaugguugugagccaccaugugguugcugggaauugaacucaggaccucuggaagagcagcagucagugcucuuaaccccugagccaucucuccagccagaggaaucguuuaagagccucagucuccauuucuuaggagguuuuugcuuuuggccaacagauaaaacuugaguaucugucucguggcuuucuaucagaauuauaauuugacuauaauaaaaugccaagaguguuuuugaggagagggagacagguaccaacacuuaacacuucauuucugauagagaacuacagaggcuaacguuguguauaaucuuugcuuaccauccaacgcuagugaugucaucugaaacgaaaguuaugaggacagguuucugagacuuagaaggucccaggacagauucagugaccagguuuucuccuuuccacuuccuugugauguguaaguggauagaaagagaugaugaugucagacucauuuuacagugaccagcuuuccuggaauugaagguuacuggauauuaauaaauuguauguuggagguagaagcuaaguuagguauuuuguuguugucuuguaagagggcgcauaggguucucuggaggugagggcaggagaguagguaggauucagucagguuaagaaugaggacaaaugugucauuucuuuaaaaagcagagccucagucuucauuuguuaggagccuuccucugaaucccugagcgacaucagaucugcaacccucuuguuaacacaagucuucuugaguuuuaggauuacaggaauuaaugcaaugucuuauauuugggaagcugaagccagagcgguuaaaugauuugcacauuuaaguagauugcauacuacuuggcugaggugcaacuaaaccugcaucucucacuucccuaaauacguguugcuuuguuccaucauucugucuuugcuuacccacucaauuagcagauguaauugagggauucuaauuaguuggcugcuaaaggcuuuuguggcuagugucagauuggaaaugagguugguuucuuccccucuauuuuugaguuguuuccaaauuuugucaguuauuguacuuuuaaagucaucauagcagugguaagaguauuugaaugccuuuguuauauaaaucagacauuguuaauacauaccaaauguaugcggucauuagauauagagcagucguguccaguagaguggugacauugcggcuacuacugucaguguguguuuuuuccagaccugugaguuuugacacgacuugauauauuugagggguuaccagcauccuggcaaaccaagcaucccgagaagcagaugcuugggcugcagggcgcugauagaccaccuaugugcuuggccguuggaugguuugguguugcuggcucaugggcacgagaagcuuggggauaugugguguccuaagaucugugagcuaauuuuugguacccuguaagggacuuuugaaggaguuaucuggauagaacuaaauuucuuuccauggaagagaacuuaagggggcaccugaaguucucugacauagacuuccaggcuuauaucuuggagugaucuagagauagagcuucacuaggaagacaacuugccuuuguuuugcuuuguauuuacuucagggaaguagacauuuaugggggcuuucugugaaccccauguucuccagauaguucagaagaggaugaagacucuagcagccuccauuuguucuuuauuucacugagcuuuguuacuggucaugaucuugaacuuuucccaguaaagaguuacagauccugucauguuugagaccugggcacugcuuacauuugaauuaaacaauucuccuuugugauuucuuuaaagguagcauccuccccagcagaaguagccgaaaaggcugacaggauuaucacaaugcugcccuccaguaugaaugcgguagaaguuuauucuggagcaaacgggauucuaaaguauguauuucucaaggguacaguuuuucuugcuguagcucuggguuuuacguuguuaaagcugcuagggcauuuaaacucuauugguuaaauuuuccugugcauuuucuaauuucauaaagugaacagugguuuccugcuuacugugaagaguuaauuuuugcacuagagucaaguaugugacuugcgggacucccuccuccagccuugcuuaacuugcauuacacuuucucacuggcagaaugguuaggagccuuuuaaagcuugcauucuaaauuguaccuacucuuuaaaacaugauuuucuucugguguauagaacuccagaaaagggacucugugaaaaauaaaagcaaacacugaaaagcacacuaacuuaagacuuuauuauauaguaaaacguuauggacuguccucugggcugguccaucugcagggaggacacgaggaagcuggaaucuaguguuagcaguagcccuuugggugacguguaauucccgucaguguuuccuaccagugucuggcuucccugacacuguaagccugcuggugaauugcugcuuccugccaaacccuuguggugugguuaugucagagugacagugguugcauuccaguuuccggcuuucuguuuuguauuccuaacuuacuuugcugucgaguuuaacagagaacuaguacaaagucaugugccaugcagacacuugagucaccacacugauuucuaauaaugcuugcuaaaagaaaggaagauuugcuuugagaaaagcguaauacaaugagauuugagguuugggaaacuaacacacuuguaaggaaaagacauguggauauuagacagaaaacugauaggauaaauguuuaggcuucagggguugguagagucagcggccccacaguguggguggucuugaggcggccuggcugacucgcuacccagccugcuccaguugugcccugcuuuauuucuccaggaaagcuacucagacgugugcagugacacaacauuuacuaauauccuuuacuuuggagcaugguggccaguuaccagaccagcuuuguccagggagggcuuaggaagaguuugguuucauauuaaacucuaauugcccucucagugaugguccccuucugccucccccaccaugucuggauucuuuuucuacacccagugcauuguuuuuaagauuguuaaaggugauaauaccauagaagacugguaguuuuauucauauuuuuucuuuuacauaaaguaaaaccuuuguacugaggugaguucuaguagcacuuggcaugucucuucuguggaguccacucaaauacucuguugguucugucugaaaucuucuugaaagaauucuaugcacugcuguuuucaauagaaauauuuuauuuuccuuuuuagugauuuauuuuuuaaacagcaauuuccccauuuucuguuuuaauauuucuauauauggaguucuaauuuuccagucuugauuguauauccccugagcgaguagaccugugggaagaacuugaggaaauauauagcuggugagauggcucuggguagaacccuugcuguguaaauugacuccacagaguccuccacugucuuccauguguacaaucagaacacaucauucgcacacacuaauaauaaaugagaacuucgggaaauuugcauacaauuguuagcugucauucuugauucauauguuucuuuuuuauuuacuuuugagacagacucuuacgguauugcuuagguuggccuuggacccaccuuguaacccaggcagauauugaacuuauaaucuuucuaccuuaccuucucugaguauuuauuuaagauuguaggccuuggacaccaagaccagguaggcaaauucuaauguaggucagaguuuucuagccacuaggguaagcacugccuuguagauaaaagggaacuguuucagguguauguucugcacucguaguacaaagagaaaucuuuuaugauaaggaugauaaagguucauguaaaauauccaugauccugcuuccaucuuuaccaauguauacauuuuaauuugccacaaaacccccuaaaucuugucaaacuucuagauucaauccuuuauuuccuuuuucaccuguuuaauauuuuguuuuuaaaaagugucuuauuaggucaggaaguagggagguggaaguggaucuggaggcgugauagggaagugggauaggaucaggaaaguguuggaggaagagugagucugaucaaaauuaguuauuugaaagucuuaauaaaauguucuuuuaaaaaauguuuccauuguuaaaagaauauauccucuugaagcaaauagcuauauuuuacuugcuuauauuuauucuuagugaaaaugauauggguaugagaaauuugcaguauagcuuacuaaagacuuaaacuuuuuaagacccagugaauaaaccaauucccuuaugaaauuacuaggguuucaaacuugcuuacacuuuaacuucacugugucagcauggccaguguacuucaccugauccuaggcuuucccaauucguuaucugaaugaguauggguuuacuuugaacuguaauugaucugaacuugaguaaauaaauguaagauuugucaacuguuucaguaccaggccacaggccuccuugacggucuggcuauuuugaccugauucugauuguugcuuaguugcaugaaguacucauucaguguuguaaacuugaauauuuucauuuauacuuagaaaagugaagaaaggcucauuauuaauagauuccaguacuauugauccuucaguuucaaaagaauuggcaaaagaaguugagaaaaugggagcuguuuucauggacgccccugucuccggugguaagugcugucuaaaacacaugugcacugugucauauaguuuucugcuuauccaaaguagcuagcuguccugcuuuugugccacccaagguauuuaccauugauuucagauguguaaagauucuuagucucucauuaagauaacaacagaacagacuggcaugauguuuagugcuuucacauacagcacaguaaguuaccuguaaauuccuguaaagguguuagagcuuagaagagucacaugguuuggguugaguuguugugugguagacagaucacugccuagaaguucaagaacugggucagggaauaauuaguuuggggcuggaacuguaguugaguugguugaaugcuugccuagugcauaugaaguccugguuugaucccuagcacuauguaaacuacaugggcugguacaugccuguacccaucaccugguuggccgaggcaggagaauuagaaguucaaguccguccgucaguacauaggcaguuugaagccaacuuagagugacugaugucuuacuucaaaaacaaacaaacaaacaaacaaacaaacaaacacaaaccauaacaaaacuccagcuuggcugacucuacuguuggaaauugaaaaaguuauuuuaaaaaggacaaaacaagccaggcgugguggcgcacgccuuuaaucccagcacuugggaggcagaggcaggcagauuucugaguucgaggccagccuggucuacaaagugaguuccaggacagccagggcuauacagagaaaccuugucucaacccaaaacaaacaaacaaacaaacaaacaaacaggacaaaacaaacccauccgaccucucaagauauacgcgaggcucaaguggcuuuacaagugacuguuauuaaaacauaaaacaaagauuucagauuucaugugaauguuuccagacaguagaaaauaaggaaggacuuugcaauugauucccaugaaagaucuuucaacucucuuauuaaagcagaucaaaucagcagggagaaugcuagguggauuucagucaggaguauaaaaguucaaccuuuaaagacauaauucauagaucaaauccaaccauaaauaagagaaauaaaacauugcaaguucuguguugccuuuauguauagauggcuuaauguuggaaaaucugcaaaucuaauuuaccauguaacauggcgaaaguuacaugauacauuuugugagacgucaaagacucacuaaugaaauuuuuaaaauuuaauuuuguaucagauaauagcaaaaaugggugugugggaugguugguauguggggauagcaggauugcugguuugguaggauugugggugugauuuucugucauuuccaaaauugcagaaguguucuuguguguauuucugcuuauauauauguaaacauaaguaugcauuuguagcaguaggcaacaauagcgauuuuauuccaauuauauuaaauauaaguuugaacuuuuaaaagaugaaaaguaaaauauaauuuaauucagauuuuauuuuuuauaauugguuuugauauaaaaauuaucuuccaaacuuacuacuauuuguuauugauguuguuguuguugcuauuuuguuuacuugugauagagucuuauguauuaaccaggguggccuugauuccccugucucuaccucccaaacuagaauugcagacauccauuaucauguucagcuucaugucauuuuugaauguaggugaaagaauaauuaauuauuagcccuucuuguuacacugaauuaguuauguaagauuacaguauaaagauuuguagugguauuuaguuaccuuaaaaauuaaaauuuauuauuaguauguguguaugacguguguaggucagaggaugacuuuguggaguugguccauuccuucugucaucaggugaauuccauuggucaugucgucaggcucuguggcaaaugcuuuccucacugagccaucucuagggccuaguuuuuaaaaaagguuugucaguguauacaugguguguaugguguguguguguguuaguguaacuguggguauaugcgugugugcacauguggaggcucuggacuaauguugggagucuccuucagugcaucaggaccuuauucaccgagguaaggcuccacagaacccaaagcuccugaugcagugaguguagcuagccaggaagccgcaucugccgaagugcuaggaugacaagugagcugccaugcucaccugguguuuccuugggugcugggaucugaucucugguccucaagcuugcauagcuuuaugcacuaagcuagcuccccagccugauucagacauuuugauuggaaaauacuaauaauauuggggcuguaaauacaauuaacaaaccaaaccauucuuucuuugaaugggaugauacacaaguucuugcuagggauucuccucuuucuucuucccauggugccacaguaacacugggacuagagaugucugcuaccuuuaccuggagcacucagcagcaaagucauacaguaagagaagcagucagcagggaugggaggaaagcugcacauucugacucaguacugagaaagcaacugauuagggagugagcgauggggucauagcaacauuucucacaguugagcaaacagucaaccaugcacaaacugcccaaaggcuuagggaagcuagguggguaaaggaccggguucccauccucagaacccaggagugugaacggugguggugguagggagggguacacaugcacgugugugugugugugugugugcaugcucaugugugcucgugcauguccagaccagagguugauaguucauauuuucuuccauugcucucuuacuuuaaaaagccuuugguauuucuauauauacacuuuuuuucuccuucgccauguggucucuggggauuaaacuuaggucaggugcuugguggaaagugcucuauccacugagacaucuugcaggcccacuuaauauuuuucacauuguuauuuauuuuguguguguguucacuuuccuguaucacauguaugaaggcagaggacaacuugugggagucaguuuuuccacuguguggauccugggaauugaacucaaguggucagguuuggcagcaggcaccuuuacccaccaaaccaucuugccagcucacucaaccuuauucuuuugagcuaguuugucccugauucuuuaggaaucuacuugucuuugccucuucaguauuggggcuuuuacuugggccuggggauccaagucagagccucaugcugucuccucagucagaaauggucagaaacauucuugucuucucaugaaacaauguuugaguccuaguacgacugugaaugcaucugaacuuguacuguuauugaugaaaagccuugcauagguauauuuugugauaauuaauugguuugacacuugaucauuaugagauuaauuacuauauaauagcaucuuauuuauauuuauaugguccuuucacagauauuuuuaggcauuuaaugugauggauuauucucauauuuauuauuuuuauauauaaauaugguuuguugaaaaugacucuaaacuaagcacacucgugaucucaucaguagggaaccugcggcaggauugcccugagacccaggucagaaugcgcaauuuagagacgcacugucucagaagcaacaacaaaaagauugugcucucucaguuaaauaaaggauuaucuaccugugugucaaauagacagccuuaaaaauucauuauguuuuaaccaaagaaaacgagggaagagggaugugggggaagaacaguuugaucaguuuuggaauauggaguacuucgggucauuugaauuaaaccuuaaauuucuucuuccauuguaucccaggcuuuacaucugaauuagaggcugcagauggauuuugggucauuuccucuauugcuccuuauugauuuuuuuaaaaaaaauuuguuugauguauguguguguguguguccguccauaugcgcccuaguauguauuugaaggucaggagauaacuuuggggguuugcucucucaucccaccaugugaaaacuuaggucagguuagcuuacugagcagucuggcuggccacagucuauuuuugagacagagucuuuacuaaaccuggaucuuugcauuccagcuggccaaaucccuggcaaccuccugucucugcuucccugagcuugaguuacagaugucuacugcaacgugugacuuuuacuuuggugcuggaguuuagaacuuggguccucaugcuucugcagcaagcuauuuaacccacuaagccauguugccauccccccauggggcggggggaaguguuuuaacuaaaauauauuuaaauagauuuauauaaggauauaaauacaaauagaaaugagacaguaucacaauuucuauuagcauuuuaaauaaaagagaauuuuuacaguucagaugauugaaauggaguagcauuuggagguguggguuaaucucccccacccaguacuucuauuucuuacuaaguaauacucuuuuuuaaaauuuauuauuuuuuaauuagguauuuucuucauuuacauuuccaaugcuaucccaaaagucccccauacccuccccuuccccccccacucccacuucuuggcccuggcguuccccuguacugaggcauauaaaguuugcaagaccaaugggcuucucuuuccacugauggccgacugggccaucuucugauacauaugcagcuagagacacgagcucccguguacugguuagcucauaauguuguuccaccuauaggguugcaguucccuucagcuccuuggguacuuucucuagcuccuccauugggggcccugugauccauccauuagcugacugugagcauccacuucuguguuugcuaggccccagcauagccuuacaagagacagcuauaucuggguccuuucagcaaaaucuugcuaguguaugcaauggugucagcauuuggaggcugauuaugggauggaucccuggguauggcagucucuagaugguccauccuuucaucucagcuuuaaacuuugucucuguaacuccuuccguggguguuuuguucccaauucuaagaaggggcaaaguguccacacuuuggucuucguuuuucuugaguuucauguguuuugcaaauuguaucuuauaucuuggguauucuaaguuucugggcuacuauccacuuaucagugaguacauaucaugugaguucuuuugugauuggguuaccucacucaggaugaugcccuccagguccauccauuugccuaggaauuucauaaauucauucuuuuuaauagcugaguaguacucuauuguguaaauguaccacauuuucuauauccauuccucuguugaggggcaucuggguucuuuccagcuucuggcuauuauaaauaaggcugcuaugaacauaguggagcauguguccuucuuaccaguuggaacaucuucuggauauaugcccaggagauguauuucaggauccuccgguaguacuauguccaauuuucugaggaaccaccaacugauuuccagagugguugcauggauuggcaggaucaauauaguaaaaauggcuaucuugccaaaagcaaucuacagauucaaugcaauccccaucaaaauuccaacucaauucuucaacgaauuagaaagggcaaucugcaaauucaucuggaauaacaaauccuaggauagcaaaaacucuucucaaggauaaaagaacuucuggugguaucaccaugccugaccuaaagcuguacuacagagcaauugugauaaaaacugcaugguacuggaauagcgacagacaaguagaccaacggaauagaauugaagacccagaaaugaacccacacaccuauggucacuugaucuuugacaagggagcuaaaaccaugcaguggaaaaaagacagcauuuucaacaaauggugcuggcacaacugggguuaucaugaagaagaaugcaaauugauccauuccuaucuccuuguacuaaggucaaaucuaaguggaucaaggaacuccacauaaaaccagagacagugaaacuuauagaggagaaaauggggaaaagccuugaagauaugggcacaggggaaaaauuccugaauagaacagcaauggcuugcacuguaugaucgagaaucgacaaaugggaccucacuaaguaauauucuuaggaguaacaaagaucacuccccucuccuuuucccaggccgugaaguagcagggugaagguuuucccuagguuggguuuuauguuuauuaaacccaacagaaaugacuucuguauacauuuuuauuagaagcaaagcaauugugacacgugacucacaaugcaaccagccauuucauacuuuggcaugauugaauuuucuggauucuuuuaaaaaagcuuccaaaccauacauguccuuuccagaucucauguucuuuggggguuucugagcuuuaauucucuuuucccucauuuuaggguauauauauauauaaauauauacauauguauauguauauguauauguuauauauauaauguguguguaucaagucuuuuuuuuaaaacaaaacaaauucuuugauuaaauacugcauauauauacauucacguucauccauucccguccuugugcuuuucaggcacugggaagggaggaagaggaaguaaacacugagcugauagauagcacccagcuuaagagauagaaccucauuauuuauuacccucaaaguucuuguuuuaaaaauacaucuuuuuaauuaauacuuguccauaauuaugggagcagugugacauuucaguguuaguguuacaguucucaucagauccacguaacugcagugccugucaccuaagacacugauguuuguccgcacuccuccaucuucacucugacuagauaaccagcguccugaacuuuacaucuuauucuccugcuuuucuuuagaguugaguucauauauucuuaaccuccaaaugguaguuuuacgguuuuucaugauuuggaacauucuagaaauggaaucaucauucuguaacuggcauguugcuuucugcucuguuccugaguugucauguguguuguuagaagaggcauuagucuguccaguucuuugugagaaucagaaagagcugucuucucaguacugaaacacuccuagguaagccugcggagucuggguugucuuugaaauaagagauugcuauaaaauccaggcuggccuaaaacuugguaacuuccugccucugucacuguggcuggaauuacuauagugguggcacaugcuguaccaccacacucaguuccagagguacuuaaaaaaaaaagccacucuuguuuggacaaaugucacccuacaacaggguuuauggucugucaaacaauguggauugaaugucagccucuacuuaucccuuugguuaagugagcacauauaauacaugaauguuuugcuguuacauacuuauuacucguaguucauuaauuuuaacugcuaugugauggucuauauaaauaaccauacuccagccuuucuacuaugaugaacguuuggauuacuuccagggcuuuaaaaaauuauacaguuuuuuauacaucacgggagccugcccuuucagucugucuaguauaauacuggaacauuguuaguguccaauaaauguuuaaaauuuuaggcugaauucaaguggaaaaacaacuaugaaaaacagacaggauaguggugguccccccuuuaucaagugaaaauaauacacagagauguuaaguaacuuauuucaagcuuguaccuguuugguaggaaagcugaauaugagugugauauuuacuucacaguuauuauaacacagcuguguuuagaaacuuucucaguguccuuaauuuguugcaaguagaaauaaaaguuguuaaaucaagaaugcucuuuagagugugaacucauuucucggcuaaaauagcaaauaacugauguggugcgcuguuacaguaaugacauugaaugacugaucuuuaguaucucuccuguuuccacuccugaaauggauuggccuuaaccguauggcaugcuuuguacagugauucauuaaauguuuuagacaaggagauuuggaagcacuuugaacacuaaaaugugccucuuucuaugugggauucuuccaucaacacagcagccugauccagcuuguauaggcacacaaagaaugggugagugugggucugccaucuugaccauccugcccuagucggcgugccagaugacugcaaccucacuggucaccauggaccugaccagcaaugcacuguccaauaggcucagugcaaauugcuuaucuauacaauugugagaaaguaaaagucauggcauuugaguacaugauagacccaguugagucagguaaccaagauacuuguccaggauuuguuagcaagcuggagaaagugauucuguauagaaaucuguuugauuguaguaaauaguucuuuaaccuugucucuauauuucugaucacuaaugaguauguuacuuggcaaguuguuaugaaauacccacauuugcucagaucugaugaaguaguugguaaaugucaauagagguuacuaugcuuuuucaugaguguugugguuaaguaguguguccagcuuuuaagugucucuucugcuccuagaauggacauuuauuauuagaaggaaccuuaugaauuacuguagucugacucuauuauuuuauagauggaaaaaugagguucaaaaccacuaaaugacuugccuggggcuuucugggugguuagcaaaccugggaacaggauucccgucucuaggucagguuggcuuuucuuuuaucugccagagcuccuuccuuuuagugguaucugggugucuucucuuuguccagaaccuuguccuugucauggcagucucuuucugauagcuuuuuuucugacaauuugucuuccccacagcuaguucugucugcuacuuacucucugguagguacugucacaucuugagaaccuaaagggaacugccuugucuucuaaccccuagaggccagcuucuaaccugagccgggcuuuccauuucuucugcagucacuuaggagaaauugguugagaaaacauuauuguguaauuugaagaacugaaaguucugacccauccuacuaauuaguuggagagugaccuguguucucagagagcaugaaguggaaacuuaagaguucuuuggaaagucaguuguguuggaagguguuuugcuggggcaaacaugugaaggagcauuuuccugaaauggacacagguggaggacuaaggcagacuugugaaggaacauuucgcugaagcagacacagguaaaaggagaugcugcuaaagcaaacacaugaaaggacacaugaugaagggggccuuugcuaacaacacgcauguauugguccgccuuacacuguguaguugagcauuuguugagauuccauagagagaaacacaccaaaaaacuucugguagugugcuguaguucauugccacuuccguggacuugggcggauuggcagauggaugucaguugagacagacacauguacugaggcaagacaugugauguuugaaggguauaaauguaggacuucacagucauugauggaggcugaguuuggcuuguauagagcuagcagugcaacacuugugggucuggugucuuugcugagucuucgcuucccugagagaacucuuggcauuccuccuggucccuccugcucacccgagcugaggcugaggcuuggcugucucugcuagguaguggcacugcugcugauucauguuggcuagcucgacccuaucugugaagaguuugugaguggaucaagcugccucugcuaaccugugaacugaacugcugcuuuccagacaacacauauccuuucuuucccacuaccucugcuggguggugggcuagaagggagcuuaaaguguuuaagagccaucauuaaaaauagguuuugaaaaaauuaaaguugcaacagaaugaguggguuggaaccgguuuggggagcuuuuccuguuugagauuacuagcuagcuccuggugcuuacucaagccugcagaggaagaaguaagugcuugauaugaccgggacgugacccauucccagacauaaacccuuggggguuggacaggauugggccugaaagcugaaggacagaaaagauuguuuauuuugcagcaguugagcuauguccacuucuuucuuuugugcauagcauagcaucuauuccauuacuaggacuacuguauuacauuuaugugcuuguuucuucucuuagacuuggacguguguaggccuuauuuagaaaaauaaaaaaaauuuauaucuccaguauauauucuuuuauuuauuuauuuauuuauuuauuuauuuucgagacaggguuucuuuguguaccccuggcuguccuugaacacacucaguagaccagacuggccucgaacucagaaaucugccugccucugccucccgagugcugggacuaaaggcgugcaccaucacgcccggcuuuccaguauauauucuuaguggacauuuaauaaaaacuuaaugaagaaucaaucaguucuuucuuucuuuucuucaugcuuuaccaagcuaccugcugauucauauauauaugaugcugggaaucaaacauaugacuuucucuaccauugagcccacauccuaucccuuuucaagaugguggugggccucuugccuaacguucacaaggccugggauuacaauaaguaaguaaaauaaaaauauuuaaagauuaauguugaacauuuuggguuuuccugcagucauuccucauucuuaaacuguaguauucagaauaguguaaagaggaauacuuucaugaaguuuagaauguaggaaaacauguaauaauuuguauaguugcaaaguguacgcuaauguagcagcauucccaggagcugugcagaacaggaucuccucugcagcacuuuccacacuagccaguugccaugaagaggcacgucucccugagcuguuggcuguuccuguucugauuuuuccuucauaugcugguaugcauauuuauagagaaaccaacacugcauuuaacuuacacagcugauucuauguuaccugaaagaguguugaguuuggaaauggaaaauguauguuaaagauaaguucugaaauccucagaugauuucuguaauaucccaugugaaauacuggaauuuagguuuaaauuuaacaguucuuuagcaaguauuuuuagauuuuuuaaaaaacauuuuauuuaccuugguguucugccuccauggaugucugugugacggugucagauccccuggcacuggaauuacagacaguuacgagcugucauguugauuugaaccuggguccuuugaaagaacagucaguacuuuuaaccauugaaccaucgccucagcccccaagaaguauuuuuuaaacaaagaacgaaaguuggucuguucacaccauucucuuaccacuguuaucccuguuaguaaauugucuuaaggaaggacaaaucucaguaccaggggcuggaaagccggcucaggagguaaaacauuugcuacaaaggcacaaaggucagaauuugaauuuccagaacccacauagaguuuaggugcaguagcacauguguauaaucccagaacaccuaaagcaagaugggauguggagacuggagaaucccuggaaacucaugggcuggccagccccgggcccugucucagacaaggugaugcuguccuccuggcuuuuguaggcaugcuguugaauacaagcacucauacacgcacagacacacacacagacacacacacacacacacacacacacacacacacugaaaagaaaguggagagugagugaaggucuaagaccucuaaugucaacucuggcccacuccacacacgcaauaacucaugaaauuuacacuucuuaucugcaugcacacaaaaaggaaagguuacauuuccuucaacaaaauagcuuacaauucaaaguacuguguuuauauaauuuuauaugauuguauauugcuuuaugcuugcauauucuugcucuguauuauguugguaauacuuugaccacaagggacauaacccacuuuccuuuucauacaguaacuguuuaguaaguucuuguuacauuucaauaugcuuuggauacuagggcuucggcuuuucuucuuggagccuauguuuauggggauaggaguaagcaaauaaagggaaucucaauaauuagugccuuuaaauaaaaguacuaacuagggagauggagacuaaugggaggcccuuuucuguagagugaaggauggucuuucucaggaaguaacauuuaaucagaggagugaguguagagacccaggagaguauuguguuugaggggaggggacugcucucuacagguuccuaugugugaacaagcugggaugauuguggagccuuuaucauucuagcauuaggguacuugguugauggguuaauaguaacuuacuugauuaccauuucuuacaccggccuuuauuuaacacuuugugguuauuaaaguaaagcuaaccaggccugcuauuaauuaauuaaaccgugauuaccuaucucaagcacgcuacuguaaucucuuuauucugugcaaaucaugccuuccuuuaugagacuuggagucaucaugugauaucaaugucacugcgucacaccacuguggguucacgggugucuuuguguggggugaauggauuuguggucacagucuugguuccuguuuaacaggaacucauuuuuggcguucauaugccagauaugaagcaaauuuaaagucauucuuuaugucuaaugaccagguucacaagcugcuagagcagcaucaucaugguacuuaacugugcuuaagugauugccuagggaugggugucuguagguuugcagagagaacuugagaugaagcagcuuugaaguggcacuugcaguucgcuccaggcuucccgugcugccaagccugaaugacacacuuaacucuauuguuucauuuaggaguuaaugucaaaauuaaauaacugcacuuguguguuuguguaacaguucccuaccaggaaaccugauuuuauauucuacuugccuggguucuguuuuaguaauugagauguucuuagacugugaaguaguaagcacaaaaacccauuaaagaguugcccuuaaaguaccagacuugcaggcuguaucucaaugaaaguuucauguagucuccauucuuacuuaaaaaccuagugugcagucguggccuuuacucuuacugaacuggauacuacuguuuuuccacuagaucuguaucuaauuuauaguaaagggaccacaaaaccaaaaaucauuucuguuuuggcaccuagcgcuauuauaguuaagcgucugauggcauuucggucacagcguuuucuuagaaaaguuuacaaccuggcagucuuucuuggcuuuaggcugaaacggugcuauuucuguuucaaagcaaauucuuuuaucaaauuucauagaccugaaugugucugcugugcugagggagagggacgauugaucguagcaguucuuucccugaugcccucacauaugauuuaguuacagggcaugcuguguguggugguaguauuuucuuuaagaaauguuuuacaucuguuuauucauuuugugugaggcauguuugggcaugucccuagugccacaaccuguauugggagcccagagcagcuugguagaguuguuucucuccuuccacucuguggguccagggcaugaagcucagguugugagacuugccauugaggccucucacuccuugagcuacuacucaguaagaaguuucauuaugcaagauaaaugaguucuagaaaucugccguuacacuacagugcuuguaguuauuuguuaagguggggaccagagagugugcgauguaagcaugacaacuauaguucagaucuuagugcugacauacaagcuggcuauaguccugcacagaccugugggcugagggggagacaugaucauuggggccugcuggcuggaaaaaaaaaugugaguuccagguucaguaagagacccugucucaaggaaacaggguaggagagauggaggaguacacccaacacucuccccuggccucugagccuugguaucuuuccccacacaugaguguacauacagaaauaaauaaaagaaaaaggaauauuaaagagcaagauuuauuggcuuaggccuguaauucuaacauucuggaggcagagauaggaggaugugacuuccaggucagcccaagcuacauuugagaccccaucucaaauaaaaacaaacaaacaaaacauaacaagacaaaagaagccaguagugaucgcaguaugcgccuuuaaucuuagcacucaggaggcagagguagaggaagguggaucucuaauuuagaggcuagccuggucuacacagugaguuccaggguaguaagggcuguacagagaagcacagucucgaaaaaaaaaaaaaaaacacaacaacaacaacaaaaaacccccaauaaacaaaaagauugaaaggcaggucuuucauuugguguugcuacugcaaaacagcagcaauaaggcccaaagaugaggcagcuuuggagauaaggguccuuaccaugauaacagugguaggcuuauggguguaugcuuauuuccacacuggucacaguuuauauguucaauaagugugcauuuugguauaucaauuaucauucauuaaauaaagcuauguuuuauucggaaauaaguuuguuaaauuuacauaggucucuuguuuuuacucuucucuaagacaguguuuuacucucaucaggcuggccuugaauuuacugcauccugcuucagccugagagacggaguuauagguaugacauaccacaccugacuaggcuuccuuccuccaagaguuauacugcuguugcaguuucuuuaaaguuacucucuaauuggaaacucucaucuuuacuaacuaaauguaaaaauauguuguagcauuugacuuuagaaugagagccuugaguuacucuuuucaaaaauauuaaauaaaaucauaguacuguucuuggucauguuuagauacuuaaaguuuuaguagcucagauaguuaaaauauacguaaacuuugguaaccaacuucauuuccuuagaaauuucuuaagauucauuuaacagaguacacaaacuugaguuaauuaugucauuucauucucugaaauuuuuauuauaacccuguauccauuaaguauccuuuuugugccucgagguuuucuacaauuugcacagguaguucagaaauauuuguaaauacauuuccaggguuuauuugaaaugagcucugaaguggugcccauaaaaauauuuucauauuuuuuggcauacugugaguguauugcaauagcugguguaguccccucugaguuuuaaguucuuuguuuguuuucaagacagggugucucuguguagcccuggcugcccuggaacucacucuauagaccaggcuuggccucaagcucagaaauccaccugccucugucuccuaagugcugggauuaaaggcguguggcaccacugcacggcgaguuuuaaguucuuaaugcaaugaaacaggacuacugacuguacacacgauagcacaauucagaagcucagauaguuugcaucuugagacaagaaugggaggagauauugacagcagagugguugcucagagucuccauuauugcuaucacucuccauugcuacggccgucacuguuacuaguacucuucuuccauuccguacacguauucuuucauuucgggauuccuuccucucuaaaucugaaggcuauauuugaauuguguuguaauuuucaguuaaacacccacucgcugcagcaguugcuccuggccagcgccugccaaugguggagggaccaaugguguucuuacauugcuguggugggaggcacaucaguaaggcagggguccugccuggagggauccugggguauuuuaaaugucuuuucauugccauucaggauguaagucagaccagacgcaguugggucugcucacacaguuaggagugccuacuucuguuuauguaagacugaaguagauuuagcaaauaagucuggagcaguugcuuguguauaauauauuauuccucaauguuauugauuucuaagcaccaugaaaucaguucuguuugcuuuacauagccuuauuuuguuagaucuggguguagcacuuugggagaggugagagaaaagauggauuugagaauuugauaagggccuuguuacuaugaaaauaguuauuuucuugagaugucugauuuucacaaaguaauuugauaauguuggcagauaaaaaguaccugaaguuaaguuuaaauuagucucuuuguauuugccacacaguuguagguuuuuccuuuauuccuuugaguguucuauuugggaauuugccuacagauuuuuaugauaguuuuuuuccuuucugcugggacaggaacagugggcaugucugcucuuuccuuacucacagggauuucagccugaacugaugguggacuguuguuuuguauuuagcucaaauuaccaucaaggauaugaaaacuagauguuuugugugguuuuguuuugcugcccucauuggggaaugucagcgucguggcugacacugcuuuguuggguuaaagcuauugucaccauaucuguuuaucccucacugacucugagaggacaugauucuuagagauuuuaaaaauaaaacaauauaaagccuggcacacaaguaacuuuagcauuaauaaauuuuauugcuucuaauucuuuuaaauuugagaguaauauuuguuuucaaacagcuaacauuuuuuaauauacuaagaguagaaaaauagucuuggcagacacuguaauagguaauuggcuuuucucgccaagauagguuuauaaaacuuucugaaaauaaagaaauagagggaaaauauuuuuucuuuuuuacuaaugacauauuaacccuuuguuguagguuauagaaugucuucauuuagcauucuuuuguuagauaaacagcucaaaaaaagaauaguuuauuucuuguaaacacucagauuguugaaagaacuauuuugauuuaaaauccuguguagagaugagauuuuucuaaaauucagaaauaauuuuaagaaagacauaauaguaacuauguaacugacuuuuggaccugggauuuguaauagcaaacuuugaauuaguacuuaaaaauauuugaugauaucucacggucuuuaauugguuugaacuuugauauucuuauuaguacucauauaaaaacaaguuugcaugauccaacaucuacaucuuagaccuugcacucugucuacgcugcaacagugaggcuaaugggaaggaguccauaucugacucagaagaagcaggcucauugcaggcuugaauaggguggcaagaccaaccaggacuccaagcuugugggaagggagagaaaagcuuugcccuucucuguucggcugcuggguuuguacugaaaacuguaaaguuaaacuuuuuggaaucguuacuaucccaagugggaauauaaacuauauugaacaaaauuuauuuagcuuguuaaaaagucaacauaaaacugugguuaauuaguuuauauuauuacaucacuuauaguagaggcucaaacuaguacccaguaagaggagcugccucaggugagcugcccgauguuuguauggggcuuuaagauaaugaugaguuuaaauucccucuuagagcuaagugagaauaaaacuagaggcaauaaauauucuuggccagggccauuaaaugaaaaagcugggaauucuccagcucuugacuuaaauuguuuguuuaucagcuggcgccuagucuggagucaagagcuggagaugucuaucugugacagaacuuugaaacucuugcaggacacuuucauuucagcugaagguaacuugaguuuauagcuuuggcuuuaaagauuacuaaugauuuacucauuuccuuacuauuuaaccagaguggacuuuuucccaggaagggaucuguguuuauuuagggcuuuugucugcggagggauuaaaaggcagcccaccagcauugugaacuugaugguaauaaaaggucaccaaaacacaccauaaaaacauucuuaccauggaauuaauuauacaguguaauuuuacaaagcaacuugguuaccccagccuuaucccccuuccuaaacauucucuuauuugaaaugaaaacuuaaguacaaaauugcuuugugaaaaaauguauugcugcuuuuauaauuuaaagacugaggaaaccaucaugugcauacaugcaguuaauugcuuagaggcuuuaaaguuucuaaauacauacgauuuuucaacgguagaauaaaaauucauuugggaggacgguagaauaguugaaagauguaguugauauuucaaggaaugcacgacuucugaacacauaugcccugcuaagaguuuaucugugccaccagggggcauugcaugcaaaccugcuugugagaaagggaggguuuaagauauuuuuuguuugagaagauguaagacauuuccuagauuuuugcuuuugaaguuggcuuaaaaauacaucugauaguaagcuaauuaaguguccacagagaguugaaaagacuucugaggguuacagauaauuuauuuuuagguugauucugaaaguaaaucaaaguggacauuuacagagauuaccuuuuuuaaagaaaauaagaugaauaugauguuuguugcuguuagugauguuaaacuguucuaagaagaagggauccugcuuguaaaaauccucgaaaauauuucaaaccccccuagugcugcaaauuaacccacaccgucaugcacacaugugcacacacacacaccacuacaccacaccacaccuguuagaaauguuuguuggcaggcuguacugaugagccuuuuugagaauacggagagaccuuuuugaaagcugcagguuggcccuuacacaagccugacugugggacucauuaggcaguucaugcucaugucuuaaaagcuguuuuaggaaaauaaguucuuaaguuuccuguacuggcuuucaacgaaucuuuauagcuuuuuugaauuagcucauuuuaaaaaggugauaauauaaaacaaaaaagcaccucauuauaaauuuuauaaaagugauauguuuucauuaaacugaauaccauguuguauuuuuaugagccauuaaguauaaauuaauaaaugguaccaaaaccaauugaauuauuuaauacaaaugucuaguuggaagaaaugcaguucccuguacauuaucuugauuuuuguacuuuaaaaauguauucuugccauguagagguggcuaguacuuagcuuugcucucugcuuuaugaaguuuacuuacuguaugcacuugccuuuucucggaggcuucuugcugugugaagccuagccacugugaugcugccguuuagcaacaaaguaaaaccuuucccucucacacgguaaauuauuaaagcucuuuccucuacuguugacucuuucuuauauugugaauuauuugguuagcaugugaguugcacuaaaaguaauucuauuccauauuguuagagauuuucuuugcauuaaaauaacuucacauuugacauuugaccugcauauuuuacuuuuuaacuugauacaacagucugcuucuuggcuuuguuguaugcuaauauuucuacuuauuuuacaucagaagcugcugugguuuuucuguaguucuauaauugucucugcuggccaugaauuguaucuuagcuugucagaauuucuuacccaggcuuuugugagcuuuguagccaacauuuucaaaaagucacauuugacacaguaaacuggguuaacaaaaaauguacuuauaaugauauauauauauauguguguguguguguguguauauguauguauaaaaugccuauaauugaagcaggcuucauggcuuaucacaucagcuuuauguauuaaaagcaaguaaaugcaaaucucauguaauaaaaaaugauugucaccaaugacuauauuuuucuaguuauuucuauugaauuaacuguuucaaugaaauucuagaaauuaauuuuuuucauuaauaauagugauggggagaaauccuuacucauuauauaugugauauuuuuuaaugaagcauauagauuuuugucugcucuuguuuuacuuggaaauaguugaccugagcaaauguuaccauggggauauccauuuagauauaaaagagaagacugcguaauguuggaggaggggcaauacacuaaaauacugugggccuaggugaucugugugugggugcccaggugaugggguggggugguuggcucaaugagaggcaggaaggaaacaguggaaagagcaacuguuggucugaaagccauugaggcaaauguucgcaaucucauggaugaaaggagacaguucaggauugaaaguauauuuaauuuuucauuugcauauguuauguugcauacuucauuuaaaacaccucauucaugagaaguauauuuauuuaagauaaaacauguuuaacuuaguuaaauuuguuacuuuaaaaguuagcauuuuggucuuugaaacagcuuuaauuauugaagaugcccaucauuguauuucugaugucugagauaauuaaaugacaaguuagaagacaguuauuguagcuuugaaaggaaaacuggcauugagauuuauagaguuuuugauacuugauuuuaaaaauuagacauuuuuaguaauuguuuuuaaaagauuuauuuauuuauuuaauguauaugaguacaccauugcucucuucagacacaccagaagagggcaucagaucccauuacagaugguugugagccaccaugugguugcugggaauugaacuuaggaccucuggaagagcagucagugcucuuagucgcugagccaucucuccagcccuuuaguaguuuuuaaguauuagccaagaaaauaauaauauucugcaccugcauguuuaguaauaauaaaagcaaaaauaagaaaugacaacaguaagaccaaguacuagauagauuuaagauucugcggauguagaauaauuagguguaagugcugggaaagaugauuagagaccaacgaaccuuaacuguaugcaaaguaauguuuuuaguuauuguauuuaaguaugaaaagcaaggaagcugugcccagguggggaauuaggggaaggaaaaggaucauuaccauuguacuugugcuguggaugcuggcagucaaauacaggaggguaugggguggggcgggguggggugggguggggugggguggggugggguggcguggcagagauuguuucaauuuaccuguuaaucuauccagagaaaaagucaggcucuugccaagguaguaaacaaccaaaaguuuuaaaauuaaauggaguaauuuaaaagcugugauugugugcaguugcuugggaggaggagggcuaaaaaugacaaaacugccugguugggccuggcugugucagguacaguuaaccgcagugggaguauuguuuucaagauggaguaaacagugcugggcucuguggguggggguguugggggaugggucuuuaagaaguuauugggaugcagaagguuaaccaauggacuuacuuggcauguaaaauauuagguaaagguauuagccuuuacaaguucugcaaccaagauucauauuuacauauguaaaucccuguuagugaugaguuguauugcuggauacuggaguguaucuuuauaaucucacacacuaaaauucucauugaugcuucauagaggcuuccccucccuccucaacugaccagauacaauaacuuaaaacaaaaauguuuucaguuccuuauaugggguuuuuaguuagguaacaauucuuuccauguuuugauaguggaacugugaggggaggcaucagagugguaguaucaguagaggauggaauaguauuucugcugacuguguaacuaaaacacuacaaagcccuuuccuuuaucuaguaaccacacagauuuuaaaaugaguauggugacuuacaucugcaguuauagaauacaaguggcugggacaaggagauugucaagagguugaggccaggcugggcuacguagugagcuccaggccacccuagacuagcugaggcauugucucaaaggaaaauaaaugugcuaguccuaccccgauguuugaagaugcucuaccugaaauguuucuucccagaaucaagcuuacucucagccucuucacucagcugugagaauccauacuucauguugugguucacaucuguagucuuagcucuccggagacugauguaggaggcuugccaagaguucauagccagccuagacuacuaacagacuaaauuuuaaaagugcacaaauuacucuacaugagagccccauuuaaaaaaaaaaaaagcuuaguauuagacucuucuaugaaaccucuuaaagugauuucaacuauacuuaaauuauaaagcaauauacauuuuaauuuauuucaagauugucauauuuucaaugcuugggguugguuaggugcacagcugcccaauucuuaagguaauaauccugauacggcugguuuugugauugauggcuuuuccuggaagcacagcaguccuuuggagugaagacugagaaggcccuucuuccccuugugucgcauguucaaaagggaaacaaaccagaaauauuauuguaguuuagagcaccaagaaaaccugcuaugaguuccuagguuauuuggaaauaacauaugcagguuuuucacucucgaguuuucugcuuacaauauaccaaguuauuuccagaaaugcugugacaugaaagaaaaggaugagagaggauaagcaaaaaaguucuaggggaaaacgcuuucuuuuuuuguguauguauauguauacuuaugugguugcuggugcgugugcgugugcgugugcguguguguguguguagaggccagacacugaugcuguuaggagucuuugcucuuccaccuuacucacugagacagggucucuuggucaaacuaagagcucacugacaugccaagucuuggcuaacaggcugcucuggggaucaucugucuccaccuucugggcuuggguuucaagcagacugccaagccuacucaucauuuaucuggguucugaggaucagaacucugguucacaugguuucaaggacaagguugguugguugguuuguucuaacuacaguaccagcuugccagcccuuaaauacagauagauauauucugacugauuccuucuaggggugauaguccaaggaaauaaugguuauuacuggguagaaaguuauuuuuucagacuucauucagcaacugaugggagucgagcaagcaaacauuaggcggagcuuaggcauccuccugaggaggggaugaagaauuggaggaaccacaggggucagggacacaauaugagaacacagcucacagaaucaacugacuagggcucaugggaacuugagggaucagggagccuguaggggucugaccuagguccuuuacauauauuguuauuucugaguagcuugguggauuuugugggaauccuaacagugggagcaggaacuguccaugacucuugucuauuuguugggacucuuuucuccugcugguuugccuuguccagccuugaugcgaugguaugugccuggucucauuguagcuucgaaugccauguuugguugaugucccugggaggccugcuguuuucugcagucaggagccugggcaccuaggggaggaggaaggcaggaggggagacaggggagacacuguggucaauauguauuauauaagagaagaauaaaaaagaaguuacucauuuaguuguaaggagacuugaaguuuagucgggacugcuuuuguguggcuuugcucuuucuugcaggauaguaaggguccuuuggugguugugugguuauggguccaccaagagcgaagagugcaucagugcuagcaccuuuaacugcaagaaugcccuacaauagcaaguuucuuuaaggggauaggggaaguggacaauucuuuauuuucccauguguugguaacacccacaacuccaguuccaaggguuuggugcucucuggccuccucagacaccuacacacuguggcauacacagaaauaaaauaaugaguacaucuuuuuaaaaugugauuuuuuuuuaaaguuaaagcgcaaauuuuugagauggugaauugugauuuucacaauuacaacggauguguuaauguguaccuaagacaguguuuccaggaagggaagaugaugugggaaaacuagugauaaaggugaaaacagcgaggaaugcaggagaauucuauuuuuauugaauaaaggagaagguugggcaaucugaauugggagaaaagaaacugcucacaguggcuuucuuuuuucccuucagauagugcuucaccauauagaccacagcaaccccaucacauagcgccucacuauauagacugcacuugccucaucacacaauguagauuguacuugaaauuguccuccugcuucagccuccugagcucagagaugcagcuguauaccaccacuccugauuguuuaaugcuguuguuguuacuauuauuauuuaugauuuaugguggacuuauuuguagagacuggacuggaguucauuguauagacuagccugcuucugucuccugaguucucggauuacauguuucacauuugcucuucugaaugacaguuuuggcacuacaccaaaauaaaauguuggcacuaauguuaauuuguaguaugugucugucacaugacucagagaaucugaaguugggaagguuacuguggaaaugagcugucugguuucacagccugacauuucccuguccuccacuguuaugacuguaccucuugacuugacucuuccuucacaccacaaaaagauuuuauugucuaagaaauaaauuggggguggguaagggggacuuuugguauagcauuggaaauguaaaugagcuaaauaccuaauuaaaaaaaaaugaaaaaaauaaaaauaaaaaaauaaaaaaaaaaagaaauaaauuggcuuuacuguuauuuuuucucauuccauaguaacucuugaauuuaauuuucauugacaaguaaaaugugaauggcauaccuuucguuuauuuauaccuauuuuuuaaaugucuugaauuuuuaugaugucauuauaauauauauuauuauaugaagaaccaccagacauuuacuuauaaucuuccaugcaaauucuuuuggggagaagaaucuuuacuuaaaaagaacuaagcuuuuaaguuaauacuauuuaauuuuauuuauauuauauuguuuuguuuauauuuuaauuucucuuuaugaaguuuuaaaacuaauaaagaauuuaagcacaaaggauucgagauaaaguuuaagauggaaaauauaucuaauugcauguaguuuuuuuucuuucuauagaacaguuccuauaaauauucuuuccuuuuggcccucccuuaaauuauauuagauuacauaugaagaagucauuuaaaauacaucuuuguuuggccugcaggaccacagcuuugacuggauugaaguuggaguuggcaugugaacacgucuuuguugauauggugcuugcuuucugaagggcucuucaauuauucccuuucaguaaugaucuaaagggcuggagagggucaaguaaauguccccuuaagguguucugcacugaaccuuuaucuggaaggacgaugauguugcgucuggucuguccugacucugcuggagcagacucugcugugcuuuucaguagucaguggaugcgucacuucugaagugaaauggugguaaagccgugagaacaaagucuggcuuccugucuuuguugguauuuguggguuccuaaucuccuaagcguccugggaugcagaucugugcauccacagcagcaguuuuuauggugaggaagggggggaaaagauaguauugaagcaauuccuguccaggucugcaaagagcagauugcauuucgcugucagugguguuaaguuuauggccucuuuuugggaaagugcuauuagggguuuggagaccuuuaucuuccucuguuuugcugucucggauggagcuguucucuggcauuugcuagguaugauaaaugcuguacuaaaacuccuuggguaaagucugaucugaaaggauuacugcuucuuucuguuuccugaaaauggaaucacagcauucaaaucaucaaacaugcugcuucauccaaucagcaggaguguaucccucuagugucuuuuaaagcaguucagggauacaaaccacaaacgacagccaguuuugucugaaacaguagcaguggcagagagaccgccagaucuuuuugaccagaacuuccaaagagaaaugacuagagacuggaggacugucuuuuucugucuaagaagaaggaaaagcagaaaaucucuuguaucacagaaagauugguccagggacaaaacuuugaggucuuugguucacacauccuagccauucuuaguuuuauuuuccccagaaguuuucuuugugaacauuucuuauguucugggauaaauuccacaucugccuuuguuguuuaguuaugauuagucugacuaaugguauuuuaaguuaacugaacauuuaguagcuuuugugcagucaugauuuauugguguugguuguagauguuagcuuuucuccagcuauuggguugaaauacguuucugauugaauucuucuaacaaguaaacuuguaaauaaaaacagaaaaccagacaguaauuucuucuuucuuggguaguucauauggcaaaugauuugauacaagugaggacauauacucagcuugagcugaguauaugggugaucuauaaauuguuauucuuccauuucauuuauauguguuaguauuuccuuucuuuaacagaggcaauaaaaaaauugauguuccuggcucuguaacuccuucuucaagcuucuuuauauuuuauauuuuagcuccuaugaauuccugcuggugauagauaucaacauaagaaagauaauaacaauguucauagucguuuuuguuggcggcggucgcugguuuucuuagugcuuacagugugaucccagagcucuugcacaugcugcacaagcucauagaacugagcuacaucuuggcuuuuccagacuggguaucauguauuacgagcagccuugaccuuggaaucuucuuuuuaaaaacuguauugagggaaaaugauaaucugugcucaaaguaacaggugagggaucuggaaguauaauucauugguagacaugcuuaccaggcccaagccuuaguuucagucagucugaagcauagagaagagagagggaugggggagauagaagagagagaccaugguagguggucuugcggaugucuagaguccacucaguuccuugacugcgguuauagcacaagagauauagcaugcagaggcaucuaauugguagggucuggcaguuuccuucauagugcuauagcccaucaaucuguuggaagauuggugacuucuagcacaauguuagcuuuuacaggggugucaggaggccugcugcauuuucgggacuccauaauaaccauuucuuauccuuuccuuuucuguaugaauuccauuuuaccuauaaauacugcuuuaaaaaguaacucauggucacuuucugccagguuuugguacacuguuggugaaugugagagaugucuguucucaucagugcuguaguccauguguuuauguuauuuugaaacuaacuuaaaaucuuauucagaauucaagguauacauuauaaacauugauucauagccacugaguuuaauuaaugcuuaccuuuuaaauuuuccucuuugcuaauauuuuucuuuauuaaguggaaugaagaauuuuuaccucuguucuuaaagcuucugggucaguguguauaguucuugcuuagcauguaugaagucuuugauucaaacucagcaucuucuaaacuuggcguauucagggaauggagacaagaaucaccaguucagagucauccucuacuaacaccaagcuugaggccagcccauguuaccaaauacacacacacacacacacacacacacacacacacacacacacaaacaauauuucuguauguuguaguuuaagauugccuuauguacacuucuuaaaaagaaaauuggauuuuuuuuacaacucauuuuacuauuuacaaugucuuauaguauguaauagauaugcuuuauuguuuucaauacuacaaaguguucuauuauauggacagccuuacuguuacaaaagaagcaacucuaaauauacaugagcauagauguuuucaaguguuuuucuuuaaaaauggaaaugccaggucaaagaauauaucuuauuuauuuauuuauuuauuuauggaucugucuggcucugaacguggaguccuccugcuuauccuaccuacugggugcugggccuggggcauguacugccucagccagcagaggaucugugguuuggguuuaguggagguuaccggguguuucagcaguuuacacacuauuggaguaauacagggagcuaucugaucugaguguguuccucagauuucauguucugggaaacucauucccagggcagcggcguggaaagggugggccuggggaagguguuuggguugugagggcacugcccuuggaaauugguuaguccauuauggaaggcucugccccagggaguuuggucuauugcucuacugccuuucuguuucugccuuguugaggaaugguguucuuucccucuguaggaugcagagauccaccaucacuaaccacaagccugcuacugcugucaucuugucauuuucuguccuccagaaaucugagaaaguguuuuccuguauaagugacccugucucagauaaucuguuguagcagcacaaaguaauagagaguauuuagucacacuuggaagacuaucuaaacaguucuacucucaggggcuaaaaauuaugucauuugauauuuuaagagugucuaugcucauucauucauuuagcaauuacuugcaaaguauaugccacauacuuaguauuagucuaggcuagaaaccuaggaaucuagcagagacacacaugcacacauagacauacagacacacacauagagucacacacagacacacacaaacacucacauauacuuucuccauggggguacucuuguacuggguaugaauauguaagggaaaauaaaaaucucagaaauauauacugccagccuguccuuuauuuaugguacuucucaaaaacagaaauuugaaucauuuauauaacuggacauuuugcuuuguuuuaccuguuacagcuucuuaguuuuaugaccuacuuaaaaagacuuugcccuuuccagagaauaagauauuaaaauucauauauauauuaucuuaguuaugguguuauuuuuaaaacuuuuaacucuucgaucuauauguaguuuauuuugauggagggaacauuaguagcgauguagaugacuuuuuucuuuugaagauccaccuaaugggggcuggagagagguggcuuagcagucaacagcacuggcugaucucccagaagccccaggcucaguuuccagcauagaugcagaagcucacagcuguuagcaacuccaguuccagaggcuccauugcugucuucuggcuuccuugggaaaccaggcauggaugugguacacagacauacaugcaggcaaaauacaaguacacaugaaacaaaaacaaaucuuuuuuaaaaguccacuuaaugaaauaaaaaucuuuccuucaccaauuucaaauacucuguuaauuucaugcucaacuuccauguauguucuuuagcucucuguaugauucugcugauagauuauggcugauucuuuuccuagaggaagguuuuauuuucuauugcuuuauuaucuagaugggauagucucucccuucaucccccccacucaccccuugaaacucagaauuuuuccaaaaaacuuuuacuugguuauuguuccaaagaaauauaggaguaauuuuauuauguucuucuuguuggaauuacauggacuuuauagagaauuggcaugauuacaaaacuuaaguguaccuuagagucagaaggggaggccggccuaagcccuguuagacaugcugcucauuuuguucuucauggcuagaacagcaagaagccauaaacuuguaagcaggaaggcacugugaccauauuagcauuucuaaaagaugauagcagcuauagugugggaaacacucagacagaggguuaggggaaaucuggugugccuggggacauuccugcaauaguccaaguacacuagaaaagugauaacaugauuuuccguguguuugucuuccugaaguagguuuuauaagaagguagccugugaaaugccgcagggauaauggagguuaaacagacccgaugcccguacucagguuagugccagcugucacucaucgcuuuucuguuggcuuacaauucucuuccuuuuguuucuugacccaaggaagcaucagacaccuguuuucucccuggauuuauguucuguauucccuuuugaagauguauuuuuaaucaaugucuauuuauguguaugccacauuagggucaguggucccagggaaggccaggggcauugaaccccuugagcuggagucguaggcaguucugagcugccugacuuggguaagagggacugacuugcauucuucaagaaggaugaccgggguucuaaccaccuacccugucugcugcccuguucuucauucaacacccuuuauccagagaacacuuacugaggauuacaguagucuuuuuaaucuguuauuugaauggcuucaucuugacucauggcucugcaccuccuagguuguaggccauaucugaugacuauucuugcuggcugagucccauggcuugucagcuacuacauggcaagaguugggaagcauacucaugcgccucuucuguucucucucccucccagaaaacuucauaccaguguucagucaugacgaugacaacauggcaguguucagucaugacgaugguaacauggcaguguucagucaugacgaugguaacauggcaccuuaccuaguucugcucacuuccuagggggccucgccucaaaauaccauguuuccucccccuccuccuuguccuccuuaucuucuuccuucccuguuucucccucuccuccuccucuuccuccuccuccucuuccucuuccucuucuuccucuuccuccuccuccuccuccuucagcuuuugugcucugcugggugcugggcaaagcaaugaauggacuuccaaggugucaguuuggcaacuaaauugauguacugaauuucaagagaacagauuuaguuguaucuuuagauggaaacacagccuucuguuuuauguauauggaaguaguugcaagugguaaaacuaaaugaugcugccucugcuagguggaaguaaucacacuuguggugggcuuggcagcucuauaggugacuuauguggcucugaaguggucuuuagccaacuguucuuacucuagugagaaguuugagacguggagaaugugugugcucacuccugcuugcugaggccagaggcagaaguuucauguuuuccuuuaucacuuuucacauuauugugagaguuuuguuuuggaguuugaaacagggucucucuacauagcccuggcuccuggaaccgacuacauagaccaggcuagucucaaacucaaagagauccuccugccucugccucccaaguacugagauuaagggcauguauuaccacaucugacuuguguaaguuucucucuucuuuaaaaaaaaugauaauuugaauuguguuguaauuuauuuuguauggcaccguuacuuaagaaaagccuaaugcuaagcuuacauuuuuuuaauugaagacuuaaacaagagcauguaaugcuauaauaugaagguaugcauuuauaaaaugaaaauuuauguugggucuuuuguaauguugguagauuuuuguuuuggguguuuuauuuauuuguuuguuuguuuguacuauguauuccuccauuaauuguuuuuuuuaaagguuacauucaaggauugaaacucgaguaucucauagaaaaacuggaaguaaaauuuuacuuagccauucauuauguucuuuucuuaaguuuuccaauuuuaaaaaguuguuuauuaauguuuuugcauuuauguaucugugccugcaugggagaucagaagagaguguugggucccuugaggcuggaguaauaggcaguugcaagccacccaguguugguucugggaaucaguccaggccugcacaggaucggaucaacaagcacuccuaaccacggagccaucucucuggccucagugguugcucuucuaauacgaguugcuacuaucaugguuagacuugaagaacauagcauuucugguuuguagaacuaaguggagccuguaucugggacuaugaaagaauuagggaugccuuuggaaugcuguaccucugaaauauaguaucagagcucuaaagagguagaggggguuaauuagaugcuuuaaaauccgaaaauugguccuuguuguguacaguacuuauucugugcuggcuuuugguucugaaugggaaaccuggguucugacugcuucugaaagaaucagaaaggaaauguugagaugguuuggaaauuaggagacuucugguuuugcuauuuuaaaguagaaagaguuacauaggcaauaaauucugaucauagaagagagagcaaaguauuuaauuccagugaggaagugaguuagucauagugagugguuacuuacacugaaaaucuggaacuggguauggugacucaugccuggaaucccaaguguucaggaggcugaggcaguaggaccacuagcuaguucugagccugccugggcuaagcagugacaucaaagcuauccugggcuacaauagugagaucuugggggcaaggagagaaaagggggugugcucugacagacuaguucaaagacuaaucuuaguuuauugagacuucucuguccauuauuaaguguugagaagaaauauuuuaaaauauccuaaauuauuccuaauggaaauauaagcuuuuguaauuuuuaaagguaauaagagaaauauaauuuaccacaauggaaauaaacuuugcccucuuuugaguauguggguaggaacaucccaugcugguauaaccaguucauuagauaaaaacacaucuuuucaguguagccacauuacuuaauguagucacagucccacauuuuaaaaugucacuuuguaggcuagauacuuauuccuacagugcaaaugguaauaaauauacuuaugccuuuaaauacauuugaaauuuuugcuuucaauuucaacuuacauaauucucucuaaacuuuagucucugaagaguuaaaagauguugacuuuuaaaguuacuuaaauuuuaaauuacacaccuuuaaucccagcacucaggaggcagaggcagguggaucucugaguuugaggccagccugaucuacagagugaguuccaggacagccaggacuacacagcgaaacuaugucucaaagggcaccaccucucaaaacaaacaaacaaacaaaccaaaacuaaaauuacuuaaagaugagcacuugaaaagcagguaccaagcaguuuggguuuaaguugagcauagagguaccaugcauuccucucauuugaucaagacaggguagaaacaaagaauauaagcucuugggcuuaucauauaucauauguaauuuaaaggaauuuuauuaucccuagaaacaaaauuagagaguugugaauuagugaaacugucuuagcaaauagagugaucucaugguauauuuuaagaugcugcauuccaauuuaugauaaauuccuugccugguguaauuucuuacccauuuuccaaguucacuuagaaagugaaacaaacagaaaccuggcaguagcagcagcauugauccucuagucccuaggucuuuaaaacucaagugugacugugcagucagcagugaacggcugugacugcuacaguaagguucuugaacaguccuacuccacuuacaggcuuuggggaaaugagguccagauagcccuuuaaauaaugcugguuguauaauguuuguaucauuuugugacuggcagacauuuauauagguccuuucuuuccuaacugcuggacuuagauuguggaaacugugaaugugaaaauaaagcuacugauaagcucaucuuuuccccuucucaguauauuuaaguguauaauuuuauagugacauuuuuuugggccauuguggagucuccccucaauuaucuuuugacuggaauagaaauaguuaagugacuuugaaaacuuacuucccaaguaaucuucagaucagugauuaguuagagugaaucauuaaagggaaacgagagaaaccucaauuuaaggagugaggugagguguguguagaggguucauguacaggagacagugcaggggagaaaggaguuuagaaagggaaggagccaagaugaacuucaugugguaaaaagucuguccuuguuuuaaaauuuaaaauuggauauuaguaaguacuacugcagcuuuauucuaauaauuccauuuuugucauuaaaauuuaagucucauauuucugguaguaaaacgaccucagucaaauguaggaacucugcagcuugaacaccucucgugucugauuagaagguuuuguauuguaauuaauuuuccucugagcucuguguggagaacaggaacccacugcagagagguuagaauaccguggaguuuagcugcucugcuuuaaugauacaagggcuagcaaagcaagaauaaaugagguacuuuuuggggaagaaaaaaaugugaacugacugucaguaugagacggguucuaggagcacuuagccagcaguuacagggcacacuugaguaauuggauuugcauaacaaggcuugccgaagagaucugacagcauagagauuugucuagcuggagagcuccagauggacgugaccacgcagcagcugggcggcacguugcucagcauggacagcaccgcccagacuggcagcuggacccuggcgacugcagggcuguggcaggccagcugguggcuucugacagccaguggcccuguuagagagccuuuucauaauggccugucaggguacuggaccugcagggacuggcaggacaaugucacaagucaccagugagggcuguugagcugaagucccagggaaguagaggugcucacuguugcagccacaaggcuagcaccuccuggugugauagcuccguguccuagggagacugugaggaucagugggacagaaguggacacaucuugugaugcuugucuucuguccuuguauauuugcaacaaaggcauaguguucaugagagaaaacauguuuaaagcauaccacacauaauacacauacauagaacauguacagcauaaacugucacaagggucaucaguccauucaggugacuuuccccaacucugugucuagguggauucuauuuguguggagaaaauaaaccauccaucuucucagauuugaaucagcuuggaagaaggcuagccuugagacugccaucagugaauuuuacauguguacuucaguugagaauuuugccaucuuauauaauuuuuccucuaaacuaucugacaaaauaccauaacuuacuuuaagagaggaaaacugcuuaauaaaaugaaaguuuugcuaaucuaagccccaaagcuuuugguguaacgaaauucuagugaaacagaaaagcucauauacuuccuuagacugucaguagcauuucaucuggcccccuucucucucucucucucucucucucucucucucuguguguguucacucuuuuucuuguauuuuauuuaguccuuauguuagcucagagaauuagacaggguggcagauaaaauaucuauuuuaauagaaugaaauggggacauaaagauggcacauaugcauaguugccuggcuaguugugaaacagccuaccugcacuugaugacacagggagugguccaaaaaacgccacaacuuuuaaaccuuuaaauugacaaaggugugugugugugugugugucuguauuagcaagggcuggguaaauacauaaauuuauagacaacuuugggaaugcaaaauauuucagccaaaucaaaaaacaguuuaacaguauguaucaaauguauagaaacacacaauugacuuaguaauucuguuucuaacaaauuuaucacuacguuaggaaugcauauaaauauuuaagugauauggaugaauuuuuagcauuaaaaccccaggccucacauacacugggcaagcucuuuaacugcuguacucuacugucccuaacucugagaauacugguucaugaugugcugcuacccauagcccuuccuuuagauggaccauaaagucacagccguucuccucacaagacagugagccucgugaaaggaauaguaggcacugcugucucuaagcaugagucaggauggccaucuuguagguuuuguuguuugagucacggucauauguagcccaggauugggcuguagcuugaggugaucuugaacuucugacccuccugcaucucucucccaagugccgagauuacaggggugcaguuccguuuauguggugcuagggaucagccccagggccuugugcacacuagacagccguucuaugagcugaccugcguuuccaaccccacguuguguucuugguucagauacaguuucauuuaagaauauucgcuguaauuaaaaugguauaaaaagcgaauugggaaaauuaaauuugccuucaaucucagaauugacuggggucaugcuaaaaaaaaaagaauauucgcaacagaggaguaaucaggguuaggguuagggaauuauuuuaucaaauuuugaguuugaauacaucugcucaguguucucugugaugaaacgacacaugugcaccaaggucuuccgcuaccauugauacagcgauguaauugcaagcuaaacuggaggaaguuuuuuuuuucuuuugguagaacaucauuuuacuuguaaaaaugacaaaugagaucugauauaaagaccuaguagagcuuuuaauucaaagggaaaaaauguugauauauuucuucucaguuguaaaauccaguuuguccaagugaaaaauuauuugaaacucuugugucugacugugauuuugagagcauccugaaauguuuaugaccugcugggaaguguaauuuaaaaacacaaguuccucauacugaguaauaggaauuuuugaaguuuuuaucuaacccaccaacuuaauaaauuucaaauggucauuauuugguuauuguaaaguagacugauuuuaauguaccaguacagaaauccccuaguaguacuuucagaucccauguuguagcuagcucugcagagaccagucaacagauuuugguuugcugucaaggacgaauagccaguguuuggaaaagcuauuuaagugcugcucccucuucuaauguugucuguguucccugucuacucacccagagcacucacacuuaaccugcauuaaaaaauaacccaacugccuuccacuaugccugagcuaaagaggguuguaguugugaacuagugcucuccguaaacauuucuauuguugugguguaacauuuuaaaaauaaaaacaugugaucauauuuuaaguaaaggaagagaaauagucuaaauuuuccuuaguuuuaaauucuaguguuauaaauuuugacuggauauguauaacccaugugaacaaagaggcuuuggguuccucacugguaaauaguaaaaugaaggggucccaagaccaaaauauuaggaaacauugguauaauuuggugaugacuuggaaauagcucaaauguccaauaagaaggaaauaauuaauuuucauuaugacuuaauauaaauaaauacuugacauggaaaaacuuguuuuugugaaacaggucucauguggccucagcuggucucagacucacuacguacccaugucugacauuaaccuaauuuuuuuuacuguauuuuuuguuagguugugaaaauagguuauaagauuuguuaauucaacuuaaaauaauuauuguaaauauauaauaggcuuaugguaauguuaaguguuuuauacauaauugguguacauaauuuuauaauauuaguuuucuguggcgaggaagguagaaaaaggcauuguaagccaggccugguggcacaugcuuguaacccagcacuucagaaguagaagcaggaagauugcgacaaauucauggccagccugguacacauggcaaaguuccaggccaggcaggguacuuaguaagauccuauuucaaaaaaaauguucaaaaaauuuuuuaagggggggggggaaaggguguguguguguguguguguguguguuuaagaguaagugugucuaaacgcuugccugggcuugaucucuagcaccgcaaaaggcaaaugaaugaaugaaugaaugaaugaaugaaugaauauucagcugcaucauuagguaucauuuccuccuggcuuuugacaauaauauucuguauuaguuuugugacacuggcuagacuacucagucugaucccuuuuugugcuguuuuauaaaccaggacaaugguagcuacccuucagacucauugguggguuaauugaggccucuaauaccauucguuauauauauuuuccucugucaucucuuagcuguaaaacacugugugaaaguaaugaguguguaacacuugguggcucagaagcuuuuuaaagucagaaugggagaccuuugaaaacaugggguauuugaaguucacuuuaccauggagauagaagaguuuuguagaauaauagcuguaauauagaaaggaaaugucacuauauaaauagaacuuuuuauaaauaaagguaaacagccaggugguggaggugcaccuuuaacaccagcccucaggaggcagaagcagucagugucugaguuccaggccagccuggucuacagagugaguuucaggacagccagagcuacacagagaaacccugucucaaaacaccagcagauagacagguaaauagauaaauguaaaguaaacuaauauuuaacaggcuucaguaagucuuagaccaagauccuagcuaaggagcguuggcaacugauagcugcuggaagaagggagagucuguuugcuuuaaggguguggccccugggagguagacuauuccaggccacaaauccaagacugaaugaacaucgcaaauugaaggguuuugaaaucaaggcuaguuugggcuacauagcaagacaaaccaacccccacccccacccccacccccaccccagcagcaggaccagcaguucgagaccacccuggguacauaaaaaaauaaaaaaagaaauuuaacuccaauauuauacaaaaguaauguguaaauaaagagguaauuacuuaauuuacuucuguugaccauuggguaagaacuuuauuccuguacgucuugcuugucuagaaaucacaguaaaaauggaguuucagaaaugagcauaagauuucauuuauacacagauuucaugaauuaugaguagauaauauauuauggaauaguuacuauuaauaguggagcuccugcuagcucaucauuuguucuguuuauuauuauuauuauuuuuuuaguuugugugcacuccauacuugacacacacacagagaugggagggagugcgggggguggugggggagagggggagaaagcaagcaugcaccuuuuggccaaacuuuacuuuuaaauacuucaagccuauguuuucugaaaagaggcuccauguaacugcaaaacugaucuucccaaggcauuagcugguugucugguguuaguggggagacuucagacuugcauugccuacuuguucccacacggagccgggcuuuuguguuuucuuucguccugugucugacaguaguuagugcauugcauuugguuuuaguuucuucauucgucuuuaaucuagaacaguucugaugcuucaucuguuaaaagaaacuuuuaugauaauaaaaucgagagucuuauagguugcuuuuuaaucuggauuuauuucuuuccuuauuagccucaggcuacuaagaaccugcuuuauauuuuaaaaaaacguugcuguucaauuguagaaauuuuugacuuuuucugcauugucucagaaguuuuucuuaagagucucagucucuucauucaaguacagggaagcugaaauugaguuaacuuuuugcagguaaagaaaccuauugugauaagaaacuuuguuuuugcuuuggauaaaaaucagcugcccugauuuaugcugcacucaccuuucugaagcccgauggcgggauuugugcuuuucugugcccagcaggaucuggaagugguguuaaaugauucccucugaagugccacuuucagauuuacauccucucaggagcggccucuguaaaacagaaacaggcugaacugcaagagaacgagcuccaagcguguauggagcaaacgaaacaugucacacuagcuucugucuauaaaaggaagugggaaauagauugguuuagucugguuauuuuugaaacauauuuaagaagaauuuaauaaucaaaugauaucuuacuguaauacaaccauacaugcuaaggaaacagauacuuuaauaugcugaacuuagagaauguguacuuucaaaaauguuucuuuuaguuguuaaaaaaaaaaucucacuuaacuaaugucaccaguucuuuucaaacccaauacacucugcuccuuagcuucgagguguugucucaguguaacaacagucuugcuggcagaucuucauacucaggaacagcagauguuuauaaucguauucugcuguggggaggaagguaguuuugguuuuggguuuuuuuuuuuuuaaggucaucaguguuuagauuaaucaggcugacauuucuugcuggugggucaugagcuguugauaauagcacuacauggugauucaguuguuccauugaaucaucagggaaacccacuggcacucaccccacgugcucugcagcaggggugugcaaggagaagaugugugucucuuuuguuugcaucuuagaguuauuagaggcugagucacauauuaaaggaugcuccagccuugccauuauuuuagagaaccauaaucaauagcuugacacuuuuuuuuaucauagcccaagucaucucuucaugucgguagccuuucugaaacccugucuuaaugaaugaauguacuuggacugccaggaagaaaagccaguccauucacagauguguaaguuguaguuuuacuuaaacuagugaugugagcauaagaacccuuggaaggugguuguucacuuugagagggacaggaagaaggggagagacggaaagcuuacaugugugaugcacauagacuucuuaaacaagaagagguccuuguaucaaaaccucuuuaaggaaaacuuaauaagacauuagcuggauuuuuuuuuaaaugcuggggauuaaacccagggucaaguguuuguuccuuugcucuaacacugagcuguggccucagucuucuggauuggcuaaucagcuacuuguaagguaaauagcaguucagaaugcagugaaucagaaauuucuggugucuuugaauuuugaagugugguuuuagcauguuugugugugugaacagagaauaaauaguacugugacaguuauauauuaaugucguuuuaguuuuuggugaaagaauucagucgauugugauguuuuagugacuaucuucagcacucagcccagaucuuaggcaggugcucaguuauaauuuacuaaauaaugugugucauuugggcagaagccauagguuugcggaggacuuuauauugucauaaagaauguauuguaaguaggaaagauuaguauuccccucuauaggaaaaaguaauugccuuauuuaggguaagcggguucuuccuaucuugcucuuuugagaagucauacagcauuagaaaguuaugggccacuagaggucacuguuuaguaaucaacugcuaaugaaccagaaccgccagaggagccaguaaauuacguguggguuuuucuaauuaugaauucauauuuaaucauucaaugacaagguaacugggaaugguucuguguacuuucauaugugguuaugcuaauacacagcuacauuucucagauguugguccuccaucauuagaguagcagacaucaaaggcuuuguuuucuaaucuuaauuaccgauuguaaaacauaauuaacuuuguuaauacuuccacaccuuacaugggccaaacacucuuuuaaaaauaaaguuuaagugcaaauaugcauuguguuugugugagugauguaaugguuccuuccucuccugugucuucgcgcuucacucuucccuugcccggcucucuucuuucuucucucucaccugguuuccuuucucccuccuuugaauuccuuuuccacuuaaauguacauguguuaguuggugacuguuuucccaagcgaucagccuugauggaaugccuaggagaaugacuuccacugugucuguuaaaggaaucucagggcaggcaacuuagguugagccaaccagcaggauaggugugcuugucgguaagcauggagcugugcuugucgcugagagcaaauggcucucugaggccugugcagccaggagucuaugcaggaaaaggcagauuuucuauccccucuuccaugauauuauauuucuugagacaagaucuccuguagcugaccucuuaagccauuuuguaguagagaaugaccuugaacuugugaucuuguuuccacuucccaagugcuucaugagccaccaaacauauuuucuuuuuuagugcauuccugaagagugagcccaggccuuccuguaugcuagaaaaaguaaccaguuuaugucuccuggaauuuccuucucugcccgagucagcaagcacacggcaacacagcaucauuuuugauggucacauuagucugauauuuuuaggcaagcuuuuacuuuuauaacccagugugacauuucacuuacuuuaauuuugaacaucuaaacuuuuuuaugacaauucauuuucuuugccuucaggcuuauuuuguagugugcuaacucuugucuggauuacaaacucaacuugaaccaaaauugggacuuaauuuuuuucgaguaaucuaaaagcccaaaaguguguuguguguguacagaaaauaucugguaaauacuugguuuguagaaaguaaauauuuuuacaugagauuuuaaaaacagacacaagcagagcaugaacuugaagugaucuuacaauucuuagcauaucauuuuuuucuuuuuugauccauagaaagucaucauuaaauugauugacugcugugucuaguugggugaaauuucuugauuucguuugaaguagcaaccauaaaagaagcauucauuugugaagguuuagauugauguugguccuaaugguaaagaugaagcuuguuuuauuaucaaaaaggaaaaaauauccuaguguaagaguaagggaagccaggcuuuuguuugacaccaaagagcccauccuguuccuucacaaagcucagugcugcuguuagcagugugguaggccaagucaaaaauuaauaguguucaacaacaacaaacaaacaucaaauaaagauaauuuuuaucaucuuuaguagcauauauuaguuguaccuaauaguuuuaaugacuuaaaauaaaaacugguaugcaauguaguauauaccuucaggagucagagacaaguggauuuccaaguuggaggccaggcuguuuuucauagagcauuccaggccagcuagggcuccacagugagaccgugucucaaaacaaaacagauaaaaacuauuuaauguugccugucauugugugugcacaugauauuuauagucgaugaaucaugugucauggcaugcacaugaagguagaggauaacucuauucuccugccuccaucuggguuuuaagcucagguugucagcugugcacagcaaguguauuuaacugaugaccagucucacugauccccaaauacauuuuuuagagacuuuauuagcauauacuaguuguaccuaauaauguuaaugacuuaaacuaauuuuauuauguguuuaucuuguguaaguguguacauucgugagugugugccacagcaugugugcagaugucagauagacaacuuauaggagccauucccaccugcccugugggucuaacucaggucuucaggcuugcucagcugagcuagcuugcuuacacaauuaugauauuuuugugcauauauauaauguguuuugaucacauuuacccccauuaccccauuacugucugguucccucuaccauucuauugacuucauuuucccaacgaguugaucuuuuuguuucuguguguguuuaugcaugcacauuuacauguaaacacacucuaauguguauugguaacaugaugaauucaauuaggauugcuuacaagaacaugggugggggauuauacacaggaauuaaguaagcuuaccuagauauauugaaauacccuguugccauaaaguguacccaugcacacaguaaaucaccauaaaauuugauggauauggggcuauacagguaaacccagagccucacacaugccgugcauggguucuaccacugaucuguguccucagcccugcagauucuuuggggaguuuugaaacaagaacucguguaacuuggguggaacugacauccuagucuucuugccuccaccuccucuugaguacugggguuacaggugugagcuaccacauugcauuuccuaaacaugccuuuagaugcauuucacauuucucagaagauaagggaaauauucagagaucaaguaauugaauaguaaugugaaaucaaaaugauggauaaacacaggaaguuuaacugcccuggaagcaguugcuacuucagggaaccaaggacuuugggaauuaguacuucuggacaaagaucacaugguaauggagaucuaagccaugugcuuacacaaacugagaaagcuaagcacuugcuucuuauauuaagaagaagaggaagaagaggaggaggaggaggugauggaagaggagaagguggcagugguggcagcagcagcagaagccaaaacaccuccaaacaggcuaaccaucaaagagaaagggucaucuggaggucauuugccugcuggucaaggaagcuaacuaagaacucuggcugucuacccuagccaaaauuugagaaacuuuauaauaacucugaauucauaaguagagaguuuaaauguaaacuucacucaacuggaaaaacaaccaauaaauuuaugggcuucuuaguauaguuaauaugaccuaucaccguaaaacaagugaacauacucucuguggaaaaucacccucaaucuggggcuauuagaauuuacagagauauuaguauaacccaguuaagagcaaaucaccuggggcuggcucugacucuagaaccauaagccuaaauaaauccuuuauuuuuauaguugccuuggucauaguguuuuaucacaguaauagaaaaguaaccaauacauuucaacacgguaagaagagaaaauaucucuuucauaucagaguaugaugaaguucagccauuuuaaguguggagacugaugaaugugaacaguuauaugugguuauguaacugcaaucacacuuaacacacagaguuucuguucucccagcaaguuugccuucuuucuuuccauagccacuuauccagcccuagguaaacacuguuuuacuggcuaggcuauaauauggcauuucauauaauaugauaugaugugauaugcuaugauaugauguauuuuauaaauauguaugugugcauguggucuuuugugucuguagugaacuugaugagaauaauugaaggcagaagacugcugucacaauacugaguuaacugucaguuuagaaacaguccaacagaacauuccuucaagauggugcugagguuccaguuuugguacgauggaguaagcauagucauucuuuuuucuccugauggauaugacuaaaacacuuggacagaaugcaugcagcuacugcccgaggacccugaaaagugaagaccagcagguagacuaaggagaaacaggacuuacaucaaaggcccccccucagcaagccugcccucggcccauagcacggagccuagcugcacacaggacacagaaggaggacuccccacaaaagaaaaaugcuagccaagagcaagaaggagauuccuaugaaagaaaaaguggggaaguuaauuauuucucuccucuucucccuccccucucucccucccucccuucccuuucuucucucucuuucccucucucccucucucuuuucucacagcucuuccauuaguuuacuccuggaguuucaguuuggcuguggccuugguagccaagcagaucauggagauccaagaggggaauucucuuuuggcuucagaggaaccuguggauagagaguuuauauuaaauuuauauuguggguuuuuccuccuguuggauccagggccagccuuaguuaccaaagcacaagacuuucuagucaaaguuuaggaggguugggguagguauuggaguauuaggggguguaagaggaaacaccaaaaaccaguguuguauaugaauuucugggucuacuucugggcccagaaauauuagcaggacucugacccucagcaguacaccgaagacuuguccccugauugucagacugucuucugguuugugaagcagaagcaaagacuacuuagaggguuguaaagguaggugggcuggcugguggucuggugaaacacacaccccacacauccaaaauguccuguuuuucauagaauuuaguuuaaggguuucauaacauguuauguuccaaaugucuauguuccuuaaaaaguuacaugacacaaagaccaggaaaggcugaugaauuccccagggaggagacaagaugccguccacagauuugcacagguguuuccuaucaggcauaucaggcagaggcuuugaaacaucuguuacaaccaugcuucagaaagggagaagauaggaaaucucaacuuuaagaaguagaaaauuuaaaaauggaaauuuuuauuuuaaauauugauuguuguuuuguccuuuucugacagauuucuucccuguagcucaggccagccuugaacuugaacuccuguguccuuuccaauauugggauuacaggauugagcugccaugccuggcucuuccccucccuguacucucucugucccuucccauuccuuuucuuuuccuguggagcuugaguucugucugcucacuuucagcugcuugaugugggugcugggaaccaaacccagguccccuggaguagcagugugcaguuucuugucagcuugacaacaaauuggggucaucugggaggagagaaccucaauugagaaaaugacucccuuagauuggcauguaggcaagucugugggacauuuaggagcauaaacuuggugacuaacauguuggcuggaagagacugugcuuuaagagcuguguggagggcuggguagagaagaaguugccuggcccgggcaaggcugugggugcaaggcccaguuucagaaccagaaaagaaguaacuggguugugagggcucucuccccacuuggugcaugggcuuuaguguuuacuuuuguaaaagagucugguggagacagcuugugcuuguccuuccauugucaugugcauacacgcuguucuguagguagaagggucuuuuaugucaucaauaaguauucuuuuuaauccgaggauugaccuuucgucucucugaugauuuaaagcauuguaauagcuuucuuccuggcauugcagcgaccagaacuuauaagcaucuuguaaauagaucaugcauauuucugacacucuucuucagaauguucuuuuaagaugauaacaaaccgagaaaaaguacuucuguuuuuacuaaaauucaguucaucauuucccugaguuauuuucuacauuauuucucuccugucuguguuuucugucaauuucuuaacuugauuuauuuaguauuauagaaagagcucaugcuccagaaagaguaaacagguaaacaacagaaguggcuaaugugccugauggugggaggccgagugaugugccugagagugaugcucacacuagagggccuagcaucaucuucaugaccccagggaugggggucugcaaaugacacuaaggcagaacuuuaaagaauauguacacuuuugccagcuacguaaaugccuugggcauuaaacuuuaaaauguauuuuuagauuuuuaaaauuuuauuguaugcauguuuuugccugcuuguauguaugcagaucauauggaugccuggagccuguagagaaaaaagaaugcauuggauacccuggaacuggaguuacacaugguuaugagccaccaugugggugcugggaaguggaccugggacuucccacaagaagcaagagcaaagugcucuuaauuaauggcugagccaucucuccagcucuuacaguaagaacuuuuugaaaauaaaauaaauugagacgaaucucagccuuuagaaaaacucaggcuauauaguugccuauuacuauaagcuuaugcaucugucuguuuaucguaguaugcauuugacuacaaaaucuuuaaggaacuuuuucuuuugggggauucauguuaggaaguuacugggguagcucucaaguugaaagaaaccagguuucaguccugguacuguuuugggcucuuucuccuugcugcagaauucucuugguuuuguugccauguggaugggguacucuguucauguuuuuuuguuuuuuguuuuuuuguuuuuuuuuaauuuguuaucagaaggaggaggauaaaaaacuauaccggucagaaacaaaacccaacugugaauuucucucuguaaauugucaucaggguccuguaggugccagucagaucugaggugccaaucuuagugaggcugcuguacagccccuaguacaggugaguggcugugccugaagaagaaccacuuuggggguggcuggaggagaaggugcaggguaaguguuaggacaugcgaaauugugucugugagggcuagcauguuguauguagcucauggcugugcaugcugucaagaaguaggguguauuaaaggaugaagagcugaaagguuaaagaaagauagauaagaaguagaacuacuguaauucucacaaaacagauggagauuucacuuaacaguuaucagcacucaaguaaauaguugccuuuacccuauacaugggcucacugcaugcuauaaauguauuuacucuaaaguuuuagugcuugaaguucacuacaauaaagagauugccaggugggugcaaacuguaaauaguaauguguccuuuacacucaugcaaauaugguuggcuauccuuccuuguggaucauuagaaaugauugcagaggaagacgugguggcuggggaguuagcaagaauaacuggaaaggauccucagcaucucaugauagaaguaggcagcugccucuucaccuuugaguucaggaucucaaaggaucuccaaguggggcucagagaugggcuccuguauucgcucagcauucgcuucauuucuuguggucuccuucacuccauuacuguuaggucaucuugcccuuugcuuacuccuccgagaucauucucacuugucagcugucauuuuuccuuccuuuaacguuacaacauguccuugauaaagcagagggaaaauaauuaccacauuuucuucuguagcaaguuggggugaugggguccaggcugauguggaauauggcaguaauuggauuaucaggcuuugauuauuagcauuuuaaacuuugauuauuaaugcugaugagaagacugugaaguguguaggaaaauaaccaauuccuaucauagaggaagcauuguuaaaagauagauguuuuuaaaggguaaaaguucacugaaguuaucagcuacuuaauaauagacuuacuuuguuuuucaguuauucuuaaagcugaaauauacaguaguuacacaaugaguuuuuguuuuuacaguauuagaaugugcucugccacucucugcccaaagacagaacuucaaaacccaggguucugcaaagggacugcccuggcucucuguagacucuggacgcguggcucucaggagcauggagcgugguugcagcucagcacugagugccuucucaguccgggcaggugucagggaauuguucuuuaagugauuuacaaaaugaagguaaaccacuguauguaugcuuugauugcccagcaguuaaaccccucugcaugucuucuggcuuucuguaacgcccgguccuccucaagccaugcucgcaccacacagacuauucuguugcucuuucagcauaagcagggcuauugugauauuuaucugaauucaaacaaggcuaauuaaaagagcugcugacaguuguugugaucugacuuugacugcagcuugauggucauuauggguaaauaaugaaccaggucugcaaguguagcagcugccaacuugggauagaagaacggcuauugcuuccaauuuaaggaucuaucgaccgcuucucuucucccugcagaucuucugcagaaaacaaauguuuucugcugcuguguauugugguuucagcuguuuuagauauagccuauaauuuccuucuuuaauauuuaacuuaggacauuauuagcuuucagaguuaacaacuuuucuguuuuaaaaaaguuuggcuuuguccuugugaaugccauaaccagcuaaccagcuguggcuauuuauaugcauuuaauuuguacauuauacaagaauuaguauaaacagcaagauacgaccucuggcaguguuucaaaggccuucauagauagcuuuuuuuguuaauagauuggcgcaugcccauugcuuuuguuuucauaaaaauggacaccucuuaccagaccucaaguuuagguuuuguucacuuuuucaguggcuuuggaauauuuugauaugugcuguauuuaucaauucagaguagcugcaguagcuuucauuaaaaugcaauagugaauauauugucgcuccaucacgagcgucuccuuguccuauuagugaauaggaacagguacauuaaagguggcacgagaacagacugcauccauagauuaauguacuucccugcagauuuccuacacuuaagaacgcagcuucuggaucuaaugguuacaaucuagagucucauacaggccggaacugagcuccauccuaccacuuagucacucgcuauggaaaagccuggcugcauuauguaaagcccgaggauacagcagugcuuugugcauaauguggcagagcuuugagaucuugcugggaggaaaugaucccaacaugccccuggaagagaaccuuacuuugaaaaauaaugaugaaaaauugcuucuuuugccauguauuugucuuuguuuauuucaggaaaggcuaaccaaacuuuguuuaucagacuccagaauagaacugugaauguuuuugcuuucucgucuccagcuuggauuaugccagaaguaauguuaacaagggguuauguuaugcuggcuuauguuaaaccagaucaccccuaacaugugcagagccauucaucugugucaccaaaacccaggagaacgucugacaugggcucugcaacagaaacagugaucgcuuacaaaucaaacauggcacgcucuaaacugauugugcacggcaaucuuuucuagaaaggacaacuaauugaacaugauaaaguguaaaguuaauuaacacccuuaaauuuguugauuacuuucacgggauuauauuguucguugaguagcagcuuucugucccagcugucgccuuuuuucagcgaaugacgcugguaaacaauagagacaccauaacaagucguaaauggucccugugacagcagccccuugugaggcugcaucuguagaaaaugauuagaacaauugcauuuuaaagacagcucacaucgcagcccaggucccuucggcccucuucuugaucucuuuugauggcagacugguuaaaacauuuaaguucuuuugaguaaauuaggugauuuacugcauuuuuuuuuuuugagagugcuuggcagcuuggcuuuuacaguguuaaaggcagauacagcuggagcuuacauuuuaguguccugucuccuuccugggcuugaaggccucuuuccgauuggcguggguaaaacuagcucaucugugauuccuaagagguuaucuuagguuacccauccuugauucagcuuuuuucguaaggccaauuccaaauuucagcucuuugcuacucuuaggcccaagacuuuggcaugcuuaggaugaauagauuuacuugcuacauuuuauaauauuugcgguuuacuaugucaaagaccuuuccuuuauauucucugcugcuuccgaagaagcauggcaccuuuugagucuaaaauguagauuuaaugguauugggauuugucugagcuaccagugugauuugaguggagauuucaccuaggccauuuauuuaucacguguuuucauuuuuaccucuuuaugauacugucccugaguguacacacacacacacacacacggguuucuuuauauggcauuaagugaagaugccagugccacauaccgagaaucacacugcuccaaaauugaggucguccuuuuguguguaauugaugaguagcaguguuauuuaguauuuggcacgcuggcuugcuaauauauauuuguuguggacagcuagauggagcuuuaccucacucgcauucagagagcuccugcccacucgacacaccauaggaaaacucaugaguuugaguaguuacgugugcuuuuuaccagugccccucggaaagcuacaggaauaggaaaagaaagccaagacuguggggcucucacugagugcagucuuggagagggagggauggggaggggagaugggaagaugaucucaagugaaggagcagugagcaugugugcacagaaacccacagcucucaguggacacagcgagcagggguagggauacuuauucacuggcaagaaagcugaagauuuagaaauuagaagauuuaaggagagaaagauuaaaaauccucugcuuccuacaacucucaggaggaucaaaggagggaggugacaguaggaguuuacuguccugugcugagucaagcauacagggucuucagagaaagugacuuucuuugacuuggugcgggacauaggugacucuccgaggccugcuuaguaauaguaaugaugucuguagcugguugugcucgcaggaaggcaucauccgagacaccagcuugugcugguuccuaaaccaaacugccucaaaccgggagacggauuagcaugaguauuagaacaaggugacuaauguugauuuuuacuguuuacagaugguagaccaagucaggcagaagggaagaacugaguauuaacuugguucacuuugagcaaacaguccuuuaacauaaaaauaugaagaauguuauuuguuauuucauuuucuguauucuauguaaaguaccaaauaaguauuaaaaauaauauguaaccuuaaaauauguaacucaguucaaggagaaaaaacucugagguugcuuuauuccucucuaaaugaaguuugcucuuacuuugaauauaacuuuauuuaauuuuauugugaaaucuuuguuuuguauuuguuaauggugaguugcucuuuucuuuuuucuccuuuugugguguguguguguguguguguguguguguguacugugugugugcagagcaccaacacugacauuguuccucauggcucuccacuuuguuuaguggggagggguauucacugagcagaaggagagcucucuauuggccuagcucagccagcuugcuccugcgaucccugucuguccuagaaugcuaggauuagagguggcugccacacuugccuggcuuuacguggguccugcagauaagaacgcucauccuaaugcgugcacagcagcagcuuuauccacucggcuguaccccuaagcuuuuaguugacucuuaauugauaaaaguaguauacuacauacauaucagguaugacauaauuuuuaaggauauguauacuuuguugaaugacuaagucaaacugucuagcaugcaauauugcauauacuugcuuuuaguuaugagaguacuuaaaaucuacucucagcaauugacagaaauacaauucacuguuacuaacgguaguuaucacaucguucagugggccccagaacuucacccucuguauuucuggcuuucuacuuucuaaacauauuacucugauaagcagauacaaagcucugcagagaggugggaguuacgugugguuagggagcagguacaguccgugagcacucugggacaucccauacugucugcucaggucaugacugcuuuacuguuucaaucagauuugcaagugcauuuggacaccauaggaguauuugggaagguuugcagggagaaaaggaaagagaaaaugguacaauuauacuauaaucucaaaagaaaaauuuaaagguauaaaccugaguccccaagccuugggugcuaaaguugaguauagguguauccuuggggagugaaggguaaagagagaguucugugaccccaugacuuuacauuuuagauuuccugggauauuaauauuucaaauguucuucaaauaugccaggaaacagaucuuaauuuuuguuucaggaaacauauuuaccauguuaccagauuccauacaccugucuugaacauuuccugauuuuucuuuugcauuuuucaacaauaggaguccaaaaaaaaaggaaagaaggaaccagaacuugguggugauugccaucugucaucugacccugguucauaugaugcuauuuuuugaacauaucucuuuucuauaguuaugauuuagaucuuuuuucuuuuaagauuauaaguguaucauuuucaucuccccacucccaaacucucccauuacccagccuagcuuguuuucgaauucauggccccuuucauuaauuguuguguagaugcauauauacaauuccuaaauacaaaauguucagugugcauguuacucauguguguguuuucagggcuggccauuuugguauuggauaagcaguugugcucuucccuggggagacuguuucucccacuaaguauuccuaagcucgauauuguucucuguuuaggccuggucucccgagcuugccuuauccauguuagcauggcuugugaucaggcagucguguuggugagacuuuugggcuguagcuucugcuacuccuaggagccgcgaucucauagcaacucccguuccucuggcuccucgaauccuucuguucccuuuucacaguggucccugggcuuuaggguuaggcguuguauagguguauccuuggggaguggaggguagagagagagucugggucucccauggcuuuacauuuuagauuuccuggaacagucuuaucucaaaugccaggaaacauaucucauuuuugauuaggaaaacauguuuacgaauugaaccuucuuaccuagcaauugaagcacugacuagauaacuugcugaugauacuuuucuccuuugagucauuuauacuucucuagcuugcauagaauuggauuuuauuggcuuguguggauuuucuucacccuuguccucccaccaacaguggaucuuguacaucuuaaguaguaagagcugguucuuaguaccagguugcaaaccacugaaugaugggucuccaguuguggaauuugugugugugucaacuguaagucuguuuuuaaaauaggaagacuggcuaacuuagacuuugauuaggcauaagaaugcuucuccucacacugugauggauacagcuggcuuuuaagagcaaaguauucgucuuaguuuggguuuauugcuguguugagacaccaugaccaauguaaaucuuauaaaagacaacauuugauuggggcuggcuuacaguuucagagauucaauauauuaucgucauggcagggagcauggcagcaugcagauggcagggagcaaggcagcaugcaggcagacaugguacuggagaaaaagcuaagaguucuauaucaugguccaaaggccgccaggagaagaagacugugucccugaggggguggagcuuaaacacuaggggcccuuaaaccccaccuccacagucaugcacuuccuccaacaaggccacgccuccuaacagcacuucccgugggccaagcagauucaagccaucacagugauugugucuauuuugagugauuugggcacuugcauuuucauuuguuuguauaauugaguucauuguuuuuauucuaggacuaugugagagaauuucuaaagacaugauuguaagaaauggcuagaagcuuuaaaggcagcuacaggauuugggcuuguuggauuuaaguuaauauauguauguuuaaaaaaaaucuuuuuuuuccuuuuacacuuguacuuagcuaaaaggccaagaagcaauaaaguagacuauauaggguagguaugggcuuaaucaacugaaggccauuuaauuuauuuacuuacuuacuuuugagacagggucucucucuguacuucuggcuauccugggacucgcucuauagaccaggcuggccagaacucagauccuucugccucugccucccaagugcugggauuaaaggugugcacaauaucauccacuagacaguuugacuuaagccauucugcaaagugugcauaucuuaaaguauuauacauaauaaguaguauacuauaucauuucucaugaucagccuuucuuuuuucuaauggggaacuuuuauccaguguaucccaguuuuguguguuagcaucauacauguuugaauguggaugcaugugaauuugaaaaccccaaaugaucauagaaucauguugucugacuucccucauagauuggaaguggauagagcaggcagcauuuaaguggauuacuagagugacaaaaaagcuugguaaacccuuagcaucaagaguauuucugugagaacaggucucaccugguaccgcuucgcuguguuucuucccuuuugccuucugucuuaguccacuuugugauacuuuaguaguaccugagagacugggaacuagggauauagaguugguagaguacuugucugauaugcucaagacccuggaguugaugccuagcaaccaccagaagcaccacuccuaagaaaaagagagagacuaguuaauuuauaagggacagaauuuuauuucuuaugguucugaagguuggaaaaccaaaaauaaacggcugucauuugugaagggccaucaugacuugaaggaacaggauuuggaggaugaggggcauaagaaugagagaggccacacuuguccuuccauaaaauacccaugcccuugauguugcaugaguccgugcgugauggagccuccguguucuaacgagcucucauugguucucacuguuuagcacuguugucuuggggaugacuuacuuuuuggaaugcacauuuaaggaauagccucuccuuuucugucuuucucuggguaaauugucaucuacugaacaucucuuuuguaccaggcucuguggguaugugccucaagagucaauuaucucuaccuucccagaaauaguguuccuauggagaauuguaucagaaauaaagguauugaaauaggugauacaaagucaaagcaggaaaguuaacaaguguuaagucuggcuucucugaagaggcaaauguugagccugguucaugauuauuggaaaauuugucaugaguaguuuggagaagaaugugccaaacugaaaagaauaagugcaaggcucggagaugagauaaggucaugcuugaucuguuucagggacagccagaggccagagugccuugaagccugagugacagaaagauggguauggauaagacaggagaggaagcuguggcuuuauuaaaagagggcuuuguaggacuuuggaucucaugcugagcaugaugggaaguuuugggauugcugagagaagagaaaaacugugggcuagauuuauauucuaggagaguuccucuggcuguuguguugagaauagauguuggagaccaggacagaagggagaucaagugcacagguuauagaaaaauguggccaggucacaggcgcauaacuucuuagaagcaauacguaugugugauuaagcucucaccccacagcuagcuacagagcuugauguauaggaggugcccaguggacuauguugaauguaagcaaauacggauucuccaucucuucccauaagaugcacucaacuguuacugauuuuucuaggucuucguggugauuuuuuuuccucucccuacucuuacuuuuuaagacagggucacauuuuguugcuuaaauuggucagaauucaugauuuggcuaucuuagccucccaaguggcaugucaggcauaugccaacacacccagcuuacaguguuguaaucuuaacacuaaccgaacguggacuucuauagaacuucuuaaccagggccagccugcuucacuuggggugaguccacagcagcuaauauucagcaagcaaggcuaaaacuaaccuagaagagacaaugacuuagauaaccagauagggaaaaugccacaucacacauaaaaauuguaaagaccuucuauuuaagugguauuuacagcuacucuauaaagaaguauuaaugccuuucccauuuuauacacugccuuggaguuucuucuuuaucacacaaccaucaaguguuauucucaaaaccaguuauuacaucuccagagccuuuauucucugaaccaugauuauugauuuauuuuccaaacaaucaucuauuaaauauauccugcuguauacaacauaauaggaauacugacauaagcaagaccccaugcugaccccauagguaaaaucagauaaagaaaaugaaagauuuuaauaauauauaguaaaugcuauauauauauaaaauagaacuaaaacaauauaauugguuuuauguauacuauuauuaaaauauaaacuaaaauacagguuuaagaucuaaagugguaggagccgguauuucagauuuaugacucuuucagauguuggaauauuugaauauauauggaaauaccuugagauugaaacccacauuuaagauuaacuucugucccugcccccaguguauaggcugaagguuauuuuacauagaauuuuuagugagccugcauuuugacugcuuccuauuaccuaaggauagaugcucaauuuucugcugugguuucauguuggugcccaaaaaggguuagauuuaaaagaaacaugauuucagaauguugaauuaagaacagacaaacucuaggcagugguugcacaugucuuugagcccagcacucaggaggcagaagcaggaaucucugaauucaaggccauccuguucuauagaguuccaggauagccaugaccacacagagaaacccuaucucagaaagccaacuaaaaacagucaaccuauuuuuagacaauggacuugaauucaagugacccaucaaggccauauacuuagugcuuauuagugacagacaugaagaccugugucuucagaagucuggggccuuuuggagcuuuguaaucgcagcuuuccagauguccuuuccauccucagaugcacaggggucacacuuccuuuaggagagcuuagauguuaguucugccccgcgccggaaguagguuugauggugugaaaggagugcaugggaugauaggauuuggucaagaauugccaaagcuuucagaauuacucaguuuaaucagacacugcauuggggcauagguugugauaaggucagaaauuaaaacaccaucagagagagagacagagagagagagagagagagagagagagagagagagagagagagagagagagccaaggacuuugaaucaaggauaaauuauucuuucuugugagcuuuucuugcuuaaguaacuuauuucuucuuuuugaaauauguguuugaacaagugagaaagugcaccugucaaaagauuaaccagcugagacccagugucagcauuaauuuuccuucaauaagugacucuggagccguucagccgucuguaaccuagguacagagcuacugaaccuaugguggauagggcucgacuuguuuguaagcuuugacuuaaauuaucugcuuaauuucugcaggccagaucaacaggauuaggagacagggugguuaugugguuugaauaagaauggguaaugaauugagcaaaauaauucuaaaacauuaaugguucaccaucuuggcaaaguaaauuagaagcuagcagaaugacagucacucagaugucauuaucaaacacuaaaaugauuagguuuuuguacauaauccuuuccagaguguaucuaaugcugguauggacugaggugauuuagcuuccugugagcguuguaggccuccccauguaaggaauguacucccaagauggcugccuugcaucacacugaguuuugcuuuuagugaugguuaaaaguaauaggaaccagggaagagcaugugcuugacuuggcaauagcaaaauauugacaauuuaauuuuaauguuuaaaaaccauauuucauggacuaaguucaauugaaaagcugguccucauucguagcuguauguucuaauggccaggucuaaucauggcacaccuaugguuuccuauuucuauuugcaaguaagccauaaaauaauuacaaaaacagaaguugugcuaauguagcuuauccacaaacuuacuuuuugaacuauaaaaucuaacuuaaaaauuaugaacaaagacaucucaauuuuaaacacauuaauuuuuaaaauguauuucauauuuaguuaaaaaguuguggccuuucucccucuaugaagaaagacaagccuaaauuaagaaguugcuucacugaugagaaaacucagaugguucuagaaaauguaugugagaguaaucuagcuaagcaugccucccuuggaaaagagccuuucucccugagggccuuuuuguggcccaggagcaggucucuagaucuuacccgaaugugaacugugguucuagaaggagcuugugagccgcauaccucaaaugcuaccuuuagggaaggcuccccugugugcugugcugcuaguuggggccccagcaaaguauguaugaauggcuauguaugggguuuaugguuaaccuccacuuggcuauuggaacauuccuuuggagauuuguaaaaucauacacaugccuggcagaaauacauuuuugaggcaagggauuuaaauuuggcuuuuagguuugucucucauuuugguauuuuacuugagcgguuuugcuucaaucucuuuuucccaaaugacucagguguaggagcugcucggucuggaaaccuuacauuuauggugggaggaguugaagaugaguuugcugcugcccaagaguugcuggaaugcaugggcuccaacgugguauacuguggagcuguuggaacggggcagguaauguugccgcacaauaacaggacucgguauaaaacgucuuucuuuucucugaccaaugcuugccccucucuacuugguucaugcuggggguuccgugcuuggauucuagguuacauuguaauaaguugguuuuucaucauugcucuuaggucugugcagauaucaauacaguaagaaguaaccugugcauuuaaucuuuuugaauaacaaauaauuuccuuuaaaauuaugagauggcuuucaguacugaacucuuaauagaacuaagugccccucuccaguuccuaaugcaugcacauaucccauuugcccagucacuaggcuugagacuuccauauuggguaucuuuauugggcugaauuuuccauucucaaagcuguaugaguuauacuugagcagucucacuguugaucaucuugaucauuccacagguuaccugggucuaagcuucuguuaucucuuaaccuaguuugcuaaucagaagggcaguaggucccuauuuucuaccauguucaauuuuaauuuuucucccacuugacagccuuagcuaucaaauuugcccacauuccauagaacacagauuugaguaaugcucuuauauuauacuccuaggcucauuccaugcuucucugcauuuaauccucuuauauauuuaccauuuauccugauguccaucuuuuuucuugccuguuuacauuauguccuaaccuuuagagagaugauuucugguucuaccuccucugugccucccugcuuuuagcgaugaaauuacgaguacugaacucuaagauugacucaguucuuccugcccacuccuaacacauacucacauucacucauucuuccugaacccugcugucugcucuaccacguacuuuaccauuuauugcucauuugcucaucuguucccuuucauauagcauaucauuccaacuuccaaauuagaauguaaauccauuccuuagagagcacugcuguauggaucauucauccuuagaguugaggccacagucauaaugccauuuauuaccaagcaaaagagacccuagguucugcugaggacaguguguuagguucagagggaaauacacuggauacauucccuuaccuccaggagagaauccacaacugaauggugguugguacauuaguugguugguuggcugguuuaagagagaacccuguagaaucagguaaagaaaacuuuuuuagaaguuauaacuugaaaauaaagaaucuuacuaaugcucucuguuuuuagucugcaaagaucugcaacaacaugcuguuggcuauaaguaugauuggaaccgcugaagcuaugaaccuuggaaucagguuuguugaaaagaacauuuucauauacuaauaauuuucauugucuucccuauuugauuuuuuauguuagaagaaugacguucaugguaauaaaugaguugguucaggagcguguugaaaguguuucauuacugaguuuugauagacuuugcuuauuggacaagcaauaggccucuagggaacaucagcacucuuugccacagccauaaauguagugcacugugcacugaaguuguguuaugcuuuguauauuggagccccauaucuucuguucuacuuaaguagaaaaacuguaaaauucaaaccuacuuuggcaauguugggacagauuugaaugaaacaugauucaaaugagucaugaauucaagugcuaugcuaccaugugacuaguuuuauaugccuguuuuaaacauacuucucagaaucuguacuagcaagaucuuggugcucuguugucagaacaaucaggcuuccauuccuaaagguacaauucauguauauaacuuuuauuuuagcuugcuugguuauccuagauuagaaaguaucuuuuaaaaaauacaauguucacuaauuguuuacuuagagugaguccaaaauucuguuuuucuuuccaaugaucauucucuagaaugcuuaagguuaaugccuuaauuucgucuuuaauccuuuggauuggaaaugcuacauaugauuaaucaccuaauuaauauuuuuaauauucugcaucucacaaauauaauaaauacauaucuuuuauuuuagagaacugcucaguguguacagguugcuuuagucauagcuuuauuucuuauccugggcugcugaucagauacagcacaaagcagaagaguggccugcacacagcuuuugauaaaagcaaugaaaagagccaaagugcuugagauauuuuuaaaaacaugguaauggauucacauucccucuuaauuaccauaucaagaugcuguuguuuuauugaacugcccgucucagguguuaaacuaucuugaccuauuaaguugucauguuguaauugagauaaaagaggaauuugcuuugcaucagcgcuaauugguuuaucaauaucccauaccauuuacauuuuagagccaaaugucuauaagauggugaggcauguuuguacaaagccuuaauaaaacuguuguacauggagcccuucagaccaucauauuugugccauggccaguuucaggcuaugggugguugucaugaaaaccuuguuauuuauuuucacaucguucucuaaaucaguuucaugaaagaagaaaacaaaacuuucugacacucgaguugcauauaaaguuaauuuuugcuuacaacagaauuaauauccauuuaaauguauauguaugauuuuauucuuauuuuucuggaauaagggacuagaccaugaaaguaagagccuguguaaacagaguuucacacccagauucaugacaugacaugcccuguccucacuaguuugucuuucacuccucacgcagcccagcacuggcacaacucugugucuucccacagaaagaauaauucuugaauaauuuuccugucaaaauucugauuuugacauuuuucaaauuguucccugggauccacacagggggaggcaagcacugauucccacaugguauccucugaucacacacaugccauggcacaugugcacacucauacacacacacacacaaguauaauuuuaaaaaauaaaaugaaacuuauaucuaagguaaguccuuguagaaauucaccagaugccaacuaauaaagaacaauaggaauagcaacugcacaaaguguauaaugagcugcaagucauuggcuacugcagugguucucaagaagaguauuaaaaguggaauaaaauccacacaaggacauuaauagcagaaaaauagcuuaucuuauuuuggccaugacccaguauagaaaaaacaauauuugacuauagaaagauuuucugugguuccaugguauaacagaaccuaucacucuagacucugaaaaauaugaaaauuuaaaaauuuuaguuugucuaaaacucuaaauauauauauacauauaauauguauaauauaugugugauauaguauauguagagaagagagagcuacaaguauaaauaaaacgugcauuauaaaguuugaaggcgaagcagaagcuugcugguucccucggcuauuaagaugauauacacccucuaaugucucacguggagcgaagcuguucucaucacucccaguuucccacguugccucacaggagucuugaugcucugaaaucugagugugucugcugcuguccuuccgucaugguuuacagacgugguuuaaagugacaggauuguucucuaauagaauggggagaguggccacaauuuauugagcuuugcaaggugaaagaaaaaauuggcaucagcaagcauaaauucgcaaguaguaaacucccccgagucgcacagcagaaagugguucagagacacuuauguucugcccacccacgaguggaauuuucuagaggauuaaugucaacauuuacaaauugagucgccucaagugaagugaucauuucugauuaauuucauuuucauaagcaauuuuuuguuucuagaauaugguuucucuuuaauaggagaagaaaaccauacaguuuaaaaauuguauugacccuugcucuuuuacagugagccuuuauggauguuagugaaaauuuuaaaauguuguaaaaaaagugcaaaaaauauugguacauaauauacuuugagauuccuuuuuauuagaucuuuucccuuccuaauuggauuccuaguuagggcucugaagucguuuauagccuugaaagcacccugccugcauggcgagguuguguccaggaucacaugcaaacaaaaucgucaauguauguuuuguuguuucaucuuuaguuuugcuccauugggaguugauucuuaagaaacacuggugauauaacaagugauugcauggugaguggugcccaggcccuccuuguugccgccaugucgucuuacaccaaaagugacugcaaacacugcuacuucuguccgauagucgaaagcucuugacaaagagcaaucccuacgaguucacuuuugcuuuccugguuaaugcaccuagaaguuaaagcucauuuauuuguuuauuuguuuguuuguuuuucagaacagggcuucucaaagaccagacugaccucgaacucagagauuccccugccucugccuccagaacacuagaaucaagggugugcacuccuacugccugacaaaacucuaauuuuuauagcuuaaacaacagaaaaauuacagaauguugauaggauuucuuaacugauaaaaugccacacauguuaacugucaugucaccaccuacagucacacagugagucucaggcugguaaagucugucuaacuugcauccaguucucauuuauaaagugauaauaguaucaaccaacccccacuagguuauagugaugguugaguuaauucuuguuuuuuaaaaguaguucuuggcacuuacuacuuagugauaucugagguuguagugagguauuuaggauuugguuugacucuuauuuggacaguuuugccucguaaccugucucacuagcugacucuguguguguguguguguguguguguguguguguguguguguguguuuuaguuauugccuguuuugugcauggccaacucuuaagaacauagacgaaaggaagaagagagggagaaggggauggguuagaggcuaggguguggcacuucuccugugguccccaggucccugaguguggaucuccccucaccugccccaggcaggcagucucagcccaugcuuggcuucuuuguugucucauugguuccugccuggaacugacacacggccagucucaucaagcaugagugaaucagggagugacugguuaaaauggacauagcuuuagauguuucuuucuguuauaccaacacccaguuguccuuccaaacaccagcacagguacguaugagguagagagugaacaaaccuuugccuccuaaaauuuugguuauggugaaggcaaagaguuuuuauacuuuucccuuccuuccuuccucccucccucucccucucccucucccucucccucucccucucccucucccucucccucucccucucccucucccucucccucucccucucccucucccucucccucucccucucccccucccccucccccucccccucccccucccccucccgcucccgcucccccucucccucccucucccucucccucucucucccucucucucucucucucucucuuucuuucuuucuuucuuucuuucuuucucuccuccuccuccuucuuuuuaacaauuuaugaugcaucguuuuuuacuucucccaaaaguucauuuaauguucuuguguuuuagaggugaguggguuugacauagugacguuuauuugaguugcauuauauaugcagucagagcaaugaauucauucuguuuguaucagagaacaucucagcaauuguaaagccccgagcacgcaugcacacacucuggaaccacguccaguggcaaguuauuauggggacugacagacugucauccuuuugauggcuugagcuguguaucuccugagcagcaauggggcucuuaugcagaaguaucauauguucccagccaauuuacagggaagcagcaauaacauuuuaucaugguugagagcccaguagcugcuuccuauuaaacuugcccuuucagauaccugucuuggauuaauuuguugauuucaaauggaaacucagucuucuccagugaagcaugacguucuaggguagacucucugaaugacaauuacuguguauucuagcugguuucagaccauuacaagccuugggcacagaggaaggcagaggacuucaguaacugauuuuaauauccugucuaauucuaacugucaguucuguaugugccagcugaaggagccucagaaggaggaaaugcaaaacacuccucacuugcucuuuuuaaugauacacugcugcagagugggggcagggagggagcagcaggcuccugaagggaaucugcagggcagacagcauuuugguuuggaaagugaguagagaaacagcuaccaccugacuuuauauguguucaugugcccuucagaugccucuagacagugacauguucagcaaagcaggcuucuguacgucagugccagggucuucccuggguuguucuccccagggaaagcagaagguguuagaaagguagggaaauaggcuuaguucgccauuugggcaaaugcuacagugugaagcuccuugacugugaagagucuugugaaguacuagccagcagaaccuggaagguucuuaagagagggguaaggccgcugcuuuaaaugugaugacaucuuugaaucuaagaugguagggcacuccuaaaauguuugaugccuuugaaaaugugcucuuuauggaugcauguuuaagaacaguaucuuuuuuucccaagucaugcaucucacugucauaccaauagcuugauuuuauuuacacugaaaaauaaagugccuguugcaacuacacacacaaagcacauguagaucuuuuucuuccccuuuggcuuuuuaaaacagugucugacugauauagcugagauuggccuggaacuugcuauguagcccaagcuggccuagaacuccuaaucuuccugccucugccucccacuugcuaagacuaggcauacacugugugcucugccaaacucagauacuucaaaaagacccaaauaguugggcuucuuucuauuacuggagagaaugugugauaacugauuuagauggaaucuuuauguuugauaaaaucuuuaauaaaagacccauccucauaacaugagccaucauacagacucagcuguguagcacguagugugcaguuuauuacuaccgccucagaagccuguuuacauccugcuguguuauacugguuccacgcacaucuuggcugucagcucucuuccccccuuuagcacuggaaaaacacuuugcuguuuggguguugagauuuugcagucaguagacuauacaguaauaaauggugaggugcgguuuguuuaacauuuaucuaagugucucuuuucaaucuuuuuuuuuuuuuucuagaagagauuggucuuaagacaaaguagaaagcuuuuaugacaguuguuuuauaaugguccuuugcauaaaagaaaccaauaaauugcuggguauaagauuuuauuugaaacuugauucaguaauacuuaauaaaacugggcuucccaaacugugugaagauccuucgacucaagcugacgagcaguuugcugcaguuccuaggguugccuugagcagccauuucugccgucagccccgggagagaacaaaugauguuuccgcuccggcaagcuuuguuuuaucgggaucaguaaccuuaucagcaggugacccagaacuacagcgcaugucucugaacagauagcauaugucaccacucugggcagacuugcuucauaagcaagauuaucuaaugaaggcuuaauaaauaaggaagagugugugcaggaaagacugcuuuuuguaaugauaacuucuccuaagcagaucuuacagcucaucguucaucccuugcauuuucucucauaaaagcuaaaggagaaagcauacauguaagugcuuccaccaggcucccgggacuucuccaguugucauauuucuuucugaaauagaucauuuguaugugaguguagaauuuagaugaucagguugguuuaaaguucauaaaugacaaagcagucauaucugagagacaagggaacccuugacugugagaagccaugcgcacugugcugaggcugugugcuuucuccucuaaaguggacagugcagguuuuucucagggaugccccuguuaaucagcagcucuuaauacuacauaauugaagauuggaugcuccacuuggauuugauuuuauggauuuguuuguuuguuuguggguuguuguuguuguuguucuuuugguguguugauuuuucuggauggugugaugggguugagacaggauaucucuuuguaauccuggcuguccuagcacuuacuguguggaccacacuggccuugaacucagagaucuucuugccuccagagugcugggguuaaaggcagauaccuccacuccaggccuuuauuuuagauuuuugagguaggcuccuacucuguagccuaguuggucugacaccccucuaucccaagcuggucucagacuagugacuccucugccucccaguucuguggauuuuagauuuauagugaaggaacaaagagguggaaucccuucacauguuaaugagucacacuugaccuguacauccugacauuuaauauuuuucuuugaccuuugacaggucaggccuugacccaaaacuauuggcuaaaauccugaauaugagcuccggacgaugcugguccagcgacacuuacaaccccguacccgggguuaugcaugggguccccucauccaauaacuaccaagguggauuuggaacaacacuaauggcuaagguauguaacugcagagguuagcugggagggacagacgaaauauguaauaguuucaucuuccccugccucuccccacuccucucucucucucucucuuucucucucucucucucucucucacacacacacacacacacacacacacuuucaacaaaccuugcuucuauccaagaaggcaaaauguuuacaacagugcaucaguuuuccacuaaaaauuaguguaaauuuggcuuugauuaaaaaaaaucuuuaccuuggucauuuuauuucuggcuaaggaugcacugagauuuuucucugaggcuuggguuuauuuauaguauaagcuaauaaaauuuuguucuucaucauaaauuuacauuaacuuaaaaacuccuuagauugggagcagugugauuuccaaguuguuaaugcucuuguguuaagugugcgaagggauuucauguauaaauuagucguuuaaaggcauuuauuuguuucuguuuugguuugguuugauuuugguuuuuuguuuguuuuguuuuuguuuuguuuuuuuuuuugguuuuuugagacaggguuucucuguauagcccuagcuguccuggaacucacuuuguagaccaggguggccucgaacucagaaauccaccugccucugccucucaagugcugggauuaaagguguacgccaccacacccagcuauuugguggugguuguuguuguuguuguuguuguuguuguuuugguguguugauuuuucuggauggcaucucauuucguuugucaucucuccucuagaacauacuuaggccaacagaucuuuaggucuucuagaacuccccacccuuugccccagaacaaauguaguaacacaguugcccagaugcugaauucccgaugacauuuguccccucuacuucccaagugugucuuggauucauucagaugccuccucuuucuccagcaauuccaugguggcaccucauuuccauacaccacaagacuuccccagcugauccugauggcucuggguugcuucccacaugcuaaugagaguaggcuacaauguaaacucaagagucacuucuccugguaccuucucauaauagcucacgguuacuuguagguuaaugucuaucucugcagcuugucuaacaaggccuugauaauuuggccucuucugcuccucucugcuucagccaugcugaauucauuguccuuuucccuuacucccauaccuuuccacuuacgguucucuccaucaggauaguucuuccuugcugcaauuccccaaccccggugccuuuaccuaacgaacacaccaccuuuuagcucugugcucagaucugccugcacaguaaauucuaucuaaaaacaaaauaaauaccucuccuggagaaacaggcguucggacauugagaaaucaagaauucuguuuauaguauuuuucuagcuauguggagguaaaagugcuuaauauagggccugggugugcggcucagugugagcgcguggcucagugggaacaugcuugcagggcaugcagugagcauguggcucagugugagugugcuugccuaccuuuguaugaagcacuugguuugauccucaguaucaaaggacagaaaacaugcacacauacaauguguguaagaaucuuuuuuuuuuuuuuuuucagauucuauuuuuccuucccuacccacuucucccuuuagccuagccgagucucccacacgucucaauaugcuuccuucugccuuugaucuaggaucugggauuggcucaagacucugccaccagcaccaagaccccaauucuccuaggaagccuggcccaucagauauacaggaugauguguucaaagggcuacucaaagaaagacuucucaucuguguuccaguaucuacgggaggaggagcccuucugacugcgcccugaggacguggacgcuguuaggaaccaaacucuguccugagcuuccucuagcucacucuagaaguaauggucuaaucaaaggucgucugucugcuuuugauugucuacaucacagcaaucccugggaauuucuauccauuuuaaaugcugccgcuuucaucuguuuagccagcacacccaaugguuucacuaacuagcccaguugaccuuuuugaaguuugagccuugagcaccuucaacaaaauugagcacucugauuaggauauccacuuugcaaauaaaaccaaauguuuugucaacaugaugguaaaaaggaaagaaaucuguuacaaagacaaauuagagggaaauuuguccuguuaaccacaugcuauuauuccuucauucaggguuacugaccuacuguccagggcuugauagguaaggcagcuuguuggcccuuguuacaguaucuuaguguacccuccuguuacagcuuccacacucagccggcuugcuucaguauuuuugcuuccuguauauucuuauacauguuuuugacuccagaaaaaugacaccuuuagacuguuucagagccaaugaugauauuuccuuuaaauaauuauuacauuauucuaacuauagucauauuauuuuggauuuaaauaaauuucuauccugauaacauuuu

SEQ ID NO: 3004 - RNA, 1608 nt, Mus musculus
ugguagaacaucauuuuacuuguaaaaaugacaaaugagaucugauauaaagaccuaguagagcuuuuaauucaaagggaaaaaauguugauauauuucuucucaguuguaaaauccaguuuguccaagugaaaaauuauuugaaacucuugugucugacugugauuuugagagcauccugaaauguuuaugaccugcugggaaguguaauuuaaaaacacaaguuccucauacugaguaauaggaauuuuugaaguuuuuaucuaacccaccaacuuaauaaauuucaaauggucauuauuugguuauuguaaaguagacugauuuuaauguaccaguacagaaauccccuaguaguacuuucagaucccauguuguagcuagcucugcagagaccagucaacagauuuugguuugcugucaaggacgaauagccaguguuuggaaaagcuauuuaagugcugcucccucuucuaauguugucuguguucccugucuacucacccagagcacucacacuuaaccugcauuaaaaaauaacccaacugccuuccacuaugccugagcuaaagaggguuguaguugugaacuagugcucuccguaaacauuucuauuguugugguguaacauuuuaaaaauaaaaacaugugaucauauuuuaaguaaaggaagagaaauagucuaaauuuuccuuaguuuuaaauucuaguguuauaaauuuugacuggauauguauaacccaugugaacaaagaggcuuuggguuccucacugguaaauaguaaaaugaaggggucccaagaccaaaauauuaggaaacauugguauaauuuggugaugacuuggaaauagcucaaauguccaauaagaaggaaauaauuaauuuucauuaugacuuaauauaaauaaauacuugacauggaaaaacuuguuuuugugaaacaggucucauguggccucagcuggucucagacucacuacguacccaugucugacauuaaccuaauuuuuuuuacuguauuuuuuguuagguugugaaaauagguuauaagauuuguuaauucaacuuaaaauaauuauuguaaauauauaauaggcuuaugguaauguuaaguguuuuauacauaauugguguacauaauuuuauaauauuaguuuucuguggcgaggaagguagaaaaaggcauuguaagccaggccugguggcacaugcuuguaacccagcacuucagaaguagaagcaggaagauugcgacaaauucauggccagccugguacacauggcaaaguuccaggccaggcaggguacuuaguaagauccuauuucaaaaaaaauguucaaaaaauuuuuuaagggggggggggaaaggguguguguguguguguguguguguguuuaagaguaagugugucuaaacgcuugccugggcuugaucucuagcaccgcaaaaggcaaaugaaugaaugaaugaaugaaugaaugaaugaauauucagcugcaucauuagguaucauuuccuccuggcuuuugacaauaauauucuguauuaguuuugugacacuggcuagacuacucagucugaucccuuuuugugcuguuuuauaaac

SEQ ID NO: 3005 - RNA, 1023 nt, Mus musculus
gcgaagcgauccuccccaagauuucuuaaagccuucucuugggcaccagagggggagggcugcuuuccaaacagcaagacucaacuaaucucucagcccaggagaagccggagaucaagccaagccagguaaacagccaaaccaggcgacacagggaguccccgccucuuccuccagcggagacucaaaccaaaacaacccaacggguccuccccggcucgccgcggccuagcgcgcccgccacccgucccuggcuuguuagacgccggggccagccggggccagccgcggccuagcacgcccgcucccgccacgcuucccacucuacggucaccccaagcccaaaacacgucacaaucgcggcccgggggaagcucguccuugggaaagagagcuucgucaccacggagaccguucccaaaacucgccaggcccggguuccagggccgagacggagcgcgagcgccgguuaccucgaaagcacgcggcccguccgcaaaccuuaccggucagggccuccgccccgcacgcuacgccgcgccccgaaccuccgcggccaccaccacugccucucagcguagaccggcuacaccuucucuaagcggagagccggcggugcgucacuuccgccccagggaggcucgcuuccgccucugcugcugcgcaugcucugcggcgacacgccccacucgcuagcuguaaagaguccuuuagugguuucccugacagcuuuuuccucuguggcuuuuggucagugauguagucaccucaaaacacaguccguuugaaacaaauuaacugacuuaccagcgaaaugggaaggaucgcucagaggccaggugaccugggucuuaaauaucagucuaagcuaauacauguuucaauauauacagaagccccaagaacugucauagcuaucacgaauugaaccaucauauucccguguugcuaugaaacuaaugacauuuaccguaucaccagcgaagaaagcauaacauuaaacagaacaauaauauacaaaac

SEQ ID NO: 3006 - RNA, 56656 nt, Mus musculus
uggggcggaagugacgcaccgccggcucuccgcuuagagaagguguagccggucuacgcugagaggcaguggugguggccgcggagguucggggcgcggcguagcgugcggggcggaggcccugaccgguaagguuugcggacgggccgcgugcuuucgagguaaccggcgcucgcgcuccgucucggcccuggaacccgggccuggcgaguuuugggaacggucuccguggugacgaagcucucuuucccaaggacgagcuucccccgggccgcgauugugacguguuuugggcuuggggugaccguagagugggaagcguggcgggagcgggcgugcuaggccgcggcuggccccggcuggccccggcgucuaacaagccagggacggguggcgggcgcgcuaggccgcggcgagccggggaggacccguuggguuguuuugguuugagucuccgcuggaggaagaggcggggacucccugugucgccugguuuggcuguuuaccuggcuuggcuugaucuccggcuucuccugggcugagagauuaguugagucuugcuguuuggaaagcagcccucccccucuggugcccaagagaaggcuuuaagaaaucuuggggaggaucgcuucgcucuguggucgucuggacuugauuucacgacuccgccucccucgcuccacccacugcugacucuccccgguguuuuggacccggcggaaggugcaagacguguucuggcuagcgcucaucgcccgaaaacuguacuguuagaacguagcugggguguucgcuuguauuucccuguugagaaauaugaaguacaauuuguuccugaaaguuuuguuggaaaacguuguggcguuugacuaugauagauuuccggcuuuaucguuauguugguauguuagacauuuuaaugcuaaguaucugccaaguaugcugcuuuuugccaagugguaaaaauucaugauuaggacacgaacaaauauaauuaaaauuuuaguguucaaucccaaaacauucgaaaaugguuauuugaauaacauuccuuaaaaguggguugauuaaguggguuugugaucuccagguuacccucuagguguggagaagaagcugaggccaaggacucgccuccauucuauucuucucagggguaaauuggauuucuguaugucccuuucgaauguuaggcaaacgcccugaacuuaucuuagauuucugcaagaauauauuugacuaugcuaggaaugacugguuaaccuccucccccucgucuuuguuauuuguuaaauuucaaauacaguuguauuguauuauuuguuuucaaguuauuacauuagcugcauaccauuugcucuuagaaucacagucguguaugugaaauguaugugaaauguaaccauugaguaccuuuucuaggacaaaaauaacaucuuggaauuauaaauuguaaccuuuaaaggaugcuguuuuuaaaaaaauuuagacuuaugcguaugaguguuuugcuugcauuuuaugccugguuauaucugacuuaagucagaagaggaugucagaucuccuggaacuagagugauagauggugugaaccaccauguaggugcugugaacccaacuuagguccucuguaagagcaguaagugcucuuaauuacugagucagcgcuccauccccuaggaugcuaaguugguuuuuaaaaaaagauuuauuuauuuuauuuuaauacacacacacuguagcuguacagaugguugugagccuucaugggguuguuggguauugaauuuaggaccucugcucgcuccggcccaaacauuuauuuauuauuauaaauaaguacacuguagcugucuucagacacaccagaagagagcaucggaucucauuaugggugauuggcugcugggauuugaacucaggaccuucggaagagcagucaaugcucuuaccugcugaaccaucucgccagccggaugcuaaaguuuuuauaugcaguucuaacuauauauuuauauuuccuuggaagaauuaacuuaccuguaaauuuuauuuuuacuuauuuauuggcugggucuuaacuauguuguagcccuggcuguccuggagcucugcauggaaaccaggcuggcuucugccuguuuucugagugcugauguuaagguguuuucaaccaagcccugcuucaccugugaagcuuguugguguauuuucuuuggacugauuguuaguauguaaacuuugggcuuucugcacuuguagcucuaaaguuuacauuguucuaaauaagccuuaauagaaauuacaaaguucuaucuucuaauacuugugggccaagaacaguguuuuacaaaugaacguauuuuaaaagauacaaaaauuaaguuaaauuggaucugauauuuuaucagcugggauuauagcgcuugggagcugaggcagggaggagugucgugagcuugaggccagccucaacuagaguugcacagcgagucuuucucaaaagagaaaaccacagcugggcagaauauaggaauaaccagcuaucaaggcugguggagauagagauggcuucaggagugcagauuaacaagucuuuguuccugccuccucaaaguuggcugcuaauaucuuucugaggcuaugcuauucuacaaacuaugcagaagacugaagaguaaauaagggacuuguuaaaucaucaggcuauuuuuauucuccuucacauguuucugucauuuaggauuuaaguuuggagacauuuuacacacacacacacacacacauuguuuuuuguuuuuuuuguuuuuuguuuuguuuuuuuuguuuuuuguuuuggagggagggucuugcucuguauguagccuuggcugcucuggaacuuaauguguaggucaggccucuucaaacuuacagggaucugccugccucuauuuucaaagugcuagaaauaggccccuauuuuuguaauugaagguuuuuaaaaacaauggcugucaacccuuaucuuaauuaugguacaaaaguguucaugcaguguuuucuauugaaguaaguuagacacagggguuuguuacuagcuugguuuuuuauuuucuuuuauugacuuuauuuuugaaauuucugauugcacacaaaggaaacaggagcaaugaaauuaagacuuuugcuguuuuuuucauuacccccuucuuuccuccaaacacauuguuuuuucuucuccuggaguuucuaaagugaaugguagaaauuaagccuuuuuacuuacgguuuuucgagacaggguuucucuguguagccuuugcuguccuggaacucacuuuguagaccaagcuggccucaaacucagaaauccuccugccucugccucccaagugcugggauuaaaggcgugcgccaccacgccugacugccuuuuuacuuguuuuguagcuaagugauggagaguuaaaaaaauauaauguaauuuaucacccagauuuuuugaaacuuaauugguaggauaggugaaauacuuaaaauugaaaaagucauuuaguuccauauggagccacuggaagaaauacuaccacaagaggcugcuccauuuggggcuaguaaaagcccaaguguaaguaaagauagcauggaaagaagugcuuuuuuccuucuuaguuuuggacauuugcuuagcuaaugccaacuaucuccuuauucaucuugauuuggauauuagugaauuguagaaauaauaaaauuggguuuuagugcaaagaucagugguucucagucuuccuaaucugagacucuuuauuauaguuccucguguuguugugacccucagucauaaaauuauuauuguugcuauuucauaacucuaauuuugcuacuguuauaaauuguagugucugugguuuugaaugaucuuaggcaaccccugugaaagguucauuugaccuggaaaggagcugagacucuuagguugagaaaugcugucauagagaguaguuuacagccugacacacauaaagagguucugcugguguuagaaccuugaggcuacaauaggaagggcucgcuguagcauuucagacauugguuccuagacauaugucaggcccuucaauuaguaacugggaauuuuuaauuuauaauucucuucccaacuuacugcacuuguuucuguagaaaugccuuagagacaaggaagcagagucuggccuggugaaguugccuggcuguauuuucucuuuccaacuaaguaggacuuguucuuugcucugaaugucagucccaggcguuaccacauggugaugcagugacuuugcacauggcuucucuucuagguuaugcacuucggcauucucagugaaggccaauguuuuuaguagcuuucccaucauuucaguguauuaucuuugagaagagugaagcagaguuacuacgugggagucagaauuuuuuuuuuucuaacuuaaaacugaugauucaaguugugauucuuccuuuaacuuuuaaaaauuaaaagcuauauuuucauaaaaguaaaaaaacaaaagcaaaaaaaccccaaacagaccaaaauugugugugugcgcgcacguauguguaagccagagguagauguuaagcauuccucucuguggcucuccaccacauuuacuuauuuugaagacagucucuuauugaaccuggaguuugcugauuuagcuagacuagcuggcuuagugaaucccuaggaucugcuuguuuuuguucccaaagauuuggugcuuauagguaagugccuggggauaugaacucaggucuugaugguugcaaaaacagguacuuuacccagcaagccaucugucuccuuguuuguuuguuuguuuguuuguuuguuuugcuggagggugaggguggaggccucauagccuaggcuuggccuucaaaucucuguguagcuugagcacugacuccagauucuuuuguuuuuaguacuaggauuauaauucugggccacaacgccuggcuucacacagauucuuacuuuugugacaugcacaucaugcauauauaaagcauauauauauuuuuuuguuguuguuaaaucuugaaucggaugguauuucaaagugugagccuccccucuagcuucuggauugacuucuuuuacaaaacuugucuguucuuucaaguggcauucaucuaucccacugcaguuuucaucucccuauauaauuuuccaaggagaacucauccagucagugguccugcagcaagcauguuuucuccugguugguugguuucucccucauuuucuuuugagguagggucucuguguagccuagacuggccuugaacuaucuuccugcuucagccugcuuaaauguaggauuacaguuuuuuaucaccugccuagcuggguuauggcuuuuauuucuuagucuuuagauguucuuagucucacuaugaagucauggcuagucuugaggcaauccugcuucagcuuccagaguacugguguaggccuguagcauuaugccuaguuaauaaacuuuuuaauaguuguucaaaugagcagcaucuaccgcugugauuucuaguagaaacuucauugaguugugaaguaaauuagauuaguuagcaauuuuuuuuguccugguuuccuucauuguugcagggaucuucuguaaugacuuagaagcaagugcuauaggcaguuacuuuugugugugauguauaauuaaugauuguauugagucugugaugugcucuguaguugcuucuuugaguaaauuccaucauuguuuuuccuuuuuuaucaaaagugaaucagauuagaaaacuauuugaagcugggcugguggcacaggcuucuaguuccagcagaaaagagguugagguaggauugcugagacuuauggacaagccagggcuacaaagcagggcccagucuuaaauaaacaacuaaaauaaagcagacaaacaaaacagaaccauuugaguccugugcuuuuuguggucuaucucugucuuucaucuuguguuuguauacuaaauaggugagcauuuacuggaugguguauuuuccaacaucauauaucucauuagugcuauacuuuaaaaacuuaaacauuuguauuguuuauguggcuaugggaugcagguuccacuggccacuuguggaggucagaggacaacuucaggaggugguuuucuccuugcaauucccacauggauucuagggauuaaacuuggguugccagguuugcagggcaaauaccuuuauaccugguucuucuuguuuuuaauacccacuauuuauguauuuauguuuugagauuaugagacuauuacaccauuuauccuuucuguuuuuuuucuccaaacccuacucuauaccauccuucuuguucucuuucaaaucuaugaccccuuuauccauuaauuuuugauacaugcauauaugcauaucauauauauuccuaaauauaaccuucucagucuaugagaugucacuuguguguaugucaguuaaugucuacuuauuuuuaauaaguauauagguaaaguaaaugaauacuuguagguaagguaguuuuuuguuuuguuuuguuuuuuuuuuuaagauaauauuacaccuagaaggaaaggauaacaucaauauagguagaggaacaaguaugaugaacuguuuuaagagacugacugaggaaauuuacaugcuuaaaucccaggaaggcuggcagagcguggguuaaagaacuggcuuucuacucagcugcauacaagauuaagggaauuuuuagagacuggguuaggagaguguguuuauaugugcaugcacacagaaucaucauaauuguuuucuuuuaaaggcccuuaauaauucugauuugaaaccaggauugagaagugaugguucaggguauuacaauaugguccgaaaauauaaacaaauguuagcaucagguucacuaugguaauccaaacucuagaaucuggggagagagaugggaguuaaggaggaacuugaacauaaacaugguguucagggcuuccauacagaaagaaagcauuaauucagcaguaauugauaacauacagauauucaacugucuguuugucuuucuuccuuccuuccuuucuuuuuuuagugucuauugcuaaagagaagucaucagguuuauauuggcagagccuccauuaaaauacugcuugcuugcuuuugguuagaauagagagcuuagcuuucccggagagcugcauugcauuuaguugaguuuuguuuugagacagagcuuaccauuuuguucgauuuuaaacucaaguguuucuuccugagucauacuagcuauaguuucuauauuucuauauuuggucauauuuuaaaggaauauuucucauguuuaaggcauacaaauauuuagaauuagaauuguguuuguguguguauggugcugggcauugaaccuagggccucauagaugaggaacaaggacuugacugaguuguauccccauccuaaaaauuauauggguuuugaaaguauaaguuuauucuuauuugacaguguuuaacguguaugaauugcucuuuucagauucacaaugacauccuuucaagaaguccaauugcagacuuccaauuuugcccaugucaucuuucaaaauguggcuaaaaguuaccuuccuaaugcacacuuggagugccauuacaccuuaacuccguauauccauccacacuccaaagauuggguugguauauucaagguaagagaacuugaauauuucuuccacauggauucuuuuaauuuuaucuuuucagaaauuacauuuauuuauuuuguggcgugugugugugugugugugugugugugugugugcugugugcauaccguuuguaucuagucagaggacaacuuggaagaguugguuguauccuuuuaucauauaagucuuggugauugaacugcaguccucauacuggcagcaggcagcuuugccugaggagcuaucuugacaaccugaauauuuucuuuaaacagauuuggauuuaacuuauacuaaaccuugucuuaagaaacuacauuaagauucaguuuuguaaauaucaccaugaaauacuaaacacugugcagucauuuaaacacugggaacuuaauuccacagguuuucuucucugugaucaaaagauccaacuuggguuuuuugcgaaaacuuuuagaauauucucugugugugcacgaacuuguguugucugugcuggguauugaauccagagcuucaugggcaagugcuguacaagugagcuguauccucagcucagaaucucuuaaaaaaaaacaaaccaaaaacuccaaauucucucccauuucacacuuaaagggggaaaauaaucauuuuuaaaagauucucaaauuguauacugucucuucuugucguuugugauugauuuuguacaucucuguagccaugcauugccucuuuuguuauguaccucuuaaauauugcucauauuguuauuguauuauuuuuaggucaauacucuguuuacuugagagaacaguaaauucuuugugggcugguucauauagucaccaaucauuuuucauauuauuuacuugaaaauuacguuucagugguuacuacuuugguauucccuaugcuggagguuuuaugcaauuuucaggcucuucagaauauaguggagaacagauacaguuucaaaaggcuaggggaaaagguuuugggcucuuuucuguuuauuauugcaugaaagaguuacacuagucuaagcuaaaaguggacccuaaaugguugcauauacaagcugugagguuuuuaaaucugugacagaacaagggacggaagggagaaucuacucauugcaaggaaauucucacuugagcuucagcgagucacaagcacuuaaaacuugggaaccuucagcugauuguccagucucugucaggaacuggcauguguucuugagaaggucaucccuucagcugaaguacucuccauauucuagaugcacaauuaaaguaccauugcaggcaaaaugucuuaaaugccuuuuccucuuaacauaaucaucccugaggcuuuggaucagggucuuccugccauuucucuguugaauuugaauaugaaaauaauccucagugcccauaggaagcaggucauuacccuuacuugaaucagcaaagggguugaaagaguggaggaucuggauaaggccaaaugugucauaauauuuauguacauauucauugaaucaguucauuuaguuaauugaaccagguucuuacuauaggacauuuaugauguagcuaaagccuuaaaucuuuuuucauuuucuucuuucuuuuuuucccucggggcagaaucuuaacuguggccagaccucacuguguagcccagcuuaucuugaauuugugaaacccaaggugaauaacccgaagggucucaaucacaaguucuguuaacuagcucucagaacucugaguuuggugugcaugcuugggcacgcaagaaucauaggcccugcccacaaaaugccaaggcucagagucuguuauauuauuuuggcugcaauacaagcuuaggcucccaaacuuagguuucuaugaagaccccauggugaaguccucugccauuugaugagucuuacaugcuguuuccacaaauaaaccuauucugcagagauaauaaacuaguuaacugcuguggauaguagaucuaaaacuguuugaauguuuuguuucaagcuuuucuuauuucuuaaaacauuuuguuggaagaagugauuuaagccacccauuauaguaugauaaagguuuccucuggcuuguaauguuuuggcugagaaaucugcagguaguagucacccuuguauggugacuuuuuccuugcugcuuaaagaccuuuggcagcuugauaauaaugcgucuuggugucuccuugggcuuagccuaguuaaggugcuuugagguuguuuuguuuauagagacaggguuuucuuauguagucuaggcugcccuuaaacucucuaaagccucgguuuaccugacucuuccaaaaucugggacucuagacauagagcaccauguuuagcuauuuuuaauuuuuguacuuuguccauuuucuuuuucauaccuaguaaguuucagcugcuacuuuuagaaauaugcucuaaggcggucuguuucuuucuagagucuucagccuuugauggcuauauuuuauuuccuuuuuuuuaccuuacaucuugucuuuuacuacuacccaggcuggcuuugacuucacaguccuuucucagccucaugaguaauggauuaaagaugugcaccacuacucuguuuauauuguuuuuauugauagguucuuuuauguucaacccccuuuuucauacccuuuuguauucccugacucagcuauuaauauuaaaauuuaaaauugcauuuaguuaauuuucuguggacauguguauuagugccugucucucuguguguguguauguacauguguguguccaggucaagaggacaauuuucaggagucaguucuugucuuccuaccauguggguuccagugauugaacuuggguugucaggcgugguggaaaagccuuuuauccauugaguuuacacacaugcucacccccgccccccucaagcucugaaacccagguaggaggccucagacuugcugguagucagugucuggccgaguuugcagaaucuuuauucugcuuuagucguuuagauuuccuuuugugaauuuuucaguucacuuauuguauucuucaucuccagaguagauggcuauuuuuuuguuugcuucauuauuuuuguauaguugauuauuggaguacauugaauuuaauuaaaaguauuauuuuggauuguuggucagauaauuuauugaacucuguuucuuuuagcuuaaugauguuucuuuuauuuucuuccuuuggaucuucuguucuucagaagaauuuuuccauuuugugauuuccacaaagcagcauccucuuugacucauuucagauuuguuuguacuggaaagaaguucaccauauacccugcccaaagauucucuggaucccccuucaaucuuucacugagauauguuauguuguagcucuuuuguguaauuucccaaccuuaaaauauugcuuguuuccggaguuuguacucuuucucccucuugugucugucugugguacugcaugcccucaguuggaaucggauguugaacaaucaguccuuuuuuuccccagugccuaggcacccaaaucguccugguuuuguugcugucaacucaggugaggcagaaaccugugcaguccaucuaaaagucuguaugcgagguccauguccggcucuuccugacugccggcaggagugaagcugcacagccugcagaguugagccuacugaggggaaagccuugugguuguuagaaaacaaugccucuuuuagcucaccuggaguacuuguuuuuguaauggguuuuuggaguucuuccaaaggauuuucuggauugugcacugugaaaucgcugacugccugggagcagagcgugggcugugagacucuuuauuuuaucuucuccacauuucuccaauuucacuuucacuuacuuggcagaagacucuuucagacauuuuguaauuuucacaauguagccaaaggaaagccuuuucuuuuauuccugguuuuuuccccucuugucuuuuuaucaagugugcaucuagggaacuagugccaguguuggagggaaagagguagaguuucagaacgugugaaaggguaucuucuguucugcuaggaaaugaauaagaguacuaguggcuaagagcuucguaagcucaaauucuauuagcucucacuaauggcacacaucuucaaucuuguuuugguuguuaaugguggcuaaucaaaauuguaggacauggggcugcuaaagauagcucagaaaguaauaucagggcaggcagcuggagugcccagagggcagaguacugacucccagauguugucuugugguaugucugaaccagcacauguguacacaacauacacacacacacacacgaauuuagcaaaaccauagaacauaucaucuaagacugugacuuucuaauagucaauauuuagcacagucuauuuuguuuagaaaacacaguuugagaucuguaaugucuauauuugaguugaaaauauuacauauauuuuaauuuuuauuauuguauauuguauaugguacuggguuuuuuaaggaucuuucucauaugaguucauucaguaugcuuugaacaucuucccuagaauacaucuaagaugaaaauauguuaaucucuuagaauguaaauacucuccucacccaagauauacaaauugcuuucagacagaacuugccaaagaugagagauuagugauuuaaguuacaggagaguacuuacuaaaacaaugcaagagccccuccgccccccucccccccaaaaaacccagacccuaaguaugagguauaaaacauuaaguuauuaaaaaguacauaauagaggggcuaggaagcuggcuuaaucaguaaauugcuauaaggacuugaauuugaaucuccagcacccauguuauaaagcugggccuacaugucuguaauccugacauugagcaggcaggcagagaaagaaggaucuguaguguuugcuggccaccuaauccagccacaucagugagcuucagggucagugagagacccugccucauaacaagguggagagcaauugaggaagacacucaacauugaccuuuggccucucauaaucuugaaucugugcacacaaaaauccacaggguauaguagcauaauaauuuuaaauaaaccagaagauuuuguauuugaucauguguguguuuccauugucuuggagaaauuagguagcacuuugaauauauaguagagacuucauucaguuuacauaaauuacuauaacuuuuggucacaguuuaaucauaauuagacaugccuaauguauuaggguuuuacugcugugaacagauaccaugaccaaggcaagucuuauaaaaaacaacauuuaauuggggcuggcuugcagguucagagguucaguccauuaucaucaaggugagagcauggcaguaucuaggcaggcauggcacaggcagagcugagaguucuacaucuucauccaaaggcugcuaguggaagacugacuuccaggcaacuagagugaggcucuuauacccacacccacagugacacaccuacuccaaccaggucacaccuauuccaacaaggccacaccuccaaauggugcuauucccuggucuaagaauauacaaaccaucacaccucauaacucaagauuuuaaaauuuuaagugcauauuuuaacuuuaggguguaauuaaaauguuguaucuagcuaguauuaagguaauuaguuauauucuuucuuaaauuuuucuccuuuagguuggauggaguacugcucgugacuauuacacauuuuuauggucuccuaugccugaacauuauguggaaggaucaacagucaauuguguacuagcauuucaaggugagaauuagaaacugaaggacuugaucaagccagcagccucuguuguaguucucuguuucagaguguuuagaugagucuuuguugagugaaagucagaugacuguaaaugccauguguagggcacaagggguuuucauagcuacucagaacacugcuuuuuuuaaaugaagcaaacuuggaguuucuuaagaaaagguuguguugcagguuuaaauguaagcauuaacaagggaagggagacaaguaggaggacagaaguacauauccucacacacaagcuaaggauugauugcauguauaggaaaggaauaucaaccaaugaugaaguugagguugccacaauauucauucauuuguauguucagaagacccuuucauuuaugccaguuuugauuugucccuuauaagggacaaacuguaaugugcacuuguuucaggggcauuguuuuccucuuucuggcuccuuugggauuauuuguggaaauguauaaccguggauuuaagaagaccauuggguuuacuaggaauacacacugggaaauaguaacugagagauuuucaucauggguccccuggccagaguuuauaucuggauaggaguaaaauguauuauugugcugugauugcacuuuagucuaacuguagauaaugaacuuguacuaugugugucucaaaagauagaauaaaggaauacugucuugcuuuucuuuugcuguaauaagacauugugagcaagacaacguauagaggaaagaauuuauuggggguuuacaguuauugguggacacuguaguagcacugcaguagcuucuagagacaaucucaaggcaaagaguuaacugggaaugacugggccuuugaaggauuguauguuuaagaccgugucucaacaucaacucuuuugagagguggauaguucagugguaaagcuuagcucaagugaggccauggguucaaucuucaguaccccccuagccuccgcacccccaaaggcaugugcauuguacguaguaauauugaguauagaauugauggguuuuuaaguaaaaccauucuguguggauauuuaaagaagugaagauugauuuuaguuaggacaguccagcaaaauuaaaaagagaggguaacaaacuggagaagaagaaacuaaacauugaacauaauuaguuuucauaugguagccaauguuauaaauagcuauagcgccuaaguggcuuagauggcuucauucauauguuaaauagagcucuguaguugcaaaucuuacagaguuuucuugugcuguaccaauggucucauccucuuugccuuuacacaguucacauauauaacauauuuuuguaguuaauauuucuuuuuacauacagcgaauguccaauuggaggaaauauuucuuaaaucauguauuucccaguccuacucccuguccuuagauuuuuauuaggucuucccuuauuucuccuccauuaaucuucuuacuccuuguaaaguacaaacuugccucucuuugaguugauuuugccauaguuaagaugcagggggagaggcucgagagaugacucagugguuaagaacacugucuguucuugcagaggaccuagguuccaucuccagugugcuuguggcaacucauuauuauccguuuaauuccagaccacauggaucugaugccucuuucuauucucugcagguaccaccaaugcagguggugcacaggcauacacacagacaaaacacauauaaauaaaaaaauuaauaaagauaaagggggaauucauauauauguuuauaucuaagagagacaacuuugggcuauguuugagaagaaaguauaacuuggacugauaaauuugugaacaauaggaaagacucauucuagauauguucagaauaauaguauggaggaaggaaaguauuauuaauaaauuagcauuuuaaaguagcaagcuuaauaauuuuuguuacccaccucuuaggauauuaccuuccaaaugaugauggagaauuuuaucaguucuguuacgucacccauaagggugaaauucguggagcaaguacuccuuuccaguuccgagcugcuucuccaguugaagagcugcucacuauggaagaugaaggcaauuccgauauguuggugguaaccacaaaagcuggccuucuugaggugagcaccuacagugagguauagaguuuacuuugacugguauccuaauccaguugauagcugugagaauuuucagauuaugccaagaggcgcuaccagaaauguuuuaaaucuaaaauugugagucuauguguagaggccagaagucaauguuaacuguuuuccuuagccguucucagucuuacuuuugaggcaaaguuucccauuggaccuggaguuugccaguugggcuagacuagcugguggggcuagucuuucuauuaugguuauuuugugguucuguugugguacuugucagaugaaugcugagaagauagcugccugauucagggcuaaugucaugugugcaguaacuagugcaguagggcagccuuuggaaccacggagacaugggcuugccuccucuuuccuugccuggagcuuuugucuucaggcauccuaauccaguugauagcugaauugucagaguuagggauggagcugcugggagaugcaguguagcggugcauccagcugugguucaggguuuggagcugaauacugggggcucagugguccgaggaggaugucauaugcuuuagguuuuuaguaauuguaaaaugagaaacaaaguucuuuuucaagaucacauuuucuacuuuauaucuggaagcuagacuguucuuugaaacaaugugacugacuguauuuaucaguccuuucguuuuaaaaauagcauuuuagauugguuacuguauuuuuugucaauuacaucuauauuucauauauuguaggugcuugguuuuucuuuauagacagaugggucuuuugauuuuuuucuuuguuuaccuuuaagaacugagacuauaaaaggaaagauaagaggcuacacugucuuccacugucaggcuguucaaagacaguucauccaggaguuagaaggaacugugaauucuucauaucuuuccuucccuuucccagaaauuccucucuuaucuuaaauacgaaaugcaacuuuuauagggugacugaaacauuuuguagugacaacugccucugaucaggguuuuuagccucguauuugaauguuagucagagacacugaaguaaacccugcuccuaggaaugcaguuagcacugaugugcagggcuuuugaauacuugucagagcacccuuaucucaagcccugcacaugaugggcauuugcuccccaugccucgggagccuuuucucuaauugggacgcagcccagguuauuuguucuuuuucuuugcuccacaaaagcugugcuauaaaaauuuuaauugcugucucuugggaaauauuucugagauaaaaaugguuuuguuuucugaaaaguucuuaaaauucuacauucauuggugucuuuaaugauuuuaugaacacuguacacuaagugauuaaugagauaaaguuuuugaacuugugagccugaauuggauaauagaauaaaauaaaauaaaaagacauuuuagggauaguaugggaugcuugaccaaaggauaucuauuggcugguauaauuauucuaacuuucuuagcuaugaucacaguagugguuuggaaggauaccgcacuuauuagaggugaucuaagguucuuagggguggaaugucaauaauuuuauuuuggauggcuuaggaaauuaaaacaaaaucacauaaacuaaugcauuuauaauauaagccagauguaguggcauacauauuuaaucccagcaucugggaagcaaaagcagggggcagaauuuuaggccagucuaggcuaugauauaaguaagacccuguuuuguucugcucuccaaaagaauaaaaugggaaaugaacaaggcagcauauugaugauuaguaaauugagggcuauauuuguucuuaaaagauuucaaaauagaaauuugaagcagaaaagagauuuauuguuuuauuguuucccauccaaguacuaaccagauccaacccugcuuaacuuccaagaucagaaaagaucuggcacguucacccuugcuuggugugguuguagacaauuuguauacuaaaaaaccccaaaaaccaaaaacauaaaagacuaaacaaaccaaaaaaaucguuacauucaggaucuugacacauguuaggcaagucuguuuuuugaguuuuaucuccagacuuagauuuauacaaauuuuaaucaaauuuaaaaucuuuaaaauuuuccuacuaagcuuuaguaaaucuuuuauuaaguguuauaaacuaaucacugaaaaaguuugauucugaaaauguuuguuguacuaggugaagacugaucauuucuaaucugcuacaaaguuuucagucagauuaaugcuguguuaauaaugccauuaacucuuaggauugauguucuugcuuggucuuaauuuuccguuggcuuauuagguauaauuuaauuuucaauagguaugacaauugaguaguuaaacuuuuaccuuuuuauuuauccuggaaaguuucccacaguauguaccuuuguuuuggucauauccuccaguucuccuuuccauccuuccuaucagcuuuuccauuuugagaacauuuauucuaugcauuugaauaaaaagauuauuccagaagaguuuagcaguucagcuuucguagguuuagauuuuagucauuuauaucuaggauucuacaacccuggaaagcuuaauauggggauuuuuggaugaaaaacauuuaucagcuaaauaccuucuuuauaaauucuuccugcgucucugcuuuucuccgguuagaagcaaagacuuguuguuauaaagacuagccauuuuauuuaugaccauguuugguccuuugauuuagguuuugcuuuguguuuccuacuggaguuccuguuuugcagaauugaguaauuaucagcauuccccauaagaaucugcuagaguuaguauaguauuguagccuuagccuuucaauuugcauuuuuacuuaaaacaguuugggggggggggucucugcaaacagcagugccagcagaguaacaauucaugugaggcaagaaggcauccaguguaacacagcccaguagccagugucggcucagacuuguagagucugacggggacagguuauuuuagguauauuuauguuuacuacaauuuggaaaaaguuuccugcuaaacacuuaucucaaucucaagugcacacuaaagcuugaagcguaacuucaucuaaagucuugugcaaaauaccuguggcuucuucuguaaagaugaguucuacaguuuaagggucuagggaaggaucugguguggucucagucauagauagcauccaggucaccaagccaucaaguacacaugacaucuccccaaaggauggacucuguugauugagaaacauugucuggggagaaggagucugagguaaacauaauacuuuuagagauugaggugugaccuggcccuacaggauagcacagguuaacuggcuacuaaauccaaucuagccuucugggcgaaaaacagguauauaucccucccuuaaagagggaugcuuguuuuaacauuccugguuucccuagugcuuaucugugagaacagggccuuuuuaacagaaggauuauaggcugaaugcuaugcaguaggcaaaauguaaaaauuugugaauuuacaauuuuuuugugaauuuuuuuuuaaaguaaaaaacuaaaguuguaauauuuuaugauaaaaaucaauuugaguuuuuuuuuaaauacagcugaaaauugagaagacccugaaagaaaaagaagaauuguuaaaguugauagcuguucuugaaaaagaaacagcacagcugagagaacaaguuggaagaauggagagagaacugagccaggagaaagggcggugugagcaauugcaggcugagcagaagguuugcuauaccuuucuaaaauggaagcauuuaggagcauugaaaacugggucuugaggaaaguaguguguauacgugugugugugugugugugugugugugugugugugugcacaucauauaugugugugcauuuacauuaauaaguguauguguauauauauaauuuauauaauuuuauauuuuauuauauauauuuauauguauuauaauuauauaauuuuuaaauuuauucauuuuaguuuuuauauguauggguauuuugucuccaugugcauuauuugcaugccugaugccuuuggaaucaaaauugggggcagguccucugguugcuaggacuagaucuuuggucuucucuaagagcaacaagugcucuuuaccuacugaaccaucucuccagcccuaagaaugucaguucccauuaaucuucugccacagucucuuuuacauuuuuaaauaggcaaaauacuuaaagauuuucaguaccaggcuuauugauaauaguucucugaauuuguuguugguuguuguuguuuuuacuauguagccugggccuugaaaucuuggaaaccacccucugccuuccuaguacuaagauuacaggcaugaacaaccaugccagcuuucugacagccauuucucaguauuucacaucuaguucuguauuauaugcuagauuugaggaggaaggcuuugggaugugagaaauucacauaggaauaaacacaaaauaaauggaagguagaaugaagaaauugaaauuacucuucaaaaacuauaauuuagguaggcaugaugcuacaugccugcgaccucagcacucauggugguacaugccuguggccucagcacucagugaggcaggaagacugagguucuguugugaccagguucucaacagaauaggcuacauaauagcaauagccuuugcccugaacacucaaacaggagcagaaacaaggcagaagucaguaaccugaguacauugugagacaaaaaugugaaauucuuaaugagagaaaggugauaaauuacccuucaaagaaaacaaaaaauccccaccuaguuaagguagccauuuuuuuuucuugagcaaagaaaaaugacuauauguaaaaaacuggauuugaguuugaaacuaacaucuguagaaaaaaaggugacuacuuacuauagucauugauuuauguaauaauuuucacaaaaauaacuuuuaguuguagaaaaauaugccucacaauuucaauguuauagcuagauggcuagcuucaugccuauggauggauugaauuuucucuuaaguuguauuuguucuauucuucuggccaauaaggcccuauuacuuaauaauuauuaauuuggucauuagugcaguguuucuuaauuucuuccacccuccuucauuugucuuccaucuuguuccuuuaagauagggucuugcuuauguaaaccaggcugauaucaggcuugcuuaucuucuuacguagucuccugaguguuggccauuggagauauguccuaucauacucagcuuuuagaaaaugaaauaguuugacuuaucaguucuuuuggcauauaguuuuccauaacagcaccuuuguauaccuuauuauacuuuagccaaaguuuuauuaauuagcuaggagagaaacuuagcggggaccuugaucaagcuuucauaagcuacuagaugcuugucauaauuuaugggaugaagauauuuuaagcuuuaaaguaucuguguaaagaagguucuauuuuauuuuuauauauguuguaacagccuuggauauuuauuuucgucuuugagucaugcugaguucauuaggagcaaugguuuagauacaggcauguguuguagugcucguaugacacuuagugggucuuaaccuccacaguguccuaugagaccugaguugucacugacguaauaaaaguaagaugucaaaacaccaaaaagcaaauuaauuaaaaaauuuuuuguuuaauuuuuguuuccugcccucugguggagaaguuagugaaauaaaagugcaugaaaagcaggggugagaaaccuauguuaguaauugaugugcuaacaguaagggcuagacauguggugcaugcuuaugcucuucacacauaggaagcugagguaagagcaucacaaauucagucagacuucacuacaugacauuguuugagaacaaaacaaacaaaagucuugggagcuagagaaauggcuuggugguuaaaugcauuuguaaucaugaggacuggaguuuagaucccagaacuuauuuuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuucgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucccagaacuuauauaacaagcugggcaacacugcaaagccuguaaccccaguuucaagccagcuuucugacuuccagccugaucaagaagaaaacuccuuaagcucaagggaaggaccaugcuucaaaaggaaaaaaguuguagaaugauaggggaaggcuugaugcuugcacacccuauacauacaugugugcauauuuucacauggacauaugauauacucacaaaaacacaaaagguugaguauaugaaaguuuaaauguuagaauuucaggcuuauuuuauagucuugguuuauacaauuugagauaauaaauaugggauugaaaugauaagaaaucagagacaaauguagugguaaugcguauauucuugguacccaaaagauaggagaccccuuuuaaggcugggcaauaguggcaccugcauucaaucucagcacucaggaggcagaggcaggcagauuucugaguuugaggucagccuggucuacagagugaguuccagaacagcuagggcuacacagagaaacacugucuugaaaaaccaaguuauuauuugguuauuuauuugagacaggauuucucuucauaguccugguugugcuacaacucacuauguagaguaguuuggccuuuaacucauagagaucugccugccucugcuucccaaguacugggauuaagggcgcuagugcuaccacauugucucuccuucuaaaagagagcucucugaaguauacacaauuuuguuuuacugaaagauacuuuauuguugucuuuaagggccuucuugaaguaucacaaaguuugagaguggaaaacgaagaguuuaugaagagauacagugaugcuacagcuaaaguucaacagcuugaagaggacauuguaucagugacacauaaagccauugaaaaagaaacugaccuagacagguaucccugguauuuuaaagaaaucacuucgguuauuaacaaagcuacuuaggguuugacuaauguuuuuucaucuuacacaguuugaaggauaagcucaggaaggcacagcaugagagagagcagcuugaaugucagcugcagacagaaaaggaugagaaggagcuguauaagguaaaguccuuuucuagugucggccucugcuuagccccagugggcuuuugggguuggggauuggagagcaguucagcugggugccuggucacuugucucguuauagucacgaggaugacaaggacuguagucagcuaauggggggccuggacaguguacuuccaugguugaccaugcuuuaauagggagauccucauagcuuuuguaaggagguucuucaguugucucuagaaggccucuugagugucauaauuaugaugguugacuucagagugagcaguccaagaugggaaggaaacgagauuacgauaguggauacugucccugaaaugcaguauuugggaaauuugcugguguuuuagauacauaauagguacuguauaauaaaugaaagcuuagugaugacaggauaguuguuuaucagaauuucuauaaaguguucucaccuuuuaagaauauacauauuuucagugaugaugcuuaauauuuuuuacauuauuuguuguguauauacaugaacauccgugauuguauguacaagugugggcaugcagaagcugguguguguggagcuuagaggauaacuuugagaaguuaauucucucugccauauggggucuggagauagaauacagcugucaggcuuagccacaaguugccuuaaugucuuuuccagccccauggucauauuucagauugacuuuuaaaauauugucagauuauaauuuuauaaaguaucuccucugcucauaagucuuuuugaaauuuuucuaauuuuuuuuaaagcauuccugcaguaugcucuaaauuagcuuaaccacgggugaacauugaggcuaauuuucuaaguaucuaagaaacauuuccuauagaaaggaguggcugggaagaagggugagaaaggcacuugcacuuaaguggugcgaacccgaguccagauccuaagagugcauauaaagcuggacacaguggcauuggucuguuaucccaguuccuggaacgaggggggagguggagagaggagaguccuggaagcuuuggggcuagccagcuugauguauacaguggcagacaagagacacuaucaagaaguugaaagaaagcugacaucuggggauguccucugaccuucauacuggcaccauagcauguguguucugugacacccccauaugaauauacauagguacacaacaaguuuuuaaaaauuugagaugaauauucuaaguuguuagccucaagucacuuuucugaacugauaguuacgaacauuagguaguguuucagaagugaugcuaaagguuugggcugcugagcgcccuagaggaccagagauccauuucaucccuaggaacaggaauuaguccuuuagacuucuguagauuugaagagucaagugcaaaaaaguaauuccacugcucuguauuacacaaaaauuauugugugagugugugcauguauguacaugcaugaugugaaugcauguugugugugggggcuggucugucauaguuggccuauagaagucagagggcaacuucagccacauggaaaauaaacaacauagugcuucuuacaggcaaaaaguggaauugggcuagagguggcccagagccaucuuacugagagcuggagugugguuccuagcacccauaccaggugacuuucaaccacccagaacucugaaaccucuggccuugguggugggcaccuaacauuugaaugcacauauccacauacucacauauauauucaucauuaaaagaaagguuaaaaaaaaacaugaguauaauuguuuauguuuucaauguacccugucuaguuuucagaacuuuuuuacacuaauuucugaauaugccucuagcaugauguuuuuugcccaaaacauccgaauguauuuacauuuuaaaauggaaaauaaaugguuaaagugaaggaaaagcuuucagaggucagguaguaaguuagacaucagaaugaauugcugcgggaaacaaaagcuuccaaaagcugggcucugccacucugugucugcauugcugcuuugcagagcuugggucgccugacacccagcuccuccucuggaauuuguggaugagaaagaaauaauguugauuuuuuuuuuuaaauguauuuauuuaaugugcauugguguuuugccugcauguuugcucuggaacugggcuuauagacaggugugggcugucuuguggguguugaggauugaacuaggguccucuggaagagcagccagcacucuuuaccccugagccaugucacuagagccccaaauaaugguauuuuagacuuugacuaacuuggguuaugauguuagcaagaauauucuugauuucaaacacuuuuauuacagguacauuugaagaauacagaaauagaaaauacgaagcuugugucagagauacagacuuuaaagaauuuagauggaaacaaagaaagcaugauuacccauuucaaagaagagauuagcaaacugcaguccugcuuggcugacaaggaaaauuuguacagagcucuccugcuuacaaccucaaauaaaguaagaacuuuagaaaaauguguuugaaacuucuccaguauguuuuuuacucuuguuuuaaauucuucccagcgauuucucuuuuuaaaaagaaaucccccuuuuuaauuugcacuacauuaguuuuauuuaugcaucuggugugaugcaugugaacaccugcagaggccggagaagcacucggagccucuggagcuugggguuagaauggccucuggaaggaaggaaggaaggaaggaaggaaggaaggaaggaaggaaggaaggaaggaaggaagacacucuuacccuggugccaucuuuaguuucuccaccauuucuuuugaaaaaguuuaaaaucacaacaguuacugaacuccugccuccagcucuuaaguacugagauuauagauagguacccaucaccuuccugggcucuugcuuuauguagcauguuggaucugcucucuaacacuguacauccucaucuuuuccaguggcugcaugaucuugcaugcguacauuuauuuuauugcguagcuuuuauggaugaauguuaggauguuuuagcauguugcugugaauucuacuggggaugucauuaaugcaacucuaaaaauguuaggaguccauggcauuuacaguuccugauuaagucugcaguugcuuuuuaaucuaaaagaucgcaaaugugaaaaguguauuugauuauauuuauuugauuugcuaagaugcuaaaaauaucuuuaagcaucuuuuuagcauuuaaccaagaccagugaaaaacauaauuuuuaauuacugaggaaaaugauuacuaguugcuaaaauguuuuaguagauuguaaugcagugugaauuuaugguuauaaaagaauuuaaauagugaugaggguacaaacugaaaguuaacauccuuuuuugcuauaagauuguaagauuguaauuuaaaguuacaugaauuauacauguauauuuacauuuuaacucaaaugagagagagagagagagagagagagagagagagagagagagagauuguagaaccuuuuuccuuuugagacagguucucauuaugcaacccuagcuguccagaaacuugguauguaggucaggcagggcucaaacucaagagacugccuucuuucugccuuuugaaugcugggauuaaagauguccggcuccaugacuagcuacaagauacuacuaggaauacacuuaauagcucuauuucacucaugauuauagcuacauaguauucuuucuugucauucagcauauguguagucaguacuuaauaguuuacugucuucagcucuucugagcaugcuccaguuaauacucuuguauagcucaaguuacaauagucaugugccuaaauaaauuccuucaaauggaguugguaggcuaaaauuuuaucauaagguaagugccaccuuuugauaguuauuuucaaauugccuuuucaaaaaauacuguauuagguuuuacuccuaaugauguacuauaugcuacuguuuauaguggcuucauagcuuuucauuauauauagcauaguuuaauucaagacaauuucauuuuagacacuuuaaaaucuauuuaaaucuauuucaguguguuuaaaaaauuaauugaauucugaaagacaaaucuuugccuaugccauuuauaauuuuuugaaugauuuuugaaguuaaaauugcuagaucaagagccaagaguaauuuaagguguuggugagucuugaaaggcggcugagaagccccaauuaggguucauguaauugugcuuaauaacuguuucucuacuuuuuaaaaaauuaauuuugccaggcauggugguugcacauccuuuuaaucucaacacuuggaaggcagaggcagacaagaucuuuugugaguuuaggucuacauggugaguuccaggacagcuggggccauguggagcaaaccagucucaaaacaaaaaauaauaaguaaaaauaaaauaaaucaaucuauauguuugaacauuugggauauauauacuuuuauucagucagaacuaauccuugggugugcugacugacuuccuguccuauaaagugguagaaguaaacacuuuugggcuguuauaugagaaaucugaaacaaagccuaaggcaugaguggaaaagcauuauuuaacuuaaaauucugaaacaaacuguuaccuuuaaauuuuaauguuuuaaucaaaauuguauauuaucugccuuucuucaggaagauacauuauuuuuaaaggagcaacuucgcaaagcggaggaacaaguccaggcaacacggcaagaacuuaucuuucugacuaaagagcucagugaugcagugaaugugcgagauaaaacuauggcagaucugcauacugcacgcuuagaaaaugagagagugaagaagcagcuagccgacacacuggcagagcugcagcuacaugcuguaaagaaagaucagguaaagcaaguuaacuugcaucucuguugaucccccaaaacuagaagccccauaaaagagaggaauaaacuauucagauaagucagguaagaaaggcuaacuucuauucacucuguuaaaucauugucauuucuuggauugaauagaaaacauuuauacgcacaauucuuacugucaguaaaggcuguugcaguacacacuuuugauguauauuauaugugacagagauugcuucauguggaacuucuguuuacuagcuauauagaauggccaucugauuauuuaaggguauugcauacaaguuacguaauugcuccuuagguggaugcuuuuccucagcuguuaaguaauccuuagacucucuacuauauauaaaaaucaguagaaagcccaaacuccaaaacaaauuuaaauuaauuaaaggucagaaaaaaauaauggaaauggaguuaggauuucuuauuaaauuaugaacuaucggaauuuuuuccuuaguugaaauauuuuuuuccuaaggaaaagacugauacccuggaacaugaacugagaagagaaguugaagaucugaaacuccgucuucagauggcugcagaucauuacagagaaaaguuuaaggagugccagaggcuccaaaagcaaauaaacaaacuuucagaccaggcaguaagugucaccgaguuccugucggugaacuuuuccuuugucagccuugcguuugcagauaagauggauaauauuuuaaguauuaaccuuuugaauacaaauuaucacuucauuuuuuucuaaacacaaaucuuauuuuguacuacguugcuuauguagguauauguggguguugggggugguaugugaaggucagaggacaguuuguaggaguuuaucaucuccugguuacacucucugggucucaggaauagaggauggaacucaggaugucgucaaguuugauugcaagugcuuuuacaugcugagccauccugcuggcccgaguuuaucaucucgauuucaagucauuggccuaauacuauaacgacaauccucuuucuguuuaaacuugagauuuguauuuacugagaaugaauaaagggaaggaagcuaggucagcagcaagaacaagcaggaacagguacucuugucuucagggcguugcucucauaagcccuugauaaguagcuuugucgauuaaacucaauaugucguaguaaaugucacuuguggcaaaggugacagcucucacucuuuucucaguacucuuccguucugcucaugccacauuaggaagaggcaaaauguguuggcuuacucauuuauauuucauguaggaguagguagauucauaauaaaacagacauuucauuuggaugggccuauguauuauguacagucccaaauuguacuuauuauaugaggggaucuuggaagugaaguauaaagaaaacauugaaaaugugggguugcguggucccacaguuuuagguucucaggaacaaauaggagcaaggagugcaugcaggauaguaaaguggaaaggguucugugaagaaauaugauucacauggggauuuuuauuuguggcuuuuuuuuuuagcacauuuuaaaaaaauguaagauuuugccugcauuacaugugugcaccacauguagguuuggugcuuguauaggucagaaaagagcauugaauucccuaggauuagaguuacagauggcuauaaaccaccaugugggugcuaggaaucaaaccuagguccugugcacaagcagcacaugcucuuaccugcugagaccucuccagaccugcugaguacacuucugacuugugagauuguaagauguuuaugaugaugaguucugcugacuucacaagaaaaacacaguuaaucuucuuuccuuuccaccacuuaggaaaaugauguagcuuuauuccuuuuagguuuucagagggaguagugugguucacuuuuuuugguuauauacaugauuaguaaaggaaaucaauaugacucguucagcgacuuuuccaguaacuuacuguuaaccuuugaauaggcgaguacuaacagugucuucacaaagaaaauggggagucagcagaaagugaacgaugcuucaauaaauacagacccggcugccucuacuucugcuucugccguggauguaaagccagcagcgucaugugcagguaaaaaucuccuucuguguagugugaccuucuugaaaacuggacacugauuugauacugcgugcuuccaugugugauaauuucaggcugcuuccauaaauucuugggagagagacuugagaggcaaagugggaauaugaggguauuagugugagauggaguuauguauguggugaccaugcagagugugagugaguguaaacuaguacuuagcuucaggagaauagucacguauuaaacauuaaauugguacuagaaguacuaauuugaaccauauggaacagugaaauguaagaauuccugacauucaaaauuauguuaaaaugugacuguaaauacagaccagagaagguucuuggaacacaaugacaaaggacaaauauagaaagugaugaaguugaaaaaucuagguuuuugcagcacauuaacaacaucuaaacuggaggcuuaucuugcacuuuaauuuuuuguaacauuuaaaauauacauacauacauacauacauacauacauacauacauauaugcaugcacacacaauauauauaauguuguagggggcaaauauccucuucuaaauccuuuguuuugcagugggguacaucuuucauuaguguaccuggagacugauguuaauguuaguugguucaauguuugacuacuuaaaauugauuuaaguauaucaaauggguaaugucguaauuugaauuaacuggauuuuuaauuuaugcucuucuccccuucuuuuauguaaaacaagcaacaauagggaaaauaagugcaagcuaacuauauuuccauuuuuaguguguggugugacugacaauuuaguuuuaaaaaaugagauucccuaugcaauuaaauauugaaugaagaggagccuguagcauagucugcagcguucccuuuacuuguccucagugcagauugacgauucugacccugaaacaucuggggaaagaagugcuuucagguuucaaggguuucucuacaaagugaaugugugcacaaacaguucauuguuccuauugagaguuaagaaccugaagcaccucgcauuugcaucuuuccuacuucacccuggcauucccaaagcuuccaaguuaacggugcacuguugggagaauuugaguuucagaguugaggauaaugacauucaaccuguagugccugcugugauccuauaguguugguuuuguggagacuuagugaagggucacaaagggcuggaggaauggacucuucuuaggaguaugcaccaguugcauaaggguggccgcuggcaggcugcuuuggaaauacuuuuagugccuuuuuuuuuuuuuuuuuuuuuuuuuuuuuuugauucucacguuugaaugugagauuuguucuggucaaaaauaacauuuaaaaauucucacauaguggucagauagguucguacaugccuauaacccuagcaguggguaugaaugaaagccaucccaggcuguauaggaagacugucucaaaaacaacaaacaagacacacacacacacacacacacacacacacacacacacacacacagagagagagagagagaggcaaugugggagagaacaacaaacauaagcacuuaucaaggugccuacguuggcccuugagcccucucugucccuucaacuuuugaugcucccuguccuagucuucugaauauugggauuguagcccaguguacuccuagaccugacaacauuccagguuuuguuccacaaaacacucaaaaguuuuucugcaagaagauaaaauaaagaaaaaaaauuguuuugcuuuuugagacagcaucucucacuuuguagcccuggcugguguagaauuugauauguaagaccaggcugaccucagacagacuaaauuuuucuuugaacaaauuuauuuuuggcuagucaguagcgucacacagcuuuaacuuuagcauggcagaggcagaagcagcagauuucuuugacuuuuaaggccaggcuggccuacagagugaguuccaaaacagccaggacuauaaagaaauagggaguauggguguuuugcuugcauguaugucuaugcaucacaugcaugcauaccuaguaccuuggaggcuggaagaggguaucagguccuguggggcuagaauuauaggcaguugucagcugccagguagauguuggcaauggaacccaaguccuuugauacagcagcuccucuuacagcugagccaucucuuccuccuucagacagcaaaauuauuuuaaauauuauuuaaguauuauuuuuuuaauuaauauuaauuauuuucuaacuuguuacaacagagacaggcuuugauaugucaacaaaggaucaugucugugaaaugacuaaagaaauugcugagaaaauagaaaaguauaauaaguguaaacaacucuugcagguaagcuccuuuuucagggaacgauuugucaaauauuagaugccagcccuugguucuuuugucaaaguauagagggcucuuuccccauucuucuauacugauacugcauuugggaugaugaaagggguguuuuguguacuugucauuaucauguaggucuuaugcuucugaagucaguguuuuccauacacaugauacaguguccugucugaauaugaguuuuuauuucuguuaggaugauacauagaaaauauuugaacuuuagaagggaaguccuucuuaaaaagguauuguauaaaaaacuaggaaauugugugguguucacucaucuacuuccuaguguugauguauauggaggccacagguugacuucaggaugucuuccuuagucgcuucuuuaagugcuuuuucagacagggucugucacugaaccugaagacagcaguuuuggcugaacuggcugccugcgagcccugggagcuacugcguucauucucccuaccaccaggguuacagacauggcugccauggucaauggugcuagagaucucaguucagguccucaugcuugugcaaccaaguacauuacccaucuagcaaagaaugggaauguuaagcaaacgaauugucucucagugugauuuuaaugauuuuaagcagcauuguucagauucuuugaauuuuguuagcuuuaaugguguacucacuuugaauuaguuaaaguauagggguggaagcuucucauuacuaucuagaauaaagaacaaaguuauuuuauauuuggauaugguuuuuaaggguguguguguauuugcauaugcgcaaggaagguaacuuuuagaacaacaaugaaauucauagauccgcucaauguuacuaaaagauacuuuuuuuuuuuuugcuacuugcuuuuaaaguaauguuuaaaguguuuugaucaaauuucaaacugggcuuuuugagaucuuucuauagaagaagugagaaugguccugauguucuaguguaauguagugcuuggguuuuuguaaaaaacguagugcaguguacauuguaggacaaggcacacaugacuauacaguuuauacaauuguugcugggguguguauuauaacagaguguuuggauuuuguuuaauuuuuguuuucauguguacgggcauuuugccugcagauaugaguaugcacugcaugugugguagcagaaaucaccuuguccagggcccugaaaacugucuugaagugcucauugucuucugagcuggcaagaaugaauguguugcuuucucucugugccaacagugcuccucacaugggucuacccagaugggagcuccuuugacaagccuacaagauggaggacauuaggaucaacucugaaaauuguugauacaaauucaucuauaggccuguccuuuugauguuuuuuucuuuagauaaagaguuuuuauguuucucuggaaguaguagagucaauuucuaggaaaccuuagcuguuuuuuguuuuuuuuuuuuuuuucucaacuuaaccauguuuggacccaguuuugugauaaagaugaaauaaauagaagcaguuuccucuuccccuuuuccuccccauugcugcuguuguaggacuagagauucagcugcugacauguucuggccaaagcugaggggauuagacuugacuggguuuguuaggcaucuguggguguucagguagucuugucuagcauggacagcuuuuuccugguuggacagcugaguguucuaaaaagacuuggggguggcugagugagugagcguggcacuggaagcagucuggaaaguggagagaaaauggugauaaugcuuggggggggauucuugauugauagaggcacugugaacauuuacauagaagccuuuuguggucaaaggggauuagauauuuucacucagaugcccaggugcuaggauagggcuuuguaagaaaucaguacauaguuuuucuuuggugcuguuuuaucacuuuauacaucaagcuaaugacuauaaugagaauauuauuguaguuuaaguugcauuuccauaauguuuacauuucuuucuuagauaugugcauaugugcguauguaugugugcauguuguauaugugccaugccugugcauguugguacacguacacauuugaguguacaucuguggagacuagaguuaauugugaacugauugcuuuccaacaggcuuucucccugagccucaagauuacuaauuggcuaggcuagccaaucagcgagcucugggggaucugccuggcccugugcaucucagcucugggcuugcaaaugcaaaugcaugccaucacaccugaguuuuacauggcugcuggggauccacacaggucucaugcuuuguguguagauggaguuacuuuuucucuguuguaugugugauguugauuuuguuugcuuaauguuuuuagaaaaucaaauuuuaauuaugguagaguaucaauuuuguuuauauuuugugcuuuuuuuuuuuuuaaacacauucugcaaggcauuaaacauauucccugcacugccccaggaguuacuuguuuugcuuuuguugugcuuggagaucaaacccaggccuuaggccagugaucugcuagugagcuacaacucgugguccauccagaaguuuuauagacagcuuuuacauugagguuuaugaaacuuuuggagcuguuuuguuuguuuguugguugguugguugguuguuguuguuuuuuguauguuaugaaguauagaagguaugguguagaguuuagaugguugaaauugcucaaaauauauuuuugaacuucaccuugaaauccaacaacccccuucaugauaaaagucauggaaagaucaggaauucaaggcccauaccuaaacaugauaaaagcaauauacagcaaaccaguacccagcaucaaaguaaauggugagaagcuggaagcaaucccacuaaaaucagggacuagacaaggcugcccauuuucucccuaccuauugaauuuaguacuugaaguccuagcccgagcaauuugacaacaaaaggagaucaaggguauacaaauuggaaaggaagaagccaaaauaucucuauuugcagaugauaugauaguauauauaagugacccuaaaaauuccaccagagaacuccuaacccugauaaacaacuucagugcaguuagcuggauauaaaauuaacucaaacaaaucagugaccuuucucuacacaaaggauaaacaggcugagaaagaaauuagggaaacaacacccuucacaauagucacaaauaauauaaaauaccuaggcgugacucuaacuaaggaagugaaagaucuguaugacaagaacuucaagucucugaagaaagaaauugaagaagauuucagaagauggaaagaucucccaugcucauggauuggcaggauuaauauaguaaaaauggcuauccugccgaaagcaaucuacagauucaaugcacuccccaucaaaauuccaacucaauucuucacugaguuagaaagggcaauuugcaaauucaucuggaauaacaaaaaaccuaggauaaaaaaaacucuucucaacaaaaaagaaccucugggggaaucaccaugccugaccuaaagccguacuacagagcaauugugauuaaaaacugcaugguacaucgacagacagguagaucaauggaauagaauugaagacccagaaaugaacccacacaccuauggucacuugauuuuugacaagggagcuaaaaccauccaguggaaaacagacagcauuuucaacaaauggugcuggcacaacuggugguuaucauauagaagaaugcgaauugauccauucuuaucuccuguacaaagcucaagucuaaguggaucaaagaacuccacaaauauucauaaugaaauuggccuauuuacuuuuuggucucuauuuguaacuucuuccuuguguuuuuaagaaaaagagccaucauaaagugcaugauuuagauuuccuccuuuugcaaaaguaguacuuuugugaaauaauauuuaucaugauccaaguacaggaauuauggcuauuuggguuauauuuuucuguauaacacugacacucauauuaaauauaacuguuggaagcaaauuauaagcuagugggauauaucauauacccucuuuugcaguguacaguuaauaugacaccucuccuggcuuuauacuguuacauuaaucauuacauguguguauaaagauauuuacucuguggagaugugaaguuuuuaguuauuguacuaauuuuaauuuuauuuaggaugagaaaacuaagugcaauaaauacgcugaagaacuugccaaaauggagcugaaguggaaagaacaagugaaaauugcugaaaauguaaaacuugaacuagcugaaguagaggauaacuacaaaguaaguucauaggcuuggcucauggugcuuggugaaccugguccuggucaaagugagauccuauagaccaucagccaagcacaguuuccauauagauaugcuggguauuuaauuacauacaguuuauucacuugccugagaaaauggccucccauaugcauugguuaauguggcuuuaguccuuuggguucagguggacuuugaaauuuaccauuuaaaaaaguuuuuaguacauauuaauuauauaaaaucauaggcuucaguauauuuucauguaucuguuugauauauuuuuauaauauuccaccuguugcacacugcaucuucccacugagacccuguuuaaauaggucacuucuuucaugcccuguccugugucugccaccucccuccccaaggcacaugcuuuuucuuagugcugcuuuuaggaucuugggugagguuauuuacaggagcaugcgcaguguaguagugacuauaccacugaggaaaacaucucuccuucuuuuaguagcuguuaacuacguaucaauccucagagaagugugaggccucauuagauuacacccuccaugauggaauguugaugacucaaucuuaugcagucuuaggcagguaaucagguuugcugagaauucgaguaucuaaaggccaugucacucccagaagacaguauuccacagacucuuagauucuuugugcucuuucuucuucuucuucuucaguaguguccccaagccuuggaugaagugacacggauguccauugggggauaagcacucaauagucauuuaaugucagcacuuugacuaguucuauaacugcaaagagaagcuuucucugaucaaagcugacuguagcacuaacuuguaggcuuaaacucaacagaggguggcuugacagauguauauucaucaugaccauuuagccguaguccuauguucucccuagcuacgggcuuuugacuagauguaccccacuagauagauaggaguucccuccaauggauacuccaaccaggaagugguuagucugucagucucagccucacgcacuccaccuccuaccccagccugcuggucuguugcugugaaagcuagccacccuggaauaagaaguucacagcucagcuccagcuugguuucuuuaaguccuguaaccaaaauaaugugaugucuuaaguaagcuguaagguguuuccuuccaguuuggauacguagucaauaccaguggcgauaacuucuauuguuuuggacuggccaacaacccacagggaguaauccauuccaaaaaaaauuguaucuuuagauucaaucauuucauuuucuuacuguauugcaaauguguauguuaaauuauuuugggacuugaccucuuuuaaauguguauguguaauugauauauuaucauuaacuugcuagccuuaaaauuuaucauaauacugugaugugguauaauauuaauugaagaaacuuauuuuuaucaguguaauauuacaaccccaauaauaaaugauaucuguaagaauguuagaaaaaaagagcaagcuaccugacuaguaagucaaaaaauauuauccuuuuaaggauuaaaauguauucagugguguaggaacuaguaaggaagcuauaaccccacccaaggcccuauaagcaacuuuaaugaaaccccuuaggucaucaguaacucugaacguagaugaggggaagaggacgagaaucauugggaggaaggggaauaggaaggauaguaggaggugcauaucacaaaaguacacuguggauguuguguguaauugaugcguuaauacauuuuaaaaggauaaggaaagcaagguaugguggccccaccauugaugucuggagucugagauaggagaauugagagagugagacuaaccuaaccuaguucuagucagcccggcgacauaaaacuggucaguaauggcagcuaauacacagacugagaacuggggaaaagaacugaacuuggugauagaaaaauuaccuugauaguagugguucaagugagucuccugugugaggagaaaauagauaauacaaauacuaacgauaaucucucuuuuaaauucagguucagcuggcggagaaagagaaagaaauaaauggucuggcuucauauuuggaaaaucucuccagggagaagguauugagcagugcacucauuguguacagcauguaaccgauuuuugcuuucuuucaucugacuucucuuugaaagcuuuccuccaggucuucaacuauuaccucccugguaguaaacaguaauuuguguaccauucucacuuccagauuucacaucugccaauuuuugaaaguaugccaaguguugaaaauugcuaguuuucucgaaaaaaaaaugaaaaacgaaaagaaaauugcuuguuugaucuccaucacauacuuugcauuagauaauaagcuaaguuuagaauaugcaaauguagggaagaagugaauuuuuaauuggguauuugcucaaacuuagauguuuucuugaagugaauuuguuaauuaaagggaaaaaauugauacuguuucuugcuaauauaaaguucaaaccuugaaccaaacuaaaauuuugacaacuugugucuucuguguuaauuugaugcugacuaguguguacaaauguauuuaacagucugguggcugaauuuggaagaucuuaaggaguagauccucagguuggaugguguaacucugcuacaaaauggaacuuugagccuccugcuucccuaguugucuuuugucauucugucaggaaagccuguuugucgucuuguauugauguuuguauuugugguuugaccguagucugcuaauccacuggugucccccagucuguugugaugucccugugagguagcaugaccauccuuuacaggccagcaacucagcugcaugagcuugcuucuacugcaggucaguuagguacuacgauuaaacuuacccguuggaccuguacuuuuacuucauaguacuuuccauaauuuuuaacuaugcacauuauuuguauauauuuuauguuucuuuguugggaaucuguuucuucuacuuaauuacaugguccaugaagaguacagauuguaccuguuuuacucauuguauuugcagccucuuuuacaauaccugcuauuugaaguuaagcauuuguuaaauggauaaacuaauggagcaaauauaauuuauagcauuugccuuugagaagauuugauggaagaaauauacugagaucaguagcuuuauugucaguuuuaaaaaugccaaccuuaccaggaauguuguguugaauacuugcuaucugcuuucauuuauuacuacuacuacuauuauuauuuacuauuauaaaacuuugaacuuacuuuuuuguuuccuguaguauggcauuguuuaaaaguguuuuaaguauuugcauugugaugucaaccuguuuaauauuuaguucuucgaguguauuucugagaauucuaaaaccugccgaagcugagauuagugcuagguuguuagucaucacggaccccuagguguacacacacuugccuagaaggcagcaaguggucaguagcaguagucggguaaauaagugcugaccccacugcugcugauguuucuuuuuaaagauucauuuguugucugugugaguucuugccagcauguauguguaugucuguguucacccuacaccccuucucauuguuuuuguuuuguuuuguuuuuuuguuuuuugaaagggggaagaaguaaaaaggaagcacaguguagacuaggggaagaugguauagaggcaguguaggaggacgggucccuucccuuagaucugcuguuacaggugauuguuagcuuagcagugggugcugggaacugaaccuggagccuuggcaaaagcagguauugcuagcccccaagccucucuuuaccuccuccugcuugagacagguuucacuaaguaaccuagccuggcuuugaacucaguauauaguccaggcuaucuucaaacucuggugauccuucuuaucucagcuuccagacaacuucuuuuagaaggcuuuguuguuguuguuguuuuuuaauguguugccugcaugaauaucuguauauugugcaugugagcucaaagaggccagaagagggugucaaaucccucaggagcuagaguuuuacacaguuagagauuaccauguaggugguaggaauuguacucaggucuucuggaagagcagucaaugcucuuaacugcuaagccaucucuuuagccuauaauucucuuuuucuuaaaaacagcagguuuacuaagacuuacauuuagauuaucuguaugguuuuguagauugaggacugcuucauuggacugccauauuuuaaaccacuagagugaaauuaguggauuccuaagaaacuuaaucuucauagcauuucucuuugagggggcaacuugagaugguagucuccagcugugcauccucugccucccagguacuaggacuuaccguauauagacauuuaaauguuaaaaucucuuauagaagaaaaugguggcuuuuaagagaagagguauacugagucacaugaugcuugagccugaaaucuagcuuguuuagggaucucucucccuuuuccuccaucuuccccucuuuuuccaucccuccuuccucucagcccccuuucauacuuuuuuggauggugcugggcaagcaggcccaaauacuucuggauguuagacuagacaggguucuacuauuaaacuguaucuuuagcuuugagacaggaguuuucauuagaacucaggcaugccuugaauucacuuuguaugucaggcuugccucaaucuuggaguccuacuuccucuaccuuccaaaugcuaauauacuguuuugaaauauuagcaguuuaagauguucuauuuccaucuuagaaucauuuugucaauucauggagaagccugcuggaauuuuuuaaauuaguauuucauuguaucuacaguuaguuuaguaacuaauuguaaaaacaauuuucugucuguauacuugguaugcaucccuccauuugugcucucuuuuaucacacucaguaucugucuuagucagaguuucuauuccugcacaaacaucaugaccaaaagcaaguuggggaggaaaggguuuauucagcuuacucuuccacauugcuguucaucaccaaaggaagucaggacuggaacucaagcaggucagggagcaggagcugaugcagaggccauggagggauguucuuuacuggcuugcuuccccuggcuugcucagccugcucucuuauagaaccaagacuaccagcccagagaugcucccacccacaaggggccuuucccccuugaucacuaauugagaaaauaccuuacaguuggaucucauggaggcauuuccucaacugaagcuccuuucucugugauaacuccagccugugucaaguugacacaaaacuagccaguacaguaucguuuuauucuuagugcauaagcacugugcaucuuuuugcuaauuuccuaggcacuuucucucauugauuucacuaacuagaacuauacuucucauucucuuauauauauauguguguguguguauauauacauauauguauauauauaugcauauauuauauggacauaauugacuauauguugacuuugagucuuguaaccuaaauucacuccuaacuccucuguuguaguuucuucuuuucuuuuuuuucuuuuuuuuguuguuguuuuuuucaagacacgguuucucuguguagcccuggcuguccuggaacucacucuguagaccaggcuggccucgaacucagaaaucuaccugccucugccucccgagugcuaggauuaaagacaugugccaccacugcccagcauagcuucuuuuuguauguauaguuguauccucugaauaaagacagauucuuuucuuuuucagccugucugccuuaaucuugucuuaugcagaaguuaacacuaguuauagugaagagaguuagggaguacagagccuuuacuuauauuuuaucugcaauagaaucacuugauuguuuucuacuuuauauacuucaugaguucuuuuccaauuagggaaauuauuuuuuauucuaacuugcuggauuuuuaaaauaucugaauaaaucuuggauuuucugcauacacugaauuuuuuuuccucccuauucuguuaacaugauuucuuaagaagauguuugucauugugacaugcuagagaaauguuaguucuguauuugugcuaaguguuuacauuguccucaaaggacuuugcuugucucuguuuuguuaauuuuaggaacuuacaaagaguuuagaagaucaaaaaggaaggaaauuggaaggccagagcccucaacaagucucaaggugucucaacacauguucugagcaaaaugggcuccuuccuccacugucaagugcacagccaguucuucaguauggcaacccuuacucagcacaggaaacaagagguuagucaaguauuuuuuuggcauggcguuagcugacucuaaaacauucagcuuuuauuuucauggaaguaaguaagcugaggauauaaucaacuauaaucauguaguuuucauauuaauguuuaguuguacuacugacaucuacaggugauaugucaugagugaagagccguauuugcuuaucacagacucaguuuuuagacuugugggcuaaaaauaaaaacauaagaaacagucuuagucuguaaccuagccugggaugugcuaccaugcccacauggccucuguggcccuucuuccucuuggagugccaaggcuuccaggccuuuuggcgcuucaggaaagcacauuccacugagccacacacugaguuccugugugcuucucuauaucaucauaacuacauagagagagagagaugcucauuucuugcaacugguuucauccaauucuuccccaaauguuuguguaauuccuaucacagauggagcagauggugcuuuuuauccagaugaaauccaaaggccaccugugcgagucccaucuugggaagacaauguugucuguagccagccugcucgaaaccuuagccggccggaugguuuagaggaccccgaagacagcagaguaaauugaguuuuaauuauuugagccugccugcuuuugugcuuccuaauuuagguggaguguuaaggcuguaugucuagaaagacugaauuugcauuugcaugugauugccuuuauuauuuuuuuuuaaaaaaaauauuccauguuugaaaauccaaccagugcugggcagugguggcacaugccuuuaaucccagcacucaggaaacaaggucagccuugucuacaggacagcaaggacugacuauacagagaaaccaugugugugguguguaugggggaugcaggagguaguauuuuuuucagacuuaacacuuuaggcuuuauauacuaaagauuaaguucagagaugauuggaauguaucaauuaucaguguaacccuaauuaugacuuucuaaauaacuaccuacaauccuuugauuguggucugcuggccuggaagaaacaaaguaugaagaugcaaagauacuaugcaaagcagaauacugccauuucaguuuuauauuuauauccuguaaauuuuaagguaaaauuuauuaucuuuaucauauacuaguuuucuuuuucuuuuuuugagaaaauccccuuuagacauuguuaauauuuauaugauuuuuuucuaguagcaacauaaaaaugauaauuaaauuagcuuauaugguguaagauuauuauuauuauuuugguuuugggauagggucuuucugcauaccauuggcuguccuggaacucaguauauagaccaggguguucuccuacuccuagaaauccaccugcuuguuccucccagugcugagauugaaggcauagguuaccguguuugacuaaaagauuauuuuuaagagauuuccccccauuuaauuaaugaauaaaauuucuuagaacaguucuuuuguggggugggaacucccuuuugcauaacaguucuuagauauuuugugcacugagauaaauuucaaggaaaugguuuaucgugcucuuugcaaguacagugguaucaugacccguuucucauuuaauauaguuugcugcauuuaauugcuauuaaccuuugcagaaacugaucaguguucagacaggcaugauuuuagaccuaguguucaacacucauaauggagaaaaauguauuucucccuccugccuuuuggccucccguguccauuauugggaauaauuaggaaaacugucagaacuuuuguagucuguuuaaggucucuaguauuaucuuacugcuuuuucuacaauuuuccuuuccaccuugcauaucuaaucugaucacucuuggcauagauguuacaugugacaagccuuuccuuuccacagucaucugcuucagcuuaauuagcagcguguucuuucuggucugugugcuuugcccuccugcaaacccaugagaaacaguguuagcgucuugggcucauuugcugagaugcuuagauuggcuaaugagagagaaggguucuuacuaugugugccuggaguagcuguaguuuauaaacagaaaaauuuuccguacuuuuuauuuacaucauuugcaaaugaugaguuuuacuauguaguuuuaguaagaauaggaaaguaguagauuuugcugugagagugguucguggucacagugcccuaaugggcaccuuggaguaagaguugagcuguccuacucuuuuagccuaugcugcaaccuccagcugccacuuccucucuuguacuagaaacugguggcuuucagaucccuucauaagucucguauaccuaauaauuguaaugauauuacagggaguaaguguuucucuagcucuuugccugcugagccuuauauacaugauaggucacuuauuuaccaugguaguguuauagaggcggauugucagcuuugcuaguugcuaguggaagaagcugaggaacagguuaacuaguuaggccuaaucacaccacugguaaaguagacauaggaucagaaccucuucaggucaugugugaaagcugugguuuuaacugucucucagcuguggcuacaucagaguucuguacuucucauagcacccugaacauuuuccucacauacuaauauauuuaguuaccuuuagaaauagcaugucugaauuaagacuuuguguuuauuuuuaaauaaccauagucaccaucgggaugugugugaucauuggccacuguacagcuuuuugagcuuuggaaucacauuugacaagcuaauugcuuacuucacguuagcuuuucuauagcacuugcuuugcauuucggcagggccagggacucagcuucucagaguuaggguggccuggaagaguuagcacuguccagagcugaaacggacggagcagggguugaauuggguuuucagugcugccugacaaacacaggauuaaaguccaauagaacccauaugaauuucagugguaaauuucaguuuuuagaaccaugaucuuuacuuuacuacucauuaagugugguuuguauauaagcagugguacggccucgagaauugcagaaguggaggcuuuccugccuccagcucccugagaaucaguggauauguggcagucguuguuucaggugcagcgauccugaguuuaagacuagauauuucccucccucaguacacagcuccuuccuacuuucaugcauuuuuuuuucuucauucuuauuucuauuaagguguuuuauugcagcuuucugaaauucugaaaugagucuuuaauaaugacccccccacccccaccucacugaagaucauuuuguugguuuacauuuuucugucacaaucuuagcauuucuuguaagaagugugguucucaaugagucuugugacucuagaauuauugaaaaucacacuuugaaagaaucagggcuguucccuguuuguccuaauguacguacggcuuguggcuucauuuuaaauuggccaucagguuaaaaguacuuguucuaguguguuuacaaaaaaugauauacaaaguauucaauuaauuuuuacugaguagccagaaaaguacaguggaagauuccucucuggaucguuguuucucuugauuagacagaaauagauuucucuuccuuucugguuuuacuuuuguuuuagccuccucugccguuuaaagguuagguuaccuuagcaugguagugcugggcaguagcuauuggaauacaggucccccuggaaaggaugaagggcgugcucagcagucagacuaguguaguuaucacggagucaguguggaaacauuuuuuugccacuacaaaggaaagaaacucuuguucuuuaccuuacccccucccuucuauuccuuuaccccagaaaaucuccaucugcuuccuuuugcacugccuauucucaucauucagcucccuaaaucacaccguaucguacgaggucuaugggcuuccccagcagauuuucaaaaaguuaucacuuuuuuagcaugcauuuauguuuagcauggaaaugugcuugcuuccuucauugcuggauaauacuccaucaucugaaucguguauauacauacuuagauuuauuuuuauuuuuuguauaugaguauuugccuacauguaugucugugucccaugcaugugccuggugcuagugggggccagaaggaagcauugauccccuggaacuggaguuacaggcaguugugagccacuguguggucaugggaacugaaccugguucauugcaagagccagugagugcucuuaaccacugagccaucucaccagccccuuaauauugcauauuuuaugucuuuuuuauuggauugcaucauuuuccccauugggcuacugugaacagugcuuuucugggauaauacaucuuuucacuuucuuggggacacaauauaaaaaagaaaaaagaggaauguucauguacaccaccuaauacagguuuugagaggcaggaguaucuucuggcuuuaaauaagcugucuagucacucaugccuucuuugucuuaugcauugauauuggcauucaugaaugcuucaguuucuuaaagaugcauacuuuugaauuaaaguaguaauuaccaacuagcaaagaucuaugcagugcugagcccuucucacuugaugcuuauuacagauuccugaauguaacuaaauauuuuagcuaauaauuccugcaaagguagaugcagucccacacauggcaacuggagacucugacuuuguuacuugguuacugacaucugaaugucugaauguauugugcuguaauuugaucauuauagcccccucuccuccuccuccuccuccuccucuucuucuugguguuaaagugcuaagauuaacacuuuauguauuuauguauauggguguuuugcuuguuuaugucuguauacuucaugcauccuggugcuuaaggaggccagaaaagggucacagauacccuggaacuagaguugcagaugguuaugagccaucauguggauucugggaauagaaaccccccagguccuucacaagggcagcaaguacuguuaaccacugagucaucucuucagcuccacauuuugaaauguauuuuuaaguaaacaguucuguaacaauucacccuaaacaaccaguuuccagaguuuuaucuuaaaaagacaaauaacucuauaaucauuaaauacuucccuuguccugaaaaaucacacaucuaauugaucuucuugaaugauuauucuggauaucccuguaaucauaaaauauuugggauuuuguuguuguuguuguuuuguaauuggcuuauuuuauguuguauuuuuaaagggccauuuauaguauaaacauguuagaauuaccuuuuaaaaauucuuuuuacacuuucgggguguguguguguguguguguguguguguguguguguguguguguugugugcauguaugggcauauaugcagauacccuguguguguguguguguguguguguguguguguguguguguguguguguguguugugugcauguaugggcauauaugcagauacccugagggccagaagagggugucagauacccaggaguuagaguugcagguaauuguaggccaacagaugugggugcgaggaacugaacuugggucuucugcaaaaacagcaaguguucuuaacugcugccccuucuguuuaguuacuguucuacugcuguaaaacgaugcuaugaucaaggcaacuuacagaagaaagcauuuaauugggggcuugcuuacaguuucacagagugaguccguaccaucauggcaggaaggauggcaggaagcuggcauggcacuggagcaguagcugagagcucauacagaaaaaccaugagacagaaagagccuuaaagcucaccaccagugacacaccuccuaauccccaaagcagcuccaccaacugaaaccaagcauucagauguaugcgcccauugauagcauucucagucagacgaccacagcauccuaacaaacagcccagaaaucuuucaaauacaccguuguucaucuucaauuucuaauauaauuugauucaaguuuauuaauauaaaaauuaaccaauggcauuucauucuuuuaacuuauagcuaugugaugaaauacaaaaauacauugaaaauuuugaguuauuuugcuuuuaacucuccacccccuacuucuauuuagggucugcuuuaauagugucauucccaauccagucuccauuuucauugguguggacuugggagugaaguagggauagauuguagugguuuuuguuuuauuuugaagacucuacugauucauuaucauguuuuuaguucuuguaaguugucaacuguggucuggaagucauuccuacauguuaguugcauuuaguuuagaguagugugcuaaaaaaaaaaucucaugaaaggcaagucacuucuuuguccaguguauuugccuguguauguuuauguuccuuaauaacuuaguagaagucuguuuucagacugaaguguuuguguucaaguaacugcuuuacuuaaugaugggcucaaagcacuaagaagugguacuggaaauuggauaugccaacaaaacauccauaaaguccugucuuuaaagccaggcggugaaguacacgccuucaguuccagcacuaggaggcugaggcagguggaucuccaaguuugaggcuacccuaguuuauagagugaguuuugggagagccagaacugcacagagaaacccuaucucaaaaaccaaaccacaaccaaaaguugaaagaccauaagauacuuugugguacuagagcucaacuucacauguguuacagcgugugguucuguuuugcuuuucuuaaccucuuaaccauguuuuauuuguaaauuaaaguuuuccauaaccaugaauggaagaagaacgacagcauuggucuggaccucacuuuccggugucuacuguggcauuuggaaugcaugcccuggaauggggaggcauacagacuucagaaaagucacacaaucuguccuagugaaauacucucuauaaaugcuuucaaauaaaauguauguuuaugggaaaguuuaaauaauaauagagguaaaaacuaaauugaguuaucuaagugucauuaugagcucccugaauuaaacaauguauauauuugguuucucuuuucucaaaaaguugcccuguuugguuuuuguuuuguguuugccaggaagacgaaaaugugcccauuccuccugauccagcaaaccagcacuuacguagucauggagcaggcuuuugcuuugauuccaggcaaguuuuuccuuuguagaauuuuauagaauuauguaagacaggugauucuaaaaauuaguuucugggagcuuauuuaaaauagugcccgagcccagcauacagaacauaaaucccuuucaaggucccggccauucacuuuuaucucgucuucugugguucagacaugccaucuuuugaagagcuagaggcauaggaacuuggaaauauuuuuaaaaucuguguguucuguuuugggucuguucacaggaggccagguccucacagaggccagcaaagggcaucugacuuccuggcgcucgaggucaggcaguugagagccaagagagggggaacaagcugacccugugcaggagaggacgagcccuuccucagccccacagucugugguuguuaaacccagcaggcacugcggggaaaugacgagguguauucauccuuggaaguaaaaaaaaaacaaaaacauucugguuuaaaagugggaguuuuuuacaguaagccucauuucacagaaugccugaguuugguagguuuugguguuugucaguccaauuuuaaaacuauauuuaguagugguuuucuaaaaaggcagauccuguacauauuaccaagaaucuagaaacagagaaaguaaacgugugaagacuuugaggauaaauuguuuaguguaaauaucagcuaauuaauuaauucaacuuguacacugacaggugcuauaucaaguuaauuagaaaauaccuaauucuuuauuuucuucuuucuuuaaaagcuuugauguucacaagaaauguccccucugugaauuaauguucccuccuaacuacgaucagaccaaauuugaagaacacguugaaagucacuggaagguguguccaaugugcagcgagcaguucccgccggacuacgaccagcagggguuugaaaggcauguucagacccauuuugaucagaauguucucaacuucgacuagcuuguaauaagagguaguacaauuuagcaauuacaaaacaaaccacaucucagaggcuaaggagaugccaggugucacuuucagguuccuccuccacacuuuccugaugauggagaacuucuuuagcgugugcugucacuagggccaggguacagcugugacuacauacaaugaauacaguuuuaaucucuguuaaucuugucugcuguaagaagagugcuucuggguuugcaucucugucuauccuccaguuagcagaagugugugaagaacacaagaauuauuuuaauguuaccgaauugcaaacauaaacauguaguaguuagauccucagcacaaucacacuuacaaguuucuguacaccuuggcgauugagcaugaccacugauauguaauaaaaagcauugaucauaacaguucugugaaauaauucuuugaauauagaaaaacccuuacucaaugaaaugauaaauuuuaaaaucguacuuagauguggagcugcaagaagaaugagauaaguggugugaagaaacccuuuuuauaugggaacgcuggcuuauggcauauuuagauaauuuuaugauaacauuuuagcauaaucuagaugacuauuuuuaaaugauugaguuuguauuuauaacuagcuauaauuguauuuaacuauaauggaccaaaauaaaucaaggcauuaucuguucucauuaaaugaccuuuguaaaugauucggggcauaaaauggcagacuguguaccauggucuuucucacauuuuccugaugagcauacacguuggacauaacguuccucaggaagugcucagaaauacaaugcacaacccagacccaacaacugugcuucucagucacagcuaacauuauagaagacaguguggggggcugucaugucacuguagcauucacacacgugcacgcgagcgcgcgcgcgcacacgcacacacacacauacacacacacacacacacacucccuuuuaugaugggaauguuaaaguacuuuuugcugcuuuaguagucacuaaaauagaggcccauucugagcaaacuagguauuggagauguuaaauaaauauucagaguugguagcauucuagauugcugucuguaaacugcuguauaccaugcugcugguauuuauagaagaguuuguguauuaauugaaucauuugaaaagguauauguauauguuuuaaaauauuuuuauuuuugcauuuauuuuauuugaaaggguauuuaaaucuaggcuguagauucagauugccguagauucuagagugaaccagcaggagacauucggacugccaggcgucaggcaguccuuagaggcagggccagcgguggauacaccuucagcauccuggcgaguccuccauagaauauccuugggcaacgugugccccacaugagaccuuggaggccauggugaugcuuaguuuggaaagugcuggcugugcugaguucugaucccagcacuggugugagaaagcagacguguugcuggggggcagcaacaggauguccucgcaugugcuggucagccagucuacacagcucaucuucagguucaguaagagacccugucccaagguggagacaugacucaggaugacaccugauguugacaucuggccuccacacgugugcacauacuguggacauuucuccugcaguuaggaaguaugacccaugcuaaccugaaaguagucuuugaauauuacugucagugaaacgaggcugcucaucuuguuggcuguuuaacuggauaguuuauguagaguuuuagucccaagcuuaucauaaaguguuacuuacagaaaaguaagcaaaacauaagggaacaaaaccuuuacauaucaccuagauucugcaaaauaacuaggagcguaauagaacaggcccuggacagauguuuuaguucccacaguaaacuugaugucgguucuuauagcggagcuaauuaaaauaaagagccauauuuauuuugggucagaggcaguuuauuuuaaaugugauuucauguacauuuauuaagcagcuuuucuugacagaaaguuugaguaaauugccuucaauucugauaguucuguugcuuucaaacuuaaugugcucuguccccaacaaaacauaugaaaauauaauuuaaagcacgguuuucacagacacgguacaauacauucacuauacacgguguaacaaaauaucccuuccucaccuguuuaguaauacugucacaaugaagaaguagaaacuggguuuuaucacugaaagguuuuuaacaugcacaaugacuguuuuuaugccuguguagcugcugaacuacugauccagcccgcaguuucucacacuagaaagagcaaagcuaacuauuaauugcuggccuaacuuuuuuggucaacuguagguagauguggagcaaguagggccuucuuuugcaccaacuucuauucugaauucuggaucauccauuuaacaccaugagagcuaacacuguagagucaagaccgagaccacuuuucagagcugaggacauuuuuagugggcagcaucuuuauaaauauuguuaaaucccucaucaugagggauugaugcagaagcuuacccaucuguuuaacagaauugucuucacagugugaaugcugaggagggacgacuagcuagcuguguguaagacugcgucagaugggaacacgggggaaaagguuauuuuagagggaaucugagucugccuuucaccaguuuguacugugugcaguuagcugugucaaagcaacguuuauugcguauuaggcaaccgguaaacucuuguuuaaagaauagcacuugggagaaaagaacacucaacacaugaugguacugucggugagagaagcuccaggacgauccagauguaggccacucuuagugggucuauuagucacucuuccuugaccaccugcugcaagaagcacuuaaugucaguaaggcuuauuuucauauucuggcaaaauguuuucuaaagcuaaacagacauuucuaaugagaaugcagacaucuacagugugauaggaaagugccuuuaaaagucgcaacugaacaggaaaggggcaguaggggucuuagcaaccuuccucgcucaaacacacuucugaauuuuaguucggauugcaacccacagaucucuuagggcaauaguugcaagaauuggcaacgucuaaacaaaauuguuggcaauagagaacuacaaagugcuuuaaaaccucaucuauugaugaagcuauaacuaaguuucacacacacacaauuugcacuuaaguauuucaaaguguuuccuaacauuucagggaaaaguauuucacugguaucuugguccacaaguaacuuagguauaacuucagucucuugcacccagcaggcacucaaugagaauguuagcauuaaugagugaacugaguccuuugcacaaagaugccauuuagaacacuaaaaugauugguaaguucgauggcaagaauuucagcuucuuaaagggcaagauaauaacuaaaaaaaaaaaagaaagaaaagaaagcacaccuuuuaugcauguuauuuaaauaugaaaauauuuuuagcauauuauguuaaacauucuuauuuauauuuccauuaccuaaagucuuucuacucacaaauacuaacuccauuauguaaggcaugauaaccaguuugauaaugaagguauuauuuugguuuuaugugagucgauguguugaaaagcuucaaucacauuacaaucuuaaaacaucucagugccagccccuccucucccaguugacaucacugcaaugugguuaaacaauaugcaacaugcccuucauuuauuuuguuuuggggaaaaugugcugaagaaccuagagcuuguuuuguuuagcaccuuauaucaacguaauggaaaugggcgugaugauuacaugugcaaauguacaaaaucauuaacuacaaagauacaucauuccaaaaguacagaaaagguuaaagcaugcauuuaauuauuuuucauuaaaggguugcugagugcuuccccugaaaaaagguggcuguuuucaaaaucagcaacugcuggugaggauuucuuggcacaguucugaccagcacgcuacugcugcaucuuccugaucaucucggcagacacugggggauggaaauugauuguguggugccgcaggcccugagcugucuuguaacucuucccacaccggcauuugaaugguuugcggacgcgaaucuguguucggugaccauucuuagcaugguacuuuaugccauucacauucug

SEQ ID NO: 3007 - RNA, 1923 nt, Mus musculus
uaauuuuacuacuguuaaucacauauaccccaggaggucuuugucuguggccauaaucgcagucuuuccugggaggcuugggauuuuguagguaagacuggguaugaaaggaggcugcuggguuagauguucucaaaggcuccuccacugcaaaguucugagacuccucuacagaaccaacuaguuagaaagcaccauuugaaagccgucccaggaggucauuccacgcauaccaaaagcauuucaucaggagggguuccuugcuuucagccccuauccugagggccagcuguguuuuaggaagacuucuucucuguauuuagcaaagcugaugugccuaagccucauacuggcaucaggugacaaugacaagauugcaggcuuucuaaacaucaccagcuagacaggaaccaauucacauucugcuuucagcucugaagauggaggcuaugaguuacuugggagucauucuuuuagauuggugaaaaaggucauuuaacaucucuguauagcaacuauaggagcacagcauguggauaggagcacagcacguagcucuacaggagcacuucgcauggaucuacaggaccgcagcauguggaucugggaaaaaguagagcauaaagcccuggaucucaaaguuuagguuugaggucuagcugucuacugauugaaauuggacaagugacuaaagcacacugcuguuccagcuccuccugugcaaauggggaacagcccacgcaccccaugugggaacggaucagaacauagagcaaugcugugugugcuauagguauuuaacaaaugaucaguacuauuauaaucagccauuugguuuuuacauacuguuuugugcuugaaaaauucucuaaucuaagaaaaauugauccuaaagcucuaugaggaaugaaauugcuaaaacucuauagagccucgagaacaguucuguuuuuuuuuuuuuuuaagccaaaacaauaagaaaccuuaaguauauauuuuaucuccaggauggagaacucuagaguaaccugcuggccuucuaaugcacugcuggcaagcaccuucuccuaucuagaaaugcaaacuaugucuguuaauggacuacccugcaggcaccagaaugagaagucacaagugacagugacauccagaaacuaugagacagcauuguaccuaaauggaucagcucacaguacaaaucaggaagucccugagugguauccccugauagaggguuucacauccuuucucugagucucccagagaacuugccuaucuuccugacagcacuugcuguugucugguuccaaagucagucuuagaaacagauuauccgacugacaggauccugagauucagagagggggcagccauggaguugggcgaacugcuguacaacaagucggaguacaucgagacggcaucugggaacaaaaaguuagucgcuagucuguuuugugggaaggcagaacaucuuucucaauggcaagaccauuauaaugaacgacuguaucauccgaggagaacucgcaaguguaagaguuggaugucacuguguugugaaaagccguagugucauaaggccaccauucaaaaaaauucagcaaagguguuaccuucuuuccucugcauauuggggaucaugucuuuauugaggaagacuguguggucaacgcugcccagauugguucuuauguucacguugggaggaacugugugacugggugccguugugucuugaaagacugcugcaaaauucuugacaauacaguauuaccuccagaaacuguguuccccccauucacugccuucuccggcugcccaggacucucuccggggagcucccagagcgcacacaggagcugaggagugaucucaccaaaagcuacagccagaagcuucuaccccuagcacaagucuaau

SEQ ID NO: 3008 - RNA, 1923 nt, Mus musculus
auuagacuugugcuagggguagaagcuucuggcuguagcuuuuggugagaucacuccucagcuccugugugcgcucugggagcuccccggagagaguccugggcagccggagaaggcagugaauggggggaacacaguuucuggagguaauacuguauugucaagaauuuugcagcagucuuucaagacacaacggcacccagucacacaguuccucccaacgugaacauaagaaccaaucugggcagcguugaccacacagucuuccucaauaaagacaugauccccaauaugcagaggaaagaagguaacaccuuugcugaauuuuuuugaaugguggccuuaugacacuacggcuuuucacaacacagugacauccaacucuuacacuugcgaguucuccucggaugauacagucguucauuauaauggucuugccauugagaaagauguucugccuucccacaaaacagacuagcgacuaacuuuuuguucccagaugccgucucgauguacuccgacuuguuguacagcaguucgcccaacuccauggcugcccccucucugaaucucaggauccugucagucggauaaucuguuucuaagacugacuuuggaaccagacaacagcaagugcugucaggaagauaggcaaguucucugggagacucagagaaaggaugugaaacccucuaucaggggauaccacucagggacuuccugauuuguacugugagcugauccauuuagguacaaugcugucucauaguuucuggaugucacugucacuugugacuucucauucuggugccugcaggguaguccauuaacagacauaguuugcauuucuagauaggagaaggugcuugccagcagugcauuagaaggccagcagguuacucuagaguucuccauccuggagauaaaauauauacuuaagguuucuuauuguuuuggcuuaaaaaaaaaaaaaaacagaacuguucucgaggcucuauagaguuuuagcaauuucauuccucauagagcuuuaggaucaauuuuucuuagauuagagaauuuuucaagcacaaaacaguauguaaaaaccaaauggcugauuauaauaguacugaucauuuguuaaauaccuauagcacacacagcauugcucuauguucugauccguucccacauggggugcgugggcuguuccccauuugcacaggaggagcuggaacagcagugugcuuuagucacuuguccaauuucaaucaguagacagcuagaccucaaaccuaaacuuugagauccagggcuuuaugcucuacuuuuucccagauccacaugcugcgguccuguagauccaugcgaagugcuccuguagagcuacgugcugugcuccuauccacaugcugugcuccuauaguugcuauacagagauguuaaaugaccuuuuucaccaaucuaaaagaaugacucccaaguaacucauagccuccaucuucagagcugaaagcagaaugugaauugguuccugucuagcuggugauguuuagaaagccugcaaucuugucauugucaccugaugccaguaugaggcuuaggcacaucagcuuugcuaaauacagagaagaagucuuccuaaaacacagcuggcccucaggauaggggcugaaagcaaggaaccccuccugaugaaaugcuuuugguaugcguggaaugaccuccugggacggcuuucaaauggugcuuucuaacuaguugguucuguagaggagucucagaacuuugcaguggaggagccuuugagaacaucuaacccagcagccuccuuucauacccagucuuaccuacaaaaucccaagccucccaggaaagacugcgauuauggccacagacaaagaccuccugggguauaugugauuaacaguaguaaaauua

SEQ ID NO: 3009 - RNA, 5452 nt, Mus musculus
ucauguacauagugaacauggcuguugaaaggcucauccugucauuuuaaacaugcaucaaaacauuuggaagcuccaacaagacaucucuaucaguauguggguuuauugacauaauugaauguaacaauguauaacauuuauccauuucucacugaaaagacuuuucagugagacuguuuuuuuuaaguccaggcauuaaaggguuuuggugacagucuacaguugggcaaggcagaugguaaacagaaucaguggucuuuuccauacuuucaacgggucucaguuuuacacuguguaaaugaaacagcuaagagaggcaacugugcugugcaugaaaaauugcgaguucuacaggaggugccagauagccuguggguugaaacuaagagcgaacagccccagcucccaugcaccaugcacuguggauguaaaacaaggccuggcagcaaacacggaaugacagucuuauuuccugugguuuauuaaguuucgucccugcagauaagacugccagaaaagcagcuguggcuuaaguggucuggacauuuuacucaugcuggacauaaacaaagaccggcucauuuagacccccaggucuucagcugcugagacaaggcagcauggcucacguaggccaaacauaaagagugaucguggugaagggcccuggacugugauggguucccugagucauugggacccucaggggccugaggccuggaacagaagagucacuguuagccauagaacuggcugaccugcacugcacagucccccacugccaauaaauccauaaccacggugacuauaccacaguguacauccucuuagcacguguauguggaccacacacgaauuauuaaugugaacccagccacuauauuuaaucauaaacguggacuucauaaauaucaagggagaaaaguaucccaaauagcuaaaaacacaacuaaacaaauacaagaggcuaauccuaaauuaaaaauaaaacauaaaaagaaaagaaauacugcaucuacuacuaaaagauaagguuuaauaacacaguaagauacuggcuauuggaauaauuaauuuguaaaauauauaauuauuucacagugacaguugaaugcacauguucuucuggguuuaguagaaacacauauucgcuacuguggguuuuuuguuuuuuuguuuguuuguuuguuuucacauuuguucccuacaguuuucuucuccuguucuauuucuuauaaagagcgacagugauguggucagagauuacagacaauucacccauugcuuuguuuguuugggacaaacucagagccccacaagcaagcuccaccacugagcucacugcccccugccccaagccugacaauuaccuuacgcuuaaugccuaaccgugcaacucagaaaugggugcugucaagaaggggaugggggacacugcugaacugucguaagauguaggucacauucacacccgucuaggcaugcuaucagaaaugugguaagcgaacuggaaggcugcagugcccuagggagucacugguuacacacacacacacacacacacacacacacacauaucgcauucuuuuuucuuuuuaaaagaucaaaucuggcauucgauuuuuucccauguauagauuuaaaaaaaaaaauaagguaaaaccacaggcgcaagccugguggagaaguauuaaaugcugccuucuccugaggauauuaucaguuacccaaaggucagcaaaaggucauuucccuaacugauaaaacgauagagaggagguccaguccuaucaaaagagucugaguuuauuggucagcuuguuaaauccucuucauauuguugacacagguagcuuuuccuuaaggcuuccuagaugcucucccagacaacagaagaaaggguucccgggagagagugguaccuguuuguuuacccugccggucuuggcagaacccaccagaucaguggggucaguugcugauggggaucacugugaugguggcaagucccccuuuucuuaacuagaaacagaacucaguuugccauagagcaaaggaguguguauacacaccagagcguucuggucaugcugggagcguaaagcacccuuucuagcccaaggucagcaggcuacugugcugaaagucacaggagccaugagcuaagugugucaagguuucccacuuuuacgccauuauucauuuguccccacucuuggguuagaccaccaagaaccauccauuugcuuugugauuaccaggacgugauggauggcaucuagauucacuuucacaucuagauuucacuuggcaaaugcacaaaagggagaaagaacaagucuaauaaaacuaguucuuccucugagaaggcaugggaccacggagaguggcuccuuaaggccugugagaucccaaggcauugccuagucagcgaaucuuugcaagaggugauccucccgccucaagcugccacugguaccaccgccggugcuguccaugaagcggucgcaggggaacucaaugaggucggccucgcugagcgcgcacacgguggugcggggacggugcgacuggaagccugagaaguccgcggacacaccagugcccauggagcgcaguggccgucggguggaguacauguggcgaacguggaccggggccccucccuuccgccuggcacgcagcuuccuccgcagccaucgcgauccccaggcugccagugccaggagcaccagaagcgcguugacagccagcaagaccaaggucaggagcugguagucgacgccaccucgaccuccugccucuggcaggguuacuaacccugcgcaguggucucggggggccacggggcaaacgcgacccccgagcacacccuccacgcauacuagguagggggugucuccgcgcagcucgugcagcguggccgagucgcugcgcuccggcagguagacgaagcgcuggaacuugggcugcuggccaaagcggucgaaaagcaggcggaagcgugcgccgcccugcggccggggacugcgguguucgcgaaccgcccagcgcaccgaggcgcuguuggcgcucaccgccucuacugucagguugcacagaaugaauuuguugaagucacaggggucagacaccagagguggcaaaccaaccccacuaacggacuggacugcgcucucuugcugcucggacgcuaggcgcugcuuugcugcgcgcugccagcugucucuggcagauggugucccagaggcgggcucagacgucggggugggcuccgucugggagagauuggcucgggugugacguccucuccccggcuucucgugcagguccaaggacuguggggcagagcccggagccgcagcagaggggcccugauggggaccugguccccgccggcucaaccuuaaugcgcugcgguugcccaccaguuccuuggcagccccaccccaggccacuccugguagaagucuuccccgcugcuggggcugcggcugcggcugcagugguagcuccugcgagaggccugcagggggcgucauccccucuucugacgauguggguagcggccacugccuacugccugcuguaggggaaggugagggauccacgcaagacccauucugcagcaguuggucauccagguaauccagguacuugccccgcagggccgggggguggcgacacugcacgaagaccguaaggaggcgacccugagaaugccaguugcccauccagcguuucagaccccgcaaccggcagucgcagguccaaccauugccgucuagauccagccgguagagagccggacuggcggcaaagauguccccagaaagggcgcugagcgcguugucgcgcaggcugagcucacggagccggcccugguggccaaagguggcagggugcagagcagaaagcucauugccacucaggucuagugccuccaagcugugcagaggcuccagcagugucagggggagcugguucagccgguuaccuuccaggcgcagcucacguagggccuccaguccccaaaaggccucuggggcgaggugcgugagcugguuuccacugagggagagcaggccuaggcguggcaggugcuggaagacgcgggggccgaggugcuguaggcuguuggcugagaggaugagaguagagagggagcgcagagggacaaagguggccgcguggcgcagagaggguugcagcucguuggccgagagauugaggaaucgaagcuuacccagcuggcugaaggcguucuugcccaaaaaacggauccgguuagauuccagguguagguagagcagguugcccaggggagcgaagaccgcguccggcagcgcucccagcacguucccguccagccguagcuugaccaaacucuccaggcccucgaaggacccgcgacucaggcguccaaucucguugccguuggcguaaaggaugcgcaacuugcgcagcggagccaacgugccaggaacgagcgccugcaagagguuguuccccagguacagcuccucuagucgugagagcuucucgaaggucuugggguggagagaacggaucugguuguacugcagauccagccgucugagcugccccagacgguggaagucgaaggcggugauguuggugaugaaguugccgccuaggcuguaggugagcacguccuggggacuaggcagcgagcuggucuuggguacagcgcgaaguccccuguuggugcauaggagauguugggggugcuggcagucgcagcgcuccgggcacacggacucggcccgcggcgggaacgccaggcagccgcacaccacgagccagaagcgcacggcacccacacccuccaucgccgcccgcccagcgcgcugcggccggaucgucuucugggccggccggcucugugucuccucugcauuccccucggccgggccugagucgcuaaaaaggccucuuucguacuucgcuggugcuccguccagcccuuccucuuugucccgguggcucgcccgggucuccgcaggccaaguucgcggagccaaaucagaaggcgcugggcgcucggcgaaucuggggugcuacuuguugcauuucugcagaaaacuguuucuucgggugagcgucgggggcgggaggagcgagcaagaguuggugcuuuuuguuugcucuggaguccggagagcuggauucccuggcgcggauucuccccgccaaacggauucccccgcugcaggcgggaucccuuccaagagcugcuggggugcggcuuggcugcagaguaccggccgcuaggcccacgucuccggcgccugcccgcucgcgauccggggggauugggagugcagccggagugagcagccugggggacgcgcaagcagcguccggaagggacccaugucggcguggagcgagcaaaccggcggaaauucguucuucccacacucug

SEQ ID NO: 3010 - RNA, 5452 nt, Mus musculus
cagagugugggaagaacgaauuuccgccgguuugcucgcuccacgccgacaugggucccuuccggacgcugcuugcgcgucccccaggcugcucacuccggcugcacucccaauccccccggaucgcgagcgggcaggcgccggagacgugggccuagcggccgguacucugcagccaagccgcaccccagcagcucuuggaagggaucccgccugcagcgggggaauccguuuggcggggagaauccgcgccagggaauccagcucuccggacuccagagcaaacaaaaagcaccaacucuugcucgcuccucccgcccccgacgcucacccgaagaaacaguuuucugcagaaaugcaacaaguagcaccccagauucgccgagcgcccagcgccuucugauuuggcuccgcgaacuuggccugcggagacccgggcgagccaccgggacaaagaggaagggcuggacggagcaccagcgaaguacgaaagaggccuuuuuagcgacucaggcccggccgaggggaaugcagaggagacacagagccggccggcccagaagacgauccggccgcagcgcgcugggcgggcggcgauggagggugugggugccgugcgcuucuggcucguggugugcggcugccuggcguucccgccgcgggccgaguccgugugcccggagcgcugcgacugccagcacccccaacaucuccuaugcaccaacaggggacuucgcgcuguacccaagaccagcucgcugccuaguccccaggacgugcucaccuacagccuaggcggcaacuucaucaccaacaucaccgccuucgacuuccaccgucuggggcagcucagacggcuggaucugcaguacaaccagauccguucucuccaccccaagaccuucgagaagcucucacgacuagaggagcuguaccuggggaacaaccucuugcaggcgcucguuccuggcacguuggcuccgcugcgcaaguugcgcauccuuuacgccaacggcaacgagauuggacgccugagucgcggguccuucgagggccuggagaguuuggucaagcuacggcuggacgggaacgugcugggagcgcugccggacgcggucuucgcuccccugggcaaccugcucuaccuacaccuggaaucuaaccggauccguuuuuugggcaagaacgccuucagccagcuggguaagcuucgauuccucaaucucucggccaacgagcugcaacccucucugcgccacgcggccaccuuugucccucugcgcucccucucuacucucauccucucagccaacagccuacagcaccucggcccccgcgucuuccagcaccugccacgccuaggccugcucucccucaguggaaaccagcucacgcaccucgccccagaggccuuuuggggacuggaggcccuacgugagcugcgccuggaagguaaccggcugaaccagcucccccugacacugcuggagccucugcacagcuuggaggcacuagaccugaguggcaaugagcuuucugcucugcacccugccaccuuuggccaccagggccggcuccgugagcucagccugcgcgacaacgcgcucagcgcccuuucuggggacaucuuugccgccaguccggcucucuaccggcuggaucuagacggcaaugguuggaccugcgacugccgguugcggggucugaaacgcuggaugggcaacuggcauucucagggucgccuccuuacggucuucgugcagugucgccaccccccggcccugcggggcaaguaccuggauuaccuggaugaccaacugcugcagaaugggucuugcguggaucccucaccuuccccuacagcaggcaguaggcaguggccgcuacccacaucgucagaagaggggaugacgcccccugcaggccucucgcaggagcuaccacugcagccgcagccgcagccccagcagcggggaagacuucuaccaggaguggccugggguggggcugccaaggaacuggugggcaaccgcagcgcauuaagguugagccggcggggaccagguccccaucagggccccucugcugcggcuccgggcucugccccacaguccuuggaccugcacgagaagccggggagaggacgucacacccgagccaaucucucccagacggagcccaccccgacgucugagcccgccucugggacaccaucugccagagacagcuggcagcgcgcagcaaagcagcgccuagcguccgagcagcaagagagcgcaguccaguccguuagugggguugguuugccaccucuggugucugaccccugugacuucaacaaauucauucugugcaaccugacaguagaggcggugagcgccaacagcgccucggugcgcugggcgguucgcgaacaccgcaguccccggccgcagggcggcgcacgcuuccgccugcuuuucgaccgcuuuggccagcagcccaaguuccagcgcuucgucuaccugccggagcgcagcgacucggccacgcugcacgagcugcgcggagacacccccuaccuaguaugcguggagggugugcucgggggucgcguuugccccguggccccccgagaccacugcgcaggguuaguaacccugccagaggcaggaggucgagguggcgucgacuaccagcuccugaccuuggucuugcuggcugucaacgcgcuucuggugcuccuggcacuggcagccuggggaucgcgauggcugcggaggaagcugcgugccaggcggaagggaggggccccgguccacguucgccacauguacuccacccgacggccacugcgcuccaugggcacugguguguccgcggacuucucaggcuuccagucgcaccguccccgcaccaccgugugcgcgcucagcgaggccgaccucauugaguuccccugcgaccgcuucauggacagcaccggcggugguaccaguggcagcuugaggcgggaggaucaccucuugcaaagauucgcugacuaggcaaugccuugggaucucacaggccuuaaggagccacucuccguggucccaugccuucucagaggaagaacuaguuuuauuagacuuguucuuucucccuuuugugcauuugccaagugaaaucuagaugugaaagugaaucuagaugccauccaucacguccugguaaucacaaagcaaauggaugguucuugguggucuaacccaagaguggggacaaaugaauaauggcguaaaagugggaaaccuugacacacuuagcucauggcuccugugacuuucagcacaguagccugcugaccuugggcuagaaagggugcuuuacgcucccagcaugaccagaacgcucugguguguauacacacuccuuugcucuauggcaaacugaguucuguuucuaguuaagaaaagggggacuugccaccaucacagugauccccaucagcaacugaccccacugaucugguggguucugccaagaccggcaggguaaacaaacagguaccacucucucccgggaacccuuucuucuguugucugggagagcaucuaggaagccuuaaggaaaagcuaccugugucaacaauaugaagaggauuuaacaagcugaccaauaaacucagacucuuuugauaggacuggaccuccucucuaucguuuuaucaguuagggaaaugaccuuuugcugaccuuuggguaacugauaauauccucaggagaaggcagcauuuaauacuucuccaccaggcuugcgccugugguuuuaccuuauuuuuuuuuuuaaaucuauacaugggaaaaaaucgaaugccagauuugaucuuuuaaaaagaaaaaagaaugcgauauguguguguguguguguguguguguguguguguaaccagugacucccuagggcacugcagccuuccaguucgcuuaccacauuucugauagcaugccuagacgggugugaaugugaccuacaucuuacgacaguucagcagugucccccauccccuucuugacagcacccauuucugaguugcacgguuaggcauuaagcguaagguaauugucaggcuuggggcagggggcagugagcucagugguggagcuugcuuguggggcucugaguuugucccaaacaaacaaagcaaugggugaauugucuguaaucucugaccacaucacugucgcucuuuauaagaaauagaacaggagaagaaaacuguagggaacaaaugugaaaacaaacaaacaaacaaaaaaacaaaaaacccacaguagcgaauauguguuucuacuaaacccagaagaacaugugcauucaacugucacugugaaauaauuauauauuuuacaaauuaauuauuccaauagccaguaucuuacuguguuauuaaaccuuaucuuuuaguaguagaugcaguauuucuuuucuuuuuauguuuuauuuuuaauuuaggauuagccucuuguauuuguuuaguuguguuuuuagcuauuugggauacuuuucucccuugauauuuaugaaguccacguuuaugauuaaauauaguggcuggguucacauuaauaauucgugugugguccacauacacgugcuaagaggauguacacugugguauagucaccgugguuauggauuuauuggcagugggggacugugcagugcaggucagccaguucuauggcuaacagugacucuucuguuccaggccucaggccccugagggucccaaugacucagggaacccaucacaguccagggcccuucaccacgaucacucuuuauguuuggccuacgugagccaugcugccuugucucagcagcugaagaccugggggucuaaaugagccggucuuuguuuauguccagcaugaguaaaauguccagaccacuuaagccacagcugcuuuucuggcagucuuaucugcagggacgaaacuuaauaaaccacaggaaauaagacugucauuccguguuugcugccaggccuuguuuuacauccacagugcauggugcaugggagcuggggcuguucgcucuuaguuucaacccacaggcuaucuggcaccuccuguagaacucgcaauuuuucaugcacagcacaguugccucucuuagcuguuucauuuacacaguguaaaacugagacccguugaaaguauggaaaagaccacugauucuguuuaccaucugccuugcccaacuguagacugucaccaaaacccuuuaaugccuggacuuaaaaaaaacagucucacugaaaagucuuuucagugagaaauggauaaauguuauacauuguuacauucaauuaugucaauaaacccacauacugauagagaugucuuguuggagcuuccaaauguuuugaugcauguuuaaaaugacaggaugagccuuucaacagccauguucacuauguacauga

SEQ ID NO: 3011 - RNA, 889 nt, Mus musculus
auguucuuggcaugcgcccaccucgucuggcaaggaaaaacgcaacacggucggauucuucucaacagcuuuauuccuggaccggcuugaugcuacgguccagggaggacugcuuauauacaccccagcacuggugagagcuauguguccuccugggauuggucagucugucggcacuuugauuuguaugcacccgcuugggagggguuggcgccagauuuggcuagcgccugcgcaguggcguuguuuacagcgguguacuggaggccggcgccaucuuuuaggugcccggcugccuacacugaggguuauguuggugucuguggccagcacuacagcaaacagccauguugauacuuguggucuguacugccacuggagaucaugcugagguccguggcuuaugaugaugucagagacccguguaggaguccgugauccaugcuccugcugacugugaaaggcaaggaagcuacuuuugcaguuaugacugcaaaaacucaaugacugcaaacucacaguugagacaaagggacaaagaacuguucuguggcacccccacccucaaaaguagcauuuuuauacaggaagccauagaagagaacuccuaaaaauugugguaaggucgcuugguguagcucuccacaaugaagcagggcugugagugggguaggacucagcuuucuuuagggggcuggccacugggaguuugaccaugcuccagugaguguaugggcaacacaaauuagacuugcuuugguuaguuucuucuuuuggagggagugauggucacaggguggaggggauggaccugggaggaguggauagugagugugaugggggaacaugauacaaaauucccaaauaaucaauaaaaguaucaugcugg

SEQ ID NO: 3012 - RNA, 19761 nt, Mus musculus
guaugauccuuagcgggccccacucccaagagucucugagcaucauuagcugcaggagauggaggagaaagaggaggagcaggaggacgacuucaaggugaguagggagugaggguggaaaggguggcuaugggaagagggaugaacaugagcaaaaggagcugugcgacauucucagagaacucggaaaauauuauucuaaaggcaaaggcuuuccaucuaaguucaucauucacucuccgacagcaaaggagagcagagggaacccaugugaucuuccuaagcuagugccauucucuuccaaaguaaggccguguugaaugaaagccaaugugccaaccgacccucaauuuuaagcagaguagucuauccagaaaaguagucagcggugugacagccuucagccuucauggaacagugagugacacacaagccaaaggaaaagcagcgaaggcuccaaugccuuuagggcuuugcccagaagccacucaacaguacuguccguucuuacuuagggaagaaaagaguugacucuuaccaucaaacagauggcaggggcaucacagaagauagauccacagagacagcuagaaaaauguuggugcaaugaaggauacagaagacuguggggagagggcauuuuacuaccaaaaguuuccacacagaaaggggagggaaaggaagacggaaaugauuaagguggggcaggagaagaaagugauuuguguguguccgggcuaggguucagaggaggacaguaaagggugaaguugacucaaggguuuacaauuaagauacacaccuacuucucagcauuuaggacagcauugggagaauggcaccgucaagccuucucuuaaacaacaugcuaaucggcuuccaguauucaaggaccugcaggccagcuuugaguucuuccuguauaaccuaaucucucugcugacaucaguggagauccuugaagugaaggccaggucuuaaggaaaaccuucucaucagacccucggguagagauuuuaaaaaaaaugaauuaacugugcuaacuacuauacuacuuggagauuccagguacaugcugacagguguacuucugccuguacugggcugugacuuccucaaaguuacucugccagaucuucacaagccauacacaccuguccuuacuacagaacugccccaccaaaggauggggaaacccuagcucuaguugguaagauuucuaguuucugcauccccacugacacguuaaauguuaacccauuuucccuaacaaaaaaguuuaacuuuaaaacgcacccagcacuguucauauagcauaguacuuauaaaauacuggcugcuuggaugaaaauaauguucguugagaaucaucuucaaagcugaggaauaguucuaacuucuggauaguuggaaagugcuuccaagagcuagaaagggggcagggugcuauuuuaagccauugugcugggcaagacaaggacaccguuguuaauaucugcauucauuuuuaugacagaguucugaaacaaaagaaauguucggagagaaaaggccgaucgccagcguacacuucagggcuuagggcugcggugcuagaguuccacuaccucggucggcagggggaugacccugaaggugccuagggagaucgacugcguggagacucuggaauccagggguugguggcacucggcacccugcagcugggcugcgcggcccaagcgaggccgccccccacccaauucgcgagauugagguggaccccgcagcggacccaggcugccggcuucacccgguacccaacucuccauccgggccgcgagccggcggagggugccgccuggcgcaccgcacccacggaagccggcacucaccgcucagguaguugguccacuuguacagcacgcccuccauggcacccgcgggccccucgucgccccggcccgccgcggggacgccgggccggccucacauccugggcccgggggcggggucaccgcgacagccugggagcaccagcuccgggucccgggggcugcgccugcgccuggcgcagucgguguggacgccgcagagcggccgccagagagaggcgagggaggcgcgggaggcgcggccccuguggcggcggucgcgggcgccuuccugcggccacugagcccacagcgcccgccccggcgcgcucgcgcaugcucacugcgcugugcgcacgcuaccaaauccacgccaggguuuggccacugcgcggaggggcugaccggugggcggggcuccgaugcgcacgcggguggcaggucacccaugggggucuaggcuccagggauccagcuuuuaaugacaaguuugucaguggaggaggaugcgggcugagacccggaauccucggaugaggcuagucuguaguuuccggaugcacuucuguguaaggcgcuguucaaacugccggccucuugacuggaagcuuggucucuggaccgcagacauugacuucaccugggcuucuguuaaaaaaaaaaaaaaaaucucucggggguuccagaccuuuuggauuaaaaaucggcacuuuuacaagcucuccaaggggaauuucuaaguacaugaaaguaugaaaaugcacuguugucaggauuuuuauccaagaaaagugucuaucacagguuagauggaaggugaauguugagaagaagcacaacacaaccaaauguuaguguuauagaaauaugcucucaagggcuaaagugcaggcauuuuuucccuuaguguaagguugacagguuuaauaaauaauauaucacuuaguugguuauuugccugacugcacaccucaaugcccuguuuuuguuguuguuuuguuuguguuuuguuguuguuuuaaucucuuuuggugauuucuaguuucuucucagauugcagcaauggacuacaucugaaaugagggcagccguuuagaacuuuaagcuguauaauuguuaaaacaagugcucucucucucucucucucucucucucucucucucuccguccuuaaguauuaucuacucaccaccaaggucacauaagugacgaauuauuagcagucacucauugacagcgauguuuguagaaugaaaucaagccaagucuuaagguggagugccaauucuuuucggccaagugaacuuaagcagggcacuaacuucuaaccuaauuuuuuuuuuaaacuagcuucucuccgggcuaguuuuuugcaacuugaugcaggcuagaguaauuuggaacgaggaucuccgaaccauaagauuuaccuguaggcaagucucuacugcuuuuucuuaaauacugauugauguggaaggguccaguucacugagaguggugccacccuuggucaggugauccuaggugcuauuaaaaaaaaaaaaaaaaagcaggcugagcaagccaguaagcagcacuccucuauggccucucuacaucagcucuugcuuccugauuacuguuuugaguuccuacccugccuucccuggauaauggacuaugauauagaaguguaauagguaaaaauccuuuccuccccaacuugcuauuagucaugaugcuuuaacccaagaauggaaacccuaagacacugucuaaaugggggggggggggggagugggugggugggaauagccacguuaaguuagugaggaucuugcaccagagugugcuuugcgaaccuuaaagcauccuaguagguccuuagaguuucuguucuaaauuaguaaccauaguucugagccuuuauuuguggcaucuugaagaaggcugcuucucagugucuggucuuuccaaaaacccgagugucaccuggcuccagacuccgcagcuggaauacuucacugaaacaacccuucccccaucucccacccccgaggauguuagccuggauccagcugccuucccgaggugggagaauuuccuaaucagcgggcucuaggacuguuccgaaggggcacauccgagcccagggcccaacagcacacagaaccacuacauuuuuuucggcgccauuggcugggaggcgccugagggacagcagcgccagccaguggaaggacgccuuucccuagaagcugccuuauuagaaccaaucauguuuggauggggcuuuaacucuuuauugugaguucgcugucugugugaaaauuguuagaaaaagugccacgucuuccugggagugugucuguugggggaguccugaacuugcuuggccuaagcugucuccgcuuuuggcacauuuuuaacucuaugaagucgggggccuuuccucugcuuugguaacaugagguuuuucuuguggaacgcuaucuuggcacugugggucacgguucugagcggagcucugauuccugagccagaagugaaaaucgaaguucuccagaagccauucaucugccaucgcaagaccaagggaggggaucugauguugguccacuacgaaggcuauuuagaaaaggacggcucccuguuucauuccacguaaguaauuacgccuugcaggcagagugauaaagggcccacccauucacacuagccugugaagcuaacaguuccuuuaccucuacaaacugaaacaaaaaacugaaauaccuguuucccuuuggagaaagaaaauugucaaacccguucuauaggucaagaccaugaaagaaauuccuggauacauggagucuugacaaauuaauuucauuaucauuuuauucuauauaaaauuauaucuagaguauuugagguuuuacagaaauacuuagguuauaauuaagcagccaauagaaaaggcuuaacagauuuuucugucuugaacuccauuccauagguaaaauauccgauuccccuuuuaauugugcaaaaaaaaaauguuaagaugugucauuuuucuucaacagcaaaaugcacaaucaucuauuugccugcuucuaaaagauacacaaauaacuguuucaagcgaccuguuuaacuucuuggcagguggcauuuuggccaaagcacaggaugacagaaagucauuccuucuagaaagucaggcuucauccauggcaaaggugugguuauagaaguaaaaaguagaaggauuuccagauguuuuacacucgcuuuucuuuuuuauaaacaaagauuuggcagauaauguuaccaagugugaugauuuccauucagaaaguauuuaaccagcaccuccuuagggccggucagaaaguucaccuucuagucaucugcauccauucauucauucagcccgggaagccacaccucugccuggagaugcagagagggaaaacacaggaaagggcucuguuuauggagaguacagaauguccacugagaagggauggcagccugugguccauugugcugaucagggaggauaaagaaggaguucggaacacaacagccuugaacgucagggguggaaauuaucaaggcggaacaggaaggggagaagauuuugcagaugugggaauggcaugagcuaagucugaagcuuccgcucaauugagauccugccauuuguuuuaauaaacugcugugagacauggucucugugagacuuaaggguagugaaugacaguccuccacacacugcucuggugaaagauuucaagaagaguuugucagagcuuuguccucggugcacaguggauaguaaccaauacuguggcauugcacuucagagucucaguuacauucuugcuuuuggucugaucccuuucauagcuagucuaaguucuuuuccagccaagggccaaaaaccugugcagacacuuuguagcaguuuacugcuuguguugugguacuuggugaagggacuguugugugcagccuuccuguaaaaucuuaggcaugucuaauggaauauaaugaaaaugaagagacuucauuaaagacgucugcaaggaguguuuuguguugccagagucaucaucugugugauaacuaguuuagcuguaauaagaaaugcagccaaauguaguuagugggaaugauugcugcuucucuguucuuuuugccuccuaugagggccugugcaguaaaagaaggagugacugggcagugguggugcaugccuuuaacgccagcacuugggaggcagaggcagguagaucccagaguuugaggccagccuggucuuuaaaguucuaggacagcuaggacuacacagagaaaaccugccuggaaaaacaaaacaaaaauaacauuuacccagauuuuguuaaccauuguacucauauacuuagcccaaggauguuuucuucaaccuaagaauuauccugaaauaggacacucucccauugaaaggacuuaacugccugggcauccucagaucuccagugguuaaacuaucccagucucucaggaugccuggacaccuaggccauuccuuuccucucuggaacuugaggagcugcacuccaggauuuucugaguggccccauaguagaucuuuggagagggccugaguguaaguggagauguaggaugaaaacagccuuugcgugcaucagaaccaccaguaaacuguacuucaagaaggcuuguagacagggaacgagauagccuugucucuaugucugggugcaaguggaccaucaggcauuagcaauacuucuagcuuuuuaucuucuuucucaagcucaagacauucccugaguuuuuccuuggucuguugccuuccugggaaaguaugacuuuaucauuaauaauuugaacuuagggguuagguauaucugaagucaaauacuaguacacgucacgucauuuucucgcuacaagggcgaauacuggaauaguugacccccugucugcagguucuaugucucucgauccaaaacaacuauagauccagaauauuugaaaacaauauauaguuauugaacacguggagaguuuguauugccauuagccaguauaacaacuauucauaugcauuuacauuauagucugugcaaucuaaagaugguauaauguauacaguagguuaugugcaacuacuguggauuugcccuccuugugguuugaaggacagaggaccaaauccuggggacaauuuuccaagaauaccuauugucuuagucaggguuucuauuccugcacaaacaucaugaccaagaagcaaguuggggaggaaaggguuuauucgacuuacacuuccaugcugcuguucaucaccaaaggaagucaggacuggaacucaagcaggucaggaagcaggagcugaugcagaggccauggagggauguucuuuacuggcuugcuuccccugguuugcucagccugcucucuuauagaacccaagacugccggcccagagauggucccacccacaaggggccuuucccccuugaucacuaauugagaaaaugccuuacaguuggaucucauggagguauuuccucaacugaagcuccuuucucugugauaacuccagcugugucaaguugacacaaaacuagccaguacaccuaucaaugauaggauugucguuggcauuagagacaaauuuacgauaauacuuacuuuaaaguauauguucaaauuaaguuuuuuuuuacuauuuucucugcccuucuuaagcuggcucaauuuaugaauuuugcagcaagaaaagugggcaggaaauugaacugcuaugaagacgacuuagguguguguguuuuuaauccaagaauugcuguuuccuuucauuucuaaguucauaagcuuaaccacugauggguagaaacacaugaagcacagcaagaaucuuugcuuuuaagucacacacacacacacacacacacacacacacacacaucucuaauguauagagugcuuaccuagcaugcacagggcucuggcuucaauuccuagugguuaagaacaaaaugagcuuuuaaaauucugcuguguuuccuuucuggcagucacaaacauaacaauggucagccugucugguucacccugggcauacuggagguucucaaaggcugggaccaaggcuugaagggaaugugugugggagagaagcgaaagcucaccguuccuccugcccugggcuauggcaaagaaggaaaagguaacccugugugacccucccugcugugugauccucccugcugugugacccucccugcugugugacccucacugcucugugacccucccugcugggugacccucccugcugggugacccucacugcugggugacccucccugcugggugacccucccugcugggugacccucccugcugggugacccucccugcugggugacccugccugcugggugacccugccugcugggugacccucccugcugggugacccacccugcugugugacccucacugcugugugacccucccugcugugugacccucccugcugagugacccuacaagcugugugacccuaccagcuaugugacccucccugcugugugacccucccugcugugugacccucccugcugugugacccucccugcugugugacccuaccugcugugugacccuaccugcugugugacucuaccagcuaugugacccuaccagcugugugacccucccugcugugugacccuaccugcugugugacccuaccugcugugugacucuaccagcuaugugacccuaccagcugugugacccucccugcugugugacccuaccugcugugugacccucacugcugugugacccuaccugcugugugacccucacugcugugugacccucacugcugugugacccucccugcugugugacccucccugcugugugacccucccugcugugugacccucucugcugugugacccuaccugaugugugacccucccugcugugugacccuaccugcugugugacccucacugcugugugacccucacugcuguguuacccucccugcugugcagcucacaaugcuucccucucuagaggaaaccugccaucucgcucuaacaaugcaagaaaagugucuugauuugaaccuuuggaauagguucaucagauguaguuugauggauggcugugucuaguuacagccaggaaguuuuccacaccacagcucucacugggagaguugcauucuugcuuuuaaaccuauuuguaaaguucucaauagcuuaauuuuauuuuauuuauuuuugguuuuucaaaacagaguuucucuguguagccuuggcuguccuggaauuuggucuuuaaaccaggcuggccuucuaacucagagaugugccugccucugccuuaugaguuuugggauuaaagguguauaccaccacugccuaucugugugguccacacagcuuuuguggcaauuuuuuccaaggcacugacaccugguauuuuagcugaauucaugcagcgcucgggcugucggaugaugcuuaucagcuggccccagagguaguuucuucacugaaaucugaucugggccaauggccauaucugaagagacaggauugugaacuuuuaccaccguguuguuauuaaccaauuggaacuaacuugaguguguuauaauugggguuagccauauaagauguagcucacuuauuaaaagugccauuugcaaaaaauaaaaaauuauacaugaaauauguucaauguaaaaguagcaaauagauuuugugucugucuagcuuuccccaugggaaguauaugcacauagaaagcagaucacaaugaauaaaauauuaauaguauacugugauucugagaauuacauucauuucugagucuaucuuacaaauucucuaugaagaaaauguaguacuuauacagugaagaaaauaauuguaagaagucaucagaagcaggcagagaaucagucugaugugguguaauuagaucucguggcauuuuucagccgagcauagccauugacaaaguaugggugaagauuccucgccuguuuccuagggagguuaagcgcuguaugugccuaugauguacuccgaagcaggacuggcucucuaagcuauguuccacugccauggcuauuaaacacauucaguucuaauuauauucuuugcaggagaaauggagcauccuagaagagguuucucuagugccuuuagauguaaucugucucuuccccgugccacugcucuuucaguacuaacucuauguuugcaacaguagucgucguccgugaccuaguuagcucagcuucacuucguagcaugcagagaucuaaggcugaguuguuuccuuuggugucauggaacuaauucuuccacuaauuuuguaguauuuuaguacaugcuugcaugccuccuuggaaagauaccagcuuucccaccggucuaugcaugucccuucccugucuccaucggcaacgguaagcuuuggcucauccugugaguguuuuucucuuagaaacugacuacccuuucauagaacuuugaggaaauggggacacagugaagucuugucuaacaaguguaucuugaccucuguacccugaccuuuauauuaaauagagaaagcaaguuugaacaacaacaacaaaaagccuaaaauuccaagaaaguuuguuucuuugacucuuaggguuuuuuguuuguuuguuuguauccccagauuuuuaacaaguuguuuuuuuuuuaacuuuuaaagauguguuaguuuccuuucagaaguugauuuagauuucccuuuucugauuaaaugucucaacaaauaaaugcauaaaguccuaugucaggagguauccgaagucguugaaaaauuugaauguuccuuuauuauuuuuaaaaccaugaaacaucaaucccuauuuaucaagaauaaccccaaggguauuauuuuuuuauggauauucccccuuuguccucuccaugauaccuaagguagaaaauugucaaucauuuuacagauaagggacagaagcgagagguggcagaugugaaguugaaguucaguugcgcuccauguucacagagcucccacuauuaaauacugccucccagugguagacacuguagugacagcccuguguacuugagggucaagauuuucugaucuaaauuaacaaaucuuuuauaauguaauucagucugaauuacucaaguccuuuagaagucauucuugaagugugacaugaagggccugaauuguauuugaaaauuagugucaaggccuuuaucauauccaccuguguguguuuuuacugcuacccaaacgcgugcuuuucuucugccaguuuggguugguuauuccucccucuguucuacuuuucuuuccuggguaaaguaugaucuagaaauaagugauuucuacuaucugugaccauuguagagcaccucuucauugaauguaguuagaaugucugcuacuguaauugauuuuguuaugaauacuuuuagaucuuguaaauaaaaauuuccccaccuccucauaucagguaaaaucccuccagagagcacacugauauucaacauugaccuccuggaaauucgaaauggcccaaggucccacgagucguuucaagaaauggaccucaaugacgacuggagacucucuaagcaugaggugacucuaccuucugccucuccucuguuuuucuucugcuuuuauuuuaagcucccguuuuuagaaauaccugagcugccaggagaagaaaaacaaguuuucuucaaaggagugacaauggguaugucagccagacccagggcagggcucaugcucagaaguaguggccaacauaaaucggaccccaugguuuuuaguggguuuuucccuuuuuuuuuuccccuugagacugauuuguaucaacucccaugcggcucuucuuuacaccugauugugccauuuuauuuccaaauacacacacuguauugacaaucuuguuuccgccuugaauuuucuaccaguuuuuguugucuuuuaugagccuguuccagugaggggcgaagaguuaaaugagauugauagcaauauauuuaccuggcuaggcuguaacuauuucuuuuuauuacuauuauuuuuaauuaauuauuuuauuuauuuagauuucaaauguuguccuccuucgaggucucuccuccaugaaucccaccgaaccaccaccaccuuugccucuaagagggugcuuuucugcccacccagcuacccgcucccuccucaccccucuagcaugcuccuucucuggggcaucaagucuccauggggggggggugggggcuccuuuuuuuuuaagagaacaugaaauuggauggagggagggaaucugggagaguugcgggucgggaaagaauaugauuaaaauaaacuauacuauauauaaguucucaaagaguaagugauaaggaaauuuuuauuuagguaaaauauuauuuacagcccuuuuuugguaggaaaucacugcuuagggaaguguguuggcugaggggcgugcccagucuccugccgcuucccuucucuccuaggcuuagaguugacugugucagccggggaucuuggaaagcauuucuuuuuuccaugacgguaaugacugcaugagacacgcguggguccugggaacuuuccccuguggacgguuucugccgaagauggccaacuggcuguugaacggcuuucagagaacucuccaaggggcgauuugccuggccaaguuuauccaagucagccuccgcgggagggcauuucuggauuuuacacagaggggaaauucuuccucggccaccugaaggccuggcuuuugaggugggaggaggaagaaggguuuuuccgugucucaagcccucccggcugucauagcuauuguggagagagagcagagguagacacacgcccgugguucucgcugccagaccccagucagccaggccccagcaggaugcuugguguuuuguuuuguuuuguuuuguuuuguuuuguuuuguuuuguuuuuguuucuucgagacaggguuucucuguguugcccuggcucuccuggaacucacucuguagaccaggcuggcuuggaacucagaaauccaccugccucugccucccaagugcugggauuaaaggcaugugccaccaugccuggcuuugagcuucacucuaagagccaggaacugauguugucucaaacaaaauuacuggggaccaagggaacuugaccaauacuaauggguuuguuucuuugugguuuuguuuuguugcauguugcuuugacugagacaggaucucccugugauguccaggcaugcuuugacuuugugacccuccugccucagcuucuucuucuuuuuuuuuuuuuuuaaagauuuauuuauucauuauauguaaguacacuguagcugucuucagacacuccagaagagggagucagaucuccuuacggaugguugugagccaccgugugguugcugggauuugaacucuggaccuuuggaagagcagucgggugcucuuacccacugagccaucucaccagccccugccucagcuucuugagugugggauuuaggguccgagucacuggguuucaaacacugugguguuaacaguuaaccuuuccccucuguccaagauaaaagguaauucucucucacuaaaaacaaacaaacaaaaaauuauaugacauucucaugacuuaaaaaaaucaacugauugaaguuaauaauaauauauaugacggcgucuuuaacugggcauggaacucaguugucuagcauuucuuuagaaugugcaaggcucugagaucaauccuaagcacgucauaaacgagaaguguuuccugugcccauguccucuucagccuucacugggucccuucaccucauuuauuacuuucuaauguauuuuuccaguguuaauacaaauauuauuaguucaccuuuucugacucaaaagguaggaaagacguacauacuauuuaguagcuuccauccaucauucacagaacugugucugcauuaauccagacaauaacuuuguuuccuccuccugggccccuugcccucuccugggucucccucuccuuacuuuugcuccaacugcguuauaucacguuacccuaaauaaauagcacauacugacaggucagaguuuggggagagaggacugagaucacugguccaaacuggcaggauggggacgggauggcaaagggugauacagguuggguugcaguuucacgaggaguuggaagcagcauuucgguuaugcguuuuuaugcaugugauuugcauauguggugcaagugugcaguguguacacccacgaguguaugcccaugagugagaggccagaagagcgggacaccaggugucuucccccacugcugucugccuuauugccuugagauugucacugaaucauuuugguuagucuggccgccuuaguuuuggaccucuccuuuucuucucuuugcagcuggaguugcaggcacaugcgccuuuugcagugcugggcguuugaaauuggguccucaugcuuccgcagcaaauggucacagccacugagccaucuccccacuccuccauuguauuuuaaagacaauagaaaacgguaacauagacacucacaagacccugcuuugauuucuaaguucacaggcucugcugguguggccucaucacaaccuguacacaguucuuucuacucguagacuuggguucaaauaaaaaggaagacuggaaucauauuuuaggagggaugucuagaauucugacucuuccaagagaagaaaacccaaugaaaccaguguauccgaaagcagccauccuucaagugcgcggcaguguuuggcucagugcugcugagccaagcuggccaaggaacacagcuacgggacaguuggggcuaguggucacucuguaggccccacugccgacggcacuuuguuugcuuauuuguuucaucagagaaagcugauuugauucuagcacauaauuguuucaaaccucuugauuaggaaagcuuaaagccagccaggcaguggucgugcaugccuuuaaucccagcacuugugaggcagaggcaggcauauuuaugaguucgaggccagccuggucuacagagugaguuccaggacagccagagcuacacagagaaacccugucuugaaaaaaacaaacaaacaaacaaacaacacaaaaaaguguaaagccuuucuaaaaaugguuucugauauaugauauguauacuacauauuauauauaauagauacauauuuaaaccauuagcuuuugauuaguauuauaauuuuuguuuuuguuuuugaccauuguauuaagugcuuaaauuguucuuuuuuucuagauuuauuuauuuuauuauaugugaguacacuguagcuguuuucaggcacaccagaagagggcaucugcuuucauuacagaugguugugagccaccauguguuuacugggauuugaacucaggaccucuggaaggccagucagugcucuugaccacugauccaucucuuuagagcccuccuuuuaaaaaauauuuauuuauuuauuuuauauguuuauaaguauacuguuacuaucuccagacacucuagaagagggcaucaaaucccauuacagaugguugugagccaccauguguuugcugggauuugaacucaggaccucuggaagagcagucagugcucuuaaacauucagccaucucuccagccccuguuguuguuuuuugagacagggcuuuucuaugaagcucugccugacccagagauccacuugcuuuugcugguaucaaaggcaugcacuaccaugccuggcaauagaggauuuccuauuacacauuuacuucuuaguuucagcaaagugaguuauaacauucaaguaagccaggaaccacguagcauaauuuguuuaaauucuucuuuaaucauuacauauuuaaaaaauacacacacauuaaaaauauacuucauaagaauguuccucuuggggcuggagaggugauucggugauuaagagcacuggcugcucuucuagagaacccagguucgauucccaguacccacauggcucacaacugucuguaacucaaguucuagcugaccugaugcccggugacuguuuuugaacucugugggcaccaggcaugcauauugugcacagacaaccaucaaauccucauaaaaauaaaaaugaaucuaaaaaaagaauuuuccucuucuuuaaguuaaacuuuaaaauaauauuuaaaaaaauuaaaucucacaaacuucuggaagauuuuaugaugcuaacaauuuauuugaaguacauuuuauucaagaguuauaguauaaugcugugaaaauauuagccacagcuaacagaaaaugcaauauauauggcguaucuaaacauuuaaaaguuacguuaauucucucaacacuuuaaaaugcugcccaaacaguuguuaaauccuacauuuuaauuuuuaaguaaaucagaauaacaaacaauuugaaagcccuaucaaauaaaacaccaaaauaaagucaaacuuucauaacauuuagugucuguguccccugcuuugggcccuccauuauuccuuggugacugaucaguacauuugcugaaggcacccugcagcaagcagaucucucugggcuugcuugccacucuugauucuuuugugacuggaagacuucacacacauuguuguagcaauagcuguggcugacuguacuguguggaguuaauaaagaaaccauuuucacacuugaaguguaguaauacauaucauuuagaguuagagaagauauuggugcauaauccaggaauuuaaacugcauuaaguuggagcugagaugguagcugucagugaaguacuugccauucacgcaugaugacccaaguuccagaccuagaauccaaggugggaaaacugcuggguguggaaggguguauguguaaucuuagagcuggcaaguggacacaggcagaucccuagagacugcuagccaguuaaaauggcccacucaccaagguacaggugagagacuaugucucaaaaaccaagacuccaaagaacgacauccgagguuggcucuggccuccauaaacacaaguacacgugcgcaugcguggacaaccccacauggacaagcacccgcauauacuccuaagaacacccgcaaauuuaaaugagcugugaacuacagauucuuaaauuaaauguuggcuucuuaaugugaaauuauaaggauaaaagugaaucuagcuuaaaacaagcaaacggacugggcagauggcucugugcauuuagugcuuaccauguaagcuuggggaccugaacugggauucccuaguaccuugcaaaacaaaaguagagggugggaaugcaugccacaaucccagcacuggccgcgugugcgugcgagcucccagggucuuacuuguuggccagccagaguggcaaucagugagcuacagguucagagagagagacaguaucucaaaaaacaggcaaaaaggcagguaauagguuuuaauaaaaaccuuguauuuggugcaaagauauauauauauauaauuuugaugcauuauauuuggugucuccaacauagccauaaagcaaaaguuuguuuuaauuccuguaggaaugggucauggaguuauuuuuguucuugcuuuauagcauagcagugaugcaauguggguuacuaaugagagccagcuauuaauuacagcuguuuuuuugcagguuaaaguguauuuacagaaggaguuugagaagcacggugccguggugaaugaaagccaucacgaugcuuugguggaagauauuuuugauaaagaagaugaagacaaagauggauuuauaucugccagagaauuuacauaugugcacgacgaacuguagggacgcgccugccauuuuauacacguucauuucuaauggaaaggcagcaccuuugaacaaagcuuuucucuuugccuuucuuguuuuuaguuuuauauucuuuuucuauuauuuaaagaaccucagagacuuuguaaauaucguucguaucuuuccagugaguuauugggcaggaacgguugucuuugaguagaggacucccaggccgcuucuaagcucacaugggaguuggcuuugcuuccuugcuucuuucuaaugguaacauggcaacuggaaacacaccccagcauacacacaggguguagcacagaccagggcccuguacuucucccucccucugucuucucaaaguccaguuacuggcauauuugaaagcuuuugugcuaguucaaggcuugcuauuuucauguuauagugaagugauuuuuucuuuaccugcuuuugagucccugcuugcaggcaggaggaauaugguggaccuuauuccuuaagagcucuggccuuacuguggagauacacaauguggaugaaugagggagguagcaacucaugaauagguggucagagacguccuaguggcuaauaaaccauuacaauaagucagacaaauaauauauuuguuuccuuguaaucaacacaccaaaauaugguaggcauggcagagaguuguauuuauaauuaauguuuacuuuuggagcuaccaaguuagccuucugguucuuaaauaaauaaaguuugcagcuaguauauuacuuugcaacagcauugaauccugggagaaauuaguaugucaaugagacuuccccauuucugauucaugaaaaauaaggcuaaccaauaacagcuacuauuaauacugggcacugacauuuaucauuuuaucucaaauuggcuuccaaaaaugacuacuacuucuguuuuuuagauuguuuuuaaucaaauuggcuuuuaucuuaaaacaaacuucccagaccuccauuuguuaugcuccucauaguuuacacgugcacaauugccugacugggggugucugacaccccugggaagcugcugggucuugggguacuucuuuauaggugagaagcucuguucagagauuggcuggugagcccagccuuggugccuaagcuguagaugcaccuucagucccugaguucagucuuccacuucucugcuaaugaagaugcagcaaguuugcgucucucucucuugguccuuauuucccuuagcaucuucaccucuggggauaauuccugccaguuccuagcugaucacagcuuuccuuaggauccaggaaggucuguguuuucugagaauagucuugcuuugugugucucucucccaguaacccccugagagggguuagguguaugucuuauggcaucuaaguucaccuguuccugucacuuccuguuguuuguagacauuguauugcaacacgaauucugcauugacauuguuacuggcgagaauuacucaagggcuuguucuugaagaugucagggguaacuguaacuguugccaccugcauuuuucuggggagguugugagaaagccagugagugucguagaccaguggugugucuugaaggcugcuuugcuccaagcugccaccaccaucugcgcuggagcagugaagaagaaagaaucuugaccacucaauuacauggauuuuuaucagaucucagcuaaacuuucaaacagaaguaugaaagaaagacauaccuggagaaaaugguuguuaaagccaucugccauuguguauagcaaugccuuugcacccucccauuagugggaauagucaaacaccaaaugugacuucacauguauauacuuugacuccuagcugcucucuguguaauauuuaaauuucuaugucuauugugacacucuuuuugaaaauaaaguuuauuugggaaauaacuaguuuuguacaugugcau

SEQ ID NO: 3013 - RNA, 990 nt, Mus musculus
cagccguuguccggacacaguacguagaaggagacgcccgggucggcguagaaguccauccugcgcuccgucuccucggcggcgaugagcucaaagggcgugcuggaacaccacuucuccgcgacaucugccagcugcuggaaguccauggcggcgccgcccgcgccuccuccggggcucacggcucccgggucuguuuacaccgcccgcuccgccuccgccccgcccccacccccaccgcccgccuugaaaggaacccaagcaccccggggccccgccaguccggggccgccccggcucgugacgucacgaacucuggccaauccccggagcccuacucggcgccgcccggagcccggugacgucagggugggcggggcgcccgucucugcagguggcggcgggguggggcggggcuggcuccggaccccugguuuggagccaguuuggaaggcuuucucuggaauccgcuauaaacgcgagggacgcacccagaaguacagauugcuugguccuugccagggcugauuguagaggugcugcgagcacccggggaaacagcuuugcuuucuacagaagccaaaauucgguccucccaggaacccagaguguguuuucuagacugauuuggaaggaaguguacacgcacaucaagcugcgugcuucuuacaaauaccuucacugauuuggcuugaauuuauauuauaugacuuaaaauggccaacuguuguuuuguuuguuggguuugagguuuuguuuuguauuuugaguugcuggaaaauugaacccagagucgugcuuuucaggcauguuaccaccgagccacaccccaacccugcuuggaaagcaaggagccugcccguugacuacaccuguugaaugcucuggcugcugcgugcccagcagacacacugguuuacagggaguagaagaguccucgucugaacacuuggcuuccggaagggacacauuaaauagcauucauucuau

SEQ ID NO: 3014 - RNA, 22234 nt, Mus musculus
cggggcggccccggacuggcggggccccggggugcuuggguuccuuucaaggcgggcggugggggugggggcggggcggaggcggagcgggcgguguaaacagacccgggagccgugagccccggaggaggcgcgggcggcgccgccauggacuuccagcagcuggcagaugucgcggagaagugguguuccagcacgcccuuugagcucaucgccgccgaggagacggagcgcaggauggacuucuacgccgacccgggcgucuccuucuacguacuguguccggacaacggcugcggcgacagcuuugugagugcacgggacgggcgcgcuccgcuuugcccaagcuccuccaggggggccggguggggcggauagcgguggcagggugccagggugccagggagcggagguguggcaaccuaccggaccaucgcgcaccgggcgcguggcuaagagcaucccaugggagccucuauggggcacccaccgggcggggcucauagucccugcggcaggauccgaggucggguccccgagaggugucagucccccucggggucucagacacaacucugcagccgcuccucccaacagggcccccucuccagccugcgagucucucaaacggacacaaagccucuguccacacccgcagugauagaucuuuuggacccucuuugcggaauuacgcccuggagcuuaaaaaugcacgcgcgugcacacgcgcgcguucgcgggggcacgccuaucccgggucuccugcuucccuagcuccucaaugagcugccagcaaguguuuguagcccauucggguucuagccugccaugaggcuacuguguccucgccgaggccuuucggcuuuuccagaggaaaaccccacacacccagguccagagggaccagaaccaggaacuacagcgaccauaccuuuggccagcaucccucccacuagguauucuggugcugacaguuuaggaaggagauacugagagcacgcgguugugaugggagguguguaggcagggcagggauggcgcuucguggaguguuuguaagcacuguaaauaauaguccccaaauguaagauggaggcagcuggggaugaggguaaucguguggucgauggccugaggcuggaggcgcugcugcagcagaggaagaugggguggugcauggugcaucgaccgcuuggcucaucaggugaaaugacaaagcuggacauauccccccaccccgcuggguccguacaccucauccauccaugggaaguucaaccuaggaucccugagacccggacaggacaggugcacaucugcccaauaaaauaugauccugguuuuggguggcagcuagauuuagguucuguucacuugucuucccuugaguugccuacccacaaaauuagcuuccuaauaccaguucucuggcaaucuuugaaguagaccuagcaguuugaugcacagcaaguguccugcaaauuuaaaguucagagaccuaguguuccccccuaucuuuguauaaacucuuaccuggaacuaagaauguagcuuaguuagaacacuuguguaguguguguaaaaucuguuaagcauugaaggaauuugaauuaaguagcaucucugcuauuuggaaauuuuguuaacaguaagacuauuauauagcaucuuucaguuuacaaacuuuaagauuguuuaaauaguuacaaacacugaugaaggcuuggucucuccuuggucagagguaucuaucugacggauggcacugugccucuaagcacagguaguuggcucuaaaggaauauagcaguacuuagccccuauucuguucggccauccccaggugcacacuucugucuguguucuuggggacaucacucucuuccaggcuuaaacaacuauguccuccuguuaccugacuucaaguggcagccuguugucacuggaugccaagcagggcugcuugggaguaccccuggcuuguggugcucauaucugggagccuguguuaguguaaucgcuguaaaugucacugccgucugcaagacagauuccagccccaauucuaaaaaccuccuaacucucucucucuuccccacucgguguccagaucaucagaguuccgccagcaucgugaggcaagcauaugcagggcccuguuccuccgugccugugagggcacuuaggggugaucccucacauggcuugucucuuccuguacccaggcaagaccccaggaucuugucuucuggugcuggagaucugaauucaggucuucaugcuuguauacagcaagcacuugacccaccgagccaucugcucaaccuugaaagaugccuucuuacugggccucgcaagaauucuaugagguagauguuguacucauuuuagaggcgagaaaacugaggcuugauguguaagagacucugauagcccagaucucugucgccucacugaaaauuggcucacaguagcuucagaggcucaagaacaaagaugccuuugaaugccacuccccugggcaacuccugggugucucccugccucgaaggcuaccugccaauguagccccuuuccaaacuguccaccauguugggaauuguggcuucgcaaggaagggcugugccacccaggagaaggggggcaggaacugggcaaccagcuggcaguucucucuucugccaacucagaaggucuugagggcuaucggcccugagaaggggauugugggcagccauucagguaccagggaacagaacucuguguguguguacagguacacaugcucauaugcuccuguacacucccaaauacgcugguuuguguccaguuggagcacuggcugcccuccucccuugaauugaagagugccuacacaucaccuagaauagagauugcugguugcagggacagacaacccaucagaagcauguuuagaugcacaauuuuguguaguuucauccccucugauccaaacacauagcaguagccauauuauuaaagaaaccgugcucacggagggacucgugucgcacguauguuuacacgguucccauuugugagcgugucugugauguauuuagguggggcugcacuguggucuugcgauggugagaaggagaggaaaggcgucucuuuaccuacuacuuuugauugccccauccagagugagauaaucaugcuauaacccauuacuacugugagcgcuguaugaggagccaagcgcgaaguggaaucacuucauagaagugaaacaacuucauagaaguuauuucaaggaagaacaaagccacuuguauaguuagcuaaucgugaagaggguaacguugggguguuaugagcccagaugauugggaaccagcagucacuuaucugcuaauugacaggcagucugcaggcagacgccugugauuuucagacccccucuaaauauaacugcugucugugacuuggcugagccaaggcccccuuaggcagcaugcacagaggcaguugagggcaugcaagcaaaaccccugugggguguucucugccuucugcugccuguguagccacaagcaagguacuuaaccuuuagagcaccaguuuccucccugacagaaugcuuaaaacgaugggcaggcugccuuaguuauggcugacugugcucuucucacugggugugcaaguguguugggcgccacaaagugguuugugguuucuguguucugucugcuacguggauuuuagauuaagagacaccaauuaaaaauagagcacuagcagaaacuccacacuucagcuaagauggcccauggcgauauugguuugcggacuuuuuuagaugccaaaaucugaggcuacucagagcuaguauaugaaaugacauauuuacacacacccugcaccuaacccuguaugccuuaacuggguuagaauacugagagcguuuaauacagugggaauaggaaguaagugggguuuguuuuauuuuguccggggaauaaucugugcucugaaccccucuuggucucaccagcuuauagcuguaggucuagcagcaugcccccaggacaagaagagcucagagggauugaguuagccuagugaucuaacgccacgcuuugaugaccaggucuugucaucucuauauagaaaguggaacacacucccugccuugcccugcccugcccugcccgcgacuugcuugugcugucuuagguggaugagcucagaccugcuguaacagaaagagguacagaaggccuauagucacagugcccccauggggcauuugcuguaagaguggcaggucauucaggguggggacagcgaaggccaaaugagucauugaagcucagggcuguggucaguaguggaacugcuugaguucucagugaaaaaugugggaugagccuggaagucugcauuguaacaagcauccaggugacagucaacaguuaagaaccccagcucggcugcacuuccugcucccggcaucuccuguuaucauaggaggccugcgcucaccccagcuccaaacucaccccagcuccaagcguccuccguacccagggcagccagcaugcuucggucugacacucccaucuaaucuauuucuguggcugcagauaguuucuccaguuccugcuguaguguuuuccuggcuaauguggguguuugauuauaugugcuuggaguauuuuccuggcugcgguuacaguggcuguaccuuauggcccaggacguugggacuucagccacucaaccugguuuuacgacucuuuccuuuuaucaucuuucuuuuaucacacacacacacaugcacgcauguucacgcucgcgcacacacacacacacuucaugguuacaucucaagucauccugccuuguauucuaacagugcuagauaccuuuaguuuuggaaagaaguauuuuaaauaaaguuaaauacuuuauguuuguaaagacaguagaaauaagaugauuagcagucuguggauggugucuuuucaaguugucgugacccaagccccuauuucuucaugguaccuugcagacagugauuccaguuaaggguuuugauuuguuuuuuguuuuuuuuucugauuuaucuauugcuuuguguguaugagucuuuugucugcauguauguaugugcacugcguaugugccuggugccuacagaggugccgacuacccuggaaccagagucacacacaguccugcgcuauaguguaggggccagggaaucacaccaagagaagcaaguguuuuuaaccucucagccaucuuuacagauuuuuuuuuucucuuaaguccacaaaaccuguaaggcugggacucugggaacugcuguacuagucgaugaaggcucuuuaggcagaagaccuuuccugggguucaagucuaaauucuccaacagauagcaauaaauagcuccagaaguggagucaggagaugggaagucaggagcugucuuccugaggcuaaggaagcugagaaacgccuaaccagugcuccccaccggugcuccccaccgaugcucuccaccgccaggcgucgggcgcugccauucuguuuuugccuaaaugagacacuucugcuuacuguguaauuuaaagcccaaaugcacuuuuaaaaagagaagucuauaagauuuugcuuacguaucuauuuauuuuagaucuaccugcucaugaauugauuucaacccaaguggccuaggagagcagucacagcaaagucacccuggguuucagguuuacucauccugugacuccugucuguggcaggugggaagcccagcuugccaccaucucgcugcagaugcagaaacucucccugugcccacuacuuacagaccaggcccaggcugccagccagcaccgcacacacacugacacgccgcuagcuuuucacuccgcacucgcacggugcccagggaaggcagauagaacguuaagugcugcuaggucgucaccccaugucuacccuggauucaaacuugaaggaaucuggaauggcguugcaaaugugguguggaggcaagcgcugugcaaguuuauuagccaaacauacugauggucugucuggcugcaucucugucgacugagaacaggcaagacaaugaguugaggagcgcuccguauaguuagccgucuguacuguguaggaaguaguuguauaugugacauuucagcagcuccgcaguguuagggucugugauagcgaauggugugaggagcucucuaguggcucugugaggugguggaggaacgcuagaggagacugcuggaauagggcagcugggcggguuggaaagccaccauuaagacugugacugggacaaugggaguauggagaugacacauguaccugcucaccccagcuguguggggaaucugugcagcccuucuuagacaucccacaguaagaaggaagguggugagaugugcucaugggguggccagcagaacuuuguagggugauggcccugcucaugcacaagaauggaagcaggcagggggugccacacggaccucucggaccauuuucuaacuaggucuugucuccuccuuccauccaccaaacaccucccucuucccagaccucagaacuguccauucaguugaaacccuugagacagaccugugguaccugucgggugccccauguuucuggcuuguugguucugcagaacuagggcuucuucauccggaccucaagucuguuucucuagcuuauucuagaucuuuaccccuaauuuaaaagaugugauaacacagauuuccucaccuagauaaaugucccccccagcuccaguaacagcagcaaaccuggaugcagacugauauccaugugugcuuuuaugaugccugguaggaugcccuccuaauguccggagggagaugaggucccugagcaaggccaggcuuccuaaguggcucagggcugacuuugcauauucuccugaauucauuucagucuggagaaauuuaccaacauccccacucaagggcugaucugcagagggaacacccuguuccaaguucaugauuacaaacugguuaauuaauucuucagcuguagcuggaggcaaaguuaaggaauuugaaggcaaaggcucugauucccucccccgccccuuuaaagucacccucaggcuccugcugagagaaugggcugggcaauaccuguuggccucacaggugagacugggagcaaaaaagcuugcggggaguucuauggcuuugacacugaucccucgaucccuugccaagcaaaccaaugaagaccaaggggguggauuucacuggaggcugacuuccagugagggacucucuaaaacucuagggugaugacccguguucuuuguuuccuccuugcccucaugggccacagcacguguggagcgagagcgaggacugccugcccuucuugcagcuggcccaagauuacaucucuuccugcggcaagaagacccuccaugaagucuuggaaaaagucuucaaauccuucagaccuguaggugcugcacggcuuccgaagccaccccguaccccuccgccacugcacgcugaucgcagggaugggcgggagaguggacagacccaggaguguucuccugucugcuugucggcccugaaguaugaagagagcagccacuguggggaggcagaaagcagggugcaccacggcuguuaggugccaguuucuagccucaguuuagaaguacugacaggguggaggcaaagagccuuuacggaaagacaggguacucuaguucucacccaguaaacuccaaauccaccgggaagccggaagccguagguuuugucuguuucgcuuugcuuuuugccuuuuaucauagagguguuuucaccaggggccauggcuggagaucuagauauaggauguccacacuugugccugugaggaagggagccccuucuuguuucaggucucagaaacacucgcauaaagcuuugccuccccucucaggauuuuggacuguguguuucuguggcaagcuggugguuggucugccuucaugcuagcugaugaacauguccagugaauacucgcuccuaguuugauggugguuuuuuuuuuuuuaacuucccucucucuuccaacgucauccccagcaucacagcaugcccugcccuagcuugcuccuuugcccgcugugauucuauugcauguauucggcggugugcuguggaauuucuguguauuucucaagcuguuuucagucuucucacuaaauauuucaagcuuguuucauaguccucugaacacagggagguugguugcauaacauuucaaggucaguaagucuguuuggcaucuuuugugucuccuggcucaaacuucugguaucccucauuuguguguguggcguugucgaaguucagguuagcauguuugcaaauucaugggcaggaauaaauggagacccagaugauagugccuuucacaggacuuguuggcccugcuacgacuugagagccaugucugcuugagguggccuucguugauggauuuguaguuccuaggcacucuaggggguuaaaaaaacaaauaaaaacaaaacagacaaacaaacaaacaaggcuucagaccuugucucuuuuagcucauugucccaggaacauggaccuuuggagggccuccuguguaaaguggagacucugcuguaguuguucccuuaaaggaccccgggcuuugacauguaaguacaguauacucuccugcuuugccauccagguuaggcugaccucucuggcuuccaaguccccgcuguacucaagagguuauuuccaugucuaauacuugaaaagucuuuagcuguucucaguggaagggugagaacauuaucauuaggagaaguagaacuucgguggguuucucuucaaugagaaagcuauuucagagauuucagagucaugaccauggggaagagccggggauugggggguggggugccaggcacaaagacaacucugaaggaaagccuagggucaggagauugauugccuguguuccugauguaggaagcacccacagagcuacaggguuuggaguugggaaccugggcacagugagaggggaguucaggaagacauagggucucauagcuguggaaggacuuggguuugccagcuauggagagcccgaagaaauagagcagggguugggggguggggcaugaugauguccuuucuucagaggugcccucuugcagacugaagugcucccuccgaucggcugucagcaggaagcauaggaccagaacagaagcagcgccaucuuccaggcagaugugaggccagcuuaaaauagcagaagugggacaggagacugggaugcuggagaugcccgggaagccgacccagcucgccucgcuguuggguugcaguggagucuaagaaaacgaggaagagaugaaacccgaguuucuuggcagugcgcugaaggagcgucacaguggaagaugagacugggagggcgugugggaggaaaagcuagggucuggugcuuagaccucaguuuugcaggaccgagaagucaguggggaacccugaaccccuccugucccugcugcucucaacuaaguguggagcuuugaaagaaggcacgagcagggguguggcugcugcugcccuaguugagagaagaccuuauccagucaggaagauuaggagccaggaaaccagugcuguguuccccuggguguugggaguuacacggcgcuaucccuaagacagcugcguuccgggugucaggggggcuuuaaaaugccagugugcccccuucuagucacaauuguuuucacaaggucaucagccagucaccugccucgugcagucucuccacagcgauaaggacaaaucucucuguagccuuccauggcccccaagggaccuagucaucccuguuggcuugaccuugcuaaaaagcugguccauggcagccgcagccugaagagcagucucaccucaaggucgugccaccuggauggagcugugucuauggacuguguccccuucgucucgccugcacugccugcaccaaaauaaucaacaucacacagccucauuucacacaugcugagacuugaucaucggaucuuugaagaaagaaagugucauccuuuucuccucuuugagccauccuuccuccuucuguuuuucuccuacuucaucagauuucccacaaaaauguucuacuugucuguugccagagcccaguucuggaggguaaaggacagcacagcguauuuggcuucugucuccugggagcugauuaggaggagcgccggccacugagcagggugaagccaggauaaaggcagagccuguguuggcucagguggcugcucucucagagaggaagcucucuccccucucuccuucauggaggcuggguaccauacccgugccuguggcagcguugaaugcuguuuuggcuaauguuaccuggacauggucuggacauggucuggacagguuggcuuuaguuccuguggcucccauggcuccuuccucuguguggcccagucuuaucucugaggaugcugugacacugaacaaagggguuccuaccagaaaaaaaugcacucuugguucugggcacuggugugaaggagaccaguguuuuaaggcugcaauccagcagcagggaaggcagggaggacgccacacaagaaaaucuucauggcccagagcagugcuggggccaagcccuugccuuugucccugccaucuggucaguagccuugaagaagugagagacuccaccacugccaagccacccaaguggggcagaagcccaagagaaaaaugguuuuuccuguccauguagauuugcaggaaugacauucaaaauuggaaauuuaaccuuuccucaucuuuuguuuucugcucauguuaugaacacucagaccuugucauuuuuuacccaagugguggugacaccuuuaaugccaacaaucaggaggcagaagaaggcagaucucugacauugaggccaaccuggucuacagaauaaauuucaggacagccaggacuaaaucgagaaaccgugucucaagaaaaccaaaagaaaaaaaacaaaacaaaacaaaguaaacaagcaaaaacaaaacuuugucauuuuuggaaggccagugccagugcuccuaccacagcgaaugccccuaccacaacgugucugccgcucuuccccuguccaccccugccuccaucuugccucuccuucucccuccuaauauagagaagacugauugaaacucaucuugaguuuuaggacagacaguuucaauacccccacacacaaauacuuuaacuagucuugcugcccagaguggggcuucuaggccccccucagaacagaaaugcagagauggagccucccuuaggcuccgugagccagggucugcacuguagguaguguucuuggugagccagagacauggucaagugugagaaaugcugcuucucccuuggaagaagcaugcagggaagccugaagccacaaggacauacuauauucaccaacauucuagcugauccaggaugcucuagacucuagaggccgcauacaccuccacucucagugcaaagacaccagcccaagguggcugaugucuucagggugccccuucagggugccacaugccagccacaaucucaaguaauuugcaacuuuguccacugggcuugaaauuagucccacaggagaccaaggccuagagaauuuuaauucucaacuggugagagcucuuccuuuccaguggaggcccacauagccugcugggccuagccaauuauguaauuguggacaauuuaugugauuguguuccaagggagcuuguggacagccaggccuggaaugccaguguguuccuuuacacaaugagcagaaacuuguuugagucccaggcugcuggaaaaaaaaaaucacuaaacuaggauugcccgguugugacugucaaggaucguuuagccggaucaggccugucggcggugguuuugccauucccauucucacauaagaacacgugggcacagauacaauaaggaagggccucagcuccuuaccaggcugucugucaucucaccucugauuuagauccuccaccacccaugguauggaacguuggcagccgugcuggauugcuacauaucuguaugaugcuuuuggaacucugggcuuuaguucugguaguuugccagccuauaugugcuaacagguugccauaaugcaaaccuuacuuguauacauuuccuaccagggaugcauuuugaaaacaugucuuguccaguagaaagcauggaaacuucccggugccaggcugggcauugacgagcauacccucagcagccugccugauggguagguguggguagacugcagucaagucagcagagguugaguccuggcucugcuguuaacucagugacucuggguagucucucagugucuccugguugugagaaccuuauguaacgcugcuugagauagcacuaggcacacgcuaaguugacagcacaguuuucauucaaucugaaguauagcagccuuauuugccucccuugggcgcuauguacaagugcaaggaucaaaugcaaaggcuagcagggaguucucccuccugauuccuagaaugcucauucacagccaguaucucccaaagccagcacagcaggaaaggcagaggaggcuagaggcaagcuagcugcacaguggggacaacuccuccucggacgauggaacccacagugcuuuaggucaagaggcucguuagcccaaccagacgcagaucuguaaggcugggcagugggcagacuguggacacuugcucuuuccucugagcucgaguugcuaugagcuccagccgagacccuaguucuugcuguacauggaagggcacaugccaaagucaagagccugaaggucaagugccaucuuccagcuucuugauccauuugcagaaccuguggggaggagccuuagaaauccagagcacuguaaguagcuucuucucuuucccauucugcaaaugccagggcugaucagguccacagagugggaggaugcuuccugccccagggaugcuuccugaggcuggcaccguagagcuagaacuauguguagaaagucauguggaagaguaagguguauauuccgagcuucugggcuaauacccucuuaucagugagugcauacccuguguguucuuuugucauuggcuuaccucacucaggaugauauccucccgauacauccauuugucuaagaauuucauaaauucguuguuuuuaauagcugcguaguacuccauuguguaaauguaccacauuuucuguauccauuccucuguugagggacaucuggguucuuuccagcuucuggcuauuaugaauaaggcugcuaugaacauaguggagcauguguccuucuuaccaguuggaacaucuucuggguauaugcccaggaguaguauagcuggguccccggguaguacuaugucuaauuuucugaagaaccaccaaacugauuuccagaguaguuguaccagcuugcaaucccaccagcaauggaggaguguuccccuuucuccgcauccuugccagcaucugcugucaccugaguuuugaucuuagccauucugacuggugugagguagaaucucaggguuguuuuuauuugaauuucacugaugacuaagaauguugaacauguuuuuaggugcuucucagccauuugguauuccucaguugagaauucuuuguuuagcucuuuaucccauuuuuaauaggguuauuugguucucuggagucuaacuucuugaguucuuuguauauaucggauauuagcccucuauuggauuuaggauugguaaagauuuuuuccaaucuguugguugccauuuugucuuauugacaguguccuuucccuuacagaagcuuugcaauuuaaugaggucccauuugucaauuuuuggucuuacagcacaagccauuaguguucuguucaggaauuuucccccugugcccauauguucgaggcucuuccccacuuucuccucuauaaguuucagugucucugguuuuauguggaguuccuugauccacuuagacuugagcuuuguacaaggagauaagaauggauugauucucauucuucuauuugcaaaacacaugaaacucaagaaaaaggaagaccaaaguguggcuacuucgauccuucauagaagggggaacaaaaaacccauggaaggaguuacagagacaaguuuggagcagagacugaaggaauggucauccagagacugccccaccuggggauccaucccauauacaaccaccaaacccagacacuauuguggaugccaaugagaacuugccgauaggagcuugauauagcugucuccugagaggcucugacagugccugacaauuacagaaguggaugcucacagccauccauuggacagaguacaggauccccaaugaaguagcuagagaaaguacccaaggagcugaaaugguuugcagccccauuggaggaacaacaauaugaacuaaccaguacccccagagcuccuugggacuaaaccacaaaucaaagaaaaugcauggugggacucauggcucuaguugcauauguagcagaggauggccuaguuggucaucaaugggaggagaggcccuugguugagugaagguucucugccccaguguaggggaaugccagggccaggaagcaggagugggugggagaauggggacuauggggagagaggaggggauagggguuuucggaggggaaaccaggaaagggcauaacauuugaaauguaaauaaagaaaauaucuaauaaaaaaagaagaggaaaaaagaguaagguaugaaguggggcaaggggagaggugugguuagucaacuagccugcuggaucuacuucagcaaugauugcugaguccaugagaggggauugagagcuucuuauggcuuggguugggguugaguaacccauguccccugaggaagaaucauuauagauauguguauuuacaaacaugccucagcuguacuauucuuacccaugaaugucauggcuaacuaaacuaucaaaacccagcauuccaaguggccaguugccaccucagauuaaauuggauggauguuggauugacuguucuguaguuaguggcauuccgcucuacagaguggucuugugucuuccucuuggggugcucaggugauguugaggcuccuagugcugcgaaagcauccucgcuuuguuagacacuuccccucgcucgacugugggagcuggugucagcaacucuccaaauaaaagccgaccaccagcuuagcagcugucuccuuucauugugacuagccaucuucucucccaggaagcagauucuguccuguaucccauuagaauaugggaaggagacaguaaguagugagacaacggggcuucucuuuucuuccgaagaugcaugagauuggugugcagggcuggaaaagcucucgcuguccuuucccgagugagcaguaacuuucugagcuguuggccgccgugagcucuauggaagcagcaugcaucugcacuuggcuguggccaucuuuacuugugacgguuaaugccucacagaugccuuugcccugcgugcuuuccugggagucugggaccgagagcucuagaacuuaggaauuaggcauugucuuaguugggacaucugguuuacugucccgucccccgcacccccucccguuugagccacagggagaguggaggagggguggcagggcuuuagagaagccacaugaggaguaaacaggguuggaaugucucuuggucacucuugacuccaucaucccguacagaaguccaggagcaaugaaggccaugguguucugccagcucacaaguuuugggucauauugauugugagugauuaguacuauucagugucuaauggaagaccaaugucacuaaaaacuguugucauggggcuggagagaugauggcuuagcagcuaggggugcuuguucuucuagaggaccugaguuugauucccagcacucacugcauguaacgcuagccccacccacaagaucugccucugacugccaagggcaccaguacucacaugagcacaccaaagacgcagacaugcacacguauacaaaauugaaauauauucaccuuaaauuuguugugcuucccugaucauagucauagaacaucauagaaggcuuguggaacauagaugaaauggaggcuggggaaaugauuuagagcuccuucgggggacucagguuugauccccagaacucaccaacauccuuaacuccaaugucaggggaucugaugcccucucuaaccucugugggcacugugcaugcacaaagugcacauacacacuagcaaaauauucauauacauaaaauacacauuuauguauauuauacauauacauaaaauacauauuuauacauauaaaauaaauggaaaaauauuuaaagaugaaauggaaagaaguuguuuacagucccaguuuuauagaaauccuuuacaucacacacacacacacacacacacacacacacacacacacaagauuguagcaccugcugccaagucugaugacccuaguucugccucugggcaucacaugauggaaugagaaaacaaacaccugugcauuguccugugaccacauauaugaugugacaugcaugcaaacacacaaaccaaauguaaaauuuuaaaagaaaacucaacauuugaauauauuuaauugcaguucuuuuucuaugugcauccauaugaauuuugagacaaacuauaucauaauugacuauuuuuacauuuuauacucaucuuauaucauuaaguaauuuuaagauucaguuuuaagucuacguaugauguuaucuuacuaacaugccauaaaauuuaacccuuugcuacucaucauaugucuaugugccacuuaucauaaauaacugcaaguguugcggggugggugggggaggaauuuagcagaggauugauuuggggacauaggcaaugcuuguggugugacucaccaacaccgugggagaggcaugcacaucuaccacaugugugguuugcgggggcgugccuccccaaggucgccaguggaaucaacagaccaugaagacucaguguguucccuguuaaauuuguaacugcccaggugggggaggugaguccaggguugcacucgcagugcuaagcaggugaauuugggugugugacgccuuugggcuucugccugcaaugcuuacagcugcugcuuuucuuguccaauuucuucucuccaguugcuggggcuuccagacgcagaugacgacgcguuugaagaguacagugcggauguggaggaggaggagccagaggcggaccacccgcaaaugggggucagucagcaguaaacuccuaggucaccuugcagaaggggaguaagcccugugcaccccaugggguccgguccuccggacagaguucggugcuccugggguagcccuuuugcauuagcacuucaaaacaggacaucccgcuccuggcaucagaaugaaaaugaaauacccuuuaaaugaccacacaauaucugugacgagguuugcucggcagugaccggaauugccgccccaccuugguggggucucuauggagaugucuugguagcuuuugccccuuugaaguuagaguccguccguguuguggcugccuguucccucucgaguuuauguuggaggauuaauguuuccugacuggaauguagagaacucugaauguauuaaggauguguucugaguccucacaggugaccuugcugaggaaaagcaugacggaggagaaacgcagccugcacuguuuguguaccuuuuaaguguccguaagugaaaggcuucgcuuagaaagcaugaguuuucauaucuagucaugcgcaugcgcaugagcaagcgcagagggugagggcggcugaggcuccuucagggaguucaccacugucugcguugguuccccgggcgcgcagccgccagccacuggucaguguagaugcuuccuggguguuugauaguuuuuuuaaagcaugcugcuuccaaagccgcuuuuaaauucuaauaguggaaaguguagauggggugaaagauguaaacgauugguuucuugacacugucuauaagccugcauaugaaacaguaaccuuuucucuuuaugacgagacggcagcuuacuuaaucgugagaacagcccggaucugagcaagugccccuuaagcuuugaagccauagguaaaucuaacaggaaaagaaacuaggauagaaauauuaauaaaaugaaaucauuugcuuuccuaaucuuuuauucuuuagagaaugucaagaggggcucccagugaguuaauuuauuuaaaauuauaauuaauuacucuaggggaccuacuugcagugaaauuuuuaaagggaccugaaaguaagaaucuuaauuacgagaucgcuuggguugcaagagggugaguuaaugaucaggacacacagacaacucccaggcgugacugcucucaucauuagccaguaaguacuuagcaagauauucucugaugccacugugagacccuuccacgcgugucucagguucucauaacuuagggugcaagugucccuugacagugcuugacugcucugugcaucgagugugggcguguuucaaacgcacacccacaccacuuauguugcugguauuuuaaauuuaaaaaagaaggagaugaugaagaagaaggagauguccacgaccacuugcgcugacaggagcuuguguggauggccagcguguaugggcauucucuguuuaaugcaggggcaguucgaagagucccaugcuccuugguguauuguagauuucagcugcugggugaugucacacacugguuuccaucugugcuuuuguaccuguguguuuuauugucuggaagaaacuuacuaauaccaagccaagugaguucucuugaaguagcccauuagcaaugucacacugagugcuccuuccagggugcaagguccagccuuugaguccugcccaucgccccacuuugugagcauacagcagggagagugagcucucugucuuguagguacuguccagggcagguaaccuucuuuuacauaugguuggucacacaaauauauggcuuuuauggcuaaaugaggaugccugagcaguuugcuccauucugagguaaccugcaauuuuauacacagaggcuucaaaucuaaauuuacauguguuugaacauuaauauaagaugaauuuuuaucaaaaauguauuuaaacuuugaccagauauacucgguguuaucacauuaauguucucuauuuguacaaguugagcuaagacccccuccuaguggugcagcgggcugcuaaaaacucuccucuucugcccaggggugaggaagagagaauaucccuggaugugguugauuuccacggcaaaccccagaggcauccacacauccaucguccuugccagccuccuucccucugcuguugugugugucccuuccagggugggccugugcgcacacccgagccuacccguuccacagugagacagaugugaccccucccagccugcggaggcaggcauucuaguggcagccauagcaugggggaagggucuuugggaguuaggagagacacuugccuuugacugcaggacucugauaagucaugugacuucucuaugaaacagggcgauuuacucuucuagcuuugaacacuauccuaaugcagcugcguaggaaaggaaguguguguucagaagagcaacagcccaggacacggagggacaugggaaagagauacuuuguaauuuugccaaagauggugucuuuaagaugcuggccaugcagcuacuuuagaauaugguggccagcagauauccagaucccuggagccuggggugggcucuaucccaggcaacugaugagauucugucacuuugagagguggguaagcagaggucccagaagauggcuugucucgguugaaugucagugucaggcagagccgcuccucgccccacuaugcugaaggguuuggaagugguaugcagggaacccaagaggggagacuagugugaagacuagcuggaggggaauggcagugaacacuuugcuuguccuaucacucaggaaagugacagugaaggcuugguagguagcagacagagacagugagagcaaacauacagggaaggacugauggcaugcugaccgaugugaccagcugaaaucugaacuagccacugacagcacucaagaggcggauccuaucacugagugauccacggagacauuuuccuccuaucugucagguuacuuuccucugccuggugauggcacugagccaagcagucuucagacaucgaagaacagagccagggcgcagcgugaggcccagugcagugccuagcaucacuaggguucagucagaccgaaggguccacuugggacuccugggcucucugcagcacaggguacauucuguguuuccaugaccagagcacaaacugucugcuacgugaggaaauuguccuucaugcuaaugccugaacuagguuuucagugcgcuuaagucagacugggucuggggcuaccaccccugcucaguauaggcagaacuguucuguagcacaaugcaugucucugaauauuguuucgguuucuucuccgagcacaaaacguauguucagggugucgugaucccagacuggaacuuuuaguuguugcauguuaaaacucaccaguugggaaacaguugaaucaaaucugguuuuuuuuuccagugagaggaacguagggaugggcaagacuuaauguguguugggagcagguggacaggugcagugaagaguuaggucuccauccauccgaguuguaaacaaagcacauagcccacccacacuuaccuucugggacacaggacgacuuguguccuuggcugucucuagagaauugguugcuuagaggaugcugguaauggcucugugacuuucaugaugcccccugccaagccagaggcacagcaaguguccugcacaccugguggaauuccuccccuuaaaaauaaaaucagccgcuugccaggggagcucgccuucaagaguacuggcucaaggggcugugacaacagagugugggccauaccugcucucuccuccacuggugcucuggugucagugaaacucaggugggggcucuugucucuggaacaaaccuugagggagaugccaugcauggcuucuugcauccucuccagagaugcauaaaauguauuuacauuagaaacacuccuccuucauacaaaccaagucacuuugguuugaugguagcuagcgagaugugagaagcugaggucuuuuagguuucguacagaguagguuuuguacagaguagcuguaaaacuugcugggacgcuggcagccugugguccacggccaugaccuggagcauuuccuguuagaaaccccauucaccacacugcaggcugagagguuccgagcagucaaaggugugucccaagcuacauaggaauucacguccaguuugauuaggacuguguucaagucgucugguauugggggaaagcugacagugugcgcuucauaaacaaccuuucccugggcuuuccuuuuuguaucucaagguucuaccuuaaccagaaccuuuugaacuggcagagaccaacgcucuauacacaugccagcugucuaaaaggcacuaaaauaaauauucagugcugggcaaauccgaacccagcuuucagaccagugcuuauuuguguacaagugagauuucuccagagaagcaaaucagaaggaacaaaagcaagggacuuuguuguuuguuucuguuuuuuauuuuuauuuuuagacagugaguuuuuccugugugaugugugugcuuucuuugagucuguauuuccuuucagagagcucucuuguaaaugacaaacugugaaauggguugccaaaaacuguguccuuuguuagaugcuucagagggaacuguguaaauucucucugcaccuugucccaucugcuuccuccucccucccaugagagcaaggaccacauccaaggauguaauuaccauacgcuugcuauuaaagagccuuccagcccuggugcuau

SEQ ID NO: 3015 - RNA, 1158 nt, Mus musculus
uaaaagaaaacucaacauuugaauauauuuaauugcaguucuuuuucuaugugcauccauaugaauuuugagacaaacuauaucauaauugacuauuuuuacauuuuauacucaucuuauaucauuaaguaauuuuaagauucaguuuuaagucuacguaugauguuaucuuacuaacaugccauaaaauuuaacccuuugcuacucaucauaugucuaugugccacuuaucauaaauaacugcaaguguugcggggugggugggggaggaauuuagcagaggauugauuuggggacauaggcaaugcuuguggugugacucaccaacaccgugggagaggcaugcacaucuaccacaugugugguuugcgggggcgugccuccccaaggucgccaguggaaucaacagaccaugaagacucaguguguucccuguuaaauuuguaacugcccaggugggggaggugaguccaggguugcacucgcagugcuaagcaggugaauuugggugugugacgccuuugggcuucugccugcaaugcuuacagcugcugcuuuucuuguccaauuucuucucuccaguugcuggggcuuccagacgcagaugacgacgcguuugaagaguacagugcggauguggaggaggaggagccagaggcggaccacccgcaaaugggggucagucagcaguaaacuccuaggucaccuugcagaaggggaguaagcccugugcaccccaugggguccgguccuccggacagaguucggugcuccugggguagcccuuuugcauuagcacuucaaaacaggacaucccgcuccuggcaucagaaugaaaaugaaauacccuuuaaaugaccacacaauaucugugacgagguuugcucggcagugaccggaauugccgccccaccuugguggggucucuauggagaugucuugguagcuuuugccccuuugaaguuagaguccguccguguuguggcugccuguucccucucgaguuuauguuggaggauuaauguuuccugacuggaauguagagaacucugaauguauuaaggauguguucugaguccucacaggugaccuugcugaggaaaagcaugacggaggagaaacgcagccugcacuguuuguguaccuuuuaaguguccg

SEQ ID NO: 3016 - RNA, 41597 nt, Mus musculus
ugagagaaaagucuuugcuaaaaaaaaaaaaaaaaaauggaaacacaacagauggauuauaaauguguucagaauuccuucaacuuuaauugugggaguaaaaccaagcagccacugaggaaaaaccgucccuggaugcagucacaaugcucuguguaguggacaugaugaguuauuuauuagcacgauggucauaagcugccagcuguucucauuccucuacugucuccuucuugccagucucuugcccuucaaagaguggguaccuggccuccacaucagcccagguaauguugccguuggccagaucgcggaccacauugggcagcucagagaccugggaagagaaaagaagugcaagcauuagccaacuugacaucuguggugggcauuugcccugaauucaggaacccuuauauacaguacagagcaaaccgucuaucugugauauacugcacaccauggauacacacaugaugucagcaaugcagacagagcaaaccaccgccuaucugugauauacugcacaccauggauacacacaugaugucagcagugcagacagagcaaaccaccgucuaucugugauauacugcacaucauggauacacacaugaugucagcaaugcagacagagcaaaccacugccuaucugugauauacugcacaccauggauacacacaugauaucauccuuuacaagcuguguuuguuuuccuaauuaugcucaccgccucccaggcuggggucuuuccucaauuccacaaaggcucaagccuaccagcucccugcacagcucagcaccgccacaagccucucaucccagucuguaucucaugcuaucucacggcuguuacauuuaacuccuguauuuaauuaagucuaugaggugcagcagagcaagugacaguggccuccagcagugguuggcaaagucgggcauggaaaagcagccuauguggagccuguuaaaccgcuuggcuacccuucccuaccaccggcuaaaggacggcaggucugggguggagauuaagaugcuccagcaaguucacaggaaaugcccauguagaggcugaugugggacucacacagaacugcagccauuggaauguagguacagaguagucaggacggguguauaaacacaagccugauuuaugaaacccuuuuggauaaagcaguuuuuguuucuauuuuccuuauuauaacuguaucaagcugaauacuaguaaguacucuaaauaaaugccuguucaaaguuaacacauuagccaggcguuuugcagggacagugccccuccagccccacccugacccacucagccacucuucugugccuguccuaccccuguggucacugcucuuuauaacguuacaaaaagauuccaucuccaaugggcuaacacuaaguuuauacacacauuuuuacgugucuauagaaauacaaugauaaagauggcuaagaucccagagugugccaguaaaacuauggcaacagccucaagggaugauacuucucuugcuuaauaaacaaccaaguguaaaaacgaacugcuagaaaaggagcaagaguaauccaaacgaccauacaauauuagagaaguguuaauggguauuuucauaauuaaaccaaacaguucugggaaucugggcuuugucugauacaaaccaaucauuaauauuacaaaaaauaaaaccaagaacauaaguauaucaaaguccaauucaagccaguaggaagcagugaacauaucuaagaguaacugugugagaaggcagucaccucugcccuuaucugucucauggagucucggucccucagaguugcaguguggggcgucuuguucacuguaucaaagucaauagugaugccgaaagccacgccaaucucaucaguucuugcauagcgccuuccaauagacccagaggagucaucgacuuuaugagacacgccguuccuggucagagcuucggcuauucaaaacaaagugaggcagaguaagguacugcaguaauucucagugucaucugaacgcaggcucggaagcucagcaaacacaaaggacccugagaugagagcagcaagucccagcuauaugggugcuuacuaaguccccugcagcagcccagauugcccugcuaucuccacccagaacagcugcaccggaaggagacugcacagcccugagcugcucaugcagaaguaaagggccagcacuccugggaucccuccaaugcuguagauucagcagggcgcuacauuccacuaggguuuugggaagagggaaccaaggccacuaagagcagcaaggaauucugaagucugacuccugacucaccccaugcuaagacaucugagcaagucugcucuguuauaauauaagcagaggcuaaaaucccauuuauucauagucaaucuaugauuuuacucaaacaaaugauacauucaguaaaacugagucugcaagacaguguucccauggagaucacccaacuggauuugcuuacauaauuccuugacaaauggcauaaacucuugguucuggcucaguggaaggacagaacauuugaauggagcaaccacagcagggaaacugaagaacuagaugguuuuaaaagaaagaaauucaaauguuagcuuauaaguaauuguuauugucacaaagcacaaaguaguuacacucaguagguaacuuagaccacuucacuaucaaaauaccagcucuucuaucagcauacagggaguaaauggcccaacccuccuacgcugugcaugaacucaaaaucaaaggcagcagauguucugaggcaggcaagccagcuuuuugcaggccauuuugcauugaaaaugagagcugaaggcaugucauaaacaggacuuguauaaaagguucauuugacggcaagaacacacaacauaggagcaacuggauguguuccauuaaagcaccgaaugacagagucgaggcuagcuccugcuuaaagcuuaauuacccccuugacggcaggcaauuacaaauauccugcuacaagggaaccuucuacuugagcaacacagaggccuacaucacagcuuccuccuucagccugggauaauucuauuuuauagaaucaagcaggaacuugccuuuacagauuuuuuuuuuuaauuucacuagaaauguuuucauaccaaauuuguaggcaaauggauuaaauaagugggugcuaauaauucagaaacauuuuuggcuucccacagccuaaucaaauuucucuucauggagggacuaugcaauucauaauagugugacuaauuuauucuuguuuagccuuuaugaaaugucuauuaaagcucuaguuauaucaauauuguugaauuaaaaaaaaagccaaaagacuuuuuucuuaaaaacuaaaaaccuuucuauuaaaaaaauaagcaggaaaacacgaagcaaaacugacaucuaaguaagcccuuuaguuaggcacaccaucacuccuugacucagcugugucuucacggauguaucugaagccugggccaggcucuuacuauuugacaaaugaaggacagcuaccaucucaugucaggacaaagaugcagucucaucacagagacuaaaagagcaauucuguuagcuauguaguauaauaaugugucagacuuucuagaacucaggaccaagaauucaccaguucauucuucaaugcuugauguuuuacaaagaaccguggguggauauccaacguuccaugugugcucagauuuggacuacauguaaaugagaccguuucuuuaaccaauaagacagacaaaagcucucucuucuguagcuagccuuuugauuuucuuccuggaaaucugcuagcagcaaccggaauacaccuuccauagaaagugagauaacaaagauaaggcucacaagguugaggagagaguggaaggcacggagccgugaugcaggaucaucaaaugaauagaaaaccugagggguugaaaagcuuuuuauaaacuccuacugccucaacacuugaaugccaggcaagcuccaccuaagcacucauuucggggcagcucaccguucucuguucaucucccucucggacauggaauguauguuccaauaugguauacaugauccugcccaagccaaaggagggcucaauuacacucggaacaacuucuuccacugcaaaaaaaaguagacaauuuaguaauacucucucaaggaccacaggaugcaaaucagaguccuugauaauccuuggcacuccaacucccuaaaucuggaugaguugugaucucuauacagaauacacucagaacuauaugcucauaagcaauaugaucccuuuaaagggaaaguuaagucaaagaauguuuaaccugaguauucacauagaaaaaugaagcuuguguccuaggagugguccuucgaaugaauaagcuaugaacaguaacagcaacacucugcucuauccccugcugccuuucgagaaagcuaacagaccuggcgcuuucauucaagaauuugugaaaucaacuacuggggacuggagagcuagcucggcaguuaagggcaacagcugcucuuucagaggacccagguuugacuuuagcacccacaugagggcucacaacuguuuaugacucccguuccagggaaucugaagccuucuucuggucuccaggcacacaugugguccacagacauacaugcaggcaaaacacccauccauauacauaaaaaacaaaccaaguaaacaaacaagcaaacucaaauaccuuaaggcaggccuggugauacaagcuuguaaucaggaggcugaggcaggaggauugcuagagcaacucuaaggccagcccuggacaacuaaguaaccuaguuacuaccauucuguggucaggaaacacugaagguagacucugcuccacagggcccuacacucucccuguaggucacacuaaggaaauguacugguaacuacuacacagagaagcagcacuauccuaggccuuggagagcuccuucucuguggguaaugagauaaccagggccaacgguucaguucuaaagaggccauuuuuuucuuugacugguugguuaggauuuuuuaagacaggguuacuucucuauguagcccuggcuguucuagaacuagcucuacagacgagacuggccuugaacucagagauccacuugccucugccucucuccugagugcugggauuaaaggcgugcauuaccacugccaggcagcgaggcuguuucuuuugucuaugauaaaggagucguuguuaucacacacuugccaugaaagugccuucccuucauguaaacugugcuuccacugcagccucucccucccucaucaucauuagaucccucaugcuggcugaguguccucccgucacagaccaucagcaccaccuggguaauaaacuguggugacagauucaugcaccaggacaaaagaaggaaguggguaguggugaggagaugaaggagaagaguaaaacucggcuuaggacacucgcccaccuuguaugaacguggccuagcucaauccuuaguaccacagggggaaacaauaauccaggcacuuucccccuaaccucugcagugucaucugaauaauggcaggcgaggcugccgguacacaagugcugcucuaugccgcccugcucugccugcgcgggcuccuggaccagcugaccuguucauagccuauagcucuuuagcaguuucuagaugccucgauucaaagccaagcaacauucauucaugugggcuccaaaauguacacugccuaacucaaaaucugccugaccaaaaauccccaauaauuuagaguaggggaaagaaaaugccucaacucaauaaaaauacuuuuuccugaaaguuggaacguuuucagagauuccauccuauguacucaggcuguaggaaauacaaagacgccuuugcuguucaauacacacacacacacgcaucuuuaaagacaccuuaaugcucaagguuuccauauccaucaagcugcuucucccuucaaaauuuauguaaaauuaacaucacaaaacuuuuauuuuuuuuaagcucagacauaauggcuaguuuuuguuucuuuauugaucuaauaaauuaccaugcaguguuuucuggaaucucuucacacugaccaugucuuucguuaacugaaauguuuuuccuucaguuucaauagugaauucccuacaaacagagaaaaaagacaaaacacauuaaagaguaguuagaacacaaaccccuucuccaggaugccgaaccacucuguuauaaaugcuaacacaauuuggucuucucucuggaugacaacucaugaaaugaccaccaaauuaaguauuacccauacauuggcaccaaacuguauaucccgcagaggauuucaaaaauguagcucauuuuauacaacucuuuaagugauuuuauggcaaaguccucugaucuugaagucaagauuaaauauaacaacuuaaaagcaaaaaacaaaagcaacuaucuuagaguaaucacauuuauccaaaauagcucugcaauuaaauggccacugaucuacacacuaucccaguacacacuaucccagcaaauauaaaccccaaaauaaaguaagugaaggucaauaaacaagcuuucuggccuugcuaugugaauauaaacauucucaccagguuguggugcucauacucacauccugagccaguuacagguuaccagagcacucuacagggcccuacauuccagcuacuuucucucauuagaaaggccgguuugcauuucucuggccggauggcagcucaggcaggacuaggaagcagagcccucaugugguugucuugaagauauagaagggcuacucguuaccauccacuuugcaggugucuuccaguuauaaucuccugccucaucuggaugguucucacugaucuccuguaauaacuacuggcuugaaaucuguguugugcacugugucauguacucuaugaguagucuuaacuguacaguaggaaacaguuagcauuagcaagaagauagcuacugcuugagauuaagcccagcaaaugaucuugcagagucaugauagucauuagcaaaugguaucucgauacaaccauuaugaugucaaaguucccacgucccucucauguccccacucucaauuacaauuaguaaccugcuuuccacuaucauaaagugucuuuccuaggcucucauggaacuauaucuaucauaggcuugggaggcaaccuuucagugaaagacaagucacaaaauagcucaggguuugcuggcccuaugugggcucuucaauacuauuuuauuguuuuuguuucauuugaguauuuuuguuguuuaaacccgccucccuaaaaaugaagggaaaaaaaaaaaaaaaagagggaaaaccgacagugcucuuaacggccgcuccacacauggcaagagucagcuacuaauaguacaugucuuguaauuccuacuguguuugucugcugcucagucugauuuacccacaacaggaacccacaguaacugacgucaccucguugucuucaguuuugguguauguguguguguaugucugaaguucugguuucaguuguguacuguucaggaaugacauggccuccuggguaacucccuccaucacugugaagugcccuuuguccaccuaauauccauuuccuggaauuuacucugauacuaaaauagcuacuccaacuuuuggcauauauacacaauauauauguuaauauguaauauauaaauauauaauauuauacauaggaaauauuuucucuguauauauuuccuuuugcuuuuagacccauuucugauuugccacugacaucagcuugguggacaugcauuaaucaggucuggaacuugugaagcgcauggacugacagccagcggcuguauuccaguacuuacuuccuuuuaucuccugcuagccacugauauuuaguacagaucucccaccucacaguuacuucuaucuguucuuuguuccuuuuccucuuuuccaaucuucuaggggugugguccugguugguuuucccccuaaacuguucugucucucagcuugugccuggcuugugugcuuucugugcaagcgacagucccgcacuuuagccugugcuucaccgcaugccagcuaucacuccaucuauucaucacagggccuucccacccaagacucuuacuuugguaugcauuucauuuccaugcauaaauucccuaacaacguuuuugcuuuaguuuguccugcacaugcaagguuguccauguggguaucuuaaggccagugguuguguggaauaccuuccuugagccccuaaaaucaguaauccugggguuacagaugcauugcaccacacuggauuguaugugagggucagggauggaaacucauccucacgcuugcacaguaagcaccugaucugaugagccccugcccagggcacaguccgcugucagccccucuaaagaccuugcaacaugauucaugcucagcauguccuccuguuuaaagcucugcaccccacacuuuacagagcuuugacuuugcuugacaguauugcugaguuuaucauguuuguacuuuuggcucuagacaacugaaggcccugacccaacugaaggaucuaucacuuugacaagaacucuaaauuauuaucuuucuugucuguuauauaaugacgcuuucuccccccacuggcugcuuuaauuuuuuuuucacuuuauacaugguuuuuagcaaguugaguuuucugugccauuucgugauuugucuucagccugccuggguucagcuuuuaaauccgaguuucuuccugccacaucaucagauguuugcucuacacacugugacuaucacacaugugcuuaucuggguggcgcugucccauggaaucccaaacccucacuuuugaugguccauggguaacuuccaaggcugcauccuuaaauuuaaucaucccuccacacuguuuaauccacagauguuugcucuacacacugugacuaucacacaugugcuuaucuggguggcgcugucccauggaaucccaaacccucacuuuugaugguccauggguaacuuccaaggcugcauccuuaaauuuaaucaucccuccacacuguuuaauccacagauguuugcucuacacacugugacuaucacacaugugcuuaucuggguggcgcugucccauggaaucccaaacccucacuuuugaugguccauggguaacuuccaaggcugcauccuuaaauuuaaucaucccuccacacuguuuaauccacgguugccccauacggugaggcggcaacuccagguuccaguucauguuuaugcuuccacuucuuacggcaguucauguucuccuuuguacucuuuauuacaagcguaugcacguggacguaugccauaugugggcagcucuucccugcugagucagcucuccagcucuucuuuuacauucaugagcacaugcaacacauuuauaacugccuuacuacauuuauguauuuacuagucauguuuguuguuucugggucuuccuuugaacuaaucauuaucaguaaucacaauauacugcuuuuacagauguucaauaauuuucuauuacuauagcuugcacacuauuuggcacugaauuuuguuguacuucuuuaaagacuaguuucuguugcuuuuauaauuaugugugugauuacagaguauucuaugccucuuauuaaaaaaguuagauuggcuucuaaucuaacucaagacaaauagucucugccaugaaaauaccuagaaaagaacuuauuccugcuuguucuucugagaugcugggaaauaaacucagcacacuggucauaaagauaacaaaaagauccuauuuguuucaaauauauuucuagaauauaaugucaaaauucuaacaaagagaguucuuuaaauacaauuaagacauagguagcacuuaccugucaaaggccuucuaaaacaacccaucuugucccuugcucucagagccugagggagacgcuuacccuuucucacucagcagcagcuccaucucugaaauguagcacucaucacaggcgcugagauacuccagcacuagcuuugcauccuucuuguacgccuugcccacggcgcccuuguugggcucaaacuguacaacguuaacuguuuuguaugaaacagucaaggaaucagacgcaguacaacuucaggaauugggaaaaucaucuugaaacacucaaccauaccaacuucaaagccaccacccaguccugccagcauuagugccccaaacucuguuuaugcacaaaaugagccagaugggggugaggggagucggucaguaaagugaucccccacaagccugagggccugaggucaaaugcucagcaaucacauaaaaaccacguguggcuguccgugccuacagucccagcacugaggaagagacagcagcuccccucaaagcugcugcgcugccagucauacugaaaucagugauccccauuuucagugagggauuaucucaaaaaguaugguacagagcaguaaagaagacauuugaugugggcaucugguucacacacacauacuacacacacacacacacacgaauaaacaaacaagugaauaucauuaacaaagacuuauaagguuacagugaaauaaaggauuuuaucuaaucugcaauauaucuuaauccacagcauaaaaucaucggguaaugucuuuggccagugagguggcucagugggaaaagguacuuccuuccaagaugauaaacugcauucaaucccugggacccacaugauggaaggaggaaagugguuccuguaagcuguucucugaauagcugcacacacacaagcgcugcaccaaaagcacaaacauuaaauaaagggaauuuuaaaaauuugguuuugucacuaguccauccuaagaauuggcucauaaucuccauacaagacagagaagcaaacuccuauucgaguauaaagagacagugggcuaaacuaucuuuaaauggcucuaggcuuacaugagaacaauacuuaccagauauccuauaucuaggggcacaugugcagaaaaaggcauguuggaaucaucuggacaaaguagccccccagaagacauucuggacauacuucuaaacauaagucuuuuaaggucuaaugcuguggguauuaauuauaucuuaaauagacuccaggaaagaagcaaugagggacaccagccaacaaguuuaaacaaccccaaagcucuccauucauucaaagaacaagaggcaaacuggggcucaaacaccuuuagccuuaauuuuggaguggccacaaaggauauggguucuuucagagguuucucagcuacuaguggaacuuugguggcucgagcaugacaggagaggucguagcaggaacggucagcacauccaacaaucucaauccagcccuaggaaaacagaacuaacaaagucacuuaccgcuuacacuggcuuugcucaugaaagcaugcagacaauaacuaauccuuccaaauauuccaggacaauugaauuauagacucuacaaauggauuuuguaaaucauuaaagagaacaguuucauacaugaggcaguuaacagaucuauacaguacauagagaauucacacuguauaugaaguggcuuuauuuuccagacuggcuuacaaugucauaugacuauccaguaaaugaauaaucuacagguugaauaugaaaauuagacaguuaucugaccaaaaccuauagauuuggcucaaauuuguagccaagacucaaauguggcagaaacuacuccucccucugaauagcgugccaucaaauagcuaacugaacauggcaggacauggcuguaaguccuaguacucaguuaguucaccugacugaacagagagaaacucauaaaauguggguaaagaggaacaggugucauaccuaugguaccaauuguuucaaguagcauacaguggacugacugccaaugucacuguaaaccccugcaaugaaauccugacacggaggugccuuuaggaagucacuaggucacaagaggaaaauuccaaucacgggguaagugcuccucauuagagagcucagcggagagcuauccuccaacaggggugaagaaaagauggcagucaucaacccauuaagagcucuuaaccaacccagagaacaccagauucuguuccuggcccauaccuucuagaaauuuguugaauuuuguuguaagagcauaaaccaagacacaaccuuacggauguguucuguaagaacaagagagccuauaaggcaugaaggucaagaacacaggcuugaagucagagaguuuagacucagcccaguuccaccuccuccccagcuugaggcucggagacucuucccucuuagcauuugagcaucuucaggaagagaagagauguagaggacugcauaagacaauguaaagcacucagaagcuuguaacagcaacaaaugugaacgaacaagaaaguaagguggaugaaaggcaggccaggccaggguuggaaucucaacugacaccaugugcucuacugcuacuuuaaauaaaaccaacagaacugggugaaaagagaaaggcaagcaaggcagugguggugcaggccuuaaaucccagcaauugggaggcagaggcagaggcaggcagauuucugaguucgaggccagccuggucuacagagugaguuccaggacagccagggcuacacagagaaacccugucucgaaaaacaauaaaacaaacaaacaaaaaaaagagagagagagagaaaggcaauaacauaaaucaagaaagauuuuauugguuuaauaugaaauaaggaaacuccaaaaaaaaaaaaaaaaaucaggaguguagaaauauauguaaugguaucuggacucuuaaaauaauuacuauccaccuggcacuuucguguaacuguuuccucuucuuggacaagcagucccuccuggagggacaggaggacagguuuaaggcuagcuuuggcuacauagguaauuugagaauaaccuaggccaugugagaucuugauucaaacaaacaaacaaacaaacaaacaaacaaacaaacccaaaauacaaacaauaaagauaugcauguuaucacacauuuauacaugcacauuauccacagaaaaaucaucuagaaacugagaauguuggagaccugcuuauaauccuggcacugggaaggcugagccaagagguuuauggcuuaugccagccugugauaacacagaugacugcauuuuauaaaagccaaugaucucauguagcucagagacccugugccacagcagcuucucuccuuguucgugaagaugccucuccaacaugcagcagggagagccagacacucaggccuugcucaggcaucuccaacacuacccacacacagaagaguuagcuacagccugcugauuuucauuccuaaaagugggacuggaauggaaggacaugauggaggugaucugaagaucucuggauuuuuaucaaauacaaagagcgaaagagaccagaaucuaucuccuaaaucuaccaaauaauucucuaaggguaaauauuuuuaacccuaccaccacagccaguguuugcuagacgccugucaggaggccggccuaucucagcuccacugaggaaugguauagcacuaugcacccaaagacagacacaccugugccaccccaccaucacccuucccucccuaccuaaagcagcuaucugucucccaagggcuuuccaacacauaggguggccccucuuuacaagucaaccgcugucugguuaguucuuugguccacucuggcaugaagagcagugagcaacgguguaaagcauuacugcgggcuacucacauaggacguuuuggacucggcaucccagcagucgcaggcauaaugggccaucucauucuccauaugcugccggaagcggaguuuaucaggagauauuccaaccuucgugagguagagguagaugcggccaauaaaauagccuaauacugaguuguuaaucacacccugaacaaauagaagagcagcaaagaagaaugaauacuucugaaggcugauggacucugucuaccugcauaccuagcuacgucagucuacugaaaacaggacacacacaguaaauguccuucccacugaaagaacaauuucaaauacccacaaggugaucuugguuauuuuuaaaaugucaagcuaacaaguuaauaaugaagucauucaaaauauaucuaagacauuggguucuaacacuugggaggcagaacuaggcagaucucaggcuagacuggucacauagcgaguuccaagacagccaggacuagacagugagacuuugccuugaaaaacaacaaaaugcguaacacaucuguccaacugacucaggccuauaccauacacuuucuacauccagucacaaauaagccuaacuuaaauuaacaaacuaaacagauauauugaggcuguuuuguuuguucugaaaaaaaauguuuucuuguccacugaaauucaucugcuccauauaggacauaucauuuuauaacuuuaguacuggaccuauuucccaucacugcaaggauguuagcuggcuaccuuuaucaacuugacacaaaccuagguauccaugaguaggaaucucaacugaggaacugcguccaccauacuggccaguggguauuuucuugauugcuguagaaggcaugcaaguccuugugcucacagauaagcacuaaggaagccaggaccacuaagcacauagguagggugucuauucaaagggagagaugucgaaccugcuuuccacccagaagacagaacagagagaaagcugggagcaggcuugguugauagccgggugaccuuugagauaucuguguggccaggccacaccugaccguccccgggacucuuaucuugggcuucuuugucucaguuacucuauggcacuauccugucgcagaccguuuucuugagcccuuuuucucaguuaauuuuuauggaagacguuacuuguacuuuacaaagagcuccauggagucacgucuuaagcuuuggugugcacauaggaccgaguuacuuaucaccaggaagcuuuuaugccugugguuuguaccaauacuggcuacugagucacacugaacugaacgagcuucuuaucuccugaggacaguuauucugcuggccauggacacagagaccucuguagguugcuaauucauacuggaggguccaguccacuacgggugaugccaucccugggagguagaccuagguguauaagaaugguaccuuaguaaggggagaggcaagccaguaacuagcauuucucuauuggcuucugcuucaagcuccuacccagcuucccucagugauggacgauagccuacaaauaagugucuaaaaaaauaaauccuuuccucccacguugcucugcuuaugggauuuagcccagcagguuauuucugcaaagcggaugauaccucuucuuauauacuucuaaaguuaggagcuaagugcuuuuccaggcgagccacucacuacugggaaacagcuacugaggguauucacucacucauuucuccaugcagauauuuaaagaaacucagaaauauacaaggccuaaagcccaugcugugggcaaacacaggggccuggaucccuugguguucguuuucccugaguaaauuucugucucuuccaaaguuguguaaauuguuaaaguagaaucaguuagauacaggacaguugagacuaagaccaauuuuuaaaugcugugugugcgcaguuguucaggaguugguccucuccuuccaccauguggguccuagaaucaaacccaagccauaaauaggacuucacagccggugagccugcugggccacuucccaggcccaucugagaaacgguuuaacauuagauccuggcccagaauaauuggauccugguuaagauaauuuucucucuugauacuaauaccacaaaguaaauucuauauaaaacaaauaguauauagggacuggaacugcaacuuagagcuaggucacuugcucagcaagguuugcucaucaguaccacaaaagacgaaaacugucaggguugaaaaugcaguucaggcacuugccugaccuacuacucagugcacaaccaagcugccaaguccugccacugcucacuggcaucaucuucaucagcucccugagaaccuuaccuguucaacagcaucucccagacgcaucuuccgagcagacuguccagugaccugggcuuuugcugaguacaaauaaaggcagaggucggccacacuuuggaacuugggauggucuuucucagugggaucuacaaagugcucaaucucugccauuguaaacucccuggaaggaaaaacaagaucaaaaucugcaugccuaacuguauaacugagucugucaacaagguucccauuucuggcugcucacuccucuagauaaagggccgaaaccccaggcuuuucuuaugacuagcuuccuaaagaaauuacccaaagauuucuggguuagguuuguguaggagauugcucuuuuaaaaaaacaccaauaacuggccuaguagacaagcugugguagaaagcaggcuuggcacgcucaaggccuugggugugagcccuaacaacgaaauaacagcaacaacagaagugacaacuccucucaacaguagucccuucuauguagcaguagccgaguagcgcuauaaauaaaaguaauuuuuaaaagcagauuaauauauccuuuaaaauaggaaacuagcaaaggucacauagaagggaaacaagaugcuggauaguagcaaccacauaaaugacucugcuuaaagcgucagaucucugcauaaauauauaccaaaggaagucacagacauuugcuuuucaaagaauaggaaauuagaagugaacugaaaugguucuccagguuuuaaagcagguugauugacuguguuuuauagcuccaaacaaguaaaugacugauaauggcaccaaacagauggucucguuagagugagagcaucuaaauaaagcaugauuccaggcaaaggacgcugggcaugaacugaacaagccacgaucaagcucagcacauaaugacgaaauaaguacgcacauggcaauggcuuuccaaagagauuucucucaacugcaauuuaguagcuauuacaggggaagggagagugguuuaaguuaauuuuaugagucaaaaucuuuuuaaaaaaauggacacaaucucacugguguacucucacgauuaucacagauguuuuagaagcaacacaaaauugcacagauuggcccuaaacacaugaaauguacugccaagagcucuggguuuuuaauuuuacucguuaauggcacuuuuuuccuuggucccagagcacuaagucuuaauuaccuuucagcaacuguaaaaugugucugugcacaugaaaacgcaggugaauauggugcugugcccucacaggacguacaccagggcugacaggaaucaacucguacugugcagaggagaccaauuaagggucuacccagaaucccccaaguggugcugccaaagucuucccguguucucuauagaaaacuucaugucaacugcaguuaauaaugcacuaauaguaucaucaucucaguaccugcugaaaggguuaagguugugaccuccaaaguaacaacugaaaggcaaugauguaaaaguuacgagcuugccuuuggucaucaguccaggauguauguguggcuacacaaccuauuuuucuauggaauauaguacucagaaugaaaaugucaaaaagaaauguggaaaccauaaacuuaaaugacgguaagcuucgagaguaagagacuaaccagugccaggacgcuucucacgcaugccuggacacagcagagagagcaggaugucagacaggcgggugucugaacucagcaguguuggcuugccaaccgcccugucaucaaccucuacaggcuuacaccuggacacgggcaccuacaagagggugcauccaggacacaccuuccagcaaucagcaaagccgccuccccaggacagggacacacgcacgcacagagagagagagcgagagagacagacagacagacagacacagacacagaccgccccuguacuccacagcacugacagaaaugcacugguuuuaacauaaugauuaucaucaggaucucuacauccucaagagguggugagcaaagaaaagauuucagcccaaguaggaaccagaagcucucaucuuugcucuuuccuuuccucaaacaaaacugccaccuucaccagagguuacaacagaaacaaacuguggucaagguuaaaguacaaguguggcgguuuccaucuccaucccgacaccaacagugaguaccugacucggaucaguccagaccgaggugagaucucauuucugaaggaguuuccaaucugggcagcagcaaaaggcaauuucccuugguugaauuccaaaagucguuugaaauucaggaaaauucccugugcaguuucuggucucagauaucuauaaaauuaaauaaaccagucuauuacaaguaagacaaugugcuuccaauaaaacaaagccuguuacaaguaaacuaccacaacuaucuuuuucacaguaaaauuaugcuuauggccuaaauaaaagauuuuaaaaggaagagauccugcccuaaggagcaaacacucccacagacccacggggcagacuaagaacuugggauggccaaagugccauccaaacucuccuuaucucuuuacuccaaguccacugcucugagugucacgacaguggucugaguuagaauggcccccauucguccccaaguuugaauacuugguacccaguugaugggacuguuuggggaaguauuaggaagcauggccuuguuggaggagcugugucacugggggcagacugagguuucaaaagauuccugucauucccagagugcucucugccuccugcuugugguuggagaugugggcucucagcuguuccugccaccaugccuucacuucgcugaagacucuaacccucugaaauauuaaacagcuggauacgcucuuucauaagcugccucggccgguugucucucccauauucccucacuugcccugcucccucucccaacucccaccccacuuaaccuucccauucuaguucccccuuucucucuccucaacacuacauucuacuuccccauccuucugacuacuuggaguacaguguauaauuauugaaacauuaaauacuaacauucacauauaaggggaaagugucauauuugucuucuggggucugagucacuucacucagagcaucuuuuuccugacuccauuauucaaggcacugcuuccuuggugauuucucagcauguuuguuauuuguagaaaaaggcuguugacuguguuaacuguauccugcuauuuuguucaaaguguagagaucuccuggugaaagacccuaggaucuuuuaggggcacuaacacuaagggccuuuugaaaaagcauauggaaaucuacuacuauagaagcuuccuuuaaaaaaaaaagucaacauauaaugugagagacagcaccccaaggagacaucuuaugucuccagacauuccagugucuggaaugggcuauauuuagucauuggccaaagagucucaugggccuccccaaauaucacaaguuauugguugcucuugacaaccugacaguaacgcccuaugcugaaaacacaacuugcuuauuaugucaucaaacauggagaacuugaaacuuaauuucaacuaacuagcauucaugguacuggaaguaccuuccugcaagacauacuagugcaauauuagcacaauguuauggauaaccaaccaccugcuuaaaaacuccaaucuaaggcccacugcaugaaacggaacaacacuugauacugcuaaaguggccaagagcugaaacuacacagguagcaggccuaggggagacuacuauuuaauuaugccuaaugacacacugcuauaccuaacaucagagcacucacccacacgagagaagcuucucucagaggaugguaauuaacauggagacccacaacuggacaaugugcagugagagacuugggagcacucagucuaacugguaugguuucauuacaccccuccccuucacagcucagagaucugggugggaaaggagguguaaagauucagagagccaggggugguggacagcucccaggagacagcaucuuacacagacaacagggcugauguacacauggccucacagaaacuaugguagcaugcacaaggucuguacaggucugggccacauagagucccaccacugagaaggggaaguggguacagaaucccagcccuaccaagaugcucuuugcaacugauaccuacuaggggaaaaaaaaauuaguuuuuugcaguggagugugucacuggguauaucaaccacacuccagggaaggccucaugccuaggaauagggguguguguguguguguguguguguguguguguguguguguguguguguguguguguuagguuuuguuuugguuuucagagcauggaacaugaaguuaggugguagagaggugaggaugauuugggagcgagguguuggggaggagagaaacaugaucaacacauauuguauuuaaaaaguuuucuuacuuaacaaaacguugcccuuuucauggucucauuacagcaacagaaaaguaacuaagcuaaccaguaaggccucugaacaaccacugccuggaggcagacgccaaauuuaguuccuuuugaaaauaagaccuaucccuuagcguacuuuuuaaaaagucuuuuuugaaaaguuggcaaaacaaaauaaugguuuucacucuggcaucgucauacacagguuacucuccuccaucccuguuuaucccugauccuucacugcccuucucuacccuccugacccuacucuggcugguccucccgagacccacucggccccccucuuccagcacucuucuacuuucccugccuguuucccuaagauauuuuccuccaucccggcuagugcaccccuccucuuuaaaaaaaaaaaagauuuauuuccuuuauuuuauguccuugaauguuuugccugcauguaugugcaccacauauacgcagugccuucagagagccaagagggcauccaguucccuaggacugggauuccagagaguugugaacugccaugugggugccagagugcaguccccaaccgcgucaggucucuuucucacaucucuguuuucugcguuguacugucuaccaaaugucuuugucuuuaucuuaaagauaaagucaaucguauauaacugccuuaguuacugcucuaguucugugaggagacacuaugaccagacaacuuauaggagaaaaguaugugaugggagccugcuuacaguuucagaccaccugaccagcaugguggggaguguggcagcaagaggucauaguguuggagcacuagcuaagaauucuacauccauugugugccccgguacaggggaacgccagggccaaagggggggaguggguggguaggggaguggggguggguggguaagggggacuuuugguauagcauuggaaauguaaaugagcuaaauaccuaauaaaaaauggaaaaaaaaaaaaaaaaaaaaagaauucuacauccagaucuacacaaaacuucaaaucccacagagcaacuuccuccaacaaggacacaccuacaccaacaaggagccuuccaaacagcucaucagcuggggcuaaguaugcaaaucuguaagaccacggcgggggugggggugcauacucauucaaaccacaacagcaucauagccaguguccucucuaacuucagaaaagacucugugcaaaacauucacuuaaaaaguguuccuagaggcuuucugcaaaauagcaaaacaaguuuaaaaccaaggaaaagaaacccuaaaguuuacucucguucauucuuacaaaacuacuauucauuuuuguggcccuuuccauguuucauuaaaauauaaauguggcuacaggguauauucuaaguaguguguauaaaacuaugccauuuccuguaugauuuuacacuuuuccuauuuuuaaguaaguaaaugcucacagguuaacugugacugaaugucagacugaaaugaucuacuugacuacaacuaguuuaaccucucaagucaauggacaaauauguuauucuuacuuucaacuaacguacuuauuuuuuuuccuuuuagauuauuuccuaauauggccuguguccuaguuaggguuucuguagcugugaugaaacaugauggacaaagcaacccagaagggaaaggguuuauucagcuuacacuuccuuagcacuguucauuauugaagucagaacaggaacuuuaauggaguaggaaccuggaggcaggagcugaugcagacgccaugaagcagugcugcuuagugguuagcuccucccacuuucuuacagaacccaggauccucaguccacagacaggcccacccaucaaucucuaauuaagaaaaugacuuacagcugaucuuauggaggcaugucucagcugaugcuccaucucuucagauaacucuagcuugugucaagcuaguauaaaacuagccagcacagccugaagguggcucucguuaggaagcacgcuugcugccacagcuaugaaccugagcucagucacugcagcccacaugguggagagaacuaaccuaagaaaaauaccuuucacugaaaauuccaugcucauuacuuuguaugucagguugaaauauuaaaaaggaggcuaagggaaaaagaaaaaaucaaggcccaccuauaugucaucuacagacucacauuacauuaaaaagagaaaaggaaccacgcgugauguuaugcugugcagagucaagggaagugagacagcccuacauaugcagagccacgaaacgcacagcucugcugccugcauaaaagcugucuuuuuuuuucccccuucccuucucccuugcucaucccccacccccacccugcucgcucugggccccagcucuucacugcugagccaucucaccaccccauaaaagcugucuuauauuuuaagagugugggcuagacccacgcucuccagcaccaugggccacuagauaggucuacguuaaugaaagugaaacaaauguugaaauucgauccucagaaacacuggcuucuuuuuaaaugcuaaaaagccacacaugacuaguaacucuaguuacaacauagcacaaaaugcaaaccgcaauggauggauucaaucauuucuaaauauaaugcaaacucaaugacauaaagcacucuccaccugccuauccugugaagcuuacuggaaggucugaggaucauggacuucugcgaacacaacccccacucgcagccuuccucuuggcccucaaguuuaccuuuugucacaggcaauuuuaauaaguguguuagauaaacaaauaaaugaaaaacaauacguacccaggcauauuuccuccaggcccaaugaaggucuggaacauuaaguuaaaagguaccggaggggacaggucauugccaguggugggagauuuuacauuauaguucacaaaaagauccgcaaguucuuguuguccauaguuaucaagcuaaggggcacagagagaagauaaugagugcaaacguuacagaacaaggcacaagaucaaguacuauccacagcuucgucccaccacugcuccaaccacacuaagugcaggucaccagcccaacauaugaccaggaaaaauccacuaacaaggacgaggucugccuggggaaaaacggcugacuccaggucugagacaugaagcaaacagaaugagccuaaaaguauccugucauaucagugagcaaggaaguuaccgaagagugcuaagguguacugagagacucaguggacacuccugcagcucaaacgagacaguccaaccaucagcaauagcuaccacuaaaggagaaguaucagucuuuaauuccuaaaucagaacugagaacagcacaaaaccgugcagacaggugggaucucacugcguccauuuggacuuuaugaaaaugauggcccgugcacuuuuagauggauaguaaggauccgacacaucguuuaaagcaagauagaggcaugggucaaagauggagucuccauuuucuuuauggcugaaaagggaacuuucccauuuucuucagucaaaagaaacagcagaggacaaagucauuuuggaaugcuugucauccagugggccugggccauuugcacagugacggccccaugaagacgagcgagcacguaccaagugucuaagcucuagugaugacacagucagagaugaacaagcagggccaugugaauagugacaagauuuuuuucucuaacauuuauuuuauuuuuuacaauaaaaaguuuuaaagcugacuuuacgaaucuguaaaugcagacaaaggucaacaaagcuugggggugaggggaagcaagggaaguaagcagucccaguugagaccacacagacagacagggaaacaaggaagcaagcaucaguggcugaguccacacaaggaaagaaagaacucuuccuauggaugagugaaucugcgcuucagagacgcucccacagucccacaguggcacuggaaucacggcaugaacuaguauggcuuugccaugacauggcuccauaccagcugggcuuugagccaugaggcuagaggucauuucugagaacugugucagcugccauccucacucuucacugagguuuuauauauaacaacugcaacaaaaaucacuguccugaauacgaaagucuaguguucaaacugcaaucacagguccucaggucucaaaguuuacuuuacuuggaaaugaaagcaacagguaagaucaaagacacacuccaaggcauauauaugacuauaugccuuggaguuaguaaugcugaacggaaaacaagaaaucagagggggaaaggcaggcauaguggugcacagcuuuaaucccaguaggcagaggcaggacagccuggucuacauagugagccaggacagccagagcuauguagugaaacccugucuccaaaaacaaaaaauaaaauaaaucaacgacaauuaguggcaucucucacuucccuuuaauaaacaugaagccuuggaaaaggaaggaaauagaaggaacccaugagacugaggccacaggccacagguccacucccagcgcuggaaagagcugcaacuguaguagaaguauaauuaaaaaaaauaauaauaacaacuuucuaaacuuaacagcauuagugugacaagcuucaggcaagugacaaacuaaacaucacagggacugacacugcuagauggguaagcaagcagacuaacaaaguguuuaaauaaagaagaaaauuuuacaucugauguuggaaggcaaaacuaauuaucagagaagaauguacaugcuuaaaagaaaaauaggcuaaggguagcaaagagucuagcaauuuccaugaaagaaaagcaaaauguuaaaaaucagcaugguggcgaaggcugaugaggaaugccaauucaaaaagauuuaaaaacaaacaaacaaaacaaaauaacccaaaguggguaggugggacaguucagugggaaaggguauucagcaccaagccugacggccugaguucaaacccagggaucuaugcagaggaaggagagugccaaccugacucccuauagcuguugucuggccuccacccuagaccacagcaggggccacuccuucucucacaagguaaauaaguaaacuugacaaaaccaaaacaagccagcaaaugugagaguucucuacccaguuuuagacagaccaaugggcuuuagagcuaggcaugaaugcuaugcuuguaaucccaacaacugagaggcugaggcagggggaucacaucaagcugguggccagcuugugcuagucaugaggucuagacuacuuugggcuagacagagacuucgaugaaaagacacaggaagaaaaguaggaccacaacuguuugucguuagccacagaagaaaacgugagguaugcuccaugacugacacaguguaagaaaaacuguaaaugcauuuugcucaggcagaacuccagacaggcguggguuguucugaugugucucccgacugcucaccugggccaagacacuuuccaucucugacuucuucucagcagagcacuucuuaucugacaucaguuucuguaaaugagcuagaacaacagugcugguaagcgacaguuuccagcaaggaaggagggcacauucugagcgccaaugcugggcaaugaagacaaauacaaacuauauauuugggauagggguggggagaggcuggagagauggcucagcagguaagagcacugacugcucuacugaagguccugaguucaauucccagcaaccacaugguagcucacagccacccauaaugagaucugacgcccucuuaaggggaaucugaagacagcuacaguguacuuaauuauaauauuaaauaaaucuuuaaauauauauuauauaaauaaaauuuauauauuauauaugaauauauuauuuauuuauuuuauguguauaugaguacacuacugcucucuucagacaccagaagagggcaucagaucccauuacagauggucaugagccacccuguaguugccgagaauugaauucaggaccuuugaaagagcagccagugcucuuacccgcugagccaucucuccaggacccgaagcuaauguucuuaucuucuacuuguucacugacacuuucgcagggaggucuugauguuaccuagguagaaaaccucgugcugaugauggaauccaggacucuaaacaugcuaagcagucuaccacugaacuacagucccggcccauaauaaugucuugaucacuugcugauuagaaaaauuacuaccugaauauaacuaaucuguaggugacucuguaacauaagcuugaaacguauguuuagucugaauauguuaaaacaagccaauuuuuaaaaaacagaaaaacuugagaaauaaguccaaccuuguuuugaugaaguacaagaaagaugcagacgcauaccuuucaacagguggucugcucggaagcacucuccguucuucacguccuucaccaugaagucagcaaauuugucuacguggccagagguccuaagugaacaagcaaaccaacaagugaacacacacuucuaguuacuucaaaugauguucugcugggacacacaagugaaaggaugucuugcuagagcaagcacgugaaagacuguucuccugaagcagacaugugagaggacacuugauaaauaugaccccacagacagugggggaugagugcugagccucgguuugcuccaccuuucuagucucugcucaccacaggcauguauugguucaccuuaaguuguguugucgagcucaacuugugcuaacucugccauugagagaaacuugcccaagaacugcuccugagacccccacagcagcuuuuagcuucugcagccucaucucaggccagcuggggagccuggugguuucuccaggauugagcuacagcugccuggugucugcuugcucaaaggacuggaccaaagcuguugguuagagccuguugucugccugccuagaggacuggucugcagcugcugagccauauuuggugucugcuaugcgacugaacugcugagaaagaagagcaagcucacccuaaacaacuacugcugaacagguccacuucccccacauccuaaagacuuuucucuuccacuaccucugcugggugguaggguagaggagagggugaacccuuauuaaaaguacguacaaaaaaucuaugcuuacaaguauguuuaucuagaguuuagauucaugcauaucaagauggaaacuacaucuaaaguaacaauauauggcagacagagacacaugcccugagaaaacuuucuucuacccucucaaguauuucuugcccaggaaaaaagagauuagcuagauuauacacauuuacaaacugucuuaaggcuauaugacauuucaggauaauucaagcuuagcgaaggccaaagccaucagggaucugaugagcuaagacucacagcucagcagauccucaccuacagugacuuuaguauuuaguuacuguaagugagacaauuagcucaacgaauuuauccagaucuuacagacucaucaacggggacaccucggauuacuaagagcaccucaaagaggcuaauaauaagaacugcuccuucccagacagcauuaaaugguaauaagggugagacacaaagagauaagaauuccucuugcacaguuacagaaaccccacccuaccugcaauaaucuugaaucuuauccuuugcauuuaggugagaaugccuacuauacuagcauuuuacaccauggaaauaaauagccaagggaauauccacaaauguagcuaugcaaacacaaauucauaaauacuuuaacuuaaauccgucaguuagcacacuaaacuauguuacacuuguaaaacagaacauuaugcuaucaucaagaaaaaugcuuuuuaaaauuauucauucgcuguauguccguauguggguguaugugacaaggucagagggcaagcuguaggaguuagcucacccucuauaccauguggggcuaacuaacuaaacuaagguuaucaguuuugccagcaaacacuuugaccugcagaaggggacaaacagcaauuucaacguggccaccugugagcagcagguauauacugcuuuuguuuguucuucacuaauuuucuaaaugaacacagauagcuuuuguaaucaaaggguuagcuauuaacuuguaaaggcccucucccaccgaagcagaagcucacuuuaaaacuggcucaggggugagcauggugcagucaaucuccaggaucugcuccucuuggauaaagugcugccuccaggccuggaugauauuguucuucaaagcacauccuaccggcccgaagucauacaauccacugacaccugugagggagagagguaaacguggcuuuuccugucacucugacucagauguugcccacagugcaagcccucugcgccaaagagcguuacuuacugcuggcugacugugggaaaccuaaaagcucccucuacucacugaaaaggcagacugcaauguauguggagaaacagcuacacaggcagggaaaaauuaccuaagggccagcacugccuucucugaauuacguuggguacuugggcugucauuuaaaccucaagagguaagacauucaaagaugugcuuagcaaauccaggcaagauacagugacaaagcacuacaggcugaucacuucgaggaccuguuuaaccaguaggccguucuuauagcacucagaaagacuugugucaucuuccugccugaagaacaccuucccugacgaaugcccacaaagaauaagccaaggcccauguauaacaguggucugugaggagaggcagccagguaucagaacuacaauaacauucuacacacccaggguaccagcaggccuuaggaagaaugcaccaauauacacacagccacagcaaaugccuagugucugagcuuguaaucacuacccacuaugagaaaaaaggcuccaagaauucucagauggagugagagaccuugauacacucagccuuuuccccccccacgccccccacgccccccaccccccccacccccccccccccgugcucaggguacuuugcagaagagguggcagaguguaagacccgaggggaugaaaggacaccaaggaaaccaggccuucuaaacaacaggagcaacaccuaugugagcucagagaccgaggcagugugcgcagggccugcaccaaacagacgcagacacacgucccuaacccuagcccagaggcuaaaugaaagauugguucucucuaacucucgcuggggacacaaacuacucccaagggcaggacacaugcccagcaguagaugccaacagaaaaggagcucaaaggucaugccagggugcuuucuuuuuccuucugaaaauuuaauuucuuuuauuuuuuuaauucuuuucuuucuuuccauccuacggguccucuaugcgcguauuauggcuuccaguuucauguucuuacgggauucccgagugugggugagcacgucucugugccuuuaucugcuucuugggcuuucucuucuguuuuguuucauuccauuccaaucuggguuuuuuuuucccucucuuauuacauuuauucaauugaccuuuagauauccguuaguuuuccagggagagacagaaaggagguggauauggaugagaggaaaaagugggaaggaaaacuggcgcacgccuuuaaucccagcacucgggaggcagagacagguggauuuuugaguucaaggccagccuggucuacagagugaguuccaggacagccagggcuacacagagaaaccuugucucagaaaaagaaaagaaaaagaaaaaaaagaaaacuauccauuuaaaaaaaaaaaaaaggccgacagggccgacaguggugacacacaccuuuaaucccagcacucaggaugcagaagcaaggagacucuagguuugaggccagccuggucuacagaguucuaggacaggacagccauggcuacacagagaaacugucuuagaaaaaaaauauauaaacaaagaaauaaauuuuacaagggggugggaggguaauuaacagaguggggaguacuaagaguuuaugcaaauaucaacucuugaacaacaaaaauguaaauuacaugacuucucuccuuuaugggaucugacacaauugaauaaacaucaguuagcaagccaagcucuugacaaagcauagugugauuuagauaaguuuggccccaaagacacacuuuagaauacuuggcucaaaggaagugguacuacuaagagguguggccuuauuggaggaaguguuggggugggcuugagguuucccaagcucagacucugcucagcguggagagacccuccucccagcugcuugcagaagacaguguccuggcugccuucugaucaagauauagaacucagcuucuucuccagcacccugucugccccaugcugccaugcuucccaucauucacuguggcuucauucacccccuaccuccauaaauagcaaaagccugaucguagaaaaaccuccucuucaacguaucuuccauuuuugcucuaucuacgaugucaucuuugggcugcaaugccagcuccuauaagagcaaacaagaagagaguaauuggacagguaggcgggguucuaacacaucugaauuugguagaauccaguauaaaaugcuagagauguaagacguugaggagcuaaaguggaggccucaguccccacaaacacuuugagcagcaguaaagaagcugugauaguuuggaucuuaaaguccccagcagcucagaguugaaggcucauuggcucuccaguugacaguguugcuggaagugauggaaacaccacgagacgcgcucgcgcucucgcucucucugucugucuguguguguguguguguguguguguguguguguguguguguguguugaggcaacagugucccuccccaugucauuugcaccacaggucugagcaaacaggcugaauauagacaauaacgccugacacucuagcccaauaagccuuugauuccugagaugugucgcucacagcaaugggaagcugaauaaugcagacacugcuacucacguagcagauaugauuacuuacgauuggagucuuucugccuacaaucccagaauugaguuaucgagccagaaggaguuuaaagucaaacugacuacaguaagacuugcucucaagaaaacaaaaaacagacaggacuacuacacuucuuugaaguaauuuaagcaauaucucaguuuauaauguauuauguaagacaucacuuuaaaaccucagcugcaaggcucaggagauggccuagcagguaagugcuauugacuaacacaggccugaauucagcagcccccucuguacccacauaaaagcacaguguggggucauggaucuguaaccccagcguugaggagauggagucagaggaugucaggagcucacuggcuggcuaguauugccaaaccgaggaacuccagggccagugagagaugccugucucaaaaaauaaaagggacagcaagaagggacccgacagguaccucuggcacugaagcacagacagacacagacaacccucccccaauccaaaacaaaacaaacugaccucuuggacuauuuaaauuuaaugcuagcagguuuacaguuugaaaaggucugaaguuaaauauaagacagauuauaacaaaacuauuaaaucuaaucccaggugaauucuuaaagaggagcaugaugucuucuaggaaauucauguauuuuauuaugucuaggacugggggacagugagaguuuggguucagguagugcggaagcuuuagagacuacggggcauuguaagcugcacuucguucuugaagcagggucuaaugugcuaggcaaaugcuccaccacugagcuacacagccuugagcagcucucagagaagacaagaaguugguuagguagaaggaggaaaaggcacaaugaauaauaaaaaaaaaaagaccaaauggcacuuguucagaaagcuuuugaguggcacuuguucagaaagcuuuugagaucuuuccuaccuggagagauuaaacaaagaggaauaagccuacaccuacugacguuucugccuuagcauccuaagacuuaccuuugcuuccagaacccucuuccgggccuugagcucagcuacugcucuguccacauccacuuguggggcuuuaucuucuuuuaacuuccguacaaagucucccuggccaacaaacaagcuacaaucaggacugguuucagaaaucagcaaacacuagugcucuuuuuaaacaugcacuuaaaaaguauuuguacacaaauaccaauugcacguguuuauucuguaagaagucuguaagaaguaucaauaacugaaggccuguguccacagcaugcacuguccaggagaacauaaguaaguggguucacacggugagucuguggggagagaacagcgcucaccuacauauggacgacugacacugaauguucaggcagguuaccagcacaucagacacacugaagagagaauuagucaccuaagagacagacuuuaaaagugccuggaacaguucagaaagccagaguuuaaacccucgggcugguaaagagcaguaaucuaauacauucaauuagaauguauaagaaaguaaaaaaaaaaacaaaaaacaaaaaacuuuuaagaggcaaaauuugggaagaugguugacuauaaaaugucaccaauuaacggaucagcacaagaaaauccaaacauacacacacaagaugccacaccugggcaagccacaguaaaggcugcugggauuuaaagacucagcuuucacuuccuaucagugaacugugaaaccuggaacaaacuggaaaucucucuggacucccgaguaugguaaaucccugcagacuuacccccaucuccugggcuguuacagaacacuaccaaaccaacuacugcaauaauaguaugugugcaaaauggcuaacagcuuuuguucugcuugcagguaccucagccuggcuguggccacagaugcuucaagccaaaucuguuccacacugaaucguuuucugucucucaggaaacaucaagcuaugcuucuuuagcuccaacaccucacugacuucacuucccuauuuacccucuccccaucugacaagaugccagcuugucccaucucaaaucaucuaacacuaacaugaaacuagucccaaauaaccucaacuuuaguguugucauuuuuaagcuuuacuuucugaacacaaaccacccuuagcuugguaacugucucuaccuugugcucaguguccaucuuccuaccacugugugucccugagcuguguuucucauauuuccaaauacuccaaccuggcugcccccaacgcugucccucgcagaagcaccuuuuucucccauauacaaagggcugagaggguagucauguuuucuuuacugucuucccuccugagauccuaggcccuggagggauccuuagcauucuccucuggcuuuccaaguccccacuccucccuucauucaugacagccucuucuagaaccaauguucucuagauauuccaggcagaaaguacaaacagaacaagaaccaaugacacacaccagaacccagugccagcuguuucugcccuucagaaccuccuagugcauuucccaggagugagcacgguaaaugugacauaaaggcuauaccuuaugcuguggguaauuuuuauaaagaaguauucauuggcugagaaaaaacuguucaauauuuggaaaaacacagcauuaaccacggcaaugcugcugguaucuaagcaaccacacaugaugucuuuaccagugcacacgcacagcaacugcaggaggguaaaccugggcaggggcuuaagcauccgcuuggcucauuaccgcucccaggagacagaccagaauguacacacugaaauacucagugcuuggcugcuaauguaucaaacuccuucucuaacucuucauauagcacuaucugcacacacacgguuuacuuagcugagcugggcacaguggugcucagcagcacuccaaggucuaugaucugcagagaccccaccucaaguagauuaaguaacuaacuucguuugacauccucuaugaguuucacuacaacaacagggaauuuugauguaaaaaggaggcagcaucugacaugguggagagccaugcuaucagccucucuccccucuaucacacucaguuucuauucuaucucagcaucaauguuccaggcacccucaaacgucaucucaucugccucacaauacuugugauccaaaaguggacguucuggcuuguuuaacguacucagaugcagucagaaaaaccuucagacauguccauuaugacacucaggcgucuguuggcugauaccauuaacccaguaugccaagcacccagcacucaguacuagcuacugacccacucuccacuccuugaggggcuccucaaggguguuagaacguccaccccauaugcuuucucaagaggaaaugaagccuguaugagccuuuguacaggagagguggcaagagguccuuuuccguguuggaagcacucaggugaguccucuuuaaaaccuccccaguguguuaauuauaggcucccauaucaucuacuuccuccuggaauucucaccaggcacuguggagccauaccauagguauugaguagaaaggauuuaaaaugcacuaucccaagucacuuuuagucuuuugaggcacagguauugaguggccagccuucauaugagaguccugugagggaggcuuccuaccguugaggucacuaucuuuccagccuagcaaagaaggggaaauucacauuuauucugaguaauauagagaaauuaagaucucaauuuauuuuaaaccaaaaaaaaaucagagaugccuuagacucaaggauuccuacuaguuaacuauuuuucuucagcacccaaccucaucuuggggcuucugugagcacagugaauggaacuggccuguacugcaucaagacuuaaacuagaagcccuguucccagguggaggauuacaauauacacacacccacacuaacacacacacacacucauacacacaagcacacacucguacucauacucucacacacacacacacucucucucuuacacacacacuaaugcucagugugacacaggugaauggcuaaccuagaacuucaccccaagggaccacauccucauugcuccuucugggagacgcccaagucguacucugcagcccaagaaaaacagagcacguuuccuugcugcuggagagugccuggcuucgcacaugcggccagcagguucucgcuaaggucagugaggccaucuuagauuccaaauguuuuauaacuacuaaaaacgcuucauaaacuuuucauuuggccuuuguagguuaagcaagaaguuuaagucacucuuggcucagaaaaucaaagccaagaaagauccaaggcuccgcacgcugucuccccacaacuaggaagcagcccacccguucgagugacagagccaagaaggaaaauuugaaaggucaccgucucaaaaucagaagacauuaauucucacacauggguucacaacacuaucagacuaagaaucuaagaaaacauguaaguuccaggccaacaguagccggggacagggaaccaguguucuuuccacuggugagcaguccacaggacacacuuaacaagagcauacugugugcuaggagcaggaggugccaacacuuuacaugaacucacugucaugcuuacaacuuuucuguacaauagaugaagaaaauguccagcuacugaaggcuaaagagucacuugccuaaagucacaaucucaauuuggaaacguagcuucagaggcuccacucugaaugacaaaguuauauugcuaccacaguuuaauccuuaaaccacacacacgcacacacacacagacacacacacacacacacacagacacacacaggggaggucagggguauaaaaaaggcccaccaaacaacucuucaaagcuuuucuuuuguuguuuuuguuuguuuguuuucgagacaggguuucucuguguagcccuggcuguccuggaacucacucuguagaccagacuggccucaaacucagaaauccaccugccucugccucccaagugcugggauuaaaggcaugcgccaccaccgccgcuuuuccuauacugucaaugauuaaguucuaccucagcagaaaaaaacaaacaaacaaacaaacaaacaaaccuccacuacaaccacucugugggagcuucaagccacacacacacccucaaguccagagagugacugugaaaccucauuaaacuguuccaccaguaccuauaaccuccagaacaguucugucaccuccaaagauccugcuuguucugacagguaugaagagccacauacaugguggcaaccagagaacccggaaucacuguuugcacagaauccuuccuuccuuuuuuguuuuuuguuuguuuauuuguuuguuuguugucuguuccccucuccccacccucacacacccuguguggcccuggcuguccuggaacuuggcucuguggaccaggcuggccucgaacucgagagauucaccugccucacugcuggcauuagaggugugcccaccaugccucguuuuuauuucuguuuguuuguuucugguuguuguuguuuuuaaaugagaaaagcaaucuugauaacaaggaaugggacuacagcugaaugcugggaacagguaaacugugaggccaaagcugcaaaggugguggugaaugucaggccgagugcaguggacagcgagugggaaaaggcggaugugaagacagcaguccaagcuuaagacacacuucuaaaagcuuguggacucagggcccccuugggugcccucaagaguggggcuccuggaaccauacaaaugugccaccacauccagcacucuucauggaugcugaagauuaugcucagacgcucaugagugcauagcaagcucacugccggcugagccaucuccccauccucaggacuccccuuuaaccaucagagucaccaagagagcuuuucugugagcuacugcugagcagcuaaguccugacuuaggguuuaacuuacacauuuccaucuugguaggaaccaccgugcuuuaaauuuugagcuucuacuguuucccaggccagagauauauaggcuacuuguggguugcuggguggcagcagcaagccguagcucccagucagcuaaaugaucagaaggguaaacgagacacuccacagucacuuggcugcugagcuacguguucuuagguaaguuagguguuguuaucaggaaguuucaacuuacacuauuuacaauauacaaagaauuuaccagccuauauuguggguagagaaauauuuguauuacaaaauaaaacggaaacuuggaaaacuuaaaaaauuuuuaaauugcuuaaaacaaaaacaaacaaacaaaaaaaaccaauauugggcuggagagauggcucagcgguuaagagcacugacugcucuuccgaagguccugaguucaaaucucagcaaccacaugguggcucacaaccaucuguaaugagaucugacgcccucuucugacaugucugaagacagcuacaguguucuuacauauaauaaauaaaucuuugggcuggagugagcagagguccugaauucaauucccagcgaccacaugauggcucacaaccaucuguacagcuacaguauacucauauacauaaaauaaauaaaauaaaccuuagaaacaaaacaauauaacaugaacauucugaaaauaguuacuuucuaaaguaaaauaaaguuuuauggugauuugcuaaucucuuaacuucuaauuuaucagacagauuaccauauauguuauauauuauaauguaugguccuaaguauuucaaaauacuuccggguagagucuaucaaagaaaucauacauaguggaauucuaagucguuucaggcaacuguagaaauucuuugaucaaagcucugacaagcaguagauuuaaaaggcccagugagcuggcucagccaguaagagugaggcuaacaagccugacagccuggguuugauucccagagaugccaugguggaagcagagaacacauuccugcaaaacuuccacauacaguaacagaaaagugauauccugaagacuugucuuuacaucuccaagugaguguguggcaugcauguguacacacauacagaaaauaaauauaaauauaugaagauauuuuucaaguaauuucaaaggcauagagacagcucggugguauaugcuugccuagcaugcagaaagcuuggaguucaagcccagccccucuggagguggaagcugcaaggucaaggucauccuccacuacaugcugucuuugaagacagcuugggagaccagaaacccuggcucugaggccacaaaguaggaccuaccucaaaaagaaacagaaaaguuauuucuaccucagaaaccacagcacugaacuuuuuauaaucaguuacauaaacccaggaauguauuuuaggacucugaaaaaaaaaaaaucuuuaccaaugccugugcucaucacaguguguccuggucauuuggagcuucaugaaucauaauauacuuuaaaaaaaaaaaaaaaaccuucaugauugcuaauaucaccacuuaucuuauagagaaauucuugaagcccugugaaucugucaagcucagacuuaagagaaaccaguuugaauuuuacuuuggggcacaacuauuucugguaacaccccccuucaaaaugcacgccacuguuaagagcgauccuuuaacaccuccaaacgacaccucaguaagucuucaacugcccaggcuuuacaaugaaaacgugugacauggacugcacuccauuuuuccauacauguccaagaggaaaaccguuuaacuagaugaucuucaaacucuuuccagugacacuggacucaguaugacucaaauuuuccacgcaacuaaucaguguauauguacuucuggaaaaguagaaaagaaaaaaguccaaacuaacuuaaauaaauuaauucaacuauugggaaaauaucccaaaguuaaaaaaaaaaaaaaaccaaaaacccuaucaaacaaacacauaaaaccaaaaaaacaagucaaaaccaacaacaaaggacaugaaggucacacaagcuguacaggaaggcucuccaugaucaaugcguccugaaguuaacuacauucagucuuacuacagaggaauacuauguacugcaguuccaggcuaacguggcagagggagggguuugcagugugugcuuuuuuuuuucccccaaaauuagauguauuguuccaaaggaaggaguuaggucacaacaaaacaacaaaggagucacacauacauuuauguggggaguggaagguggauggagacugaauguacagaacauacaauuaaaaaaagaaaaaauaaagcccauagugaaaaucaaaaugaaagccuauuaacugagucgggcucaaacuggagcaaaguggcagaauuccucgaagcugcagcaccucagcuccaaugaauuauccuuaagacaggauuccacccuccuuagcuagacaaacgauugcaucaggcgccagagcaggcgcaacccgaccgguguuuacagcuaguaggucauggaugccgggcccuacuguaagcucuggcucucacuggguguggguaucauuccaaauacuuuucuccuuucccucuuaagucugaucaccaccacucagugcuacaguaaaaaaaggagaucugcauuaaauccccagauucuccagcuaagaaaccucccuucccuuccgcaaaaugacauuuucagguguuccacccuaagaauggaugacuucacugaguggcucggucaguccaucuacaauuuccagcuugauccgaaagcucgcugguuccagacacucucuucagaaggcagaaagaugacaggagagggaucaugaauucgcaucaguauuggagggggguggggggucgacaccuccccauagccacguuucgaccgugagccaguccucaggcuaaacacugaagcaaggaagauaaagagaagggaacgcuucccaaagcauccccaagacuaaagaaaagaagcgcgcagcaucagcuugccgcugagccgagccaucggggcgcucaaagagggaggcgaagccuacggcuggauucgggguacgcagagagggcacgaggcccaaggaucacggaugccgacgcagcgcggggacaggggaaggacggacaggagcggggugcggcgcgcggcugcgggcgagggucgguaccugcuggcgcacggcuagccgcaguggggccagcagcuccuccgcgcuguccaugcugcuccgggaggcggcgggcugcgcgggagcgcugaggagccgcugagacgcggacgcugcgaccacucggggcggcgacaggagcggcagcgcggcgcggguggcucugagcagcgaggggagcagacagggcaugagcacgccgccuaggcggugcgcagggcggcuacggaagcggcgcgcggcccgcccggugcaugaugaaauagcgcagcca

SEQ ID NO: 3017 - RNA, 2908 nt, Mus musculus
gggaacuaaacuuggauccucuagaggagcagcaagaacauguaagcacugaucuaucucuccagacccagguuuuaauuuccaauacagcaacuaucaauagauacaguccccauaaacaagagcuacagcgauccucaauguuaaaggcacaaagagacccugagccugagagguccgagagccaccacugagccugaacucugagcuagauaggcuuccgucugccaugucuccacguccccacgaccccacgaccccacguccccagcacggagaggaacaaccugcuccccacugaggccacucuauaguacaaucuucacaccggcuuccaaccagagugcaggagggcuucccacagcccucaggggacugacucuacaccacuccaccccacacaggccugugagcaaacaccacgggccacacacaaaugugacagcccucagaggccucagacuaaaccuaagacuaacaaaguuccugugauaugucaccacagcacucuccuggcguuaacuacucaagguacccagagggaucugacagaaggaaagacacugaugcugaccagggauguuggccacagcaaggcauuaugggguggcaccagagucugaggucacauauuugcuacccugggacugggacuuagguagucuucuucuacauuagagccuaugcuuccucccaacuucucuaaccuuccuagccacuuuccucuggacaggguccaguuuaugaauuuccuucuuugacaagaugccuuggguagggcaugacaccaagggguggcauggcagggagaggauccucccucuuuguccuaacgcgacaagggugagaagauuagugccagcaucaacacacccaugcagacacagaaacacagcuaaaugagaggagguagcauuccaccacaacggggguaggucugucugcccaggccacucauguuucugguauuuccccauuuguuguuccccuccuuucacacugucuguccucucaucugcuguacccucguaccuaaggagaccaaauccugaccccuccuuaaaggaaaccaccaaacaauuagugaaauuuuuacaauuugucugaaagaaaaaaaaagaaaagaaagcgaauaaaugauagcuuuagcgaccaggguuccuacuccccuuuaaccacugugguaagugauacuauucucuagacucggggaagaccccuucucuagaacugcaaagacagagccaagaaugugugucuucacucgaagugagaggagaggaaaucaaagcauucauuucacuaacucagguagauaagcugagggcaaggagguaacgaagcccgcugaggauccacagagccaagagaaagcaggcagacauccucccuguccccacauguaccccauucucagccagcagugcccaacacacaucucucacugcccaggcuacagagaacagaaaggggcagccccacccaccugaggggagcuggcgacaggcccagccaucaugccucggacaaucaggccagacuuaggccugguccucuccauugucuucuucacaucuauaccgggcucugaugagugaagcugguccaccuucucccacgcaggaaccaacgggaggcugucacccagguccacgugugcagccuuacuuuugugugaggguuuuuuggaugauacgaaauuaccaaguauguccccauccagacugucaugccugcagaaauguaacacuuccauuuaaacagagccuccaaauaauaaagcccaaaguuacccaccaugcaugaacacauaacuggaaaugagcccaguugggagagguauggaacggaagcagcacaaaggcagcugaguacaagcaaagucagaugacagucuacaggaugcucagucccaauggcugaaggcuaaagaacgccuugugucuggcacacucaaacgauaaaggagggcgcccgcggugcagugcugggcauggggagcacaccugaggcaaaccacauguccggguguccaguaaagcugcgccaguguguauacacauaguugugugcaugcaagggagaaggggggaggaaacaaaagaaaaaagagaggaacaguauaaagaagcaagaaguccucuauuuaggugagcuuccuaaguggccagccaugucucgauggggcugaaucuccccugccaaccacuggccgucagaaccucuuuaaaggugacaauaaacaugagccucacccuuucuaugagaaguacguggccacgacauugcugcugaugcucuggguuaugucauccgaaucagugggaaugacaaacaagguuuuccugugaaguaagguguccugacccacagcagacugugucugcuguccagaaagggcauucuuguuauggaucagggaaaggagagaggaagugcaagucugauuagggaugcaagcugaugccaaccugagcucucaacuuaguuacuggaaggagagacaaagacagacagacagacagacagacagaccagacagggagagagggagagagggagggagacagagacagagacauguugauaggcagaggggggcauauuucuggacugacugacugacagcuauuacuaugccucagugacuggggucccaaagagcagaaucuuaaagcaucucaaccucuacagaugcugaugucccccagugcgcugucacaaagcccuuaaaguacgaagcucaggaccacagcacccagaagucaacacuccacacggccaggaacacagaugccagcgcauugcucugaagaaacaacguacuaaggaaaaugaagagaggcugaaaaauaugcuaaacuugugcccaagagaauaaaggaagccagagaaaaagaccaaaaac

SEQ ID NO: 3018 - RNA, 12526 nt, Mus musculus
ugagacacauaacagauagcauuuauuuacagccaaauccagacauguggcacacuccacgcauacaagacagaaaagcgauuugcaucucugccugugagaggaggggaggaggagggguuugggacaaaagagagugcuuuuaaaaaauaaauaaaacaugagaauucauauagagacaaauggcaaugaggcagcuggagccaagggaugaggaaugcaccggaagugcaaauaauggcugcugacaagagcgccccuucggagccacauugacucaacuguggaucacucguguacaaguuuauugguuucucugggccuugggcaauagcccuagaugggaagaaagaacagaugggagcagaugcaggaacugagaaagucgaagguugauauacggggaccuggagaaagcagaugcagagaaggggaaggagaacgguagggaggaccgcauugcccguggugccaugacaguuugagcacaggguuuggggcuuggcccuugugaugauggcuggccuagcacucagaggucagcaccuucaaucucgaucggggaggugugguccacucagugcagguccgucgagcuggcagaaguucagggucguggccauaccauuugcgugaaaucucuguccucaccuccacagacaagggagaggauguuaggaagaucccacugccacuccucagcucaaucccaagagacuaaagguccagggggaagguggugugagaaaaauagggcaggcaaggagagccuggucgccaacccugugagguacaggcacuacuacucuauccuuccuuggacaguuuccagccuuugucugagaccaggcaaacacauggaugcccuuugugccucuugaccuacgaccaggugacccucucugagugacuuugauccacccuugccuuagucugagacaccaggggauacgacugucaagagaaagcugggaagguagagugggacagucuguaucuuugucuggcugggggaccgaccaaaggacugaaagacguccugccugaucgcuaaccuggcgcuguaggaaagguaaaggggaaacugacugauaacauagauaaggcugagcaagacucaaacaauggguucgguacacugagagucaguuggggacagagguaucagguaaggcaaggauggaugaacggaugggaagaaagaaagaaugaacaaaagaagaagggagggagggagggagggagggagggagggagggagggagggacuccuuaaccacagaauugguuaccacagagcuaaccacagagcccauggcagacacagggccaucaggaaaagcugugacccuaccugugcaugcugccagagagcuggagaucuggacucagccaaauuuucuccaucucugcacagcaggacuuuaaugagaagaaaagccaagggucuccugggugacugucucuucucagcugucugccuucuccuauaaucccacauguguuauggccucuauugugucugcuugcuucacuccugccuccacuucuggcaacccagucugagucccuuucuuccagaguuucucuguuuccugcucugcucuggcucuuucugucucugcaucugacucuuuucccaaauuccuucuauauggaccugugacuuucugucccuguucuuucacucucucugucccccaaccaaucuaaucugcccucuauccucccuugacccuugaaagaccucuaucucauaagcuuguuguagaacauagcccagcucauagaaggaauauguucaaaaguauucagguuaaacagaaccuacucacacaaaggaccacaagaguggaggaucaugagagucaaccaugcugggauuuacaggaccagggcaaaagaaaaggagcugaggagaaggucuacuuguugaauaaaggugagcuuuugggugcacacauaccucuugauugaggaagcaguagaggacagcaacaaugaagcccugcagggucaacaagaagaaaggacuccaucagaacacuuuggucugacuuuggaauuuggcagucuuccucuugucuucucccucacucaucagucacugcaccagacacaccaagucauguagucaucguggcaugccugccagagcuguauagauagcccacgccucacuguguaucuucauuuuuguauuugcauuagugagcacauugccugauauauaauagguacucgguaagaauugaaaagauaagaugaguaaaugaaugaaaggaugggugggcagauggguagguagaaggcaggcaggcagguaggcaggaaggacaaauggauagguggauagagauauggacggaacaauggaugaguggggagaugaaugaaagaaggaugacuauaugggcaaguggacugaaggaaggaggaacagaaggaagaaugaauauacuggugaauggauggaugauagauagauagauagauagauagauagauagauagauagauagauggauauauaaaaagaaugacagauggaagaaugugaagguggauagguagauuaacauagggauagaaggauagaugaacagaugagugaaaagaagaauguauggaugggaaguagaauaaaaagaaugggugaacagauggauggauucauucauggauggauggauggauggauggauggaugggcaaguguacugaaggaaggagaaauagaagaaaggauggauggauggauggauggauggauggauggauggauggacagagggauagaugggugaguguguagauaaaggugaguagaaugaugcaugaaugaguggagaagauggaaggaaggagaaaggaagaagaugaauaugugcaagggggauggaaagauggauaggugguugggugaauugauugauagcaauaaugcaugaauuaaugagagagaggaagaaaagaauugauggauagauaauaagugauggauagauggauagggagggagggaugguugaaggaagaaaggguaacugaauuguuuaauggacaaugaauacaggauggacaaaugaguagauggauggauacauagguggaugaaugacuaucuggggaaugugaagaugaauguaucaguacuuggaugaguagagagauaaaggguaaagauggaugacugauuaaacagauagaugaauaggccucacacugacaugaaguuagucaagaccugcagccauaguccuuggaaggaaggagugucuguaaggggcucucaccugaaaggaccccaaccccagcuccagggguacacggaugucaaggccagcacugucaggcaggaaguugaagaugauguaaugaauuccaaacagcgguauaaggagaaguguugacuuggaaagccgccuuggggaagacaaauucuagacucugaagcuguccaucaucauccauccuggagacucuguccuccacacagaccucugggcuucuugacuuuuaagggccaucacacuauguggcccugcaguuaucccggcuacuccagagucuauguacaucuuucaaaguuuaauucuuccaggaacccuucucuaauugccccuuuuucucauuuagacauaaucuccuucuccgggccccauagaaauagaugcagcccuugucagccauuuaccaugguaacuggcagcuuugugugccacuucccuguacuguaaucucaugggaggcagggcccagaucuguucucucucuagggacauggggaagaggacaggaccaggguaagggauagcugccaaacgagacaaaaacaaaugacauucccuccaagugcuuuccaugaugguucuccagauacauaccacacacacacacacacacacacacacacacacacacauacacacacacacacacacacacacacacacgacacauccacaugugcaugcacacacacaugaaugguaccaguacugagcccguguguguaggccgccuugugcaggcuccagcuuccucagcaggauacaaauuauauugagaaacagcccaaaguucaccuggaaaugaggcacaggaaaguggguggaaaguucaaagacagcacuagguggcuggccuaggauuggccccauccccuuugaugacuaugaaucccaaaccugugaggugcagggagagaaagacugaggacccccucccccuccagcccuggcaaaaacagaugagagagccaggucuggccaccugccuccagccaccucucgggaucucucagguacaaagcagcugucugucacugugcaguuucucugcuggggagagauuacacacccacaggagccaugccacaucgggaauaggagcagcugagugcccaccuguaggugccauucacuaccacuuagcaccccagcaagacauguucugcaagccagacacauggaaacuagaaaacaggucuaggugcaaauguaaucaacuagugucagagaaaguagacacugguuucccgugggguaaucauguagccaccccuccaggaccauauuaagaaaccuggaggcuagguuaauaaagcaaagaacacuggccucagagacugaccccaacagagaggacuauggguccuuugaugauccaccagcagggggagcuguugucuaagucccagcaccuggaaagaaaagagccuagucuugaaggugcccccuuuucuacccugauaaugcaccuccucaacacaccugcuauggcuccuggggccccucucugucuagugcucaagucuucagccccagucugucuucaucuugccugaucuucuauaccagccucuccauaggagagacccagugaaggcugguuagccuuucucauccuuguccagacauuucuuguccuuagaaaaccuacucagagcugaucucuuuaaccuagggaucccccucccccucccccuccucuccuuagauggucuaugacacaccuugcugacagcaugggggugaggaacuugcucuacucacucaguguccucaaaagccaguuugcagcccacccacguaccagugcauagcacggggagcccugugggugaaauaacacagaggugagugagagcccugcacccuuugccuugaguguagccucuaccucccagcaaucuguuagccacgugcagacuauaaugguggggccaggugaugguuugaggggaucuggucuacuucccaauguucagcacaggacuguggccugccccuucccccucccugagccucacaaugagaaaggcuucuuuaugagcucccagguccuucccaaccuccaccucuccuauggugaucaaugagcccuugaugcucaccccagccagccaggaccagccaccaaaaagcugguuuggaccugggggauguggaggccaacaggcagcucagguagacagcuucugccaacagccagcugaaguuggucaugguggccaaaugugagauggccacagagaccuugcacaggaccuaagaguggggaccugaugcuucagagcuuggacagcccccucccacccccgacuucagccccauuggaucucuuucacuccacugagacaccaaacccucagguccccuccaccuugggcuggaccacuccacuccuugggaugccauaggaggaauuggacaguauaauugugauggucagagcacagacacacagguuagguucauuguguccucugucagccaugcaaaccaucucagccuaaguauucuguaugugaaaaaaggaagaacuccaggaccucacauggcuugcgcucucucucucucucucucucucucucucucucucucucucucucucucucucucucucucucucucccucucucucccucucucucucucucuuucucucucucucucucucacacacacacacacacacauacacacuuuucuauuuccucugucauagugcacccuucccuagcugaaguucuccuuuaaagugauaaccacggacagcguugaucaguggauauaggauguguucaucaugcaugcaaccaucuggcucacuccucccucaccugccucuaugggcuacgguaccaccucugagcccaguugcccaggcucuauuuauuccccaacuguguggcugggugaccuggccaacugccccucguuaacaaaaugggauuaaagugaggccuucaaggcguuuuaagaucaaaagagauaauacauguaaaguacuuggugugcugcccggccuaagugagugcaaucagugauuaauucauuaauuaaaucagcccacuuguuggucccgguacucacuugucuauucauuuccagaacacuuucaaagaccuugaacucugaucccuucaguuuucaaucuguuccucuccucuccuuuccccaccccucuacuuuugcgacuuccaauuucuggugugauggcucuccucuuauuaaaagcuuccuccccaucucacugcuuuugggcccaugcagcuccaaggccaccuccucccugaagcucuuucauucucuuaauucucugcuuucccuacccagcaguccccaggucugagugcuuccuguccccugagugcuucuggaaggaggggccaagcuccacccagguccuugcacacucauuaaaggcaaugacauggcuggcuggcacaggagcugcugugaccaaguugaaauggaaacauugaugaaagaggaaugaugguguggggcgccccuagcaaagggagcugcucguauggacacugaucuaugaaugcguggggagagcuugaggcuuccuucccuugucacagcccuugucacagccucagccuguggagcaacaggucaggcacacucaggccugucuucugcccucuucccccugccccaacucccuccagucacagucuuuacaguggacaugcugcagugguccgugcuaucccccuggaagauggcggcauccuucaagaacacagcacuggccuugaggaugaagguggcaaacagcugcguguggauguaguuccuggggcaguggagccuccugaaaggggcaagagagaugaacauagaggccugacugcagaagaccuucccagggccuagaccaagacuggcauggcugggaagcugcacagaagugagccaagacagaguggccaaagccacaucaaauaaaaugagacccaaugaacuggguagaaagugagacaaaugugucaguuugaccuugaaggucagcuggccagcauuuuccuggccuaaguucagguaaggagcagggguuucuuauaucccugccuuuagacgguuuuguaacuguggguuacaagagccuaagggagccucuaaugaucagagagcuacccucugaggcauagucccaugggggaacucaaccuuugaagccuggaaagccauuacacccagcaguaagggaugagggugaacuuggugguggaggccauuuggggaacccuggguucaaucccugauacugaaaagaaaaaaaaugauaccaaaaaguacuacaauggucagaauguugcaaccauuagaaaagggccaugcaggggucaaggagaucucuuagaacuggaugagagcugggcuuccaguguuggcaggggugaacacaccaccaaggaaaagaaggcauugggagcaaacaggaggagauccgcaugaggaaagguguggccagagaacagaggccugcugugugaagagagggcccaucuguguggcuugggguggggugaggggagcaagaggucaacaaaggucaucucgccuggaucugagccccucuugacuaugcaggccaagaaccagacuugguccccagguaguagggaggcagugaugguucuugagcaaauggcaaggguggcaaaccugagggcaaccaggauggcaauagccacgcagagggcuacaauggagaugcuguggcccgugguguagaugaucuucaccguggagaaguacgauuucuggggaggggggcaauagaagcagaagaaagguuuggcaaucaagcaggagucuggcaacgccaccagcuucccaggcacugauaccacagaaagccucggacagacacugccccucagauagagaugcucagauaaggauucccaguugcaaugggagugggaggagccagcagaagcuaccuggcucuggagagcggcaaaagcacaggaggaaguugggccugauuauugacaccagcuugaguacacggucacccccauauacaggcaaccuccuggacaccaggaacagccacaggcaggcggggaaaggcucuuugggacccaaguauuugaaucaguuagagcuaggggcguaguaugaccagguacugccacuccggcuugcuguucaucucaagccaucccugugcuucucugaccugucucuucaucugaaagguaaguacaccaggguuuuugcucuuagggccgagggcagggagaaaugggauugugaguguggaugggccuugagaagacccugagcugugcacaguguaaaguaugauguccagagcuaggggucucuguaaugacuacacccuggaguuuuaccugcuugcccauaccacagcccaguauacuguaccacugguggaggaccagagaaaacaagcacauccugucuaacacagcagcaaucuuuauucccucugaaauaacuaaagcuccgccccacccccaccccacccccauccugcaccaaaaacuaggaagagaaaaggcuggccaagagguggaugacuauggcuuccagucugccucugcuucccuucucccucacccuuaaguaaauggaccagcuucaggaggcaucuccugccaucugcuggacagcuccuguaauuacuacauccacggggugauuacaguggggaugauaggcauccauugagauaguaaacuacauacagggcuuaccuccuugguuaacaguuccaagggcacagggcaagccacaggguauggugggaagggauuagaccagccagugauggugcagucccucuucacaaacccuagaggcaaagaagagucucugcuuauagaauuccucccuuucccagaagauggugggaagguucugugagguauauacacguucuuaaccacaaggacagaagaguccucuugucccauggcuuggguucuggacugguguagucugucucuguucuccaggaaagcucugcugaguggaaugauggaccucuacauccuaagggcaggaaguaugacacccacccccuucccauaagagacaggaaggacagcaggugaaguggacgaugagguguuccccacccucaucaguaugguaccaccucccuuucuccagugucaucauuaauccugcacugggagguuggugcuaucagucaucguucaagaugacuaaauuuuucaggguaacacuagaagauugaaauccaggauaguccaucaccgaaccaguaaugugcaaaccagaaggaaccacaugcugugcgucccugccuuagcuaggccacucaccugugucugagccgaagugagagaagaauucagggcaggggagagagacccacuggccagagccugucgggggccagcacagcagcccaucccaggucccagggcauccuagguggagaaggaggagacaugggguaaccuaugagggaggagauucugaauggcagugcugaaggagaugucaggaccagggacauccccaccccuucauacccagggagguguuguugguccccucugccgccugaagacaugcaagcucaucgucucucagcugagugaugaagucacauucuagguggaggugacccagugucuaugggaaauugugacagaaugagccaagcccacuggaggccuugugcgcucuaguuguagugaccugaagauggagggagaccaagccugguacauuucugugcccuaguucugagaaaggcccauuugccccacagauaucaaggaauguuugauaagcaguggggcauaaggaaggaggaguggggcauagagggcagauguucagaaaggagaggggaggaaugaaaaaagaggaaggaaggagaggagaagaaagagggggaagaagagauggagggaaggaaaggaaggagaggcagagagaguggagaauaagggaggggcacgugcaguuuuccuucucuuggcagggaauucuaagacacauuagagaaagccauaaagagcucccaucacugugacagugcagcccuugacgaggccuuuucuccuuccccaccaccccuuacucuauacacuucugggcucugaaaguguuucugcauaaacagcccugggagacagaauggaccccaaagauguccaugucgcaguccacaaagccaguaaaugugucuccugacagagccaaaggucaaggaucuccaggcaggaagaugaccucgauuaucugagugggcccagagucaucacaagagggcacagggaccaaaucagagaggacaggauggaaaggguugaaagaagcuauggugcuuccuggagaugaagaaaugucucgggccagggcaggagacuccagaaagaccaccuggguuuaacaucugaugugucucagacaagucacaugagcagauguauagacgagugagugggagagaauacgagcggaugggagaguaagaagacgggagcaucugacugcuguaaaggaacaaugaacaggaagaaggggcucgguguggagggggacaggacugacuguacgguugguggaguggaugacuguucagacagacauauagacaaugagaucgggggaagguggacguaugagggugcguggaaguaugguggaugaugagggcccugcaucggggcaacugaguugaucauuaggugggauaaaggaagcugccuucaugcaugcuugauguugauaaagauugcagauuggauaccuauuccacagccuggggaccacaagaaauggucuugaagauuuccugcacaucucugugcuuccgaugggugauucaggggcuguguggagcccacgugcuccaggcuaggcagagaucugauguuugccuaaggcuuggaguuugaccuuuucuuuaaagagcucaaauuccuaacagcucucaagauuuaaccaaaugcccuuccuugcaagauucauauacaucucgcuuucucucucuguaucuuucugucucucugucucugucucucucugucucugucucucucugucucucucugucucucucugucucccucugucucucucugucucucucucugucucugucucugucucucucucugucucugucucucucucugucucugucucucucugucucucucucucucucucacacacacacacacacacacacacacacacucgggauuuucccuaucuaccccagcuauugaaugacuccucugguguaggguucccucccugaaauggagcuuuugagauucuguguacacagaggaggacaugagucuuuuguaccauauagggaacuuauagaacuuaccugugugacacucacaugccagcugcaugacacucucaugccagcccuggacaggugagaucacuuaucauccccuccccgcggcaugguagcccuagguccgcugaccuauaauccucugcauagcucagacugacaucaaacucaugauaaucgucuaguguccacaaaggcugagccaccacaucuagcccaagucucucuuuuuuuacacagaggcaaacgaaagcucgugucacagaguucacuucacggucugaagaugccagccucuugauugaaggacagugagguacugggacggguggucaccccuggcaaggcaguagaagaagguagccuccguucccguaugcucccaccuagugacuugugacuccuccccucuuggcccuggaugcuacugacagcaacccagaaauucugcuggaaaguuggagcacauucaaggaagccuccuuucuuggcuuccccaugccccuauacacaggccagggagcaguagcugguuucugaagcuccuccaagccuggcucuaugaaaggaagaguucucaaauaucacagcuggaagagcuggcauucacgacaucuucaagccccacaugguccuaacauuagucagggaaggaaggagggagccaccagacucaggaguucccccaccacagacugccaccacccaagagaacaaaggucugaguuggcuacuuacaacuccgcacaggcucagcaagcagaggauacggguagcccacaucaggccauccauggcaauggugucugcagucagccuucccucccaggcugucucuggugaugccaccuagcugcaucucugcugccucaccuucccaguagca

SEQ ID NO: 3019 - RNA, 3660 nt, Mus musculus
ucaaaucacaguuaaccaaaaacaucuuuauuuuuuuuagucuuuaaaaaaaaaaagaagacaaaacaaaacucuucuuuucccaaaauaaccaugauuagcuuagaaaaauggauguauaucuucaaagaguuucccuuuaacggaaacuucauuuauagacucuaaauguuaaagguuugaaaacaacgucgaggaaauccauucauacuucaggcccuucuccuccgggaaccagcugcauuggagaaaaagaauuuauuaauaacacuaccacaccaccuaaaaaacccuucgugucccucguggaccaaagccagcuuugccucucccccauccuucacaucccaucuucuccaaguccaucuguuaguaaucccuacaucacuagcugacgucuaaguuauuaaugauuccggaugagcuagaagucgacaaagauuaauaagcaagcuaauccuaaggacuguacuggcuaguuuugugucaacuugacacaagcuggaguuaucacagagaaaggagcuucaguugaggaaaugccuccaugagauccaacuguggggcauuuucucaauuagugaucaagaggggagguccccuugugggugggaccaucucugggcugguagucuuggguucuauaagaaagcaggcugagcaagccaggggaagcaagccaguaaggaacaucccuccauggccucugcaucagcuccugcuuccugaccugcuugaguuccaguccugauuuccuuuggugaugaacagcaguauggaaguguaagccaaauaaacccuuuccuccccaacuugcuucuuggucaugauguuugugcaggaauagaaacccugacuaagacaaggaccaaagcacuuucaacagcugcccugaggcacagaucaccaaggcucccuucccauccucagugugucuaucucagugccaugaacauugccaacgaaauagaaguuuaagucaguuccauaaucccuacacuacaaaaguaaaauaauuuccagagaaaaguuuuaaugucuuaccauuguuauauuauuuccauuuaguagaauuugaucuaauuuuguaauucuucuuccuucugguguaauuucacuaaaaagauagauuaaauggagucuggauaaacaaguaaucaaaggcaguauuagaaacacuuucccucccuaaaaguccuacugggguaaggagaauagcuugguggcagagcacacacacaaggcccuggguucaaucccuagugacaaagcuguuauucuuacacaugauucaaugugaacgcauauaauuacaguaaauauauacagaauacaaacugcccauuggauaauacucauguaaauauaauucaccauaaagcuuguucacacuaauuucuuacaaauucaggaauaauaugaagauaauaauccuuuaacuggaccucacaaacaccaguaaauaacguuucaguauuaagguauuuuccaacaaguaauuuuuuuuauaucgaucauacuaaagcugcuauggagguuuaaaggagaauggccuccacuugguccucuguuggcaaacuggaaaugauuaggagguguggccuuuuuuggaggagguguaucacccuguuaggcuuugagauuccaaaaaccuaaauuauacccacuuagugcgcucgcguucucuauuuacuucucucucucucucucucucucucucucucucucucucuugguuauuaucuaacauauaagcucuuagcuaggacagucagggacucuaaccaucugaaacuguaagcaagcccccaguuaaacgcauucuuccauaagauaccuuugucaugcugucucuucacauuaauagaaaaaaguaaucaaggcaccaucuuuaauuaaaaagagauuuccuccccuccucucaaauuuuuuuaauuuuuuaaauacuacucacaauucugugacaucuuccaacaccauaucugaauuuaauguuaagaaaauaaauaagguuuauucagguauauguuuuuguuugguuuaaaauauguucaacacuaugauagugcaaauucaaaagguuuguuguuggcaagagcccuaucaacugucagcaaacacaccucuuaaaauacuaccaaguuccuggaaaacaaaauuauucuuaauguaauaaccagaaauucuucgguugucuauaguucuuucuuauauuaauacaucuuuagaaaccuacaccauucccgcuuuuaaaaaggauacugacaaagucaucaaauccuagaagugucccgacaauuucuuuaucacucuucaucacaaugugaauucuugacccuauacauuuguccacaagcucuguggaaggaaaaggguaauuuuaccuacuuauuagaucgaccaacauuugaaugccuacuucacuuauuauuuuuuaucauuaaagauaagcaaaaacauucaguuuuuugcuauuuauuuauuuauuuacuuacuuuuauuaaucauuccaucuguuuacaucucaaaugauauucccccuuccugguuaccccuccacaacaccccucccauaucuaccuucuccccacuccccaauugcuucuaugagggugcucccccacccacccacccacuccagcauucuccuuaugcuguggcaucaaacuccacaggaucaagagccuccccucccaaugaugucaaaaaaggccauacucuccuacauauguaucuggaaccauucgguaauuuuacaucuuacacaaaucucuguuuaaucguuagcacaaauguuugccuuagcuuucacuuaacucuuuauuugcaauuaauaggacugugauuuuuauuuagauuauuugauuaauguaugaaaacacacaccaugagguggguggagaccauaacuguuuuucuucaucaguguuuguaccgauaaacaauaucuaacacugcaaaaacuuucaaucacagacacauucacuaagcucaccagccccaaaacaugacaagggagaagcauuauuacagacaccggcuuucccgucacuccuucucucacuuaaccuuaacucucugugcuccugggccaaccuguucaucucagcaucuuagaauugcucagcacgaugcgugccggugugcgaucuugaaagcaauggcuguaauucaaguucauuauucaacaguucucuggcacugcgcgggaauugcuuguugaauuaaugaacgacggggcuaguuuccagauuucuauuguaagauucauuguaugccguggcgcacuccuuacccaagccaauacagggucuaccugaucuggagaccaagaaggccaagcugagaacugggacugcgcgacucaugacaucuuacuggcgagcucaaaaaggccgagcacguccuucacuaagugggacccucaccgaccaccgacaggcaaaacggucugucugucugcccagugacgccaaggaccggacagccgggcccggaggggcgguggcccagccucggcccccagcguggaauugcagcaacccgaccgcuccccaaacaagacuuuuaccuaguggcaggaguugggacggguucguggucgcguuagccgccauggccacgccggaaguggcuaaggacaccggcgcagacuuuaaa

SEQ ID NO: 3020 - RNA, 3660 nt, Mus musculus
uuuaaagucugcgccgguguccuuagccacuuccggcguggccauggcggcuaacgcgaccacgaacccgucccaacuccugccacuagguaaaagucuuguuuggggagcggucggguugcugcaauuccacgcugggggccgaggcugggccaccgccccuccgggcccggcuguccgguccuuggcgucacugggcagacagacagaccguuuugccugucgguggucggugagggucccacuuagugaaggacgugcucggccuuuuugagcucgccaguaagaugucaugagucgcgcagucccaguucucagcuuggccuucuuggucuccagaucagguagacccuguauuggcuuggguaaggagugcgccacggcauacaaugaaucuuacaauagaaaucuggaaacuagccccgucguucauuaauucaacaagcaauucccgcgcagugccagagaacuguugaauaaugaacuugaauuacagccauugcuuucaagaucgcacaccggcacgcaucgugcugagcaauucuaagaugcugagaugaacagguuggcccaggagcacagagaguuaagguuaagugagagaaggagugacgggaaagccggugucuguaauaaugcuucucccuugucauguuuuggggcuggugagcuuagugaaugugucugugauugaaaguuuuugcaguguuagauauuguuuaucgguacaaacacugaugaagaaaaacaguuauggucuccacccaccucaugguguguguuuucauacauuaaucaaauaaucuaaauaaaaaucacaguccuauuaauugcaaauaaagaguuaagugaaagcuaaggcaaacauuugugcuaacgauuaaacagagauuuguguaagauguaaaauuaccgaaugguuccagauacauauguaggagaguauggccuuuuuugacaucauugggaggggaggcucuugauccuguggaguuugaugccacagcauaaggagaaugcuggagugggugggugggugggggagcacccucauagaagcaauuggggaguggggagaagguagauaugggagggguguuguggagggguaaccaggaagggggaauaucauuugagauguaaacagauggaaugauuaauaaaaguaaguaaauaaauaaauaaauagcaaaaaacugaauguuuuugcuuaucuuuaaugauaaaaaauaauaagugaaguaggcauucaaauguuggucgaucuaauaaguagguaaaauuacccuuuuccuuccacagagcuuguggacaaauguauagggucaagaauucacauugugaugaagagugauaaagaaauugucgggacacuucuaggauuugaugacuuugucaguauccuuuuuaaaagcgggaaugguguagguuucuaaagauguauuaauauaagaaagaacuauagacaaccgaagaauuucugguuauuacauuaagaauaauuuuguuuuccaggaacuugguaguauuuuaagagguguguuugcugacaguugauagggcucuugccaacaacaaaccuuuugaauuugcacuaucauaguguugaacauauuuuaaaccaaacaaaaacauauaccugaauaaaccuuauuuauuuucuuaacauuaaauucagauaugguguuggaagaugucacagaauugugaguaguauuuaaaaaauuaaaaaaauuugagaggaggggaggaaaucucuuuuuaauuaaagauggugccuugauuacuuuuuucuauuaaugugaagagacagcaugacaaagguaucuuauggaagaaugcguuuaacugggggcuugcuuacaguuucagaugguuagagucccugacuguccuagcuaagagcuuauauguuagauaauaaccaagagagagagagagagagagagagagagagagagagagaaguaaauagagaacgcgagcgcacuaaguggguauaauuuagguuuuuggaaucucaaagccuaacagggugauacaccuccuccaaaaaaggccacaccuccuaaucauuuccaguuugccaacagaggaccaaguggaggccauucuccuuuaaaccuccauagcagcuuuaguaugaucgauauaaaaaaaauuacuuguuggaaaauaccuuaauacugaaacguuauuuacugguguuugugagguccaguuaaaggauuauuaucuucauauuauuccugaauuuguaagaaauuagugugaacaagcuuuauggugaauuauauuuacaugaguauuauccaaugggcaguuuguauucuguauauauuuacuguaauuauaugcguucacauugaaucauguguaagaauaacagcuuugucacuagggauugaacccagggccuugugugugugcucugccaccaagcuauucuccuuaccccaguaggacuuuuagggagggaaaguguuucuaauacugccuuugauuacuuguuuauccagacuccauuuaaucuaucuuuuuagugaaauuacaccagaaggaagaagaauuacaaaauuagaucaaauucuacuaaauggaaauaauauaacaaugguaagacauuaaaacuuuucucuggaaauuauuuuacuuuuguaguguagggauuauggaacugacuuaaacuucuauuucguuggcaauguucauggcacugagauagacacacugaggaugggaagggagccuuggugaucugugccucagggcagcuguugaaagugcuuugguccuugucuuagucaggguuucuauuccugcacaaacaucaugaccaagaagcaaguuggggaggaaaggguuuauuuggcuuacacuuccauacugcuguucaucaccaaaggaaaucaggacuggaacucaagcaggucaggaagcaggagcugaugcagaggccauggagggauguuccuuacuggcuugcuuccccuggcuugcucagccugcuuucuuauagaacccaagacuaccagcccagagauggucccacccacaaggggaccuccccucuugaucacuaauugagaaaaugccccacaguuggaucucauggaggcauuuccucaacugaagcuccuuucucugugauaacuccagcuugugucaaguugacacaaaacuagccaguacaguccuuaggauuagcuugcuuauuaaucuuugucgacuucuagcucauccggaaucauuaauaacuuagacgucagcuagugauguagggauuacuaacagauggacuuggagaagaugggaugugaaggaugggggagaggcaaagcuggcuuugguccacgagggacacgaaggguuuuuuagguggugugguaguguuauuaauaaauucuuuuucuccaaugcagcugguucccggaggagaagggccugaaguaugaauggauuuccucgacguuguuuucaaaccuuuaacauuuagagucuauaaaugaaguuuccguuaaagggaaacucuuugaagauauacauccauuuuucuaagcuaaucaugguuauuuugggaaaagaagaguuuuguuuugucuucuuuuuuuuuuuaaagacuaaaaaaaauaaagauguuuuugguuaacugugauuuga

SEQ ID NO: 3021 - RNA, 1235 nt, Mus musculus
ggaggaguaacgauauuucaugaaggaaaaauagauuuuagaaggaagugauuugacaaagaucguagggagaaaggagcagguuuaagagucagccaaaucaacccccugugcacaccacuucaccacugcacagggucugugucugucugcccuaccuugcccugccccgccccguccagcuccgccccgccccaccggucguguaggccgcgccuucagcuggggguccucuuccuucaggccagcucucgagcaggccccgccucuccuguuauacagccccuccccucuccgccuccuuuuccuuuagacccgcccccugaucaggcuccgcccaugccgccucagacccagccgggacaggggccucaggguaccgccccgcgcugccggaggcggcuguagcgucaggugacagcccggaagcugcggaagcggaugaagcagagagguggaggcccgguggggcuccgcggaggugagggagcuggucggcggccccggagcucguggcgcagcgcguaugcggcgcucaggcugacauccgaaggcugccgcucugggucgugcggccgggccucggcguuuggagucgcggcgggggccuccggcgagcguccauggagaagucugggcgugagagugacggcgcccccugcgggccuguccugcacaucgugguggucggcuuucaccacaagaagggcugccaggugaggaccggcccgcgccuucucggcgccccgcggccuuccucgcggugugccuccggggacugcgcgacgagccgcggggguucggguuuagcggaagaaugacgggcgagccuuguguucccugucagucuccaccaaccugcugggugucuacccauaaaggagcucuugaggaaaacucgguguuuggacgccggcacguuacgagcuguggguuuccacacgaaugcucaaguagacugacgcacuuguaagcuccgcucggcuuccuuuguuuaucucuugcgagccuuggaaucuguaguuugggguuagcgaccggccccgcccccuucucuuugugccauuucagauuugauccggcccagagcuauucuuuugguuagguuagcccuccaaaucgcuugcaguaaguaaaaauguaauuugucaaacagauagugcaaauggagccagcuucuuaaaugacucuucacccuaccgucugaaccgagcguuugcuuuguguugaaggca

SEQ ID NO: 3022 - RNA, 47081 nt, Mus musculus
caugccgccucagacccagccgggacaggggccucaggguaccgccccgcgcugccggaggcggcuguagcgucaggugacagcccggaagcugcggaagcggaugaagcagagagguggaggcccgguggggcuccgcggaggugagggagcuggucggcggccccggagcucguggcgcagcgcguaugcggcgcucaggcugacauccgaaggcugccgcucugggucgugcggccgggccucggcguuuggagucgcggcgggggccuccggcgagcguccauggagaagucugggcgugagagugacggcgcccccugcgggccuguccugcacaucgugguggucggcuuucaccacaagaagggcugccaggugaggaccggcccgcgccuucucggcgccccgcggccuuccucgcggugugccuccggggacugcgcgacgagccgcggggguucggguuuagcggaagaaugacgggcgagccuuguguucccugucagucuccaccaaccugcugggugucuacccauaaaggagcucuugaggaaaacucgguguuuggacgccggcacguuacgagcuguggguuuccacacgaaugcucaaguagacugacgcacuuguaagcuccgcucggcuuccuuuguuuaucucuugcgagccuuggaaucuguaguuugggguuagcgaccggccccgcccccuucucuuugugccauuucagauuugauccggcccagagcuauucuuuugguuagguuagcccuccaaaucgcuugcaguaaguaaaaauguaauuugucaaacagauagugcaaauggagccagcuucuuaaaugacucuucacccuaccgucugaaccgagcguuugcuuuguguugaaggcaaaggagcaaaauagaauagguuuguuuagccuaaacaaacacuggaagccaaugaugucauaaugugcuagugaauauauauauugaauacuuaagguguugaaaaaaacggauugcuucuagcagaaaacgaagcacuugguuucuuuucuuucacagagaauguaacauuagauuuauuuacagaaguucaguuaguuagaagauaacaaaaguagugaagggaguggagaagugauagcugcgagugugugugucaguguacaggugugugucgacuguuaccuucaaucuaggugugguggcacauggcauacauccagcaaaugggaggcuuggggcaagagaauuaucuuaaauuagacaggguacuuagacccugccucaaaaaaauagacuauuauuuuaagauguuauauucgcuuauccucagaaagauauggaauaacacuaaagagagaguaacacuauuguguaugauauuaagaaguuuuuuuaguacuuccugauuacagccuuugaacuaacuaguugcuuuauaagcuaggaguaaaguaacaaaaugacaaaaaucauacuaaaaaaaaaaaaagauugcugagauuauacuguuaugaaaaacagccccggagucagucagaaguuguaacuuugcauccugugccauggguguucuugugugugguaguauagucaucguggaagcuugauucagaacuacacugaauggagggagcucugggaaggaaacuggaaaacaucagaguugauaggagauaggguagucuucggauucuugcugucauuugaaagucaagauuauuauguuucugccucucuuacugguuuuauuaauaguauagcuuucaauaagggaaacaguauauaguguugcauaaagauuagagaacagagacuguuuaaaaacaaagauacaagagcagccugcaugcuaucucauuuuuuugccuuugccuuuugguuucagcaugcagguacaagugucugcuuuuguaaacuaaguucugugccagaagcaggaggccuguauuagguuacucuuaagaccagcaaauccaaagcuuccuaauuugcccuucuuaauuucuuuugucagauaauguauaauuacagugaagcaaacaaguccuaguugaguuuuuccccaauugaugccuaaaguagcuugauuaaucauugaucuuuuuaaaauuauaccuacuuaggguauugaaguaacaaagcacuaagaaccuaauccuaggcuggggaauguagguagcucagugguagagugcuugccuaauaaguacagaagguagaucuuugaguucaaggccagccugguccacagacugaguucuaggacaauaagggguauacaauagagagauccuaucuuuuuuuuuuuuuuuuuuuuuuuuugguuuugguuucucgagacaggguuucucuguauugcccuggcuguccuggaacucacuuuguagaccaggcugaccucgaacucagaaauccgccugccccugccucccgagugcugggacuaaaggcgugcgccaccacgcccagcagaaagauccuaucuuaaaacaaagauuuaucugcugucaugcucugcucauuuuuuuuggucaugcaugaauacuuaguuacauauuuuuacaccucuuccaaucccucuugugucccucccucuccucaaauuuuucauuucaucuuuguuacacacaugcaagcaugugugcauacacacauauacauuuaaccuacugaguauuuaguguugcuaauauuuaauguugcugguguguauguguuuaggguugacuacuuggaauagauaaccuaucagagacuugucccuggagaaggcugagucucuauaucucagcucaaugaguugccuagagcucuucaucuagguuuggggcccuugugagauuuccccuaucugcuuugccauagcuacugacuucauuguguaggucuuguuuagaaaaccauauugcugagaguucauguguacagcuuuccuguuauaucuagaaaauauuaucucacagauaauaucuuguccucugacuccuagaaucuuuccacccccacuucuaccauguucucugagcauuagguguaggaauuguguuauagauguaucaucuacuuggguuggguaccucauggucaguuguccucugcauuuugaacaguuguagauuucuuuuuggguuuuuuuuuuuuuuuuuuuugguuuuucgagacaggguuucucuguauagcccuggcuguccuggaacucacucuguagaccaggcuggccucgaacucagaaauccaccugccucugccucccgagugcugggugggauuaagggcgugcgccaccacgcccggcuauaguuuuaaauuuuuaaauguucaauagaaaacaauuauuuuccaaaccuuaaaauaauaauaacaauaauaauaauaauaauaauaauaauaauaauaauauuuauuguguguaugaugugcuuagaauggguuauggcccauguguagaagucagaagucaguuuugugguguugcuucucuccuucaacauuuacaugaacuagggucuuuauguuuacauuguuagguugcaggcaccuuuacccacuaggccaucucagcacucuaaauuuuugcuuuuggccucuuuucugauaaaguccugguuuguauacauagcuagcucuaauucuugaauaaacuguuucuuuguuuuuguuuucuuguuuuuuuuaccaaacuauuucuuuucuuucuuuauugugcauugacaguaucauacacguauguaaagucuuugggucauuuucaucucucauuacucuuuuucaugcccuccacuccugcugaacccuuucuacucaacaagucuucuauuuucaugguuuugguuuguuuugguuuguuuugguuguuauuguuguugugugacccacugcacaaacauggauggggaaauuagucacuggaacuuuggcaccuuaaugacuacaccacuaaggaaaaugaucuguucccauccccuagcaacuauacuaauaguuccucagaggugugugggaccuuaugacucuccccacgacucucuuguuuuuguuuuuuggggacagaguuucucuguguagcccuugguauccuggaacucagucuguaaaccaagcuagccuggaucucaaaucuaaacucuuauuucuuuuccuuuuuuuccuccaagauuuauuuauuuguuuguuuguuuuguguguaugugugugccugaguguauauguucaccauauguaugcaggugccuguggaauccagaagaggguguuauauuuccuggaauuguaguuacaggcagugugagcuucucaaaguacauguuaggaauugaaacugaacucucugcaagagcaacaaauacucuaaucucugagcucucucuccagccccacucuauauuucccggaaagaaaaagcagaauuauaagacaguuggaacuuuaccagggaaacuggguuuuccuaacaauuuagaaacugacacagaaagaaguuuaagggucacuugauaaaacaaaacaaacaaaaacaaaaccaagagccagauggugguagugacaccuuuagucccagcacucaggagacagagguagauuuaacucugaauucuaggacagccuggucuacagagcaguuucagcaagacuacguagagaaaccuggucucaaaaauuaaaaaaacaaaucaaaccaaaacacacacacacacacacacacacacaccagaaucaacaaguuaaaauuuggcaucugccaggauggagagauggagaagagaaagaaaagaagucaucacuuguuuuuuaacuacauuuuaauuuuauuuuguaugggcauggaaguuuuacuuuuacuaugaagagucacaaccaauuaauggaugcuuagaaagacugagucuucuccagggauaagccccugauggguuaaucauuucaagugcucagcccaaaacacgcgcacacucaugcgcgcacgcaugcacuagcagcaguaaaucgacucagcagguuauauuuauaugaacauuuguguguaugugucuguguguauaacaguaauaaagacaaaauccugagagggaaggacauggaguuggaguggagagagaaggugggaugugggaagccgugcacaaucgccauuacaagauggcacuggcuuccucagugccuaacuaguaaacaagcaaugugcgcaggugcuggaguaaauucgugccaagucacugcccaucccgggguguaauaguggggugaugggugagcagcuaaucaggagcugacaugucacacagagggguauuuaagcagcuccauuuuccggguucggggucuuucugagaaguaagcaauaaagcuuugccguagaaggauccaguuguccgaguguguuuugcuggcgaaauguuacaaggacauucuguaaauacaauacucaugcaugacauuaaaagaacaaaagagcugggcaugguggcauguaacuuuaauuucagcauuuaggaggcugaggcaagcagagcucugauuccaaggccagucugaucuacauaguaaguuccagccagccaagacuacauaggagaugcugucucaaaaauaaaucauagguuuuuuuuuuuuuuaaauagcaaucugacaguuauaccuuauauacuagaacaaauaaaaaucugggaucuauaacuagcaaacuuacuguagaaauauauacauaaaucauuucauaucaaaaagucuaauuucaggcaaauuuuaaaggaaacaaauuggaaauaguucucuccuugcacugugggaguucuggaaaggaaacuccagacaugaugacuuuaacccucugagcuauuucauaggcccugaaaaucaugccuuucaaauuagaguccaauaaaccaggaggguucagcccuggaagucaguaaacagcuauaaauggagguggaggagucuucauagaaaguaaaaaagcaugagcauguguccuuaguguuuuggauucuauccaaggaaaaaauagaaagauagaaaaggaaauguuggcagacuuaguacuacugcuuaauggaaaagcuauaagcagcuuuucgggaguggggcuucugggagaugaguacaugaucucauucagaggaucauuuuccccaucuccauaaugccuucaggagaagcagcuuuccuaaggagaaguaauugacagagaaggcacacaguggggguuagaagaccaguuggggagacacuuaucuccuuccacuacaacgacugcagggauugaauuuuacguuuuuaggagugacugcaaggaccauuacccacuaugcuauuuuacuggcccaggauuaauucuuagagaauaguauguuauguucuaaucuuuggagcauaucagaaugucaugcuuccuccuaggacaaaaggcaugauuaagauuccuuuuuuuuugacccagacacaguagcuuucccuuaaugggccucaacauaguguuuaccuuuucauguauuauuuuaaacucuaaguggcagcugugauguuuccuguuagguaccuaaauaagaauuaacaagguuggaggcuacugaggauggaucccugccucuugcucagcuuuggcccccagauucuguuucuuugguaacuacuagaaaaaggcacccacaugguguucuuacguagaugaaggcaaaacaccuauuuacauaaaauaaagaaaaaaaucacuccuuguuauuuagagcauuguuauuacuuccacuuuuuauaagucagccauugucuucuuuccuccuguuaccacuucauaauaaauauguaaaauaauuagaaucaggguagaucugcccacaugaauugguucuuuaaagagagauacuugaaauuuucuugguuuuagcuuuauccuuuugggggacauaaugcugcaccgugguuuuugauccuuaaauuuuacuuagguuuuagagcgugaucuacuuaguaguagguaauaaucaggauaaguguuucuuauucucuggaagcuuauugcgcguuugagccgagauucuuaccuaaucuucagaccuauuaugaacuacccagaguuaacauuaaaccccaucauuuaagggcuuggauccuuaagacuuauuacaaagccaguuauaggugccaaggucccaggccaccugaacuacuguucaauuuaaccccaaauucaaagguucccacaacccucagcucaaggauagccaaaugaagagagugcucuauaaagcaggauaugaaggagaaaucuggagcauccauuccuucccuucaucuucauguauuuaguaacucaggagcucucugaacuccacuguuaagggauuuaaauuucauuacaugggcgugauuaauuaacacauuggcuauuugcugauugaauucaaucuccagacucucuccuagggucaaaggacaagcuugaaaguuccaucuuccuacucaaggcauggauuuuuuggugacuauccuuuauucuaaagauagcuuaaguauaaguuagcguuuauugggacugauuacaaauaauuuaugacucaggaaguuucaaggguuuuagcaucuuuguugaaggaaucaauaguauuuuuauuaugcccauuugaauaacaacuaguuuauaaagcaguuaaaaaccuccuaauauaacaagaggauugaugaaacaaauaaguaguaguacuguguagcuauuaaaauugugaguguugggcuggcgagauggcucaguggguaagagcacugacugcucuuccaaagguccugaguucaaaucccagcaaccacaugguggcucacaaccauccauaaugagaucugaugcccucuucuggugugucugaagacagcuacaguguacuuacauauaauaaauaaauaaaucuuuaaaaacauuuugaguguugggcuggagagauggcucagcgguuaagagcacugacugcucuuccgaagguccugaguucaaaucccagcaaccacaugguggcucacaaccauccauaaugagaucucaugcccuuuucuggagugucugaagacagcuacaguguacuuacauaugauaaauaaaaauaaaccuaaaaaaaaagaaagaaaaaauugugaguguucauguagaaaggagguuaacuguuuugaaaucaauuagcaaacucaucuaauuuuuaaguacaaguuccaauuguaguaauuuuaccagcaggaaacaagaauucuaaaaacugccaacauaagguaggcagucuacaauuuauggaugaauuguguuuccagaguugcuauuuaaagccuggaccacauuuucccaaagaaacuguguuacagacaccgugaacccaauucuuccugacacggucuuaauuucacuuacagaauucuugaguauguuuagcaccuaaacucuauuuaaacauacucaacucuauuuaaacuuugaguuacaacuagacccuuuaaaucagcugggaauagucuauaaaccuucccaucuuucuccacuucugcuuuugaguuuguugauaaucuucaauagcaucauucaggguuuaagcacaugacaguucaucaguguaagacccuuucuuugaucacuguuuggcuaacauucuuuuucauuuuagguugaauucucuuacccaccacuaauuccaggagauggacaugauagccacacuuuaccugaagaauggaaguacuugccuuuccuugccuuaccagauggugcacauaacuaucaggaagguaugucauuaaaucguagaccaauuacuaagugcaauuuuggaaauuuucucauagcggucgugaauacuuuggauaaaugaaagccuuuggaccuguugugauuacuuauaaaauguguauguguuggaggugagacaugcacaagagaagcuucagagaguacugggccuauuuccuugguuaguaacccucggcucccuccugcccagagcucuuagguauagccagagcagggcugcugcugaugggugugccuucaauuauauuaugcuugagacugaacucaguggcagaaaugaagauuugccugcauuagcuguacauggucuggaaagcucugguuucagacuuacucaaccaucauccucuaaugcccaccuggauacaguggagauuguuucuuuugcucuguagccauugcugcaauccuguacuuuuuucuuuucuuuuuuuucuuuuaguuuuuuugagacaggguuucuuuguguaccccuggcuguccuggaacucacucuggagaccaggcuggccucgaacucagaaauucgccugccucugccucccaagugcugggauuaaaggcgugcaccaccacaccuggccuguacuuucuuacuuacaugagaauguuuguguccucagaaaagaaugugcugacaguuucacugagucuucucccaccauaugggaaugcuuugucacaccugauaaaggacuauucuaccuugguuaaaccagauuaaucaucauuugaguacuuguuuuccuugugcauuauuuaauacuuccuuuauaaaauaaaucagauguuaccaugcaguuuaaauaaguuuuauuacagaauuuguaaccucagaaauguuucucccuaacuuuuuauuauggaugcuuucaaccugguggaaaaauuaaauuaagauuauagggacuauuuugcaaguuuucuuuguuuguacauauugucaguuuuguuacuuuuuauucuaaagucauuuggaauaacgacagacacuugacuucuaaauauuuaaguacaugcacccucuaagaauguaacauuccucagcauccaguuguauuaucauagcuaaacaauuuagcaguaauuucauaauaucucauauccagacuguguucaaauuuccccagucuuuaccaaaauuucuugaguccacucagaaaauuuaagaauucacaugucgccaucaguuuuuaugauugauuuuucuuuagucuggaacagucccuguauauauuuccuguaauuguauagucaauuugaucuguuaucuuugauacucuuagguuuuguggcagacauguacuguaaggauugggaaaaagucugaugucaaaauaaguaucacaugguuccuggauguguugucauguuuguguuaucgacugcauuauaauuugguuguucagcaaugaguaacuaauaucacuacuuacauuuuucuguguaucucuuagauacuguguuuuuucacuugccacccagaaauggaaauggagccacaguauaugguaucucuuguuaucgacaaauugaagccaagguaugaugguugaugaugaacagcagcaggaaaaagcuccuccaaccuguucuuggguguuggucguuuggggaaucacagucuuuagcuuucauguaguacuugugugcauagacaagaagaggguguucgucccauagaguuggagugauagauagucacaacucaccugacauggguucuugaaacagaacugggauccucugccauagcaguguguacuccuaacugcugagucauuguuccagcuacuaauuuguaggcuuuugaggaaucuccauacugguuucuauaauggcuguaacaauuuguauccuuacuagcagugauuagggguuuucuuucuucacauagguaccagcauuuguuaccauuuuuugucaugcauuauuuuuauuagcauauuaaaauuuacauaaugagaacuagugaaagauggaaggcauaaaauuacuuuaaaaauuaaauucaauaguaguuaaauguauagaaauguacaaaaacaaaauguugcagcauuuugguagcauuacuaaugaaaaaaggaaauacauccauaguaaauuugagugucagucccuaaaaccacacuuaacgauggccuucuuuaccucuccugacuaguuuugaagucuacuuuagcaucuaugacuuuagcaacauuaggguuuuuuuuuaagacucccauuuguuugguaguuugauuuccauucugugacucucaguuuuuggaugucugacagguauguuuuucuaggagauagcaaaucuuguuuuuaaauccagucaguuuuuguugguugguucucacuaagugguuggccugguaugugacuuguacauaaagcaguuucaaucagccaguaaauucugggagaguagggauugucccuucacuguucuacccagggccuggcuucugacauucaguacaaggcuggcagguuacacucccucaacuaguaguaucugagauucacugugacauauuuuaaccaaaugcacgauuuuuguuauguucuuacugaaaacuguuuuguaaaugcugcuaugaaguauuucuaauacauaacuguuugcuuauaacaggcauuaaaagugaggcaagccgacaucaccagagagacuguucagaaaagugucuguguuuuaagcaagcugguaagagaccuaaaacuaacuuaccuauuagcauucaaagcagaacuuuuuuugaguaagagaugugugagaauugcuaaaauuaguuaaguacuuacuaauaugcucuuguagccucugcauccagcaacacgcucucauuucuauucugcugaagauucuaagauuagcaaguugacauuugacccaaauaagacaacuguuacauuucauuuaucgauuuuuguuuguuccuaagacuuugaauaacuguucuuuuaacaacuuuaaaagaaaucauaacugcuucaguuuuauugauaauacagaaguucaugacuauugcagugaagaaaguuagccuuaacauguacuuuaaauuuuagaauguuugagaaaagccaaugacaugguaaaacuauacuaaaacagaauuucagaguuguguuucuucuugaugcauagucuucaauuugacauuaacaauugcacauuuaagcacguaugucauuuuuuuauuuguacucuagagaaaggaaaggagugcacauguguaggucaucggacaacauugugguguuacuucucacccucugacuuuaucuguguuccagggaucaaacucaucaaggcucuaucagcggagccaaugccauggccccuauuuuaacauuguuuuuaaacaggguccuauauggcccagguuggccuggaacucuuuguauagcuaagaccuugaacuccugauccucugccuccacuucuagaauuacaugugugugugaaaaauacuccccaguuaauuuguacauguggccaguuauccauaacauaggaauaauaucacauauguaaguagauacaugccgaaaggcuaccagaguagucacccuucaaagggcaauuuugauaacagaaacugaguuuucugugugucugguauuaauucuuaccagacauuuuauauaacauugucauuuuuauuuuccuaacaauguugagauaucuuuguuagucucauuuuacaaauacccauauuuuagaguaacaauaucuaauucucaugugagacuacuaaacauggaaauaggauaaaaaugcaauuuugucauaucuaaaacuaaggaaugaaaauagcuuacuuagaaagguucacuuguucauagugcauuguaguggauaugaaaauguaaugauauuguacuuaaugauaacagucaucuauucaccaggauggauacuaauuacuaauuacuaguucaguauaaauuacuugcauucuaaaagggagaaauaaaugagaaaaugucucaaauguaaauaaaaggguguauaugaucuaucuuagguaggaaaaauaggaauugaagaguaacuuuguucacauauacaaaaagagaaccaaccauccucagauuaugggaaaggaugugagcuuaaaucaaaucaugaguguucaacuugguguaagaaccagacugcuuaagcaugauuaaauguuaccacaauagagugaaaugcaguagccauugacauuguugugucacugugugucaaagacucucuaagugcuuuauguacuccuaaacacagccauagaagcuguaccuuuugguauacagggucagccuggugaggagguaugaagaaguuaaggacauuuaauuaaacaggcugaaagauggagcaauuuugccaagauagcuuucaccugcugccaaagagugggacuaggugauuucacagcuucugguucugaauuugggcccuacaguugguaguuaauaacuuucaucccuaauaucuucaaauuaaaagcuguaggaauuuguuuacugcuguuguucacuauguucaaccuaauaaugguuucucuuuuucuuuagccucuuuauggcuuacuucaagcaaaacuccaacucauuacacaugcauauuuugaagaaaaagauuuuucccaaauuuccauucuaaagguaacuaauuucgauacugauguauuucggugaaugguagcuuaaugagucaaauagcucuuguggcaguucuaugaaggauaguccugauaguuuaagauaaacauugcaugaaaguccauuugcucgggccugagaugguucagugcuuaagagcucuuacagagggcccaagcuugguuccuagcauccacauuggauggcucacaaccaccaagacuaagacugccuacacaguucuuuucuggucaucguauuucuggaaguuuaguggcuaaagugacaguguaaaguucuaaacuuggucugcauuccacaggagcucuaugaacauaugaacaguuccuugggaggggccucauuagaaggaucgcagguguaucuugguaaguaacuugcagggcaagcuuuauuuucaaaguuuucuguugucaaacugaguugcauguaacuguugaugaucagaacuguuaagcauaugugcacuccauugaauauuaaucaacuaauaaauuucacacaaccuuuguaugggaucuaaguucuuaaguuugcuucuuccuuaaauacucagcauucauccugagauggaucauuauuuuauacuggugaugauauucacauguauugcagaggcaaguuucagcuuuuuagaauaguacuggacuucuuuccauuaaugcugaucagcucaauuccaauagaauggugcugcuuagcucuugacugagauucuucaauuugggggugggcguggggggguuguuaauguacacuauugacagcacaaaaaaaaaauccauugucagcugacguagucaauacauacuauuuugugauaaagaguuguaaugauaugguaauuuguguuuccucaguuuccauuucagugugaaguagccaaguugugguuuacuagugcaguuuuagaaagucagcuagauaguccugcucugagacuguauuuauacauuguuuucucuuuuacuauugguguuagagauaugugaauggaaaacauugugauucagaaauaguagauauguaaugcagugaccagaguucacauuuaaaagacuggggcugccauuaugguguaagcuuuaugauuuuuaaauuuaugugguuuauguguguagaauagaaguguuacacccagugucuaaaacuguauccacuaauaguauagacauaacuguaucauauuacaguucauaaaauuuaaaagccacauuuuaagugcucagugaccacauggcuaaugugucugacagguaauauuuuaaacaucuuuauucuuggggaagauuuuguuagacaauacgcuuucugacuauauauguauuucaccaaauauuacauaaaugcuugaauauuuacauauuuucauuugcuguuuuagauauucucuuucacauuuagcucuccuguuugcauuguagguuugucuccucgagaucuuguccuucauuuucgacacaaggugugauagauauccuucaacuugcgauguacugaaaugggagaggcugugcuuguguuccuuuuccuucgaacucagugggcagcaucacaaucagcuggcggcauaauugugguuuugcucuucuaagacagcuucuuaacuauacaaggcuggaggcgacaggaguauuugugugguaaaagucugggaguaccucuugcucaauagaguuggcuuuugauuucuuuauucugcagucuuugcaguuucacuuaguaugguguuucccugaaaguguaauauuuuucuauaugaauuaauucuuuuuguuguugucauuuuggugucagauauuaugguccuuauuguuaaagcguaaguugccaaggacacacacgcacauagucacuuauuuaccaaacuuuuauugacuauguaaaugcauguauccgaaacuagccuugaacucacuguguagcuaaagauagcccugaauuugugacucuccugccucuaccucccagugcugagauuacaaguaugaaccaccaugccuaauuuacauuucuggggaucugaacaccaggcucucacacauuaccaacuaagccauuccccagccucaaaucucugccucuucagaaacuugaaaauuuucaagcagagaugacacuauuccuuccaaaacaaagauuauuucaaucaaagguuaagugauucacaauuuuagagaacauagcuaaugcuuaauuucucaguucaaguucagaguuucucguuucuuaagucguauaauuauuuaauauuguuuauaugauuauauuugaaaaaaugaaauagcaaauuauuaauagaucugaguucuuguuuuaagauaguauuucuuucuuuuucugcaggucuugauccuguuuaagcuaauucuucuugaaaagaaggugagauacagaaggauaaaaggaagaacagguuuuuuauuuuuuauugucauuuuuacauacuauuauaaugugggaauuaaggauuaacuauuaagacauauuuugucuauuaaaugaaacacaaaauuauuuuuuuacugucauacacauacaaaucuguguguucuuuuuggagacaguuugauaguauauugaauuguacugucaccauaaguuuaaacuaacuuacagaaaaggaaauauguuuguucacugagacuucaggguugaugguugacuuggugcuucuaggguaucacaauguuggguuuucuccuuguccuacaguccagcuaguuuuacucagagcugaucucccuuguauacaauaaacugccaacaguaauuuggcuauuugcuuccucagacauaauaccacuucccauaauacuacuuucuaagcuauugaauaugaauuugucccaucaauuuguuaucaaaagucugccuguacuaauuggcuuaaacuuggguuccagaccacuguguacuccaaagagaugggcuugccaugaucauuguggaccucaggucuaauagccuauuccagcuuaccacuuucuuuuauagaaguuuguuguuuuuaagacuuauuuuauuuguauuuauguguauguguauaggugugugcaugugcuuacagguuccuguagaagcugaaaacaggacaucagauacucuaauugugguuacaggguaccuaaugugagugcuaggaauugaacucaggucuuuugcaagagcaauagcuguucuuaacuguugacccauaauaagaguuuuacuggaaaagaggcauaucuacuguuuacuuauuguuuguagcuguuuucacucuuuaggagcagucgcguaguuaaugagagacuauauggcucacaaagcaaauguaucugucccuuuuuuagaaaaaguugaaauuaugcuuuagacuaaucagaagcuagcccugaaauacaaccaguuuuauaucccauauuaacuguauucagugcaccuaaaguaaagggaauauugagggaucagccaugcacuauguucauuauggcuuauuaccuuaagcgaauuguuccuuugccccaguaauucucucaauagagauuuuuuuuuuucacaauuaaucuggguugaaugcaaacuaccggaaagagucauuuaaaaugaguuaaaaaucaguagcuaauuauuuugugugucccauuuaacuccaaacaauaaacauucccaaauacuuuuuauuaucaagauguuucauggcacauuagguucauuuauuuuuaccuaaauagugugaguguuuugccuguauuuguauauauguacuacauguguaccuagugcccccagaguaucagaagaagguaucagauccccuggaacuggaguuauauaagguugugaacugcugugugggugcugggaacugaaccugaucaucugcaaaaucagucaguguuuaucacugagccauuucuccaguccuguguucuauuaacuaugauccuauuuuauaaacaaauacagauucacugaaagaaggccguagaauaaaaaugcagucuguuuucaaguuucccuagauguuuuaaccuccuuuucuuucuuuuuuccuuuuuuugggggggguuggggaguggggcuaggacaggaucuuaaaugugauccaggcuguuugaaaacuuauaguccuguugccucuaacaucugaauccugggauuagaagcauacauuaccacuuguagcuauaauaauguccuugauagcugauuuauuuuucuuuuaguuccuuauguuaauuuuauuugccuagaaauaauguaauuauaauacaccgugugaaguagagaauuuuuuugucaaugaaguguuaaguaucauuguggggacuuaggagaauggaguuuuacucuaauuaggacacuagggguuggggaaguggcucagucaggagagugcuugugaugcaguacaagcaccugagcucagauccccagugcccaugugaaaagacaagcuggcauaggagcacguucugaaagcucugcacuggagaaauagaggcugaaaucugucacuugcuggcuagcccaucuggccagucugugagcuccagauuuaaauuagagacuuuguccuaaaauguaauaagguggagaagcaauuggaaaagacaccugaugccucacuccagcuuccacacacauugagauguguacaugaacacauaaaaaugaacacaaaauaaagauuaaaaacccaggcauaggggcuggcucauaggaaaugacucagcauuuaagagcacuagcuauuuuuucagucauaggguuugauucccaguacccacaugguagcucauaaccaucuauaauuccaguaccagggugucugauguucucuucugccuugcugcaagcacccagcagcacacauuguucaugcagacaaaaccacagaaacuaagauuuaauuuuuaauaauucuggugcucuauuuuaaaaagaaaagaacaaaaagaaacccagacauaguaucacaggcuuguaaucucagcccuuagaaggcuaaagcaggagaauuauggcagguuccagaacagccugggcugcacaguaacuaccugacuuucacacucuuaaauuuuacuuaugguguacuuuagucugcauuuauuucucugauaucucuggccuauuccaucaaucucucucuuuuuuuaagauuuuauuucuuuuauauauguguaaguacacuguugcuguuucaaacaugacagaagaaggcaucggaucucauuacacauaguugugagccaccauguguuugcugggaauugaacucaggaccagucaguguucuuaacugcugagccaucucuccagcccccaucaaucucuuaguaauuuaucuuguauaaaaauuacagauuuaaagaauguugagcuggguuuucaaugucuuuauagaaagauaaugagggugucucuaauuaacuuuauagauaaaaugauaaaauguauaggcaguucuuuuuuaucgaggaaccagucaagaauccuauauuacguuucuaguuccugcuaaugucaaauuacucuauagcacaaugauaguacaucuaacuccaggucaaauuguacuaucaucacuucauacucauuuuuuaaagaucuaucuuauguuuaacuguauguuuuuguguguaucuguguauaugagugcagcuaugcccaaaauccaggagaucuuuggauccucuggaacugauaagcauuuuuggaccaccugaugugggugcugggaccuaacucaggucuucugcuaaaguaguauacuuucuuaaccacuugacuaucuucuuaguccugccgcuuuuucccauuucuucuugaauuucaugacauugggacuuuuuaauugaucuuuaucuguauggguguauguacacuuauacacaggcaugugcaccugugccugcaugcugaggcuagcagaggguaauggguauccucgucuaucaaucacccuauucauuuugagucaggaucucuuuuaaccugggacuauucuuucagauauacaggaaaccagcaggccucagcaaucagcuaggcucugcccaccucagagcugcuauuuacaagcuuguuaugugggggcauuggaaccugcacuucaauccucaugauuggcacuuuuuuaaauuauggaaugcuucaugaauuugcacaucaucuuugcaaggagucauuucucuguuuaguuccaauuuuaguaucugugguguugaagugggugcgauuggcacuuuuaaagagaaucuagucaaguauuacagaauuaaauauaugauuguuuuccugugguuacuuucauuuuaaacauauuuagcaagauacuagaucaaugaugauaugaccucagaaugugacacaacuguaugguucuugguaauaagaauuuugaucauuugguuaagucgacaaacuaccuuaaucaaugauuugugggacaaugaaucuaaauguugugacuauucaguugcccaacaaucucccauggucauuuggugucugucugcaguauuuuuuaaguuacauauuuuuauuuauuaaaaccuuauuauaaagaacuugaaauuuuuuuuuaaaaaaucaugaaauuaaccagacccaaagucugguuaacucaaugugugugugugugugugcgggugcgcuuuugcauucccacagucaccaaagcauauauauauaaagucagaggacaacuauuuauuuauuuauuuauuuauuuauuugcuuugcuuugccuugcauccugauagcagcuucuucuccuucucuuacucccagucuuucccauagauaccaacccuccauggcauaucagauugcagcaggacuaggugcaucuucaacugaggcuauaggagucagucuaguuagggaaaaaggauccaaaggcaggcaguagagucagagacagcucuguuccaguuguuagggauuccacaugaagacuaagcuguacaucugcucaugggcuuuuuaaagucuuauucuuaugcaaagaauccuccccuuauuauuacagccuugugaauuuuguaguuuaauuucauuuucauccauuucagguucuguuuuacauuucuccagugaauagauuggugggugcacuaaugacuguguuaucccuuuuuccagguaagaggauaaccauuacuacuuuugcuuauuguuauugaaauuuugaccuuuuaauaauaaaaguauacaaaaaguaaacucauuaggguuaauauuuccauuuuaauuuuccuuuuggcaauauuuuuuuuuccuuuagccugguuuucuuuccuuauuuuaauuuuaacauuggggagagggaugguguaagccauggcaugcugguggucagaggacaaccugugagaguguaccccccauuguguguugugguauucaaccuagguugucagguuuggcuuggcaacaagcacccuuacccaucuugccagcucccuuuuuguuuguuuguuuguuuguuuguuucaauuuuuuauuagauauuuucuucauuuacauuucaaaugcgaucccgaaaguccccuauacccucccccugcccugcuccccuaccuacccauucccacuucuuggcccugguguuccccuguacuggggcauaugaaguuugcaagaccagggugccucucuucccaaugauggccgacuaggccaucuucuccuacauauacagcuagagacaugagcuuugggaguacugguuuuaguucauauuguuguuccaccuauaggguugcagaccccuucagcuccuuggguacuuucucuagcgccuccauugggggcccuguguuccauccaauagaugacugugaguauccacuucuguauuugccaggcacuggcauagcugucauaacuuacuuuguagaccaggcuagcuucaaacucaagagaacuaccugccuuugccucuuaagugcuuggauuauuuugugugcuaucacacucaacuuucccagcuuuuucuuuuuuuacaaaaaauuucauuuaaaaagaugcaaauacagcuuuugaaaaaauuuuauaggaaauuuccacuauauaaaacaggaacuacaccuuauuuucuuccauauuauuauaagccaagcuguucuucaauauuuuauauuguaggcaugauugagcauggccucagugacuguucucaguauagaccucgaaagaguaugucugaagaugcuggaccucaggaaaguaaucccucugcagaugauuuuacuucugagucuacuucugacgucuuaaauaccagcuuggaaacugucacaagagucauggcaguaaaccauggcgaagaugcugugcccaagacggagaagccuuacuuccaaguagaagguaacaacaacaaaggacaggaacccagugauucuggccgauauuuggaacuuccaccccguccaucuccagagucuucagaaagugacugggaaacguuggauccuagugucuuagaggaugccagcuugaaagaaagggagcagauggggucagaccagacacacuuauuccaaaaggacucucugcccucggacaguccuccaauuacuguacagccucaagcuaauaacaggcaggugguccugauaccagggcucauuucugguuuggaagaagaccaauauggcaugccucuggccaucuuuacaaagguaaaauggacuguccuuuauugaggacauuaauuguaacuuuauguguuuggacacauuuuugggucuuaaaguucuccuugaaaacugggaaauaccuaaugaauaaugcuguuagauaaagauguuggacuuuuaaagaaaaccugaaauauuuuaaagacaaagaauuuuaaaauuacuguguuuauauuguaauuguuaauaugagaucuugggggaugaacaagaaaggaaagguuaugauuaauaagugauauguuugugugagguucacaagggguuaaaugaaccuugacauaccugggaagaagaaaucuuaacugagaaaauaccuccauaagauuggccaagggcaagucuauagggcauuuuccucaucaaauauugauaugagagagccagcccccuaugguuggugccaucucuggguggaugguuuuggguuguuuuaagagcaagcugagcaagccaugggaaauaagccaguaauaacuaaccuuccuccaugauuucuuuucuaauuucacucagugaugaaugugaccugagaguuguaaagugaaauagaccccuucugucccaauuugcuuuuggucaugguauauuaucacagcaauagaagcccuaagaaauauacauacauaugccauguguacuuaguguccaaggaguacuagaucucuguaaaguggagugacagacaguuggaaccuaccauuagugugcaaugagacccagguccccugcaaagcaucagguacuacuagcaguugagucauccuuccaaccccaaauuguaaaauuucuuuaacugccauuguuucugcauguccaagagcacuucuuaccaggaggcaaauggacugaagaagaauuuugguuuugaggaucagauuccucagaguaaucugaaucuuuucaauaaaccauguuaguugcuagauuuaugcgcuuuaugccaguacuaaauaugugauaggcuuaccacuguuacugugauaaauaugugauaggcuuaccacuguuacugugauaaaggagucuuuuuuccccuugguaucaucuuucauuguguguugaguaaaacccaguguguugcuuaaucacauuucuaacuacaaauacugauccuuuaggucaguaacuuuggaagauuagauguucuaaaaaccaaauugucuuuaagcuguuuucccuugggauucuuucacuucauuauuuuuaucuuacauguauaaaguuuggccuguauguauauguaugcauuacagugccugaucaggucagaagagggugucaaauccucuggagcucaggugacagaagguugugagcuaccauguggguacagcuaauagccuguggucuguuuuugguuuugcuuuuguuuuguuuugaggagguuuuguguguguccuggaacucuauuuauagaccaagcuggccucuaauucagagguucuccugccucugccucccaaaugcuggaauuaaaagcaugugccaccaccucccagcuucacccuguacuuucaaucuccuagccaguuccccagcucuuaguauuugaacuuggaugagaaugaugucaugucauccuuacaggccagguuuacuauguaagcccuagagguuacaucagauuguuaauaauuuguaugaccuuuuucugagagcuuauuuaagaaauacacagaaggagcugaagagacagcucagugguuaagagcacugauugcuuuuccagagguccugauuucaauuuucagcaaccacauguggcucacaaccaucuguaaugggaccuggugcccucuucuggugugucugaagacagcaacaguguacucauauagaauauauaaaucuuuuuuuuuuaagaaguaauaaaagggcuaaggaaaugaugagucuagaacuacuauccagcagaacaagagaaauagaaaaaaaauugaaacaaaucauaccuguguacucaugcucugcugccaugcaaaugaguaagcagaggaacacugaaaggggaauggcgugagauaagcugagaaaagagauggaauagcauuuggggugugcaaguccaguauugugggccuuccuucugaucgaguacuggaguugggcacacacuggcauaguuaaguguugggaugacuagaaaggacuggggauccuuuucuguucaauuuccugugucagcuuuccucuccaaucacaagucaguuaggaaaaucaguugauguaccauaaaaacugauuaaaaguuacuuuguuuuaauuucuauaugccaguuuaaaacaagguauuuuaacuagugaaauuuaauuuucucagcuauguaacagugaugacacaugaugacugugacccaacgcuuugguagcugagacaugaggauccugaguuugaagccagcccaagaugagaaucguaucucagaaaauaaaaaaaaaaucacauagcuucucaacuuguaacugaauauauagaauuuauuuuaguauuuggauauuugaaggggauaugaauaauaucccauuauauucuacccuacuuuuuuauuaauucacucaucaacugaucauugccuccaacuuuuggcuacuaugaauacuucagagaauauugauaugcaaauaucucaauaauguuugcuuauaauuuuuauuuuuguaauuucugugucaguguauguuuaccauacacgauaauuauucucuguuuuuuugucuuguucuuuaucaguauauggugccauuucauguauggauguugaguugucuuaguuaagugggaagccaggaguagguuuggauaugaaaucugcuuuuuuggaaaaaauauauucuucuauaaucauauucuggcaccuuccaaagauuuuuaauuaaguugaacaucaugaaaagaaaaguagugacaccauauuaaagcuauuuugaacaguuguaucaauauguaguauuuucacaugguucaguaguaaaaaguccaaagcaccuguaauaaaauuuucuguggccugagaauguacagugcaugccuagcauacacacagcacuggauucaacccagaaccaagaagaaauguuuccuaauccaucucuucuacccuucugccuucucugauagcugugaacaucgccagugucuaucuuuuuauagccuaaggaaaugcauaggcuuuccccuaucccuuuuacacaaaugauagcaguccgaacccaucuuuaucuaucccuugaucacauuuacauuucugagaauugaacuucaucacuacaggguuucucuguguagcccuggcuguccuggaacucacucuguagaucaggcuggccucgaacucagaaauccaccugacucugccucccaagugcugggauuauaggcgugcaacaccacucccagcacaucagcacuuucuauaguuuuagaauaugccauuauauggcuagaaauauaucuacuccaguuuuuacgaaguuauaaauaaaaagugcuauguuaaauaauuuaaaaauacacuaacagaugagcaggcauaucugugagauaaauuuagguaaagaguguguguguguguucucaagccaagguucuuuuuacguagccccguugaaauauucacaggaaaauagaaacaguuacugaaagauucugaaucagcauagguuuucaguaagugugauguuuuauguacaaccugaggcuacaaacagaucagagauucaacagcucuguccugccuuuaugcacaaaucuuuaccacugaccacacccucaacucuggggauugggcuggguugggcuugcuuuuuuugguugauugguuugcagaauuaaaugccuauugaggauuagugauucagcuguaauuuuaagucagugcuuuuucaaauagaaauuaaagagauacugccaauguaacuuuugcuuuaacuaauuuguagcaaauauuuugacauaucuuuguauugugucuaacaguaaacuagauguuuuucucuucucauugcaccuagauggcugugcaugcucuacaauucuuaacugcuuucuaguagacaacauacuuuuuaauggauauaauauauuuaauucccuaaauuaaaaaggaagucagacuuuaaauuggaccaaaaaugaagggauuaaguaagauagccuugcagagguuugaccauuugagaagagaauuagcuaaccacucacuggacuuuacugcagucaaggcaaggcauugcucuaugugaauauuauuuuaaugagucagagauuaaaugggcaggcagggaagaauggacaauuuuuucaugaaaagaggaguggcuuauuuuauuuuucacguuucuguuauuuucuguugcucuuguaauccauagggauaucuguguuugccuuacauggcauugcagcagcaucaucuucucucugaugucacuguucggggauuuguggcuggagcuacuaacauccuuuuccgacaacagaagcaccucagugaugccauuguggaaguacguuuaugucugagucuaugaacuuggccugcuggcucacuauuccuuuccuaaauauaauuaugaacuuauuguaacagcauuaauaagaaaaauaaugucuacuauauucuagucauuuuaauuuauuuguuuguuuauuuauuuauuuauuuauuuauuucguuggguuggguuuuguuuugcuuuguuuuuuguuuguuuguuuguuuuuuguuuguuuugguuuuucgagacaggguuucucuguauagcccuggcuguccuggaacucacuuuguagaccaggcuggccucggacucagaaauccgccugccucugccucccgagugcugggauuaaaggcguguaccaccacgcccggcuugcuuuguuuuugagacagggucucuauguaccccugacuuuccuggaacuuacuuuguagaccaggcuugucuugaacucagagauccaccugccucuuccucccaaguauuaaaggaauuaaaggcauaccucacuauaaaccacuuuauauuuauuaacugaucucauuuuccuaacagcccucuaagauacauacuaucuacauuuuggauauacauaagcugagggucacaaguaagggugauugucccauuaucaaacaacugauaaaugcuugagcaaggauuccagccugagcaaagcaugccuaucauggucucaaugccuuauuaaaauguggaauuuuuucagaauaauuuauacacauauccugcuuaauauguuccugauguuaaagaacuucauagcaguuauucaauacugugucaguauauuuaaauuuuuaaauuauucauuuaauuucacaguugaaaaauacugggauucuuuuuaaugcacugauguuuuuauaauuacugacagauuuauuaucauccccaauauaagugagggagaaacuuuauaccagauaggaggguacaggugggagaagcauaaagugcuuuagcguucacaaguugauugauugauguuuuauuaauucacucuacaacuaaccuuuggggaugaguugacuuguacagcaguugcuaaguauguguaagggcccaacuauaauuaccagcagcuaaagaacaaaacaaaaccuugccaguuagguagguagguauguauacaguauauacaguauguuuguguguguguguauacaauauuaaaaauauuucaaagugugcaugcccucaaaauggaaaaauuugaaggaauuauaacuaaguuuauuuuuuucauguuaauauaaggacaaguuuuauuguguauguaucuauauuuuccaaagcaauuauauaaucaaagauuuuagaagcauaauuacuuuuauaguucaaagucauguucuuaguugcacauauuuuuucuguaagucuuuucuuaagacuuauuuauaugugugcuuauuuugccugcaugcauauauguguguguacugugugcacacacaguaaccauggacaucagaagagggugcaagauccccuggaacugaauggauacaagcaaccauaugaggcugugaagcaaacguagaucaucuccaagaguagcaagugcucuuaaucacuaagucagcuauccuccucuaccuauaauuucuaaaauuagaacaggcacuuuauuccauaaaaagagaaaguauacagaaaccgcaguguacacaccugccucuuucuuagauucauccuuugagaauauguuauucauauuuuuuaguuccaguuccccagugguuccuuuuuauaacaugacauggaaaucugugucccaacucugacuuguaccugggcacucuucuagguggaagaagcacugauccagauccacgauccagaacuuaggaagcugcuuaacccaacgacggcugaccuaagguucgcagacuaccuggugaggcacgugacugagaaccgggacgaugucuuccuggauggcaccggcugggaggguggugacgaauggauccgggcccaguuugcagucuacauccacgcucuccuggcugcuacacugcaguuagguaagaaucacucagccggagcuggagagauggcucagugguuaaaagcaccgacugcucuucugaagguccugaguucaaaucccagcaaccacaugguggcucacaaccauugguaaugagauuuaacaucuucuucugguacaucugaagaccgcuacaguguacuuagauauaauaauaaauaaaucuuuaaaaaagaggaagcacucagccacaauucuucuuauaaaccuucauguucuaauuuuuauggauguuuugaguugcguuagaaaaucacugguacccauacagacauaaugaugacucugacauuuugaguacuuuauauguuuccaaaccuuuuucuuuacauauguuuuagacuuugauuuuaugguuugggauagucuuuacaguagugacucuauuugaacauguggucugaccauuacucuuucuuucuuuuuguuuuuuuguuuugguuugguuuggguuuugguuuugguuuuuuucaagacaggguuucuguguagcccugucuguccuggaacucacucuguagaccaggcuggccucaaacucagaaaucugacugccucugccucccaagugcugggauuaaaggccugacuuuuuuuuuuuuuuuuuuuuuuauccucuuuaugauaaaaauguuaagacaguauugauuguuuucacuucaguuuggcugcugauuacuuuguaucaaaggaaaugucaguauuugguaacuuuauaaaagcugcuuacauauuuucaaguuauuaaaaaauguaaaggaaccauugcaaauuauauucugagugauuagaccuucaaaguuuuauccuauucuaaaaaauauuauuuuuccuguuaaaugauuuaaauggggcaggugaaaauacauuucugguuaaaacuacuucauucuacuuagaaaacaguaugaacuagaaguggagcuuugcaauaagcauuucuaccuuggaacucuggcaaauacuuguagacuuguagcaaaaauagauuucagaauaauuuuugguugucauuacugaaaaaauacauugcuuuuuuuuuuuuuuaaacagcaaugaaauauguacgauaugcaguuuacuuucuuguaauagucuauaaacgugcacgucugcaguauugugcagcuuauuugcauuuuugugucagcagggauuuuuuuuuuuuuguuuucaaaucacuauuaucauuuccgccugccaggguagucugaaaucuagauuucagggauguuuucauuauaaagaaaaaguaaugaucauguccucacuuauuuguuggauauuuuuaaaugucuaucauuucuacaaauauaucauuagaggcaucaaaauuaaaucucguaacccaaaauuacuaaucuuaaaaagaaagccagauaucugcuaguuauuuggccucaugaauaaucaauucuuuguuuucaagacaggcuuuuucuguguagcccuggcugucguggaacuuguucuguacagaccaggcuggccucaaacucagagaucuaccugccucugccuccuaaguacugggguuaaaagcauguacuauaauuguccaacauucaacuuuaaaaauuaauacaugcaaggcauguucugaacacuuuacagcuaguaauaauuuuggcuuuaauaauaaucccagaaauuacaauuuacagagaacaggaaacaaguauugaguuacagaguacuguaacuuggucaucuaucugggugagaggcuugagcagucugguucagaagcccauucuuacacgugaccagcagagagggcugugcugcaggggaaguguaccuuauugcuguaaauggaacuaugugucuccugguccuuuccuagcaacaaaaagcuacuggcauuucaccuuaaaagcauagaauauagccagacaugguggcauagaccucagauaccaucugccuggacagaaggaagucaagacagaagagucacaagaguucaaagccaaccugagugcauagcaagacuuuguaucaaaaacaaaauagcauaccuucauguguaguaaaugugaggcaauagcuucuugaaucaguuccccagaccuauucuguccuuccaagcaaaaggaauguucguggacccuuccccaugguaucaauauaacaaagagcuacuuggcauuaaugugaagauccuauguuguuguaaguauuuuugauaguacagugcuucaauaauuuaagaaugaagcaccaaauacugagacaaaguccaaacaaagaaaacauagguaaaagaaguagucuacuugcuuguucuuaaccucuuuuaacauuaaggagauucuaacucucaucauaugcuuaagccaauaugucugcucccugccauguguguacuuuuuauuuaauaaauaauauaauccuuguaacagaaaggaaaacguggaaacauuuuggcauagagagccuugggcaauguuuggcucaguccucuuauuucccaguuaagaaaaugaaguucugaaugauuaagugauuugccaagggcuucaaggcuucuuaacaggguuucugggacuagagccaaauuugcuuacaucuaggcaauuuccccacaauguggcugugggacuuaaaaacauaaagggacuuucacacuuuaugguuauuaaucuucaugcccagauggcuaugauccagcuuagcuuucuucaaccauuuucuuggcagauaaugaaaagauguuaucagacuauggaacaacuuuuguugccgccuggaagaauacucacaacuacaggguauggaacagcaauaagcauccggcacuuucagagauaaauccaaaguaagcauauccucuagacguggugggauggaaaaugguugcuuuacaaagaaagccugucguuauugaaagagacagucuuaguauacagccccugccuagccuggaacucacuguguagaucaggcuggccucaaacugagaaccaccugccucugccuuuccagugcuuggauuaaagguuuacuaccacuccuugcuuaaauacuauuuuuaaugauacaagcauaaauuacauaaauuggcuauuuuuauuguacuuugaacuuuuauuucuugguaaaaauggacaaagucaauuuuguauucagcaccguguuauugugggagcuauuguuuauuguuuuuagcuaaaguagaagugcaauuuaagugauuaaacacacacuuucuuuuuuuuuuuuuuuuccauuuuuuauuagguauuuaacucauuuacauuuccaaugcuauaccaaaagucccccauauccacccacccccacuccccugcccacccacuccccccuuuuggcccugguguuccccuguacuggggcauauaaaguuugcaaguccaaugggccucucuucccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcccuaugauccauccauuagcugacugugagcauccacuucuguguuugcuaggccccggcauagucucacaagagacagcuacaucuggguccuuucaauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccaaaucuaaggaggggcauaguguccacacuucagucuucauucuucuugaguuucauguguuuagcaaauuauaucuuauguauccuagguuuggggcuaauauccacuuaucagugaauacauauugugcgaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguuguacaagccugcauucccaccaacaauggaggaguguuccucuuucuccacauccacgccagcaucugcugucaccugaauuuuugauccuagccauucugacuggugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucaauucucgaucuuacagcacaagccauugcuguucuguucaggaauuuuuccccugugcccauaucuucaaggcuuuuucccacuuucuccucuauaaguuucagugucucugguuuuaugugaaguuccuugauccacuuagauuugaccuuaguacaaggagauaaguauggaucaauucgcauucuucuacacgauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaucacaauugcucuguaguaaagcuuuaggucaggcauggugauuccgccagaaguucuuuuauccuugagaagacuuuuugcuauccuagguuuuuuguuauuccagacaaauuugcaaauugcuccuuccaauucguugaagaauugaguuggaauuuugauggggauugcauugaaucuguagauugcuuuuggcaagauagccauuuuuacaauguugauccugccaauccaugagcaugggagaucuuuccaucuucugagaucuuccuuaauuucuuucuucagagauuugaaguuuuuaucauacagauuuuucacuuccuuaguuagagucacgccaagauauuuuauauuauuugugacuauugagaaggguguuguuucccuaauuucuuucucagccuguuuauucuuuguauagagaaaggccauugacuuguuugaguuuauuuuauauccagcuacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuugauggaucuuucugugguuuagguaucagaguaauaguggcuucauaaaaugaguuggguagauuaccuucuacuucuauuuugugaaauaguuugugcagaauuggaauuagaucuucuuugaaggucugauagaacucugcacuaaacccaucugguccugggcuuuuuuugguugggagacuauuaauaacugcuucuauuucuuuuggugauaugggacuguuuagauggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcugucuccccuuucuucuuggaggcacucagagcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugauaggauacaugggacaauuucuauauuuuuguaucuauugaggccuguuuugugaccaauuauauggucaauuuuggagaaggucccgugaggugcugagaagaagguaucuccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaaugaauguggcugcccuugcauuuggugcguagauauucagaauugagaguuccucuuggaggauuuuaccuuugaugaguaugaagugucccuccuugucuuuuuugauaacuuuggguuggaagucgauuuuauccgauauuaaaauggcuacuccagcuuguuucuucaguccauuugcuuggaaaauuguuuuccagccuuucacucugagguagaaacacacacuuucugauguacacauuaaacaauauaaacuucuagaugcauuugguagggaacaugguuucagaacauuuugguggacuagucuauuauuaucuuuauauuaucucucaaagaaaaugauaggcucaacucuaacuucgguggauuuuuuuggcuauggcaaaacuauauugccaccugaauguauuaaaaacaauuaaaaaguagacuacauuuuaaugcuaguaaaugaaagaacuaagaguucaaaauagucugccucaccaguugcagggucugggugcugaggcauacaaaggaaaugugagcugguuugccagggacacgugaaguggcucuucuuauaagcuaggucacccuaauuagucaacucuccaauaugugaagcugucucaaucauugcaccugaggcuguuaaccugaaccaacucugcggaucuuaaugcuaguacauagguugagcuaggcugggcuuuaaaaauagguacgaaaaaauauauaaagaaacuaaaguuauggggguugaaaugcagacuggaaagcacucauaacuaagugugauagcacaugccugaaaucucacacucaagaggcuaaaguuggagaaauguaaguuugaaggccaaaacaaaaaccaaauaaacaaagaggacaccaguagauauauauacuaacauggaagaaggaaaucucauggggcuucguaggcagcuaaggaauacagagcccagaggaaacaggagagaaaaagucugucuagggaagagcccucaaauuguggucagcccugaaaucauacacauacagguaacauuauacauuauaaagacugguaaggugugugugugugaguguguauaacaacaauuaaagaaauagacgucaugaauuugagagagcaaagugaguuacguuguaagguuuggagggaagaaagaaaagaggaaaaacaaugcaauuauauuuuaauuucaaaaauaaauguuuauaaaaguacauauagaaaaaaagacacuuugcuuuuacauuuuuaaaacaaaaaggggagaagaucaaggaugaagaggcccauuagaguaguaauuaggaaaucaugaugaucaguagauuuuaaacauuuucaccagauuaaaaauaagaaaugaaaaaaaaaaaaaaagaacgauggucuucauuaucaggaaguguaauuugaaacauuccaaacuaauuaccuugaaaucugccugauacuuuuuagcuucuaaagaggaaucucuaaauuaccaagcauaauguauaauguucccccauccuggaaucacgcuguuuggggaauaggagaaaugacugaugagggacguuuuugugauguugcaauguuugauacugaaccuggggcuuugcacauguuaggcagcuacaagcacagcacguuuguaugaucugucagcuuaguucugugauccauaaaaggaagaacuggucuauaugcuugcuuugacccagagcacuuuuacugucauuugacaaaacuauagcauuauauauucauagcuauagcauaaguagcuauggauuucucuuucuccauaacacaggauagaguaacccugaguuuaagacaagacuuguuuauugaccuuucucuuucagucuuaacuaugcuuauuaagucauuuguuugguugauuuugguuuugauuuuaauaaaauguuuuuccuuugguguggcagaaauucucacaaaacuacagugccaauuuguuuuacauuuugaguugcuuuuauaauaaacaacagauuuugcugauuuacuagcaaauuuuuauggccaaugacauauauuuacagggugaccaggaucaagguaaaguugugacaguggccuaaauuagcuccucaccuaauuuccugauguauuuuuaaguugggcuaaugcuuggucccuaccccagaugaaguaauuccugucagaacaguguuagcacuucuguccccaguacacacauguccauuucuagccacauucauuuacugcacaaggaaagaagauagaacccaaaacuguugagucacuuggagaggucauauuuggaaugaugcauguguccccacugucaguuuuagagcacuauguccucuugugucucccaaaaaguuaacuaacaguucaugugacugcauuuugcaccauuauugauguauucauaauauaaauuuaaacuuuguuuuacagccauccuuuucaaggccaguacuccgugucagacaugaaacucagauucucacagugaguacuuagagaaaauaaggggaaauuauucugagucuaugccauauguugccaaauagguauuauguuuacuugauagauuaguguugcaaauaguaacccaguguguuuaacauucuguagcucaacagcauguauuucaaaauaaaaacucugucuauacacaauaguaugagauaacaggacuugccauucuuauuuugaugauauccucucagaaaucauaucugucaagaagauuuagccauaaaucuuucuguucucaccucagcucauuucuguguucuuucaaauacauucaaguauuuauucauaauaauuuugcuuuuuauuuucuuaugauaauagaaugguuugguugugggcauucucaaauguuugauauuuuuaaaaauuguauuucuuuuuuuuuuuaguucuguucagaauagugaacguggcaaaaaaauuggcagugucauggucacaaccagccggaaugugguacaaacaggaaaagccguugguaaggcacacccucagcuggagcugcuugucauauguauccauuuucugucuucaguguggaauucauuacaauaaaguuauagagauuucuggaucacauaacaauacaagggggcuuuuagagacacuacagauaaccaggauuagacuacagauaguaaaaucagaauagcuuuagaucugugaagaacuuaaaaccuggugcaggguuucuaauuuaaccaacaucuauguuggcuuggcucuugaguucuuuucuccucuucuuccucucuuuucucucucacucucugucuuccuuucuuuuauucaacccccuacuuuuguuugucaagacagugucuagcuuuguagucuagauuaaccucaaacuccagauucuccugauucaacaucccaagugcugagauuacaaacuucucauugaaauucuauuagauauuuaaggaagaaauaacauaaauugaauacaaaccuuucauaaaguagugaauaagauaauacuuuccaacucacuuuaugaggccaguauuaaccagauacccaaagcuagguaaaucauugcaugaacauauauucugugccuagcauuuuuucacucaaaauuuuuugaggauuauucuauguugugucggaauaaauaucuuauuucuucccacccccaccccuuuuguuuguuuguuguugaagccccagcuaaccuggaacuuacuauauagaccaaacuggccuugaaaucaaaaucugccugccucuaccuccuaaguacuggaaaaaaaggugugcaccaccauugauccaauuucaaacuuagaaacuauauuaguuacuguucuuauuacuuugaccauaucugacaggaacaacucaaggaagaacuuugcuuuggcuuaugguuuaaagggcacaguuuaucaggucagcaagucaugaugcaauucauaacagugugagcauguugcugcugaugcuccuuauguccuaguagaucaggaagcagagagcuggagcuggaaauagauacaacuucagacgccaauguaacacuucacuucuacuggaccacaggucccaaaguuccuuaaccucccacagcaguaccaccaugcagagacaaaguauucaaacaaaugagcccaugcgggacauuuucuguuacccuuaacagaaauaacuguuaacucuuauugaacagaacucagaagccccaguagaagaaugccucauaauggucuuuguaacuaacauuccuuacaccuauagaaaguuggugaaaggacacucuggacuccuuuuaaaagacacagaacacauagcccuacuuaggaucauuuuauugccagaggaaugaaauuugauauauauguuucuauauaguuauaguggauucuuauauuuaauagaaaaaguuagcuucuuugaagacauauacaucacuauaguagcaccccccccauccaaaagagauuauucaaagaaucacagaggauaccuaaaacuauauacacgccauguuuuuuucuugcauaucaaccuuugauaaaacauuaacauguaaauuaaccacugaaauuaacagcaauaauagaaugagagaguuauaacaguagauuuuaguaaaaguuauaugaauauauucugucgcucaaaauuuuuuuacuuuuuuuguuuaaagaaaucacuuuacagcucuucuuuggcauguucaaguugccagcuccacagcccuugccuuuaggguuacuggaacauagacacugcgcuaccagguaucuucguuagggcuauugcugugauaauuacuaccaaaagcaacuuggaguugaagggauuuguuuggcuuacauguccuaggacaguucauugagagaaacaaaggcaggaacugaugcggagaccauggcggaacacuacuuacugguuugcucagggcuuuugcucagccucuuuucuuacaccaucaagaccacuuaaccacugugggcugaaucguccuauacuaaucauuaaucaagacaaugcccuauaaauuuaccuacauaccaaucuguuaguagcauuuucccaauuaagauucccucuuuccagauuugucuaggguugagucaaguuaauuaaaaccaaccugcacaccaugggagugagccugauaaccaagugacagaaggaacagaagcauguguacauuagacagaaggagauacgaggagggacagaacuggauugugagauaggccaucacuacuuagaacagacugaaguuuauaauuuauaagugauuuauuucuaagauaauuccauugaacauuuauaaccugaauagcauugucugaagauucagacaacagggaacucaaguguaggaacugaaaccacaggcaaagaggacagcuauauuugguuucuaguguugcugcuggaauuaaauugcaacaugagucucuucuauguccccuuucccuaauagcaaugacucaaauaaucucacauucacagcaacuucaaagauacuauuauuuaaaaacaacaugagaccuacaaggcucucuucuaguauaguacuauucuucuaauguaauuagguucagagaacauguguguuuguucugucugcaugaauguguggguacccgugcauugggccagaagcauuggguccccuggagcuagaguuaaaggcaguuuugagucucuugauaugggugcuaggaacugaacuugguccugaaagaacaguaaacaauccuaauuccugaggcaucucuccaguuguauauucagcuauuuaagcucuccagauaauucugauguuagucagaguugcuagugcuguagcuauaaaauuauguuaucagcccccauaaaguaccuagugugggcuccuauggugaaacauuacucaguuuucuuuaagacguguaaauggaaagauagucuuuugaacuaaaaaaaaauuuuuuuuuuuuuugguuauuugagacaggguuucucuguauaacccuggcugaccuggaacucacuuuguagaccagguuggccucgaacucaaaaauccgccugccucugccucccgagugcugggaucaaaggcgugcgccaccacgcccggcuugaacuaaaaaugaacguggugucuuaguaacuacauuauuuuacuguguuucagugaguuaacuuuauucauguuuguuggguuuucauuguguaacgaaauauuagguacaggcuggacaugugguucaauauuaaaggaccugccuacguucuauucccagcaugcagaaaacuuaaaccuuuuauuaauuucauacauuuuuuccuuuuguuuuucuuuuucacacaggccaaucaguuggaggagcuuuuuccagugcaaagacagcuaugucuucauggcuaucuacuuucaccacauccaccccucagagucuuccugagccacccaaugggaagcccugaguccagcagagcagcagaagcugcuugguuuucugcgguguaaugcucccuccccgucugcugcucccaggguuucuucuucuauccaaagguccauacccagggaccaagaugauaaacuguuuacauggacgguugcacucuaucuaaaugaaaguugcaguaugcugaauggaugaaauuacaaccguagcggaauagcuuuccagguuggggguuaaaucgacuacuuuuacuucauucugagccuaauuaauguacacaaugaacguuguagugaauuuuaaguucugagacuguacauuuguuuacuuagaagaauuuuuacauauguauauuuuguucuauuuugcuguuuaaauauuuagauggccauuguaauuuauauugacuaaaauuaaguuauauuacuauuucacuaucucugaaguuagcccuaaaauguauuuguaauggguagggacuaugcauuccagucugaguucucuaggguggacuucuaugggaggguuggaggaaaccuucuacccacuuaaacauacuuaccagcucacuucuucccagagcugugaaaguaagaacggaaagcugaggauaagaugucauuuuuuaugaaugucuucuugucacaguuggugugaagcagcaaagaugccccugugcuucuccuauuggcagugcugugcaaggaagcagcaguggugacugagccgcacugaagggcugccgcaugucuggagggcaguacuuugacaacccacaugcuagcucgaucaacuccaguuauguugcugucuuaaucagcacuuuguuaucaaaauuaugugccuuguuucuugugaaugguugucuguuggaucuggauagauccacaggccuucucuuagucuuguucugcauugagcuuuucaaaggcacuugaccucccuacuucccugacuggaaaucuuuagucaggucugcuaccuucuaaagaaaaacaaagugaccaaugaagguuaaauauaaaccaugacuuaguucacauuuagaaaagcaagaaguuggccaaggagaugauuuagugaggaaaagcguuuacugugcaagcaugacaaccugaguccagaucccuggaacccacauaaaaagccacaucuguaaucccagugucccuacaaugaggcgggaacagagucagaguuccucaaaacaauguggaaaggaagaaccaacucuugaaaauuguccucugaccuccauguaggcaaugugucgugcaaauucuuauauucacacacacaaagacaccucaaaugaaagaacaguaagaagcaagaaaaugaauucgcacccaugccaggagucaguuguuugguaaaucaguacaguuggcuucauguuaccacaggcaugaauuugccagccucucauuuaauucauguuggucauguauagcugucauuugccuuucaggggauccugaaugggcauucucagggaguacuuacaggaaacagucuaccuuuucaguaacagaaggcauguagaauaaccauuauaucuacauaugauuaaaaaagcauugggaaaguaagaggcauugauuaucuuucauuuauccucuaggagguucccuaaggacuauaaaaagaagauagggcauaacucaauauuuuuaaaauuuugcaaguuggauuuucacacaaaaccacaaaaauaugaacuacuuuaaguugggcauaauaaguugagagaauccagugacaauaaauuaauugguuaaugggagaaaaccauuaauuuucuuuggccaguaaauauuugaaaagagaagaaacuaaagccacacaaaacugugaaaggcacauuaauguugugcugagacuauuaagaauuccuuguuagauaccauuucauguggcugcagcaugcugauauauccaugguaguugacauugcuaggagcccugccuggguuagcuaauaagguaaugauucauucuuuaguuuguaccagguuuauaugacuugccgaauugccugcuauuacuuaaacaaaagcaaugcagcacugacuuugaaauauacuuggggacaaaauguaacugguuuuguuucacacuccccauuugaguguguaugguuccccuguguauggucucacagucuugccacacaggucucuaaauugccaacuuccucccucuugucucaacugggauuauaggagcacacuacugugccaggcuuaaguguauauuuuaauugaaccuucucuuaauguaguuaaaaacuuaacucuuaaaaugguuacuuaacuggucagccuaaaauaacuuaccuuggaauauaaaacaucuuggaauggucaaaagacuauacuccuacuuccuucagguucuuggaaauguuggcuuuucaagggccauaggccauuuuguugcugggggcaucaccuaaugcagcagccugugucauggagaacaggagauacagccagugagcccagacacgugaagucuguauuuuaggcuccagugagcuagacuaacucggaagaguagucucccuccagugcuggcaugguaguccuuuagucaacaccuggccuuuugacuauugccaggagauguggcuauuggaaaccaugcuuucuccagugauugccagugcucuugugucuuaagaacugaguguuuguaacuagaccugcaggagcgaaagucaaccagcauuuuucagguuuccagcaggcagacauugacaguagcugcacugcuguugagguaguuuugaucguaguguaacgacaaaggcacagauaaggaagagaauacaagcugugagucuggaguagaguagaaauucugaagcugcguguaacaggauguagagcaauuguauauguauaucugauuuauaaccaacaugaauuguccacccccaaguccuucacuagcucucaagccugaaaacaguucucuccuuuugcgguaagaaacaguuggcuuucuugggcagcaaaguagagugcaugacaggacuuccucagucuuucugcuuuucacauuuuguacuaagcaguuaacugauuuuuagaauagcuuucuuuagaaauucaaggaaagcaaauuaggaaaacacaaaugagaagcuauuacauggcugagaaacagggcacuuaagucugaauggagaguauuuugacaucaguauuuaaccuacuaaaggcaugaguuuagacaaguuagaauuguaaucugcuauugacauuucuaagugaagcuauaacauucuuuagcugguaggcagguauuauugaagcuguauauuuuauagagaaaauuuugagggaguuaacagccaguggcucucuuccuuccauguugauaaauuuagaaguccugcggccagcauccugauuuauacccacaggcagugucugcugcagccuccacagagggcagccuguuaggacagaagcugcugccuccugccuguggugcuagcugcaccagccuguucauguguuggggcauugcuuaggaucccugaaacauuugcacacugugguucuuuaaagagaaauggcccagcauucauggcuuuccacaccaucuucugguagccuuuaacuaugacagaaugcuccuugaaucacuugaagaugaccaucauuccucauaaccuaaugugccgguuuucucauccaagucuucugacuucguuagcuuggaauucuuuuuccguaauuuccaacauuccacaaaacuuuuuuuuagagaaaaaaggaucuuguuuuuauuuuuucguacaaaaaacuccauaaaaaugacuuccuaccuacauuaugaagaagaaacuggcugccucguauacuauaacacuccaaaaugaaaagauugugcaugucuaagggguuggauauauuuuguaaaacucuaaauacauuuguauuucugugcuguucagaaauuuaccuuuuuacuuauacuaauuaaagaugcagaaaacuauauauuuaaaucauguauauggaacgcaauuuaagggguuuccaaucguauuuuucaucagcuucccaugcacauaguaugcugcugaaguuucuuuuuugugcaauauaaacauuugaacauuucaagucagguacugagccagaaaaggucauugaaguuuucagagaacugccuaaagcguauuuuauucuguugagauacuguuauuuuauagcugggaaaccaagauugugcauuacauguuucaguccacuugaucauuccuuucuaaauuuagaaagcaugugauuaaugacuugguggagguacuuaaugauuggaaaacaguuuuuaaggaagucaagcuauagcuucucuuuccuccaguggcuuuguaguuugugccgguucauuucuguugucauuuguuuuuuaaaaacauauucaaguuauaaaucaugucuagucauacugaacuguagagcuucuauuguacauuuauuuuaaggaaaaccuaauaauaaaauuauccuguuucucuugcacacgg

SEQ ID NO: 3023 - RNA, 79838 nt, Mus musculus
uuuuuuuuugguuuuucgagacaggguuucucuguauagcccuggcuguccuggaacucacucuguagaccaggcuggccucgaacucagaaauccaccugccucugccucccgagugcugggugggauuaagggcgugcgccaccacgcccggcuauaguuuuaaauuuuuaaauguucaauagaaaacaauuauuuuccaaaccuuaaaauaauaauaacaauaauaauaauaauaauaauaauaauaauaauaauauuuauuguguguaugaugugcuuagaauggguuauggcccauguguagaagucagaagucaguuuugugguguugcuucucuccuucaacauuuacaugaacuagggucuuuauguuuacauuguuagguugcaggcaccuuuacccacuaggccaucucagcacucuaaauuuuugcuuuuggccucuuuucugauaaaguccugguuuguauacauagcuagcucuaauucuugaauaaacuguuucuuuguuuuuguuuucuuguuuuuuuuaccaaacuauuucuuuucuuucuuuauugugcauugacaguaucauacacguauguaaagucuuugggucauuuucaucucucauuacucuuuuucaugcccuccacuccugcugaacccuuucuacucaacaagucuucuauuuucaugguuuugguuuguuuugguuuguuuugguuguuauuguuguugugugacccacugcacaaacauggauggggaaauuagucacuggaacuuuggcaccuuaaugacuacaccacuaaggaaaaugaucuguucccauccccuagcaacuauacuaauaguuccucagaggugugugggaccuuaugacucuccccacgacucucuuguuuuuguuuuuuggggacagaguuucucuguguagcccuugguauccuggaacucagucuguaaaccaagcuagccuggaucucaaaucuaaacucuuauuucuuuuccuuuuuuuccuccaagauuuauuuauuuguuuguuuguuuuguguguaugugugugccugaguguauauguucaccauauguaugcaggugccuguggaauccagaagaggguguuauauuuccuggaauuguaguuacaggcagugugagcuucucaaaguacauguuaggaauugaaacugaacucucugcaagagcaacaaauacucuaaucucugagcucucucuccagccccacucuauauuucccggaaagaaaaagcagaauuauaagacaguuggaacuuuaccagggaaacuggguuuuccuaacaauuuagaaacugacacagaaagaaguuuaagggucacuugauaaaacaaaacaaacaaaaacaaaaccaagagccagauggugguagugacaccuuuagucccagcacucaggagacagagguagauuuaacucugaauucuaggacagccuggucuacagagcaguuucagcaagacuacguagagaaaccuggucucaaaaauuaaaaaaacaaaucaaaccaaaacacacacacacacacacacacacacaccagaaucaacaaguuaaaauuuggcaucugccaggauggagagauggagaagagaaagaaaagaagucaucacuuguuuuuuaacuacauuuuaauuuuauuuuguaugggcauggaaguuuuacuuuuacuaugaagagucacaaccaauuaauggaugcuuagaaagacugagucuucuccagggauaagccccugauggguuaaucauuucaagugcucagcccaaaacacgcgcacacucaugcgcgcacgcaugcacuagcagcaguaaaucgacucagcagguuauauuuauaugaacauuuguguguaugugucuguguguauaacaguaauaaagacaaaauccugagagggaaggacauggaguuggaguggagagagaaggugggaugugggaagccgugcacaaucgccauuacaagauggcacuggcuuccucagugccuaacuaguaaacaagcaaugugcgcaggugcuggaguaaauucgugccaagucacugcccaucccgggguguaauaguggggugaugggugagcagcuaaucaggagcugacaugucacacagagggguauuuaagcagcuccauuuuccggguucggggucuuucugagaaguaagcaauaaagcuuugccguagaaggauccaguuguccgaguguguuuugcuggcgaaauguuacaaggacauucuguaaauacaauacucaugcaugacauuaaaagaacaaaagagcugggcaugguggcauguaacuuuaauuucagcauuuaggaggcugaggcaagcagagcucugauuccaaggccagucugaucuacauaguaaguuccagccagccaagacuacauaggagaugcugucucaaaaauaaaucauagguuuuuuuuuuuuuuaaauagcaaucugacaguuauaccuuauauacuagaacaaauaaaaaucugggaucuauaacuagcaaacuuacuguagaaauauauacauaaaucauuucauaucaaaaagucuaauuucaggcaaauuuuaaaggaaacaaauuggaaauaguucucuccuugcacugugggaguucuggaaaggaaacuccagacaugaugacuuuaacccucugagcuauuucauaggcccugaaaaucaugccuuucaaauuagaguccaauaaaccaggaggguucagcccuggaagucaguaaacagcuauaaauggagguggaggagucuucauagaaaguaaaaaagcaugagcauguguccuuaguguuuuggauucuauccaaggaaaaaauagaaagauagaaaaggaaauguuggcagacuuaguacuacugcuuaauggaaaagcuauaagcagcuuuucgggaguggggcuucugggagaugaguacaugaucucauucagaggaucauuuuccccaucuccauaaugccuucaggagaagcagcuuuccuaaggagaaguaauugacagagaaggcacacaguggggguuagaagaccaguuggggagacacuuaucuccuuccacuacaacgacugcagggauugaauuuuacguuuuuaggagugacugcaaggaccauuacccacuaugcuauuuuacuggcccaggauuaauucuuagagaauaguauguuauguucuaaucuuuggagcauaucagaaugucaugcuuccuccuaggacaaaaggcaugauuaagauuccuuuuuuuuugacccagacacaguagcuuucccuuaaugggccucaacauaguguuuaccuuuucauguauuauuuuaaacucuaaguggcagcugugauguuuccuguuagguaccuaaauaagaauuaacaagguuggaggcuacugaggauggaucccugccucuugcucagcuuuggcccccagauucuguuucuuugguaacuacuagaaaaaggcacccacaugguguucuuacguagaugaaggcaaaacaccuauuuacauaaaauaaagaaaaaaaucacuccuuguuauuuagagcauuguuauuacuuccacuuuuuauaagucagccauugucuucuuuccuccuguuaccacuucauaauaaauauguaaaauaauuagaaucaggguagaucugcccacaugaauugguucuuuaaagagagauacuugaaauuuucuugguuuuagcuuuauccuuuugggggacauaaugcugcaccgugguuuuugauccuuaaauuuuacuuagguuuuagagcgugaucuacuuaguaguagguaauaaucaggauaaguguuucuuauucucuggaagcuuauugcgcguuugagccgagauucuuaccuaaucuucagaccuauuaugaacuacccagaguuaacauuaaaccccaucauuuaagggcuuggauccuuaagacuuauuacaaagccaguuauaggugccaaggucccaggccaccugaacuacuguucaauuuaaccccaaauucaaagguucccacaacccucagcucaaggauagccaaaugaagagagugcucuauaaagcaggauaugaaggagaaaucuggagcauccauuccuucccuucaucuucauguauuuaguaacucaggagcucucugaacuccacuguuaagggauuuaaauuucauuacaugggcgugauuaauuaacacauuggcuauuugcugauugaauucaaucuccagacucucuccuagggucaaaggacaagcuugaaaguuccaucuuccuacucaaggcauggauuuuuuggugacuauccuuuauucuaaagauagcuuaaguauaaguuagcguuuauugggacugauuacaaauaauuuaugacucaggaaguuucaaggguuuuagcaucuuuguugaaggaaucaauaguauuuuuauuaugcccauuugaauaacaacuaguuuauaaagcaguuaaaaaccuccuaauauaacaagaggauugaugaaacaaauaaguaguaguacuguguagcuauuaaaauugugaguguugggcuggcgagauggcucaguggguaagagcacugacugcucuuccaaagguccugaguucaaaucccagcaaccacaugguggcucacaaccauccauaaugagaucugaugcccucuucuggugugucugaagacagcuacaguguacuuacauauaauaaauaaauaaaucuuuaaaaacauuuugaguguugggcuggagagauggcucagcgguuaagagcacugacugcucuuccgaagguccugaguucaaaucccagcaaccacaugguggcucacaaccauccauaaugagaucucaugcccuuuucuggagugucugaagacagcuacaguguacuuacauaugauaaauaaaaauaaaccuaaaaaaaaagaaagaaaaaauugugaguguucauguagaaaggagguuaacuguuuugaaaucaauuagcaaacucaucuaauuuuuaaguacaaguuccaauuguaguaauuuuaccagcaggaaacaagaauucuaaaaacugccaacauaagguaggcagucuacaauuuauggaugaauuguguuuccagaguugcuauuuaaagccuggaccacauuuucccaaagaaacuguguuacagacaccgugaacccaauucuuccugacacggucuuaauuucacuuacagaauucuugaguauguuuagcaccuaaacucuauuuaaacauacucaacucuauuuaaacuuugaguuacaacuagacccuuuaaaucagcugggaauagucuauaaaccuucccaucuuucuccacuucugcuuuugaguuuguugauaaucuucaauagcaucauucaggguuuaagcacaugacaguucaucaguguaagacccuuucuuugaucacuguuuggcuaacauucuuuuucauuuuagguugaauucucuuacccaccacuaauuccaggagauggacaugauagccacacuuuaccugaagaauggaaguacuugccuuuccuugccuuaccagauggugcacauaacuaucaggaagguaugucauuaaaucguagaccaauuacuaagugcaauuuuggaaauuuucucauagcggucgugaauacuuuggauaaaugaaagccuuuggaccuguugugauuacuuauaaaauguguauguguuggaggugagacaugcacaagagaagcuucagagaguacugggccuauuuccuugguuaguaacccucggcucccuccugcccagagcucuuagguauagccagagcagggcugcugcugaugggugugccuucaauuauauuaugcuugagacugaacucaguggcagaaaugaagauuugccugcauuagcuguacauggucuggaaagcucugguuucagacuuacucaaccaucauccucuaaugcccaccuggauacaguggagauuguuucuuuugcucuguagccauugcugcaauccuguacuuuuuucuuuucuuuuuuuucuuuuaguuuuuuugagacaggguuucuuuguguaccccuggcuguccuggaacucacucuggagaccaggcuggccucgaacucagaaauucgccugccucugccucccaagugcugggauuaaaggcgugcaccaccacaccuggccuguacuuucuuacuuacaugagaauguuuguguccucagaaaagaaugugcugacaguuucacugagucuucucccaccauaugggaaugcuuugucacaccugauaaaggacuauucuaccuugguuaaaccagauuaaucaucauuugaguacuuguuuuccuugugcauuauuuaauacuuccuuuauaaaauaaaucagauguuaccaugcaguuuaaauaaguuuuauuacagaauuuguaaccucagaaauguuucucccuaacuuuuuauuauggaugcuuucaaccugguggaaaaauuaaauuaagauuauagggacuauuuugcaaguuuucuuuguuuguacauauugucaguuuuguuacuuuuuauucuaaagucauuuggaauaacgacagacacuugacuucuaaauauuuaaguacaugcacccucuaagaauguaacauuccucagcauccaguuguauuaucauagcuaaacaauuuagcaguaauuucauaauaucucauauccagacuguguucaaauuuccccagucuuuaccaaaauuucuugaguccacucagaaaauuuaagaauucacaugucgccaucaguuuuuaugauugauuuuucuuuagucuggaacagucccuguauauauuuccuguaauuguauagucaauuugaucuguuaucuuugauacucuuagguuuuguggcagacauguacuguaaggauugggaaaaagucugaugucaaaauaaguaucacaugguuccuggauguguugucauguuuguguuaucgacugcauuauaauuugguuguucagcaaugaguaacuaauaucacuacuuacauuuuucuguguaucucuuagauacuguguuuuuucacuugccacccagaaauggaaauggagccacaguauaugguaucucuuguuaucgacaaauugaagccaagguaugaugguugaugaugaacagcagcaggaaaaagcuccuccaaccuguucuuggguguuggucguuuggggaaucacagucuuuagcuuucauguaguacuugugugcauagacaagaagaggguguucgucccauagaguuggagugauagauagucacaacucaccugacauggguucuugaaacagaacugggauccucugccauagcaguguguacuccuaacugcugagucauuguuccagcuacuaauuuguaggcuuuugaggaaucuccauacugguuucuauaauggcuguaacaauuuguauccuuacuagcagugauuagggguuuucuuucuucacauagguaccagcauuuguuaccauuuuuugucaugcauuauuuuuauuagcauauuaaaauuuacauaaugagaacuagugaaagauggaaggcauaaaauuacuuuaaaaauuaaauucaauaguaguuaaauguauagaaauguacaaaaacaaaauguugcagcauuuugguagcauuacuaaugaaaaaaggaaauacauccauaguaaauuugagugucagucccuaaaaccacacuuaacgauggccuucuuuaccucuccugacuaguuuugaagucuacuuuagcaucuaugacuuuagcaacauuaggguuuuuuuuuaagacucccauuuguuugguaguuugauuuccauucugugacucucaguuuuuggaugucugacagguauguuuuucuaggagauagcaaaucuuguuuuuaaauccagucaguuuuuguugguugguucucacuaagugguuggccugguaugugacuuguacauaaagcaguuucaaucagccaguaaauucugggagaguagggauugucccuucacuguucuacccagggccuggcuucugacauucaguacaaggcuggcagguuacacucccucaacuaguaguaucugagauucacugugacauauuuuaaccaaaugcacgauuuuuguuauguucuuacugaaaacuguuuuguaaaugcugcuaugaaguauuucuaauacauaacuguuugcuuauaacaggcauuaaaagugaggcaagccgacaucaccagagagacuguucagaaaagugucuguguuuuaagcaagcugguaagagaccuaaaacuaacuuaccuauuagcauucaaagcagaacuuuuuuugaguaagagaugugugagaauugcuaaaauuaguuaaguacuuacuaauaugcucuuguagccucugcauccagcaacacgcucucauuucuauucugcugaagauucuaagauuagcaaguugacauuugacccaaauaagacaacuguuacauuucauuuaucgauuuuuguuuguuccuaagacuuugaauaacuguucuuuuaacaacuuuaaaagaaaucauaacugcuucaguuuuauugauaauacagaaguucaugacuauugcagugaagaaaguuagccuuaacauguacuuuaaauuuuagaauguuugagaaaagccaaugacaugguaaaacuauacuaaaacagaauuucagaguuguguuucuucuugaugcauagucuucaauuugacauuaacaauugcacauuuaagcacguaugucauuuuuuuauuuguacucuagagaaaggaaaggagugcacauguguaggucaucggacaacauugugguguuacuucucacccucugacuuuaucuguguuccagggaucaaacucaucaaggcucuaucagcggagccaaugccauggccccuauuuuaacauuguuuuuaaacaggguccuauauggcccagguuggccuggaacucuuuguauagcuaagaccuugaacuccugauccucugccuccacuucuagaauuacaugugugugugaaaaauacuccccaguuaauuuguacauguggccaguuauccauaacauaggaauaauaucacauauguaaguagauacaugccgaaaggcuaccagaguagucacccuucaaagggcaauuuugauaacagaaacugaguuuucugugugucugguauuaauucuuaccagacauuuuauauaacauugucauuuuuauuuuccuaacaauguugagauaucuuuguuagucucauuuuacaaauacccauauuuuagaguaacaauaucuaauucucaugugagacuacuaaacauggaaauaggauaaaaaugcaauuuugucauaucuaaaacuaaggaaugaaaauagcuuacuuagaaagguucacuuguucauagugcauuguaguggauaugaaaauguaaugauauuguacuuaaugauaacagucaucuauucaccaggauggauacuaauuacuaauuacuaguucaguauaaauuacuugcauucuaaaagggagaaauaaaugagaaaaugucucaaauguaaauaaaaggguguauaugaucuaucuuagguaggaaaaauaggaauugaagaguaacuuuguucacauauacaaaaagagaaccaaccauccucagauuaugggaaaggaugugagcuuaaaucaaaucaugaguguucaacuugguguaagaaccagacugcuuaagcaugauuaaauguuaccacaauagagugaaaugcaguagccauugacauuguugugucacugugugucaaagacucucuaagugcuuuauguacuccuaaacacagccauagaagcuguaccuuuugguauacagggucagccuggugaggagguaugaagaaguuaaggacauuuaauuaaacaggcugaaagauggagcaauuuugccaagauagcuuucaccugcugccaaagagugggacuaggugauuucacagcuucugguucugaauuugggcccuacaguugguaguuaauaacuuucaucccuaauaucuucaaauuaaaagcuguaggaauuuguuuacugcuguuguucacuauguucaaccuaauaaugguuucucuuuuucuuuagccucuuuauggcuuacuucaagcaaaacuccaacucauuacacaugcauauuuugaagaaaaagauuuuucccaaauuuccauucuaaagguaacuaauuucgauacugauguauuucggugaaugguagcuuaaugagucaaauagcucuuguggcaguucuaugaaggauaguccugauaguuuaagauaaacauugcaugaaaguccauuugcucgggccugagaugguucagugcuuaagagcucuuacagagggcccaagcuugguuccuagcauccacauuggauggcucacaaccaccaagacuaagacugccuacacaguucuuuucuggucaucguauuucuggaaguuuaguggcuaaagugacaguguaaaguucuaaacuuggucugcauuccacaggagcucuaugaacauaugaacaguuccuugggaggggccucauuagaaggaucgcagguguaucuugguaaguaacuugcagggcaagcuuuauuuucaaaguuuucuguugucaaacugaguugcauguaacuguugaugaucagaacuguuaagcauaugugcacuccauugaauauuaaucaacuaauaaauuucacacaaccuuuguaugggaucuaaguucuuaaguuugcuucuuccuuaaauacucagcauucauccugagauggaucauuauuuuauacuggugaugauauucacauguauugcagaggcaaguuucagcuuuuuagaauaguacuggacuucuuuccauuaaugcugaucagcucaauuccaauagaauggugcugcuuagcucuugacugagauucuucaauuugggggugggcguggggggguuguuaauguacacuauugacagcacaaaaaaaaaauccauugucagcugacguagucaauacauacuauuuugugauaaagaguuguaaugauaugguaauuuguguuuccucaguuuccauuucagugugaaguagccaaguugugguuuacuagugcaguuuuagaaagucagcuagauaguccugcucugagacuguauuuauacauuguuuucucuuuuacuauugguguuagagauaugugaauggaaaacauugugauucagaaauaguagauauguaaugcagugaccagaguucacauuuaaaagacuggggcugccauuaugguguaagcuuuaugauuuuuaaauuuaugugguuuauguguguagaauagaaguguuacacccagugucuaaaacuguauccacuaauaguauagacauaacuguaucauauuacaguucauaaaauuuaaaagccacauuuuaagugcucagugaccacauggcuaaugugucugacagguaauauuuuaaacaucuuuauucuuggggaagauuuuguuagacaauacgcuuucugacuauauauguauuucaccaaauauuacauaaaugcuugaauauuuacauauuuucauuugcuguuuuagauauucucuuucacauuuagcucuccuguuugcauuguagguuugucuccucgagaucuuguccuucauuuucgacacaaggugugauagauauccuucaacuugcgauguacugaaaugggagaggcugugcuuguguuccuuuuccuucgaacucagugggcagcaucacaaucagcuggcggcauaauugugguuuugcucuucuaagacagcuucuuaacuauacaaggcuggaggcgacaggaguauuugugugguaaaagucugggaguaccucuugcucaauagaguuggcuuuugauuucuuuauucugcagucuuugcaguuucacuuaguaugguguuucccugaaaguguaauauuuuucuauaugaauuaauucuuuuuguuguugucauuuuggugucagauauuaugguccuuauuguuaaagcguaaguugccaaggacacacacgcacauagucacuuauuuaccaaacuuuuauugacuauguaaaugcauguauccgaaacuagccuugaacucacuguguagcuaaagauagcccugaauuugugacucuccugccucuaccucccagugcugagauuacaaguaugaaccaccaugccuaauuuacauuucuggggaucugaacaccaggcucucacacauuaccaacuaagccauuccccagccucaaaucucugccucuucagaaacuugaaaauuuucaagcagagaugacacuauuccuuccaaaacaaagauuauuucaaucaaagguuaagugauucacaauuuuagagaacauagcuaaugcuuaauuucucaguucaaguucagaguuucucguuucuuaagucguauaauuauuuaauauuguuuauaugauuauauuugaaaaaaugaaauagcaaauuauuaauagaucugaguucuuguuuuaagauaguauuucuuucuuuuucugcaggucuugauccuguuuaagcuaauucuucuugaaaagaaggugagauacagaaggauaaaaggaagaacagguuuuuuauuuuuuauugucauuuuuacauacuauuauaaugugggaauuaaggauuaacuauuaagacauauuuugucuauuaaaugaaacacaaaauuauuuuuuuacugucauacacauacaaaucuguguguucuuuuuggagacaguuugauaguauauugaauuguacugucaccauaaguuuaaacuaacuuacagaaaaggaaauauguuuguucacugagacuucaggguugaugguugacuuggugcuucuaggguaucacaauguuggguuuucuccuuguccuacaguccagcuaguuuuacucagagcugaucucccuuguauacaauaaacugccaacaguaauuuggcuauuugcuuccucagacauaauaccacuucccauaauacuacuuucuaagcuauugaauaugaauuugucccaucaauuuguuaucaaaagucugccuguacuaauuggcuuaaacuuggguuccagaccacuguguacuccaaagagaugggcuugccaugaucauuguggaccucaggucuaauagccuauuccagcuuaccacuuucuuuuauagaaguuuguuguuuuuaagacuuauuuuauuuguauuuauguguauguguauaggugugugcaugugcuuacagguuccuguagaagcugaaaacaggacaucagauacucuaauugugguuacaggguaccuaaugugagugcuaggaauugaacucaggucuuuugcaagagcaauagcuguucuuaacuguugacccauaauaagaguuuuacuggaaaagaggcauaucuacuguuuacuuauuguuuguagcuguuuucacucuuuaggagcagucgcguaguuaaugagagacuauauggcucacaaagcaaauguaucugucccuuuuuuagaaaaaguugaaauuaugcuuuagacuaaucagaagcuagcccugaaauacaaccaguuuuauaucccauauuaacuguauucagugcaccuaaaguaaagggaauauugagggaucagccaugcacuauguucauuauggcuuauuaccuuaagcgaauuguuccuuugccccaguaauucucucaauagagauuuuuuuuuuucacaauuaaucuggguugaaugcaaacuaccggaaagagucauuuaaaaugaguuaaaaaucaguagcuaauuauuuugugugucccauuuaacuccaaacaauaaacauucccaaauacuuuuuauuaucaagauguuucauggcacauuagguucauuuauuuuuaccuaaauagugugaguguuuugccuguauuuguauauauguacuacauguguaccuagugcccccagaguaucagaagaagguaucagauccccuggaacuggaguuauauaagguugugaacugcugugugggugcugggaacugaaccugaucaucugcaaaaucagucaguguuuaucacugagccauuucuccaguccuguguucuauuaacuaugauccuauuuuauaaacaaauacagauucacugaaagaaggccguagaauaaaaaugcagucuguuuucaaguuucccuagauguuuuaaccuccuuuucuuucuuuuuuccuuuuuuugggggggguuggggaguggggcuaggacaggaucuuaaaugugauccaggcuguuugaaaacuuauaguccuguugccucuaacaucugaauccugggauuagaagcauacauuaccacuuguagcuauaauaauguccuugauagcugauuuauuuuucuuuuaguuccuuauguuaauuuuauuugccuagaaauaauguaauuauaauacaccgugugaaguagagaauuuuuuugucaaugaaguguuaaguaucauuguggggacuuaggagaauggaguuuuacucuaauuaggacacuagggguuggggaaguggcucagucaggagagugcuugugaugcaguacaagcaccugagcucagauccccagugcccaugugaaaagacaagcuggcauaggagcacguucugaaagcucugcacuggagaaauagaggcugaaaucugucacuugcuggcuagcccaucuggccagucugugagcuccagauuuaaauuagagacuuuguccuaaaauguaauaagguggagaagcaauuggaaaagacaccugaugccucacuccagcuuccacacacauugagauguguacaugaacacauaaaaaugaacacaaaauaaagauuaaaaacccaggcauaggggcuggcucauaggaaaugacucagcauuuaagagcacuagcuauuuuuucagucauaggguuugauucccaguacccacaugguagcucauaaccaucuauaauuccaguaccagggugucugauguucucuucugccuugcugcaagcacccagcagcacacauuguucaugcagacaaaaccacagaaacuaagauuuaauuuuuaauaauucuggugcucuauuuuaaaaagaaaagaacaaaaagaaacccagacauaguaucacaggcuuguaaucucagcccuuagaaggcuaaagcaggagaauuauggcagguuccagaacagccugggcugcacaguaacuaccugacuuucacacucuuaaauuuuacuuaugguguacuuuagucugcauuuauuucucugauaucucuggccuauuccaucaaucucucucuuuuuuuaagauuuuauuucuuuuauauauguguaaguacacuguugcuguuucaaacaugacagaagaaggcaucggaucucauuacacauaguugugagccaccauguguuugcugggaauugaacucaggaccagucaguguucuuaacugcugagccaucucuccagcccccaucaaucucuuaguaauuuaucuuguauaaaaauuacagauuuaaagaauguugagcuggguuuucaaugucuuuauagaaagauaaugagggugucucuaauuaacuuuauagauaaaaugauaaaauguauaggcaguucuuuuuuaucgaggaaccagucaagaauccuauauuacguuucuaguuccugcuaaugucaaauuacucuauagcacaaugauaguacaucuaacuccaggucaaauuguacuaucaucacuucauacucauuuuuuaaagaucuaucuuauguuuaacuguauguuuuuguguguaucuguguauaugagugcagcuaugcccaaaauccaggagaucuuuggauccucuggaacugauaagcauuuuuggaccaccugaugugggugcugggaccuaacucaggucuucugcuaaaguaguauacuuucuuaaccacuugacuaucuucuuaguccugccgcuuuuucccauuucuucuugaauuucaugacauugggacuuuuuaauugaucuuuaucuguauggguguauguacacuuauacacaggcaugugcaccugugccugcaugcugaggcuagcagaggguaauggguauccucgucuaucaaucacccuauucauuuugagucaggaucucuuuuaaccugggacuauucuuucagauauacaggaaaccagcaggccucagcaaucagcuaggcucugcccaccucagagcugcuauuuacaagcuuguuaugugggggcauuggaaccugcacuucaauccucaugauuggcacuuuuuuaaauuauggaaugcuucaugaauuugcacaucaucuuugcaaggagucauuucucuguuuaguuccaauuuuaguaucugugguguugaagugggugcgauuggcacuuuuaaagagaaucuagucaaguauuacagaauuaaauauaugauuguuuuccugugguuacuuucauuuuaaacauauuuagcaagauacuagaucaaugaugauaugaccucagaaugugacacaacuguaugguucuugguaauaagaauuuugaucauuugguuaagucgacaaacuaccuuaaucaaugauuugugggacaaugaaucuaaauguugugacuauucaguugcccaacaaucucccauggucauuuggugucugucugcaguauuuuuuaaguuacauauuuuuauuuauuaaaaccuuauuauaaagaacuugaaauuuuuuuuuaaaaaaucaugaaauuaaccagacccaaagucugguuaacucaaugugugugugugugugugcgggugcgcuuuugcauucccacagucaccaaagcauauauauauaaagucagaggacaacuauuuauuuauuuauuuauuuauuuauuugcuuugcuuugccuugcauccugauagcagcuucuucuccuucucuuacucccagucuuucccauagauaccaacccuccauggcauaucagauugcagcaggacuaggugcaucuucaacugaggcuauaggagucagucuaguuagggaaaaaggauccaaaggcaggcaguagagucagagacagcucuguuccaguuguuagggauuccacaugaagacuaagcuguacaucugcucaugggcuuuuuaaagucuuauucuuaugcaaagaauccuccccuuauuauuacagccuugugaauuuuguaguuuaauuucauuuucauccauuucagguucuguuuuacauuucuccagugaauagauuggugggugcacuaaugacuguguuaucccuuuuuccagguaagaggauaaccauuacuacuuuugcuuauuguuauugaaauuuugaccuuuuaauaauaaaaguauacaaaaaguaaacucauuaggguuaauauuuccauuuuaauuuuccuuuuggcaauauuuuuuuuuccuuuagccugguuuucuuuccuuauuuuaauuuuaacauuggggagagggaugguguaagccauggcaugcugguggucagaggacaaccugugagaguguaccccccauuguguguugugguauucaaccuagguugucagguuuggcuuggcaacaagcacccuuacccaucuugccagcucccuuuuuguuuguuuguuuguuuguuuguuucaauuuuuuauuagauauuuucuucauuuacauuucaaaugcgaucccgaaaguccccuauacccucccccugcccugcuccccuaccuacccauucccacuucuuggcccugguguuccccuguacuggggcauaugaaguuugcaagaccagggugccucucuucccaaugauggccgacuaggccaucuucuccuacauauacagcuagagacaugagcuuugggaguacugguuuuaguucauauuguuguuccaccuauaggguugcagaccccuucagcuccuuggguacuuucucuagcgccuccauugggggcccuguguuccauccaauagaugacugugaguauccacuucuguauuugccaggcacuggcauagcugucauaacuuacuuuguagaccaggcuagcuucaaacucaagagaacuaccugccuuugccucuuaagugcuuggauuauuuugugugcuaucacacucaacuuucccagcuuuuucuuuuuuuacaaaaaauuucauuuaaaaagaugcaaauacagcuuuugaaaaaauuuuauaggaaauuuccacuauauaaaacaggaacuacaccuuauuuucuuccauauuauuauaagccaagcuguucuucaauauuuuauauuguaggcaugauugagcauggccucagugacuguucucaguauagaccucgaaagaguaugucugaagaugcuggaccucaggaaaguaaucccucugcagaugauuuuacuucugagucuacuucugacgucuuaaauaccagcuuggaaacugucacaagagucauggcaguaaaccauggcgaagaugcugugcccaagacggagaagccuuacuuccaaguagaagguaacaacaacaaaggacaggaacccagugauucuggccgauauuuggaacuuccaccccguccaucuccagagucuucagaaagugacugggaaacguuggauccuagugucuuagaggaugccagcuugaaagaaagggagcagauggggucagaccagacacacuuauuccaaaaggacucucugcccucggacaguccuccaauuacuguacagccucaagcuaauaacaggcaggugguccugauaccagggcucauuucugguuuggaagaagaccaauauggcaugccucuggccaucuuuacaaagguaaaauggacuguccuuuauugaggacauuaauuguaacuuuauguguuuggacacauuuuugggucuuaaaguucuccuugaaaacugggaaauaccuaaugaauaaugcuguuagauaaagauguuggacuuuuaaagaaaaccugaaauauuuuaaagacaaagaauuuuaaaauuacuguguuuauauuguaauuguuaauaugagaucuugggggaugaacaagaaaggaaagguuaugauuaauaagugauauguuugugugagguucacaagggguuaaaugaaccuugacauaccugggaagaagaaaucuuaacugagaaaauaccuccauaagauuggccaagggcaagucuauagggcauuuuccucaucaaauauugauaugagagagccagcccccuaugguuggugccaucucuggguggaugguuuuggguuguuuuaagagcaagcugagcaagccaugggaaauaagccaguaauaacuaaccuuccuccaugauuucuuuucuaauuucacucagugaugaaugugaccugagaguuguaaagugaaauagaccccuucugucccaauuugcuuuuggucaugguauauuaucacagcaauagaagcccuaagaaauauacauacauaugccauguguacuuaguguccaaggaguacuagaucucuguaaaguggagugacagacaguuggaaccuaccauuagugugcaaugagacccagguccccugcaaagcaucagguacuacuagcaguugagucauccuuccaaccccaaauuguaaaauuucuuuaacugccauuguuucugcauguccaagagcacuucuuaccaggaggcaaauggacugaagaagaauuuugguuuugaggaucagauuccucagaguaaucugaaucuuuucaauaaaccauguuaguugcuagauuuaugcgcuuuaugccaguacuaaauaugugauaggcuuaccacuguuacugugauaaauaugugauaggcuuaccacuguuacugugauaaaggagucuuuuuuccccuugguaucaucuuucauuguguguugaguaaaacccaguguguugcuuaaucacauuucuaacuacaaauacugauccuuuaggucaguaacuuuggaagauuagauguucuaaaaaccaaauugucuuuaagcuguuuucccuugggauucuuucacuucauuauuuuuaucuuacauguauaaaguuuggccuguauguauauguaugcauuacagugccugaucaggucagaagagggugucaaauccucuggagcucaggugacagaagguugugagcuaccauguggguacagcuaauagccuguggucuguuuuugguuuugcuuuuguuuuguuuugaggagguuuuguguguguccuggaacucuauuuauagaccaagcuggccucuaauucagagguucuccugccucugccucccaaaugcuggaauuaaaagcaugugccaccaccucccagcuucacccuguacuuucaaucuccuagccaguuccccagcucuuaguauuugaacuuggaugagaaugaugucaugucauccuuacaggccagguuuacuauguaagcccuagagguuacaucagauuguuaauaauuuguaugaccuuuuucugagagcuuauuuaagaaauacacagaaggagcugaagagacagcucagugguuaagagcacugauugcuuuuccagagguccugauuucaauuuucagcaaccacauguggcucacaaccaucuguaaugggaccuggugcccucuucuggugugucugaagacagcaacaguguacucauauagaauauauaaaucuuuuuuuuuuaagaaguaauaaaagggcuaaggaaaugaugagucuagaacuacuauccagcagaacaagagaaauagaaaaaaaauugaaacaaaucauaccuguguacucaugcucugcugccaugcaaaugaguaagcagaggaacacugaaaggggaauggcgugagauaagcugagaaaagagauggaauagcauuuggggugugcaaguccaguauugugggccuuccuucugaucgaguacuggaguugggcacacacuggcauaguuaaguguugggaugacuagaaaggacuggggauccuuuucuguucaauuuccugugucagcuuuccucuccaaucacaagucaguuaggaaaaucaguugauguaccauaaaaacugauuaaaaguuacuuuguuuuaauuucuauaugccaguuuaaaacaagguauuuuaacuagugaaauuuaauuuucucagcuauguaacagugaugacacaugaugacugugacccaacgcuuugguagcugagacaugaggauccugaguuugaagccagcccaagaugagaaucguaucucagaaaauaaaaaaaaaaucacauagcuucucaacuuguaacugaauauauagaauuuauuuuaguauuuggauauuugaaggggauaugaauaauaucccauuauauucuacccuacuuuuuuauuaauucacucaucaacugaucauugccuccaacuuuuggcuacuaugaauacuucagagaauauugauaugcaaauaucucaauaauguuugcuuauaauuuuuauuuuuguaauuucugugucaguguauguuuaccauacacgauaauuauucucuguuuuuuugucuuguucuuuaucaguauauggugccauuucauguauggauguugaguugucuuaguuaagugggaagccaggaguagguuuggauaugaaaucugcuuuuuuggaaaaaauauauucuucuauaaucauauucuggcaccuuccaaagauuuuuaauuaaguugaacaucaugaaaagaaaaguagugacaccauauuaaagcuauuuugaacaguuguaucaauauguaguauuuucacaugguucaguaguaaaaaguccaaagcaccuguaauaaaauuuucuguggccugagaauguacagugcaugccuagcauacacacagcacuggauucaacccagaaccaagaagaaauguuuccuaauccaucucuucuacccuucugccuucucugauagcugugaacaucgccagugucuaucuuuuuauagccuaaggaaaugcauaggcuuuccccuaucccuuuuacacaaaugauagcaguccgaacccaucuuuaucuaucccuugaucacauuuacauuucugagaauugaacuucaucacuacaggguuucucuguguagcccuggcuguccuggaacucacucuguagaucaggcuggccucgaacucagaaauccaccugacucugccucccaagugcugggauuauaggcgugcaacaccacucccagcacaucagcacuuucuauaguuuuagaauaugccauuauauggcuagaaauauaucuacuccaguuuuuacgaaguuauaaauaaaaagugcuauguuaaauaauuuaaaaauacacuaacagaugagcaggcauaucugugagauaaauuuagguaaagaguguguguguguguucucaagccaagguucuuuuuacguagccccguugaaauauucacaggaaaauagaaacaguuacugaaagauucugaaucagcauagguuuucaguaagugugauguuuuauguacaaccugaggcuacaaacagaucagagauucaacagcucuguccugccuuuaugcacaaaucuuuaccacugaccacacccucaacucuggggauugggcuggguugggcuugcuuuuuuugguugauugguuugcagaauuaaaugccuauugaggauuagugauucagcuguaauuuuaagucagugcuuuuucaaauagaaauuaaagagauacugccaauguaacuuuugcuuuaacuaauuuguagcaaauauuuugacauaucuuuguauugugucuaacaguaaacuagauguuuuucucuucucauugcaccuagauggcugugcaugcucuacaauucuuaacugcuuucuaguagacaacauacuuuuuaauggauauaauauauuuaauucccuaaauuaaaaaggaagucagacuuuaaauuggaccaaaaaugaagggauuaaguaagauagccuugcagagguuugaccauuugagaagagaauuagcuaaccacucacuggacuuuacugcagucaaggcaaggcauugcucuaugugaauauuauuuuaaugagucagagauuaaaugggcaggcagggaagaauggacaauuuuuucaugaaaagaggaguggcuuauuuuauuuuucacguuucuguuauuuucuguugcucuuguaauccauagggauaucuguguuugccuuacauggcauugcagcagcaucaucuucucucugaugucacuguucggggauuuguggcuggagcuacuaacauccuuuuccgacaacagaagcaccucagugaugccauuguggaaguacguuuaugucugagucuaugaacuuggccugcuggcucacuauuccuuuccuaaauauaauuaugaacuuauuguaacagcauuaauaagaaaaauaaugucuacuauauucuagucauuuuaauuuauuuguuuguuuauuuauuuauuuauuuauuuauuucguuggguuggguuuuguuuugcuuuguuuuuuguuuguuuguuuguuuuuuguuuguuuugguuuuucgagacaggguuucucuguauagcccuggcuguccuggaacucacuuuguagaccaggcuggccucggacucagaaauccgccugccucugccucccgagugcugggauuaaaggcguguaccaccacgcccggcuugcuuuguuuuugagacagggucucuauguaccccugacuuuccuggaacuuacuuuguagaccaggcuugucuugaacucagagauccaccugccucuuccucccaaguauuaaaggaauuaaaggcauaccucacuauaaaccacuuuauauuuauuaacugaucucauuuuccuaacagcccucuaagauacauacuaucuacauuuuggauauacauaagcugagggucacaaguaagggugauugucccauuaucaaacaacugauaaaugcuugagcaaggauuccagccugagcaaagcaugccuaucauggucucaaugccuuauuaaaauguggaauuuuuucagaauaauuuauacacauauccugcuuaauauguuccugauguuaaagaacuucauagcaguuauucaauacugugucaguauauuuaaauuuuuaaauuauucauuuaauuucacaguugaaaaauacugggauucuuuuuaaugcacugauguuuuuauaauuacugacagauuuauuaucauccccaauauaagugagggagaaacuuuauaccagauaggaggguacaggugggagaagcauaaagugcuuuagcguucacaaguugauugauugauguuuuauuaauucacucuacaacuaaccuuuggggaugaguugacuuguacagcaguugcuaaguauguguaagggcccaacuauaauuaccagcagcuaaagaacaaaacaaaaccuugccaguuagguagguagguauguauacaguauauacaguauguuuguguguguguguauacaauauuaaaaauauuucaaagugugcaugcccucaaaauggaaaaauuugaaggaauuauaacuaaguuuauuuuuuucauguuaauauaaggacaaguuuuauuguguauguaucuauauuuuccaaagcaauuauauaaucaaagauuuuagaagcauaauuacuuuuauaguucaaagucauguucuuaguugcacauauuuuuucuguaagucuuuucuuaagacuuauuuauaugugugcuuauuuugccugcaugcauauauguguguguacugugugcacacacaguaaccauggacaucagaagagggugcaagauccccuggaacugaauggauacaagcaaccauaugaggcugugaagcaaacguagaucaucuccaagaguagcaagugcucuuaaucacuaagucagcuauccuccucuaccuauaauuucuaaaauuagaacaggcacuuuauuccauaaaaagagaaaguauacagaaaccgcaguguacacaccugccucuuucuuagauucauccuuugagaauauguuauucauauuuuuuaguuccaguuccccagugguuccuuuuuauaacaugacauggaaaucugugucccaacucugacuuguaccugggcacucuucuagguggaagaagcacugauccagauccacgauccagaacuuaggaagcugcuuaacccaacgacggcugaccuaagguucgcagacuaccuggugaggcacgugacugagaaccgggacgaugucuuccuggauggcaccggcugggaggguggugacgaauggauccgggcccaguuugcagucuacauccacgcucuccuggcugcuacacugcaguuagguaagaaucacucagccggagcuggagagauggcucagugguuaaaagcaccgacugcucuucugaagguccugaguucaaaucccagcaaccacaugguggcucacaaccauugguaaugagauuuaacaucuucuucugguacaucugaagaccgcuacaguguacuuagauauaauaauaaauaaaucuuuaaaaaagaggaagcacucagccacaauucuucuuauaaaccuucauguucuaauuuuuauggauguuuugaguugcguuagaaaaucacugguacccauacagacauaaugaugacucugacauuuugaguacuuuauauguuuccaaaccuuuuucuuuacauauguuuuagacuuugauuuuaugguuugggauagucuuuacaguagugacucuauuugaacauguggucugaccauuacucuuucuuucuuuuuguuuuuuuguuuugguuugguuuggguuuugguuuugguuuuuuucaagacaggguuucuguguagcccugucuguccuggaacucacucuguagaccaggcuggccucaaacucagaaaucugacugccucugccucccaagugcugggauuaaaggccugacuuuuuuuuuuuuuuuuuuuuuuauccucuuuaugauaaaaauguuaagacaguauugauuguuuucacuucaguuuggcugcugauuacuuuguaucaaaggaaaugucaguauuugguaacuuuauaaaagcugcuuacauauuuucaaguuauuaaaaaauguaaaggaaccauugcaaauuauauucugagugauuagaccuucaaaguuuuauccuauucuaaaaaauauuauuuuuccuguuaaaugauuuaaauggggcaggugaaaauacauuucugguuaaaacuacuucauucuacuuagaaaacaguaugaacuagaaguggagcuuugcaauaagcauuucuaccuuggaacucuggcaaauacuuguagacuuguagcaaaaauagauuucagaauaauuuuugguugucauuacugaaaaaauacauugcuuuuuuuuuuuuuuaaacagcaaugaaauauguacgauaugcaguuuacuuucuuguaauagucuauaaacgugcacgucugcaguauugugcagcuuauuugcauuuuugugucagcagggauuuuuuuuuuuuuguuuucaaaucacuauuaucauuuccgccugccaggguagucugaaaucuagauuucagggauguuuucauuauaaagaaaaaguaaugaucauguccucacuuauuuguuggauauuuuuaaaugucuaucauuucuacaaauauaucauuagaggcaucaaaauuaaaucucguaacccaaaauuacuaaucuuaaaaagaaagccagauaucugcuaguuauuuggccucaugaauaaucaauucuuuguuuucaagacaggcuuuuucuguguagcccuggcugucguggaacuuguucuguacagaccaggcuggccucaaacucagagaucuaccugccucugccuccuaaguacugggguuaaaagcauguacuauaauuguccaacauucaacuuuaaaaauuaauacaugcaaggcauguucugaacacuuuacagcuaguaauaauuuuggcuuuaauaauaaucccagaaauuacaauuuacagagaacaggaaacaaguauugaguuacagaguacuguaacuuggucaucuaucugggugagaggcuugagcagucugguucagaagcccauucuuacacgugaccagcagagagggcugugcugcaggggaaguguaccuuauugcuguaaauggaacuaugugucuccugguccuuuccuagcaacaaaaagcuacuggcauuucaccuuaaaagcauagaauauagccagacaugguggcauagaccucagauaccaucugccuggacagaaggaagucaagacagaagagucacaagaguucaaagccaaccugagugcauagcaagacuuuguaucaaaaacaaaauagcauaccuucauguguaguaaaugugaggcaauagcuucuugaaucaguuccccagaccuauucuguccuuccaagcaaaaggaauguucguggacccuuccccaugguaucaauauaacaaagagcuacuuggcauuaaugugaagauccuauguuguuguaaguauuuuugauaguacagugcuucaauaauuuaagaaugaagcaccaaauacugagacaaaguccaaacaaagaaaacauagguaaaagaaguagucuacuugcuuguucuuaaccucuuuuaacauuaaggagauucuaacucucaucauaugcuuaagccaauaugucugcucccugccauguguguacuuuuuauuuaauaaauaauauaauccuuguaacagaaaggaaaacguggaaacauuuuggcauagagagccuugggcaauguuuggcucaguccucuuauuucccaguuaagaaaaugaaguucugaaugauuaagugauuugccaagggcuucaaggcuucuuaacaggguuucugggacuagagccaaauuugcuuacaucuaggcaauuuccccacaauguggcugugggacuuaaaaacauaaagggacuuucacacuuuaugguuauuaaucuucaugcccagauggcuaugauccagcuuagcuuucuucaaccauuuucuuggcagauaaugaaaagauguuaucagacuauggaacaacuuuuguugccgccuggaagaauacucacaacuacaggguauggaacagcaauaagcauccggcacuuucagagauaaauccaaaguaagcauauccucuagacguggugggauggaaaaugguugcuuuacaaagaaagccugucguuauugaaagagacagucuuaguauacagccccugccuagccuggaacucacuguguagaucaggcuggccucaaacugagaaccaccugccucugccuuuccagugcuuggauuaaagguuuacuaccacuccuugcuuaaauacuauuuuuaaugauacaagcauaaauuacauaaauuggcuauuuuuauuguacuuugaacuuuuauuucuugguaaaaauggacaaagucaauuuuguauucagcaccguguuauugugggagcuauuguuuauuguuuuuagcuaaaguagaagugcaauuuaagugauuaaacacacacuuucuuuuuuuuuuuuuuuuccauuuuuuauuagguauuuaacucauuuacauuuccaaugcuauaccaaaagucccccauauccacccacccccacuccccugcccacccacuccccccuuuuggcccugguguuccccuguacuggggcauauaaaguuugcaaguccaaugggccucucuucccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcccuaugauccauccauuagcugacugugagcauccacuucuguguuugcuaggccccggcauagucucacaagagacagcuacaucuggguccuuucaauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccaaaucuaaggaggggcauaguguccacacuucagucuucauucuucuugaguuucauguguuuagcaaauuauaucuuauguauccuagguuuggggcuaauauccacuuaucagugaauacauauugugcgaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguuguacaagccugcauucccaccaacaauggaggaguguuccucuuucuccacauccacgccagcaucugcugucaccugaauuuuugauccuagccauucugacuggugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucaauucucgaucuuacagcacaagccauugcuguucuguucaggaauuuuuccccugugcccauaucuucaaggcuuuuucccacuuucuccucuauaaguuucagugucucugguuuuaugugaaguuccuugauccacuuagauuugaccuuaguacaaggagauaaguauggaucaauucgcauucuucuacacgauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaucacaauugcucuguaguaaagcuuuaggucaggcauggugauuccgccagaaguucuuuuauccuugagaagacuuuuugcuauccuagguuuuuuguuauuccagacaaauuugcaaauugcuccuuccaauucguugaagaauugaguuggaauuuugauggggauugcauugaaucuguagauugcuuuuggcaagauagccauuuuuacaauguugauccugccaauccaugagcaugggagaucuuuccaucuucugagaucuuccuuaauuucuuucuucagagauuugaaguuuuuaucauacagauuuuucacuuccuuaguuagagucacgccaagauauuuuauauuauuugugacuauugagaaggguguuguuucccuaauuucuuucucagccuguuuauucuuuguauagagaaaggccauugacuuguuugaguuuauuuuauauccagcuacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuugauggaucuuucugugguuuagguaucagaguaauaguggcuucauaaaaugaguuggguagauuaccuucuacuucuauuuugugaaauaguuugugcagaauuggaauuagaucuucuuugaaggucugauagaacucugcacuaaacccaucugguccugggcuuuuuuugguugggagacuauuaauaacugcuucuauuucuuuuggugauaugggacuguuuagauggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcugucuccccuuucuucuuggaggcacucagagcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugauaggauacaugggacaauuucuauauuuuuguaucuauugaggccuguuuugugaccaauuauauggucaauuuuggagaaggucccgugaggugcugagaagaagguaucuccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaaugaauguggcugcccuugcauuuggugcguagauauucagaauugagaguuccucuuggaggauuuuaccuuugaugaguaugaagugucccuccuugucuuuuuugauaacuuuggguuggaagucgauuuuauccgauauuaaaauggcuacuccagcuuguuucuucaguccauuugcuuggaaaauuguuuuccagccuuucacucugagguagaaacacacacuuucugauguacacauuaaacaauauaaacuucuagaugcauuugguagggaacaugguuucagaacauuuugguggacuagucuauuauuaucuuuauauuaucucucaaagaaaaugauaggcucaacucuaacuucgguggauuuuuuuggcuauggcaaaacuauauugccaccugaauguauuaaaaacaauuaaaaaguagacuacauuuuaaugcuaguaaaugaaagaacuaagaguucaaaauagucugccucaccaguugcagggucugggugcugaggcauacaaaggaaaugugagcugguuugccagggacacgugaaguggcucuucuuauaagcuaggucacccuaauuagucaacucuccaauaugugaagcugucucaaucauugcaccugaggcuguuaaccugaaccaacucugcggaucuuaaugcuaguacauagguugagcuaggcugggcuuuaaaaauagguacgaaaaaauauauaaagaaacuaaaguuauggggguugaaaugcagacuggaaagcacucauaacuaagugugauagcacaugccugaaaucucacacucaagaggcuaaaguuggagaaauguaaguuugaaggccaaaacaaaaaccaaauaaacaaagaggacaccaguagauauauauacuaacauggaagaaggaaaucucauggggcuucguaggcagcuaaggaauacagagcccagaggaaacaggagagaaaaagucugucuagggaagagcccucaaauuguggucagcccugaaaucauacacauacagguaacauuauacauuauaaagacugguaaggugugugugugugaguguguauaacaacaauuaaagaaauagacgucaugaauuugagagagcaaagugaguuacguuguaagguuuggagggaagaaagaaaagaggaaaaacaaugcaauuauauuuuaauuucaaaaauaaauguuuauaaaaguacauauagaaaaaaagacacuuugcuuuuacauuuuuaaaacaaaaaggggagaagaucaaggaugaagaggcccauuagaguaguaauuaggaaaucaugaugaucaguagauuuuaaacauuuucaccagauuaaaaauaagaaaugaaaaaaaaaaaaaaagaacgauggucuucauuaucaggaaguguaauuugaaacauuccaaacuaauuaccuugaaaucugccugauacuuuuuagcuucuaaagaggaaucucuaaauuaccaagcauaauguauaauguucccccauccuggaaucacgcuguuuggggaauaggagaaaugacugaugagggacguuuuugugauguugcaauguuugauacugaaccuggggcuuugcacauguuaggcagcuacaagcacagcacguuuguaugaucugucagcuuaguucugugauccauaaaaggaagaacuggucuauaugcuugcuuugacccagagcacuuuuacugucauuugacaaaacuauagcauuauauauucauagcuauagcauaaguagcuauggauuucucuuucuccauaacacaggauagaguaacccugaguuuaagacaagacuuguuuauugaccuuucucuuucagucuuaacuaugcuuauuaagucauuuguuugguugauuuugguuuugauuuuaauaaaauguuuuuccuuugguguggcagaaauucucacaaaacuacagugccaauuuguuuuacauuuugaguugcuuuuauaauaaacaacagauuuugcugauuuacuagcaaauuuuuauggccaaugacauauauuuacagggugaccaggaucaagguaaaguugugacaguggccuaaauuagcuccucaccuaauuuccugauguauuuuuaaguugggcuaaugcuuggucccuaccccagaugaaguaauuccugucagaacaguguuagcacuucuguccccaguacacacauguccauuucuagccacauucauuuacugcacaaggaaagaagauagaacccaaaacuguugagucacuuggagaggucauauuuggaaugaugcauguguccccacugucaguuuuagagcacuauguccucuugugucucccaaaaaguuaacuaacaguucaugugacugcauuuugcaccauuauugauguauucauaauauaaauuuaaacuuuguuuuacagccauccuuuucaaggccaguacuccgugucagacaugaaacucagauucucacagugaguacuuagagaaaauaaggggaaauuauucugagucuaugccauauguugccaaauagguauuauguuuacuugauagauuaguguugcaaauaguaacccaguguguuuaacauucuguagcucaacagcauguauuucaaaauaaaaacucugucuauacacaauaguaugagauaacaggacuugccauucuuauuuugaugauauccucucagaaaucauaucugucaagaagauuuagccauaaaucuuucuguucucaccucagcucauuucuguguucuuucaaauacauucaaguauuuauucauaauaauuuugcuuuuuauuuucuuaugauaauagaaugguuugguugugggcauucucaaauguuugauauuuuuaaaaauuguauuucuuuuuuuuuuuaguucuguucagaauagugaacguggcaaaaaaauuggcagugucauggucacaaccagccggaaugugguacaaacaggaaaagccguugguaaggcacacccucagcuggagcugcuugucauauguauccauuuucugucuucaguguggaauucauuacaauaaaguuauagagauuucuggaucacauaacaauacaagggggcuuuuagagacacuacagauaaccaggauuagacuacagauaguaaaaucagaauagcuuuagaucugugaagaacuuaaaaccuggugcaggguuucuaauuuaaccaacaucuauguuggcuuggcucuugaguucuuuucuccucuucuuccucucuuuucucucucacucucugucuuccuuucuuuuauucaacccccuacuuuuguuugucaagacagugucuagcuuuguagucuagauuaaccucaaacuccagauucuccugauucaacaucccaagugcugagauuacaaacuucucauugaaauucuauuagauauuuaaggaagaaauaacauaaauugaauacaaaccuuucauaaaguagugaauaagauaauacuuuccaacucacuuuaugaggccaguauuaaccagauacccaaagcuagguaaaucauugcaugaacauauauucugugccuagcauuuuuucacucaaaauuuuuugaggauuauucuauguugugucggaauaaauaucuuauuucuucccacccccaccccuuuuguuuguuuguuguugaagccccagcuaaccuggaacuuacuauauagaccaaacuggccuugaaaucaaaaucugccugccucuaccuccuaaguacuggaaaaaaaggugugcaccaccauugauccaauuucaaacuuagaaacuauauuaguuacuguucuuauuacuuugaccauaucugacaggaacaacucaaggaagaacuuugcuuuggcuuaugguuuaaagggcacaguuuaucaggucagcaagucaugaugcaauucauaacagugugagcauguugcugcugaugcuccuuauguccuaguagaucaggaagcagagagcuggagcuggaaauagauacaacuucagacgccaauguaacacuucacuucuacuggaccacaggucccaaaguuccuuaaccucccacagcaguaccaccaugcagagacaaaguauucaaacaaaugagcccaugcgggacauuuucuguuacccuuaacagaaauaacuguuaacucuuauugaacagaacucagaagccccaguagaagaaugccucauaauggucuuuguaacuaacauuccuuacaccuauagaaaguuggugaaaggacacucuggacuccuuuuaaaagacacagaacacauagcccuacuuaggaucauuuuauugccagaggaaugaaauuugauauauauguuucuauauaguuauaguggauucuuauauuuaauagaaaaaguuagcuucuuugaagacauauacaucacuauaguagcaccccccccauccaaaagagauuauucaaagaaucacagaggauaccuaaaacuauauacacgccauguuuuuuucuugcauaucaaccuuugauaaaacauuaacauguaaauuaaccacugaaauuaacagcaauaauagaaugagagaguuauaacaguagauuuuaguaaaaguuauaugaauauauucugucgcucaaaauuuuuuuacuuuuuuuguuuaaagaaaucacuuuacagcucuucuuuggcauguucaaguugccagcuccacagcccuugccuuuaggguuacuggaacauagacacugcgcuaccagguaucuucguuagggcuauugcugugauaauuacuaccaaaagcaacuuggaguugaagggauuuguuuggcuuacauguccuaggacaguucauugagagaaacaaaggcaggaacugaugcggagaccauggcggaacacuacuuacugguuugcucagggcuuuugcucagccucuuuucuuacaccaucaagaccacuuaaccacugugggcugaaucguccuauacuaaucauuaaucaagacaaugcccuauaaauuuaccuacauaccaaucuguuaguagcauuuucccaauuaagauucccucuuuccagauuugucuaggguugagucaaguuaauuaaaaccaaccugcacaccaugggagugagccugauaaccaagugacagaaggaacagaagcauguguacauuagacagaaggagauacgaggagggacagaacuggauugugagauaggccaucacuacuuagaacagacugaaguuuauaauuuauaagugauuuauuucuaagauaauuccauugaacauuuauaaccugaauagcauugucugaagauucagacaacagggaacucaaguguaggaacugaaaccacaggcaaagaggacagcuauauuugguuucuaguguugcugcuggaauuaaauugcaacaugagucucuucuauguccccuuucccuaauagcaaugacucaaauaaucucacauucacagcaacuucaaagauacuauuauuuaaaaacaacaugagaccuacaaggcucucuucuaguauaguacuauucuucuaauguaauuagguucagagaacauguguguuuguucugucugcaugaauguguggguacccgugcauugggccagaagcauuggguccccuggagcuagaguuaaaggcaguuuugagucucuugauaugggugcuaggaacugaacuugguccugaaagaacaguaaacaauccuaauuccugaggcaucucuccaguuguauauucagcuauuuaagcucuccagauaauucugauguuagucagaguugcuagugcuguagcuauaaaauuauguuaucagcccccauaaaguaccuagugugggcuccuauggugaaacauuacucaguuuucuuuaagacguguaaauggaaagauagucuuuugaacuaaaaaaaaauuuuuuuuuuuuuugguuauuugagacaggguuucucuguauaacccuggcugaccuggaacucacuuuguagaccagguuggccucgaacucaaaaauccgccugccucugccucccgagugcugggaucaaaggcgugcgccaccacgcccggcuugaacuaaaaaugaacguggugucuuaguaacuacauuauuuuacuguguuucagugaguuaacuuuauucauguuuguuggguuuucauuguguaacgaaauauuagguacaggcuggacaugugguucaauauuaaaggaccugccuacguucuauucccagcaugcagaaaacuuaaaccuuuuauuaauuucauacauuuuuuccuuuuguuuuucuuuuucacacaggccaaucaguuggaggagcuuuuuccagugcaaagacagcuaugucuucauggcuaucuacuuucaccacauccaccccucagagucuuccugagccacccaaugggaagcccugaguccagcagagcagcagaagcugcuugguuuucugcgguguaaugcucccuccccgucugcugcucccaggguuucuucuucuauccaaagguccauacccagggaccaagaugauaaacuguuuacauggacgguugcacucuaucuaaaugaaaguugcaguaugcugaauggaugaaauuacaaccguagcggaauagcuuuccagguuggggguuaaaucgacuacuuuuacuucauucugagccuaauuaauguacacaaugaacguuguagugaauuuuaaguucugagacuguacauuuguuuacuuagaagaauuuuuacauauguauauuuuguucuauuuugcuguuuaaauauuuagauggccauuguaauuuauauugacuaaaauuaaguuauauuacuauuucacuaucucugaaguuagcccuaaaauguauuuguaauggguagggacuaugcauuccagucugaguucucuaggguggacuucuaugggaggguuggaggaaaccuucuacccacuuaaacauacuuaccagcucacuucuucccagagcugugaaaguaagaacggaaagcugaggauaagaugucauuuuuuaugaaugucuucuugucacaguuggugugaagcagcaaagaugccccugugcuucuccuauuggcagugcugugcaaggaagcagcaguggugacugagccgcacugaagggcugccgcaugucuggagggcaguacuuugacaacccacaugcuagcucgaucaacuccaguuauguugcugucuuaaucagcacuuuguuaucaaaauuaugugccuuguuucuugugaaugguugucuguuggaucuggauagauccacaggccuucucuuagucuuguucugcauugagcuuuucaaaggcacuugaccucccuacuucccugacuggaaaucuuuagucaggucugcuaccuucuaaagaaaaacaaagugaccaaugaagguuaaauauaaaccaugacuuaguucacauuuagaaaagcaagaaguuggccaaggagaugauuuagugaggaaaagcguuuacugugcaagcaugacaaccugaguccagaucccuggaacccacauaaaaagccacaucuguaaucccagugucccuacaaugaggcgggaacagagucagaguuccucaaaacaauguggaaaggaagaaccaacucuugaaaauuguccucugaccuccauguaggcaaugugucgugcaaauucuuauauucacacacacaaagacaccucaaaugaaagaacaguaagaagcaagaaaaugaauucgcacccaugccaggagucaguuguuugguaaaucaguacaguuggcuucauguuaccacaggcaugaauuugccagccucucauuuaauucauguuggucauguauagcugucauuugccuuucaggggauccugaaugggcauucucagggaguacuuacaggaaacagucuaccuuuucaguaacagaaggcauguagaauaaccauuauaucuacauaugauuaaaaaagcauugggaaaguaagaggcauugauuaucuuucauuuauccucuaggagguucccuaaggacuauaaaaagaagauagggcauaacucaauauuuuuaaaauuuugcaaguuggauuuucacacaaaaccacaaaaauaugaacuacuuuaaguugggcauaauaaguugagagaauccagugacaauaaauuaauugguuaaugggagaaaaccauuaauuuucuuuggccaguaaauauuugaaaagagaagaaacuaaagccacacaaaacugugaaaggcacauuaauguugugcugagacuauuaagaauuccuuguuagauaccauuucauguggcugcagcaugcugauauauccaugguaguugacauugcuaggagcccugccuggguuagcuaauaagguaaugauucauucuuuaguuuguaccagguuuauaugacuugccgaauugccugcuauuacuuaaacaaaagcaaugcagcacugacuuugaaauauacuuggggacaaaauguaacugguuuuguuucacacuccccauuugaguguguaugguuccccuguguauggucucacagucuugccacacaggucucuaaauugccaacuuccucccucuugucucaacugggauuauaggagcacacuacugugccaggcuuaaguguauauuuuaauugaaccuucucuuaauguaguuaaaaacuuaacucuuaaaaugguuacuuaacuggucagccuaaaauaacuuaccuuggaauauaaaacaucuuggaauggucaaaagacuauacuccuacuuccuucagguucuuggaaauguuggcuuuucaagggccauaggccauuuuguugcugggggcaucaccuaaugcagcagccugugucauggagaacaggagauacagccagugagcccagacacgugaagucuguauuuuaggcuccagugagcuagacuaacucggaagaguagucucccuccagugcuggcaugguaguccuuuagucaacaccuggccuuuugacuauugccaggagauguggcuauuggaaaccaugcuuucuccagugauugccagugcucuugugucuuaagaacugaguguuuguaacuagaccugcaggagcgaaagucaaccagcauuuuucagguuuccagcaggcagacauugacaguagcugcacugcuguugagguaguuuugaucguaguguaacgacaaaggcacagauaaggaagagaauacaagcugugagucuggaguagaguagaaauucugaagcugcguguaacaggauguagagcaauuguauauguauaucugauuuauaaccaacaugaauuguccacccccaaguccuucacuagcucucaagccugaaaacaguucucuccuuuugcgguaagaaacaguuggcuuucuugggcagcaaaguagagugcaugacaggacuuccucagucuuucugcuuuucacauuuuguacuaagcaguuaacugauuuuuagaauagcuuucuuuagaaauucaaggaaagcaaauuaggaaaacacaaaugagaagcuauuacauggcugagaaacagggcacuuaagucugaauggagaguauuuugacaucaguauuuaaccuacuaaaggcaugaguuuagacaaguuagaauuguaaucugcuauugacauuucuaagugaagcuauaacauucuuuagcugguaggcagguauuauugaagcuguauauuuuauagagaaaauuuugagggaguuaacagccaguggcucucuuccuuccauguugauaaauuuagaaguccugcggccagcauccugauuuauacccacaggcagugucugcugcagccuccacagagggcagccuguuaggacagaagcugcugccuccugccuguggugcuagcugcaccagccuguucauguguuggggcauugcuuaggaucccugaaacauuugcacacugugguucuuuaaagagaaauggcccagcauucauggcuuuccacaccaucuucugguagccuuuaacuaugacagaaugcuccuugaaucacuugaagaugaccaucauuccucauaaccuaaugugccgguuuucucauccaagucuucugacuucguuagcuuggaauucuuuuuccguaauuuccaacauuccacaaaacuuuuuuuuagagaaaaaaggaucuuguuuuuauuuuuucguacaaaaaacuccauaaaaaugacuuccuaccuacauuaugaagaagaaacuggcugccucguauacuauaacacuccaaaaugaaaagauugugcaugucuaagggguuggauauauuuuguaaaacucuaaauacauuuguauuucugugcuguucagaaauuuaccuuuuuacuuauacuaauuaaagaugcagaaaacuauauauuuaaaucauguauauggaacgcaauuuaagggguuuccaaucguauuuuucaucagcuucccaugcacauaguaugcugcugaaguuucuuuuuugugcaauauaaacauuugaacauuucaagucagguacugagccagaaaaggucauugaaguuuucagagaacugccuaaagcguauuuuauucuguugagauacuguuauuuuauagcugggaaaccaagauugugcauuacauguuucaguccacuugaucauuccuuucuaaauuuagaaagcaugugauuaaugacuugguggagguacuuaaugauuggaaaacaguuuuuaaggaagucaagcuauagcuucucuuuccuccaguggcuuuguaguuugugccgguucauuucuguugucauuuguuuuuuaaaaacauauucaaguuauaaaucaugucuagucauacugaacuguagagcuucuauuguacauuuauuuuaaggaaaaccuaauaauaaaauuauccuguuucucuugcacacgggcuauugaucuccuagacuuaacugcguguugucugugugaucucuggccuucacaacugggcaacagugcauucuucauuugucaagaaagcagcgcaugggugagcugaaggacuacacauccaguuuagcuuccuccugauacugcuuaucaccauacgcuuucuagcuaugaccucuucggaaagagcuuuauguagcgucuggggaacucugaggaaugcugcgcaaguacuaaggauauuggucauguaaucacucauggacagggccagggaaggagaaaacugcacucccgccauccauuucuccacuuggacugguaagguucaaaauaauacacugaggauuccagguaugugugcugugcaccauggcuccauuacaacuuguuuauggaauaagaagauaaaugucccuuuccugggguugugugaguguggccuuuaaguuguuuagcacuaaggaaggugaucuagauuuaaaaggauauuuuuucagaugacaauacaaguuaaaauuaaaaccauucagguagaaaauuauaaacuccuuaagauagaauagauguuauaauauuguaguaaauuauucagauugugaauuucuuuuaaacuuuccaaccacacacacacacagacgcacacaugugucaaaauaauuauugucuguaauaaacuucaucaaaacgaguucuggcuuuuuaguacucugaguauauuuaacuuuaaugcauuaauaauaauaaaagacuuuuaugccuuaaaaaaauaauguacuaaauugaaaaaauugauggacuggauguuguuaguguauaucuuaccuuauaauuuacauaacuguuauaacuguucaauguaugugagagagaaaaggccuuuuuaauagaugaaaaauggugaauuguuguaaauugguucuaaugcuaagucacggggaaaaugcuaaugcuaaagucacagggaagccuaacaucugccugaaagaggcugagggucccugccccuaguuggcucuaauugguaaauaaaguugccuguggccaauggcugaguagggagacaaagguguagguguauaguccuauaaccccaggcaacggaaccauggaaagaagguuuuagaauugcuaugacggggaaucugaaagaucaggcuugagagcugaagaagugagagcauacagacauguaagagcauccccauuccucuucccuuuugagucuaggguaacaaagauagaauuuagauuuuaguaaguaauaauucaagaguauuggaggggagacguuagcaucgaagugugggaauggcccacacuugaucugcuuaggggcauauuaaaaauauuaaauauuaaaaaugugugucuuucauucaagaauccacaacauuggaaagguagugagaagugcuaacacaacugccagagauacugccacaacaaaacaugaucauucaacuauagcacacauggguguauguguucugcauacuguuuaucauuuuggguuuuacaaauauuucccgugauucauucuucacaaugccucaaaaguaguuauuuuuuucuuuuaauuauuuuuaaucaugugcauauugagggguggguguucacaaugccauguccacaagagggcauccaaucccccaaagcuggagucaccgggugguuaucuaaaguggaugcugagaacugaacucuggucuucuucaaauacagcaugccuuucuaaccacugagccuucucuucagcacaugaguaaaauucuuaaucuagucacauuuauccaacuacauuuagugauucuguauucucuuuaagaaacccuuuaccugaaagaucauaaagacacucuacaguguugaaguuauuuauuuagucuuacauuucacauucaggauuaucugggauuucgucguuagagccaugugaagugaagaugcacaaggacaguguaucucgcugcugcuucuuucuuccaggaagaacucuguggagcuggcuaacuucucaucguugugcauucaugcaaaagcacuagaggagcauggggucggaguaagcguuagagagaagccucuaagugaaacaguacauuuacaguaguaaauacagagauccucacuuagcuuaugcauauuucucuuauuguuucagcucuuggcaaaguauuaccucagcaccacuuaauagagauggaugaagggaucuuguuuugguauucugauuggcugauguccucaaagucaaauagucucacaguugcuccaguguuuccaaaucuguccugggcagucacaaacuuugaggaccuuuuaaguguacaagagacucaauuuucccccaggaaaccgauguuuacagucuguggccacuugaaauuacuguuaacaucaacugagucccucagcugcauauauguucugccuuccuuguggaguacuugaguucuuuucuguguguuguguauauugcaugauagcacucacuaucucuggcugaauauaguuugcugccauagguugccacuugccagaggguagagcauacugacuuuugagccaggguacugaaccaccauacauuccuaggggguagcaacuguucacuggggacaguuagguccccaagccaagaccuaaggguggugaguuuuagcauggaaggaguugaagaugaaguuguaagacaccaaggaccccagagcuaugugaacaacaugaagaaagacuagggagcagcgugucuuggagaaaucaaauguuccgaguggcaauaagggucagcaaggagauaaaaccaaaaaauaaggccaagucaggccaaggagagucccuucagccuggugaauggaaacaauuuggaagguaacagggcuuccuaggggcaggcaacaucuuagggagcugcuucaggagccugaucaccacagccuguuuaacugaacuaugaaccuguguuucucagcuggccaucucauguccaaaacacaguaaaccccaaaacaaaacucccccaacuguucucggucagaaucuagucacuguaagaacauggcuccagagguuggguuguaaggugacuaaugaaaaggcacuguaagccacuauagguaugggggcgucauauugaggauccaagcaacugcuccagcuacugucuccagcagagcagagacccuagagauguggcucuaucacagugcucagagaaaccuugucugcaugcuguacacuggguuacuucacauguguuaaaaaaguccaucuauaacuaacaccuagauucuucuagccaaccuaauccaugagcuuguuuuaagcaggaacuuguacuuccucuggggaauaaagggaugagugaacaaagaggaacgguagccuucccaccugccugggccagcccugcuccagaaagcagucauugaacaauuuguagagcuuugaggcaaguucuguugcaccguucucugcugccauggccugaauugguucuuuguucaguagcauccauccauuuagaaacugaaaccucugcccuagauaaaucauugcucacaccacacgccugugagauggaaagucccagguagacuuuugacagcucaaucacuacuuuuuguuauuaaaaucacaaggcuaaaagccagguguagguguauaguccuauaaccccagcacagcagaguccagagaacaguucaaagucagcuagaugcuuuaggauuuuauugcuaugaagaaacaccaugaucaaggcaacuuuuauaaaggaaaacauuuaauuggggcugguuuacauuuugagagguucagucaacuaucaucauggcaggaagcauggcagcauccacgcagguuucaugcuggagaaggagcugagaguucuacauuuugaucugcaggcagcaaguaggagcucccacauauaucuaagaccuuuaagccugccucugcagugacauacuuccuccauaaggccacacuuacuccaauaaggccacaccuccuaauagugccacuuccgacgguucaagcauucaaacgagucuaugggggccaaaccuuuucauaccaccacaccugggcuacauaaugacacauugucucacaaaacuauuggacuaacaggaauuaaaauagaaaauuuaaucuuauaugcuuguacacuguguguguguguguguguguguguguguguguguguguguguguguauguguucaacaaccuuuaaagugcauuuuuuuuccaguugggacauuguggaaaauaugcagauguacaagacuguaagcauuccuuaguguucagcaguggggaugcuaguguggccuaggguucauguaccaagaccuuggucccuagcauagcaagaaugagaagugagacaguuaagaggauguuagauuacuaagaucaaccauugcccuucugcugagugaccuuacccauagccuaccauugugaugacaucuaccuggaggccauuggagaaauauugcucauuggcuuugcuccuuauaacuagcucaguuuauauuacccaggaccaccugcccaggagugguaguauccacagugagcugggcccucauuaaccauuaaucaagaaaacacccccauaaacugaccuuugggcuaaucugaugaagacauuuucucaauugauguuuucucuuucuagaugacccuaguguguuucaaguugaggaaauaaaacuuaaucagcauaguauauaauuguaccacaguauauaauuaaguuaguaguuuaauuguaccacuaaugaaauaugaaacagaacuugcauacuaaugagaaggguaugcuuuuuguugucuuugguuuugguuuuggucaggguuucucagugaagcccuggcuauccugaaacuggcucuguagaccagaaacuccaaaagauuuaccugccuuugccuuuagggcugggauuaaaggcaugcaccaccaucauccagcuuguguaugcuuauuuuuaaaugaagaauuaaucuuggcagaauauuagauacuacaagacauagaaaaucuuaaaauuuuuuucagacuuaaugagaauaccaccuagcauagaugcagagugcaaauaucacagugggaguacagguccccucagaauccaggggaaagguaucagaucuagagcuagaguuacaagugacucaguacaacaugaucuaggucuugggauucaaacucagguucucuauaaauguuccuaccuccucauccccuuauuuagugauaauaauaguauuauuauuuauuugguuaaacgucagagacucaaauagaauuuuuuuuuuuuuuuuuuuuuuuuuugguuuaucaagacagggaggguuucucuguauagcccuggcuguccuggaacucacucuguagaccaggcuggccuugaacucagaaauccgccugccucugccuccugagugcuaggauuaaaggcaugcgccacaacgccagcuagaauucuuuuuuaaagauguacuaucaaggccuggagaggugacucaguaguuaagagcacugacuauuccuacagagguccugaguucaauuccuagcaacuuuauggugguggcucaaaaccaucuguagugggauaugaugccuucuucuggugugucucaagacugugacaauguauucgcauaagauaaaucuuaaaaaaaaaaaaagauaugcacugucacucuugaguauuugaguuucuauguguggucagaggucaacuucuucgaagucagcucuuucuacuuuuguuuuaaaacaaacuaccaaaaaccaauucucucucucuccuuccuucccucccucccucccucccucccuccccccuucucucucucucucucucucucucucucucucucucucuguguuucucagagcaugccuguggagguccgaggauuacuugcagggagucaggucucuccucccaccauguacgggucaggugugagggucaacuuuguggcauagguuuuccucuuccuaauggguuccagagauucaacauaaauggucaggcuuggccucaaggugagcaccuuccugcugacucauuuuacaugcuugcauguuccuguaaacuauuuuaaaaagguaaaaauuacauaccauaaacuuuaugacauaguaauuauauugcaauaagauauggcauuauaucuagcagcaugaagacuagcaggcguuuguugcuugauaauauugagaaauuuuuugguuuuguuuugguuuguuuugguuugguuugguuuuugguuuuucaagauaggguuucucuguauauuccuggcuguccuggaacucauauauguacuugcuauauauauacuugccuagugaaguuuuagguuugauucucaguggcacauaaaauauagggauguaaucucggcacuugggacaugggaguagaagaaaguucaagaccauuauagacuacaugagacccuauuucaaaaaauaaaaaaccaccgggcagugguggcgcacgccuuuaaucccagcacuuggcaggcagaggcagguggauuucugaguucgaggccagccuggucuacagugugaguuccagaacagccagggcuauacagagaaacccugucucaaaccccccaaacaaacaaacaaacaaacaaacaaccaggagcaucaagauacccagaguucagucuucagaacccacaugguggaagcagagaacugacuuccauaugccaugacgugagaacaggaguguacacauacaugcuaaaaugaacauuuaaaaaguauauuucaaaacaauaaaauaucuuacauucuaacacagcagaguccaaagucucauagucugaaucuuacaagcugcagcaugaggugggaaacauuuagaaucuuugucuucuauaaugaaaaaaauaucauguuucuauaugagaaaaaaacuacauguauguauauacuguaauuuauaacacacaguagucuccaagugagccaagauguuuuagauaguguaaggauaaauaagaaauauguuuuuaugaguaauaaaagauaagauuuagaugacuucaagcagcuagagaaggcuuuauuuaaugucagagaaguaaugucucugguucuggccacaccaugauggggaugcgggacccggucauucaaugagcagaauuuagaucauagaguacaugcuuugagcugaggguuuuauagcuaaggaugggaaagggguuuaguacagguagaguugaugggcuacaaaggcuauugucuuuucugcagccaccagguaucugggaugggggacagcugcuuugcuucugcaguccccaaagaacuguuccugggauuacagauguauuuauuccacuacaccaaaaugcagugaagccucgggaugggacuugaaccaaaauccuauggcagagcauuucuccagcaccaaacgugaaggguuuugucuguuuguuuuguuuuuugccuuuuguuuuucaagacaggguuuuucuguguaauagcccuggcuguccuggaacucacuuuguagaccaaucugguuucaaacucaccaagaucugcuugccucugccuccccagugcugggaguaaagagauaugccaccacacccagcccaauaugaggguuguuuguuuguuuguuuugggggggguuguuuuguuuuguuuuguuuugagacaggguuucuuuuuuuucuuuuucuuuuucuuuucuuucuuuuucuuucuuuuuuuuuuuuuuuuuuuucgagacaggguuucucugaauagcucuggcuauccuggaacucacucuguagaccaggcuggccucgaacucagaaauccgccugccucugccucccgagugcugggauuaaaggugugcgccaccacugcccagccaaagguuucuuuuauaaauguuuuuauauuccaacauaaaaauuucucccuccccccccccaaaaaaaaaacccaaaaaccgggcgugguggcacacacuuuuaaucccagcacuugggaggcagaggcaggcgaauuucugaguucgaggccagccuggucuacagagugaguuccaggacagccaggacuauacagagaaacccugucucgaaaaaccauaaaaacaaaaacaaaaacaaaaacaaaaaauuucucaauauuaucaagcaacaaaauagcaaacgccugcuagucuucaugcugcuagauauaaugccauaucuuauugcaauauaauuucuauguuauaaaguuuaugguauguaauuuuuaccuuuuuaaaauaguuuacaggaacaugcaagcauguaaaaugagucagcaggaaggugcucaccuugaggccaagccugaccauuuauguugaaucucuggaacccauuaggaagaggaaaaccuacaccacaaaguugucccucacaccugacccauauauaaguaagcagaauaaaaaauuuuuaaauagcuucuaggauauucagaaagaucuacaacuaucacuacugucuacuucuaccacuccaaaaggaaacucuguguccacuagcagucacucccugugucccagcagccccugccagccgccagugcuauccauggauugccuuuucugaacguuuccuuaaaaugggauuaaacuguugaaguuugaaucggaaauacucccacacagauucuuauuuugaauacuuguucccagcugauacuucuauuuuggaugacgaaaggaauacuaccucaggugauauggaggugaggaggugagggcugaccucugaugaccauggccuagccacaguuacugaggcacacucugggcacagggagugcccaugaugggcuccagcugcugugugugccuucccugcuauguguggggcacauugagcggauaauaaacuaauacccacacaucuucugguagugucuuuuuaaccacuuuuuaaagguuugucuuaugugucuggucacccaaugcugugguggacuuucagguuuugccaguucaaagcauaaaugauuacuuaaggaagacauguucucugaagaagagcucuguuacugugccagcacuaggaaacauuuacauaaaccugcgugguacagcccacuacacgcccaggcuguguaccuacaaugguaugcuguuuguguuuuguuugaaacacuuuagcuuaaacuuagacuccuucugcuucauucuccugcagacugaacuuagcugguucugugcugugcuuucauggcuggcauuguaguggguuugcauuggcaucaucacaaacauguuaucuuuuacuccagcaccacuauggcuucaguguuucuuaggcacaagucauuauuuuagcaucauuauauaccuauuggaaacauggucccauacaugguccaucgauguaagaaacagaauuucacuuuuguuuucuauuucaggggagguucucacauaugacccaacacgcauauggaaggaggucagaggacaauucccgggaguggaaucugggaauggaacucagaucaucaucccugcauauucuaccugcaaagccgucuuggugggaccuccuuuucaacuuuuuggcauauguuaauuuuauguucugggauuguauguauuccugcacagacauggcauauaccauggaucugaugauaucuaacuauugauccuacuccauucuugccccaugucucaggcccaguaauuacaauuuacuuucagauuuauuuucuaaauuuguuuucacauaugagagaacaugcaauauuguuuuuuuuuucugagucuugcuucuuguuccauauaauaucuucuagucagugcauuuugcugcaggucauggauaauaguccauuauguacagauggaauguuuucuuuuucuugucauuaccuguucauuuauuuguacuuaagcugacugaugcugcaucuuaacuauuaugaaaauagugugauacacacgggcaggcauaugccacaacacacugucuucacaccucucucuucagguuuaauaguuugaguaaauuuguaugguuuugguauuuggucuguauugauuuaugcuuuauuuauuuauagggauaguguuuguuuguuuguuuguuuguggggauagugucccauuaucuggcccagacuagcuucuaccuugugaaucacacugcuucccgagcacaugugucacaggaaaguaccgccacacucucugcuccuauuaccuuugauuaauuggcuccuggguggccuuggucucucacuaauuuuguauuaagaucuauuuggucaaauagaaggugcagcuguuuuguuggcuuuaggagacgauugucauacgccuggaaugucauuuucuauaauuucuaguugugugcucucacuacugaaaugaguuccuuauaggaaacauaccauuggggcuuggcagccuuuuguuuauaguuucuuugagaugacauuucaggcugcccuuaaacucacagcaacccucuuggcaaguguggagguuagagguguuugguuuugugguacuggagaguaaacccaugcucucagggaaagcugagccaccuccaacucuguguuuguuuguuuguuuguuuguuuuguuuuuucgagacaggguuucucuguauagcccuggcuguccuggagcucacuuuguagaccaggcuggccucgaacucagaaaucugccugccucugccucccaagugcugggauaaaaggcgugcgcaaccacgcccggcuucuguguuuguuuuaauccacucagacuaucugucuuuuauuuggagaauuuaauccacuuacugaaugguauugucuuaguuacuguucuauugcuauagaggagacaccaagaccaaggcaacccuauaaaggaaaguauuuauuuggggguuugcuuacaguuacaguuucagaagguaguauauuaucaucauuauggggagaguaguaguacgcaauaaggcaugguacuggagcaauagcugagagcauacaucugagagcacacauaucugauccuaaaguugcaagcaacaagucuaggucugguggcaugggcuuuugaaacagcaaagcccaccccugguaaaacauaccuccuccaacaaggccacaccuccuaacccuucccaaacaguuccacuagcuggcaaccaaguauucaaauguaaguauaggagacaugcucauccaaaccaccagagguauugacucagggucauuugcuugguuccuucuggcugcuuugcacauucuuuguucuuuuuuuuuuuuuuccguguauuaagcuccaugguuugauaguuuacuguugcugauguuugauucuuuuuaauuuuuguuuuuguaucuacucuucuagugagauuuguacuuucauguacuuaggaugguuauaguuuucaauucuggaucuagaauucucuuaaucacaguuuguaaggguggucugguaguuauagucccccccuccccccccccccccccgucuuccucccccccccccccaguuccuguuuaucuuagaaggucuuuuucuuuuaccucuucaaauuaaccuugcuuggguaauuauuucuggacuugaacauucucuaggacugcaggauuccaggugagaaaucucauuagucuaacaaguguugccuuuaaaugugucuuggugcuauuugagauuuuaaaauucuuucuuuacacuaaccuuagguaaucugauuaucuugucuuggugagcaucuuuucuggucaugugcauuuggaguucuacaauucucuugcacauaaauguucaugguuuuguuuguuugccuuugaacuuaaaacauguuuucuuuuucuaacauuucacccacuuuaauuuaucuggagcuaugauccuuguggggguguuauacuaccuuguguuccuacauaggacagacuuuuuauuuuaaaaaaaauuaagucacuuuacucaugaguguuuucuugcacauauguaaguguaucaggccugugacuggugcccagcagagaacaucugguccccuggaccuggagucacuaugguuacaaauuaccuccugggugcuggaaaucaaagccagguccucugcaaaaguaacaaguguucuuaacuguugagcgaucucuccggccucaucuuuacaauuguuuauuguuugugugugggugcauguggugccuuuggcggguacauguggaggucaaaggacagcuuuucaagaaucaguucucuuauuccacucuggguuccugaggcuggccucaggacaucaggagagcgcaguagcaagcacuuucaccugcuggcccuuggaaggucuuuuagcuaagggaucuucuuagauguaucuugagauauuaaucuauuacacagugucuggaaauaaagagcauguagcuuuuguggggaggcagagaugucugugauuaguaaauuuggacacaguuguuucuugugucuuaacugauucuuucugaaccagagguucucaaccuuccuaaagcuguaacccuuuaauacaguuccucauguuggugacccccaaccauaaaauaauuuuuguugcuaucauaacuguaauuuuacuguugugaauuguaaugcaaauaucuguguuuucugauggucuuaagugaccucugugaaaggguuguuccauccccaaaagguugagaaaugcuguuuuuauucucaaggcgggggcaugcuuauugccccaguuaggccaaaguagacaaccuguguagguccugaguuuuuucuuuauuaucuaucuauucaguuuuuuuuuuuuuuaggcaguauaaauuuucaaucuuccaccuuugcugcuuuauagagauuuccuauuuguaacuuuguugaauuuuuguuuuagauuuuguuguuccugaaacaaaguuucacuguguagcccaggcuggccugauauucccgagccuugggauuauaggcaugcaccaucauccauauuaaacugaguguuaucauaaauggacuugggauuugucaaguuauuuuucugugcuaauuagcaugaucauguguuuuuauuagauuauuuucuccccucaccccauccccccucccccugcucaccaacccacucccuccagcuucccuguccuggcauuccccuacacuggggcaucgagccuucucaggaccaagagccucuaucauguguuuuuucuuuuacuguuaauacagauaugagaagcuuagagggguuuaauguuuuuuuuuucuuuuguaauuuugugugugugugugugcacgcgcgcacacauuguguguuuuccugccccuguaaguuuguauagucuguguguccuggaucuaccggaccuggauuuacagaaguuuugagucaccaugugggugcugggaaucaaacuugcauccucuggaagagcagucacugcucccaacugcugaguuaccucucuugcuccuauguuucauucuguuuaaugccagcucaucuaaggguaauuugagcccucuuuucauauugucagacacaucucaauacuaauuucaaaacagaaaagaacuagacacaaauccaucuuaauuguagugaagacaacucaaacaaguaaugauaacagcuugaugaauguuaauuugugcauuuuaaauuuaaauaaagguaauagaugccccccacccccuaguccuguagcuuacagggguaggcuacgauagaauuuuuuuuuaaugcuuccuugaggagguuaccucaaauguaaacagaauuuaaucaguuaucacacaauuugccaaccaaaccagggcauuuuggggagugaaagugaaugcaagcacaaacuacuuuggcugauuuuauaagacuuaaacaacaacaacaacaacaaaaaacccaaaugaacaaaacaauuauaugaaaaaaauaaggccaauaaaacauuugauguugugagccaacauacuuuagagaugaaacuaggcuagcaaagcaagcagaggaaaugcuucaagccucguacacucgaaacaaacccuggcuuuauuccaaggguacgauacugagcaaaagcaggacuucuuuuuagacaaucuguuucaguguggugaaagaucaaugaggggcccuuuggacagggacugggacauaaaauaucuuccaacugucugugguaaagguuguacaacucuuaacuauucuuaagaaacacacaacuguuuguacuuuuaaauggauggauuacauagaaaagauuauagccccccaaaugauuuaccaaacaagaacuuugauuuugaaguuguuuuuuagagaggaucccuuuauguaguucuggcuggcugagaacucaggagguucaccugcugcugcugggaucagacuuauaccaccacauccagagagaaaaauucuccaagagacaaugguguacugguuaguuuuuuuuugucaaauugauacaaccuaguucaucugggaagagggaaacacaccugagaaaaugcucccuccccagccaccccccaccccacuggccuguagggcauauugauugaugugggagggccagcucacugugagcugugccaucuuugggcagguggucuugaguuguagaagaaaguaggcggggcaagccaugagcaagccaguaagcagcagcacuuugccagggccugugcuucaguuccugccccgauuuaccuacaugauagaucuguaaaguauagugaaguugcuuguggccauggugcuucacugcagcaacagaaacuguuaagauaggccuuaaauaggccagggaacgggguguggucuuucaguggcuggaucuuuucuagcauaugcagacccccuggguucaaucuccaacacucuaaggccugagccaacaguacucaagcacaaugcuguggucuuucaaggguguuccaauaggccaagcaauccugcccugacuaucucagcuuuuaaaaaaauaaccgcagagaauucuaauaguucucuuuaucuguagacauauccuaagacugcuacaccucaaacugggcauaguauuagauccuacauaugccauuuucaugccuuuacuauaaaagauuauuucauaaauuacaaaguaggcuaucaacaguuaugaugguguuaguuacuuaaauguggugcuuaugccauagcaagccugaagcgagcugguuucuaaaugacuagcaguuauaucuuauucaguacaaacaugcagcuuaaagggacaauuguaucaauuuaaagccuacaaauuuaaacaaauucucuauuuaguauuuucaaaccaaaacugauguuggaggaugggacugaagaaaguaaaauagcagugaagagggcucucucucucucucucucucucucucucucucucucucucucucucucuguaucucaaagagauuuuugagaaaccaccuacaaguacuuaaaucuguucuggcaaaaccucaaauaaaagcacagguagaguacucccaucacaaaagaaaaaaacaaaaaccaaaaaaccaacagauacugauuauauacaauuuauuuaauaaauuaaugucauucaaaauacagugccagagcauuaugcaguugaacaugccagccauguuugccaugaggcaccugugcucauguuacauugguggcgccccacuacugcuagugguuccugggauuaaugccagagcagcacuaggaucugcucuucugcacagugcagacaauuccugcacaguucaccuuccuaauccuagccccccaaacauacacacaucaaguuaaaaaaaaaacacaccuauuagauaccuacacacaaucacucuacaguaaugcuuguuauuaaauuaagauguaaugaccugguuaauccacucuaaaucuuuuuaagauggagaaguacaucagcagcaggugguuauaugcaugagccaacguuaauguaauauaggaaguggagacauuuacugauuaaagcuccacauagacccgcacaaugagggacuagcaauucauuugcaagcccagcaacguaaguccacaccugguaagugaccagcugccuggacaaccuguauucuagauagacgaguguaagucagugggaagggaguccaugcaccuaguagaagaaugagacugauccugcagucacagcuuucccuguguaauaccauagacagagagcagaucuugcucaacaauaggauuuaaaagacauuucuauaccaacaugaacauuaguguuaagugcaguggaauuauacuaaaaaaacuauauuccaggacuuuggaaguacaggaauccaauacauauacuaagauaaucucagcacaauuuugagauaccacacugggaacagauuacuuuuaaaagugaaguucugagcugggcggagguggcgcacgccuuuaaucccagcacuugggaggcagaggcaggcggauuucugaguucgaggccagccuggucugcaaagugaguuccagggcagccagggcuauacaaagaaacccugucucggaaaaaaacaaaaaacaaaaaaaccaaaaacaagauaaacaaacaaaaaaauuuucuaaaaaaagugaaguucuggacuguacauacacagggcuaacaauguuagauaauccagacucuuaugcucacaugauacauuuaaaguuucucaguuaucaaauaaccuauuucauauuacagaagcauaucuuucuguaugacacacugauauauauuauacugaugcaaauauuaaguagggcauaaaaauaaaauguaucaaagauagauuuuuauguacucauacucuccuuuuuuauccucugguuuagcaaaggauaucacaaguucagcacguggcacucccucaaguccccuauacaggcggaagugcaaccauuuccccauccaguucaaacuccucuguuccaucuggugaaaaaagguaaguugguggcuuccauggagauucuucaagacaggauggauaaaguuuccccacagugcaccgaaaaucucucccuaggucccacaguacacguucagauauaugcugccgcagagaccaccggucaaguuccaaaucauacugguaggugacauacuuagcucguucauuuaaguggguuucucgcauaaacacacaaagagaauuugagaucacaacagcucuaacacagggaucagaauaccuuuuagcagggauguuggcagccaucuuccauucauuuuuauucacaucauaaauuuccacaguuacugaagacccaucuacagugccagaggggagucuuaugccagaauugguagcaauaugcaacccuccaauauagaaaauuuuaucaccaaaagcugcagcugaagcaaaagaucugcuagucugccucauggccauuucuacccaugagucagaucuuggaaaguaacaguacaugagguuuaaugucaucacauagaugcagucgugaacuacaacugcugcacuccacugccaugcacaaggcaaagggcucaccauuguccacucauccuucucagugucguaucuuucuacaguccuccgguuaaguucuccaccaacacuaucuccuccgauugcauagauauagccuucacagcaaaccaaagauggcuucacacggacaaaaagcauuggugucuuuggaaaccagguauuuuguugugcaucaaaccaguaaaagcaauucacaguucggaaggcagucugcaguuuacuuguuuuacugugauuuguuuuuguguuuuucaagggcacuuggcccccugcuauguaaauaucauuauccggaguuacaacugucccaaccuuaugcaaaucagcgggugggcugcauaacuuguaaacuuuuucugccugggggcuauaacagacagaagaguaaagacuacaaggguuuucugaggaugcuucaaugaaaaucaucauuuccuccuuagucaucccaagucuggguuugaagaacuugggcauagacuuauaaagacccugaaccacaacagacuuaucguugggugggagaccuugaaaccaagcucuuugugugacuucugaaagagcaucaauucugaucuggcuaagaacugaagacaaauacugggaucgugacucuguguuguacucuagccagagcauggcagccucucgcacgguuuccuccuuuucuacauuuaaguugucgcugcugaggaugucuaugaggaggucgugggacagcugcaugaaggcuuccuggcgguacacagccgugaacuugugcuccaccauccucuuugcacucugcuuuaauucuucacaacugaagaggucagcaaaacucagcagccgcacacaguucucugcauuaauuuuuuuaauuaaauauucucggcaacgcuguaacacaucuucuaccuaaaaaaagaugacacguagaaaaaaaaagguaaaaagaugcugagauuuugaacucaggacccugcacugcgauccauacucccagccuccaguuuacuuuuaucuacgauaccacagguuucccauagcagaugcuccuguacugucaaguuuuauacguuugggguaagagacaaguucuugcaauaacaaaauuagacuucuaggcuauacaguuuucuauuucuuacucuugcccaauggccuauuuuaccuguucuauuuaggcuggaugaguggcacacacugguaaucucagauuuaaggagcuguuuaaauuuuuuaacugccuuucuacggcugguuccugauuguuuuuguauacagguucucguuacaguagcugaggcugaccuuaaacuccaauccuucacucacuuccaccucccacccucccuccuuuucucuucucuuuucgaaacaggguuucucuguguagcccuggcuguccuugaacucagaaauccgccugccucugcuucccaagugcugggaucaaaggcaugcgccacuaugcccggcucacuuccaccucucaacugcugagauuacggccuggugcuaccaugcccagcugaaacaaguuuccaaaguacuaaguauuauuccgaaacaggaaaaagaugggaaaauacccacauucccauuaaaaucagaaagggaaaucugagaaauacagacuagaaaagauaaucauacuaaaaugcauuaaucaucaauuuuacuuaacugcuuaauagcucaauauaauuccacaaccauuacaaauaauaaaucuuccaaaagaaucuaaaucugucuaugguaagucuauuaaacacgaaugaauuuaggcuuuaaccacaaacacucuuaaaccaauacuuaaguugaaaucuaaauucugaaacgaaaaguaugaaacauaauuugucucugucucuuucaagacaguuuggggugcccuggagaaucuuugauccuccugccucagccucccgaguacugucauacccagcuuguuaauuuuuaauuuuaauuuaauucuguaaucaaacccacacagauuaugaccuuguguuuaauacagugcuaccccuggaaaauggaggagggaacccaaauuuaauauuuuuacaccaauaugccuauuauuuuggcauacacuacuuuuaaguuauaugcaugucauaaaacuacuaacuaaaaaaaaaaaauccuauuuuuuuaaauuucacauuuuauauacaaaaucugacccauauaaaaucugcaauaaaacuguacagauaaagauaucauuaaugaaacacuguuuccugauaaaaauaagcuacaccucagcaucagggcgaggccgcuguaccugcaggaagcaagcuguuucauagagcugcuccacagugcugucguuuacugccaaguucccuguguacgcguaagcuauuaucaucugcaaggcggcagcguccacauuccucagguguacaugugucugcuugcuuucacuuaguccacucaugaacauggcccuacaggagacacaggaacaagcuuaauaaaggaaagcaaacuagguaccacaggacacaaacuuaauaaguuguuaauucaauuuacuuauagagaacacuuucaaaggcaaugagaaagucauauauaauccagggcugaagacaagccauacaauaaccuguaagccauucugacggaggacaucaaaauuacuuuauucuucacagucacauaacggaauacuauccagcaauaaaaacaaguauugauaaauaaaugaaccucaaaaacaugcucagugaagaaaccagauacaaagacaaauaagauauuacuugaauucauuuacaugaaaugucaaaaaauuaccaaauauucacagacagaaacugacuagcaguuaacuagagcuaugggagggaugagaaaugacuauacacacgaaaacagguaacagaaauguuuucaauccgacagugcaaauaguagcaggauucugucauagcuccuggacacauauccucagcacacaaaacaaagauacuaaguccuuuuuaaaaagagccauauuuguauaaaauuggcacacaccuuuaaauuacuuacuuaucuaguuaucuuugcaccaagcugccuguacucugauucuaugcaccaagcugccuguacucugauugucccugccucucccuccagugcugagauuauagacauguacaucauaccugcuuccugugguggugggaaucaaacccagggcacugcauacgugggaaggcauacccacucaacuucaacacuauccagcccuuuuuauaccucaaacaauguaaauacaggaaaaguagcuaggcuauaagguuuucuuucuuagagcauuuucucuuugcaguugaauaugugguaagaaagcugccaaaagcugacuacacacuuaaaaugggugaauuuuaugguuuauaaaucccaccuuuaaaaagcuuaccuaucacuaaauuuccuaaaaaccaugcagcuccauuacaaaaaguauggaaacuaugauagaaagacuauuuacacugugggaauacauacuccaagucuuuugaguuagccaucucacuugugugccucugacuguccuggaacuugcuauuuagaauaggcuguaaaauuuagagaucuaccuaccucugcuuccugcugaauuaaaggcaugcaccauauacauggcucuuaguccacgacuaaaaagguuacuuuuauuuacugugcaugucuacacugugugugagaucgggugcaggccacaaugcauguguggagggaggaucaguuucugggagucaguucuguccuucccacagugugggacuaacuggagggucuaagcccaguugucaggcuugauggcaagugcugagccaucuugccaacucacuuacuagaauacuuagcuggaagaauaaauauuacugcaugcacaagagaaaaaagccucuguaggcagugaauuaagagugaguaccagcugggugguagcggugcacaccuuuaaucccagcacuugggaggcagaggcaggugaauuucugaguucgaggccaaccugaucuacaaagugaguuccaggacagcaagggcuacucacuaauuugcauccugcaaagagaugaggaaggcauauaauuuggauaacauaguguggguaagguuauagcugaauaaaguucaugaaguauaguagagaacugaaaagacgaguaggucgucauaggccuuuaaaugggcagggcuggaaaggcagaucagugguagagcacuuugaguaacauacauggggccuugggcucaguuccagucuccccugcugccugaggaaucuuguacacaggaaagaagacaaugcuugcacuaaccaugaugaacucuucucugagauggacacucuauacacaaacagagcucaagagcccaauguugaaaacuagaaaaguggcuaugaaaccagcgcaggcaucuagcuggagacacacaaggcugauaaagccuagcuacuuucugaacacagaacaggauccucagaaagcagauaagagucaaagcugccuguuuacuuucaauaaaauaccugggaaaaauguuaaccauuaacaaguuguaaggccaggaaggaaaguucaucauuggaaaaaggcaagucagguugggcuuaugugaagaccuguugagucaaaaggaaauaguauaaugaaugcaauaaucgaggaaaacuggaggcugggcauuaaugaaggagccaugacucagcuacaaaguggccaguuauauaaagaccccccccuccuccaccacagaaaauucaaggaaacuguacuuaauaauuccaguuuaaaaaacacaacacuguagacgacauuguaguagaacuuaguuuuuugguuuuguuggugguguuuuuggggauggggugggggcauuugaaauauuuccugaaaaaaaaaaaaaaaaagacaacaaaaccaaaaaaaaaccagugagaugcacacaacaccacucagcacaacugagguguugcuaucaaacuguggagucagcuaucuggaaggccaaagcaagagaacuacaaguucaaagccagcuuaaaauuuuaaacuuucaaaaauuuucccaguauaucucacugggaaaauucuugccuugcccaaaugauacccugggcuuaaucuccaguaacuauaaaacacaaaacaacaacaacaacaugaauccaccuguugccaggcacaguagcuugcaccuguaaacucagcaccugagggguuaaagcaagaggaucacaguggguucaaagcuggccuacaucaguccuaagagccaaacggcagcugugcuguggagcgaagcccugcauuuauuuggccucuguuucagcuucugucucagguccuuugccuuggcuucuuuucaugauggacuguagccuagaaacugaaauaguacccccacccucaacacacacgccaaaauaauucacugcagaaggaacuuaaguuacuggugauuccuaauacaacacaaaaugagcaauaaggacagacuuuaaaaauccaaugagggaacacaggcaccagugucaaucagcauggcuccuaaguccccccugaggcuaaauuuaggaugaacacaaaugauuaugacugagucaggagaguguucguagaaaagacacccagaacaucuauugcuaccgguuucaucuguccggagggaggagggaggagggaggaauaugaaucauacucacucaaaacccucaaacugaaaaaggucugcaaaaacccuugaaaagaaggacaagugguuuuccauucaccccauuagaacaguggcauaaagcaaggauggcagugagaaugguuaucaaauauugucacgagaacacacuacuucagucaaguaacuguuuccugaacacuaaaaacagcgcaagccuaaccaaugugaccacagucauuuuaaaaauguaccuuuauugaccaacugauugacugauugcaugugugccuauaugugccauggugaguauguggaggucaaaagguaugugggaaccaguauucuccuuccaccauguggguuguggaaaaccuacucauuaggcucaguggcaaacacacuuacuuacccacugagccacacugcucacccuuugucaaaguucuaaacuggcuuaaaaaaaaaaaaaaacaaaaaacaaaaacaggugcugaaaggauggccucuggaaaagaucacuaucuguuuuuccagagguccugaauucaauucccaccaaccacaugguggcucacaaccaucugaaaugggauccaaugcccucuucuggugugucuuaagauagcuacaguguacucauacauaaaauaaaugaaucuuuuuaaaaacaaaacauacaaacaaggaaucacauaacgauguaacaaguaucaugaaacugcugggguuuauucucaagcagugacucacgucauugaguauaaaauaaucaguaaauuuuaacaaaauaaacaaaaaagcacaacuaauuuaaagacagaauuuugguauuggggagagaacuggcucagugaguaaaauucguguugcacaaauacugaggauuucaguucaaauucucagaauuuacuuuggucaggcccagaagcaacuguaaucccaguuuccuacaacagaauagagaaugcccagcaagucugggguaugugacagucucaaacaaaaugggaggcuaagucugacacaugagguuugucccugaucuauacacauaaaguggcaugugcacucugcaacauaccauaaacacacauaaaaacaaaaagcagaauuagcuguguauguagcaacccugaauucugaaggcagaacccagcuaaaaauacuuaagacuaucuguacuacauguacuauacuauauggccauauacuauaaucuuagcacaaacaagaaacacguaagaaaaaauuaguacauuuucuucuguggcuauaaaacuaguccaaucacaagaucauaacgauacgaagcuuuaacuguacacauguacugaaccauguucucaauaaauauaagcaguugcuuuaggaaaaucauguuuucccauaaaaccauggaagcgaaaggaaacuccaggguggggagauggcuaaguaggucuggcugcucuuccaggacuugguucuguucccagcacccauaugguggcucacaaccauguguaacucaaguucugggagauccaacacccucuucuggcuuccaugggcacugcaugcagccaaacacacacacacacaaaaucgcaacuuuuuaaaaggugacuugagugauggcucaacagcacaggcucugccaggaccuggguucaauucccccgugaaggcucauaacuaucuaaacuccaguccaagggaucuaaaacccucugcuggccugugugggcaccaagaacacauguggugcagacuucaugcaggcgagccucugguagacaacaaacaaacaaacaaacggaacuggcuacuaauaaauaauggcagccuugaaaauacuguuccccuuaaauugcaauauuaaacaguacuaauaaaagauaaaaguugcacggucuucaaaaaucuuaacucagguaaguaacuugauagcacuggaagaagcagcaagaugacuuggcagguaaagaccuuugcuugccaagccuaaugcccucaguuugacccuugggacucacagagucaaaggacagaaccaacuccuccaggugguacucuggcuuccacacaugaacuguuacacacacacacaaaaugugauuaaaaauuuauauaacauaaacuauauuauuuuuacaaccacaaacaagaaaaaaugaaguggcaacacagaaaauauuaauagaauuucucuugcauaguuuaaaauuauacaagaugauugcugagauaacuauuguauucuauuaacaaugcuggagcaggagaauuguacaaguucacaaaauaaagacuaaccugggcaaaaaaaacaaacaaacccaacugcaugacuauacagaugucaaucucuagcaaaagcauaaagcucuuuucaauaauggcuuaugauuuacaacuaagucauuaagaagagagagcuuaugaacucagguauccacucacugaaccuauaacccugaauuucuaccacuggcuaagacaaugggucuaaaaagcaaaaaugacaucacagucaccugcaaagcucuuuaauauacagcaucuaagucugcacugcagagcuaccaaagcagaacugguguuggaacccaguaaccaccacuguaaaacacacuugauuauugcaaacaggccuuguaacagauaagaaaauccacgucugaaacugcauggaaaccauaaccuaaacugaaaccaaggcacuguacagggaacugcacgauggacucuggcucccugaggacuguaccaucuccacacuuuuuuguaaaucaaccuuucuuucuuuucuuuucuuuuuuuuggucuuuugagacaggguuucucuguguagcccuggcuguccuugaacucagaaacccgccugccucugccucccgagugcugggacuaaaggcacaugccaccacugcccggcugugagucaacuuuccaaguccuuuagucugucuugcuuacaguuguuaugaacaggcacagaagcacauuuuuguaacagaaauacacuuaguauacauuuauugucucuuauucauccuaucucuuucaaauauugaauaaaacucacuuuaaagacagagaacgaaagcaauuucucuaccuuagcuucuaaucucaagaaccuuaaagaugaaaaucaucuugaaaguuuaaagucuuauuauuugucugagacugaacuuggaacugugaacuaaaauaaaccuuucuaauuauuauuucuaaugagcauaacuaaacguggaaguucugagacagagagaguaccaauacugucacugacacugcauggagccugguaaggcuaagcugaggacuaccacaagcacaacaguaaccaaguuacuauuaaguuggcaccuaguuuuguuguuguuaaagcuaguaucuaaacagcaacaauuaucuccuaaaaauuauuucagucugcuguauaacucuucaguuuauaaugacuguguguuucuagaagaauaaauuagcuauccuuauuuuucuucccaagaaaaacaguauuuugaauuuuggcugccaccccacaguaaaacuuaagucaauuucaacaauuuuugugcaauuaauacuuuugugaaaaugucaucugucccuuaaucacauuaggcaaugcucuaacauugcauaaaaacuuaacuaaaacacagagaugggaguuuuaaaaacuuuaaucccaggaugugggaggcagaggcaagcauaucucugugaggucaagggcagccugguccccauaaugaguucaaggacucauguauguacaccagggcuacacaguaagauucugucuuaaaaaacaaaacaaaacaaaccuaaaaccccaaagcuuuaacacugaaagacuguacugaugaagccucacugcagcaucuccagugagaugcgcugguuccacugcuuguucuggcauagcugaguguacacacacacccagaguaauaaagaaauuuaaauaacacuuuuauuacaaacuaaacaagauaaacuacuuaccugaaauaggagcuacauguugcaagaaccaucuuaugacaagggaauucagugcccucaacaauuaacacuaugucaguaaauaacuguuguucauaaaacaguuucaacuguuccaauaaggacacagcauauucgguauugaucugccuuuccucuugaguggacaugauuguauuccauuaauaucuccaagaacagauuagaaaaguccgucuugauggaaggucaaaugaauacuucaaaagcaaaggagggaguucacuugcuguuaucugcagcauucagaacagaacccacacagccgcucugaauaucuuguuacaggcucacaaucuuugcuaggucauccugagcuacaguuuuucaacagauucuccaaacauccugcucaaauuugcaccugggaagcucaugaauagggaaaauacaggagguagauuuuguugcaacaucuuauguucaguaggucuucugcagaacuaaacagaaaaaaguucaguuagaauauguagaucaagcuuuuagaacacaauauuuaaaucaacggccuuugauaugcauuauaucuaugugaacuuccaauaaacuuuagauauaaguacaaaaauuaaacagaauuguucaagucuaaaacacuuaaaguaacuaggcugcagaaaaguaacaguugugcuuuaaacuuuuugccuuccauacgagauauaagcauccuagaaaauaagcaaaugaaaaagcagacaauuuuaagguucuuuaaagaauuuaaauugcaaaagcaagauuuuuuaguuaauuaacagccaacaccugacugaaacguaagaaauccagaacucaaacaaaagcccucuuuggcaauggguaucacucucugaacauacucucaugaucucaaagacggcacagcaacuggauucaaaggaugcuauuucuaaauuuggagaaauucuauuguauagacaucuguauauguaggcaucaaacauguauuuuguugagauggagauagaguucagaaccuuccaacauaccaggcaagcacucucccacugagucgcaucucuucucuaaauuauacacaagagagaucuguauaauuuaucucucuguagugaguucucucguagaaauguuuaugagugagaauaacauguuacauagaaacacgcuuaccauacaaauuauguuauccaaauuaaugugugaacucaaguugucagaauauuugaagaacaaguuuccuucaugccucucucauuaaaaaaauuauaaaucaccaauaaacccaaguacccauaauaaauuagacauaaucaaaugggucuugaaaucaagaagacuagcuuauuucaacaaauaaaauuggaacagcuagccgguuaaucuuugcugucaccucacaagauuuagaaucaccgugaagacaagucucugagugcuuguaaaggagucucuagguuagauuaaugugaaaagaccuacgauaaauguagaucccaggcugaaugggaaggagaaaggcaagugggaagcagcauucaguaucuucugcuuccugacuggguugauguugacagcugccucaacccuugcccccauggacuauacacucaaacuggaagccaaaacaaaccauuccuuaagccgcuaucaugccuuuaaaaaauuguuuauuuauuuauuuacuuauuuauuuauugugguuuuuucaaggcaagguuucucaguggaccaggcuguccuagagcucacagagaucugccugccucugccucccgagugcugcaauuuaagguaugcaccacacuuggcuuaucauuuauuuugcuacaagaaauauaacaccacucaauggggaaaacucacagcuauauucuacuacauaacauucacuuaguaaaagaaccaaaaaacuggagcuagggugguggcucugugguuaagagcucuuagcacacacauggcagcuuauaacuuucuguaacuccaguuccugggaauuggagcccuugucuggccuuuucagcacugcauacacaugguucaacauacauggacgaaaaacacccaguccauguaaaacaagaaauaguuaaaauuuaaaaacaauuaaaaauucaaaugaauuaaaaguuuaauuuaaaaaugauuuggaacucaggauucguaacacgugaugucaaaggaacuauaagccagaaaauuaagagggaaauccaaauagguggcuacccauaaauuaacccccaagcuacugcaauuuuaaacuagauaauuaauccugagcuccaaacucggaaagggaaauaauuuuuacuuuaauuagagcuacugcuuuuuccucaccaaguaucaaucauucaggguaccaaaagaaaucacaacguaucuucuggcuggaacuacgaaacugcuggaacugcuaaucccaaacagacugucauguuucuagcaaauuaacuauggacguaacuaaaaacagguaaaggcaaagcaagaccaggucccaaaaggcucuguuguccuucuagaucugaaagguacaucauaaaucuaaguuuuacucuacagucuccgagguuacuaccuaagaucacuagcugcuaccgugguagugaagguuuagaaacauuugcauucuuuacacccacagcccuuuauucaaaauccuuaggaugagauauguucuagaagcugaaguaacauauuucauggagguacugugaugcguauuaucauauauuaaaacucucaagaaaucuagggcaguauuccauaacuaaacacaucaucuuuaccaauggcaguaacauggaauaguuguccugugacuuccacaccugagcugugcauauacaaauuucaggacgauuaacaaacugagaugcccaacaccacaccaaauuuuccuguaacaaaauuccuugcucuuuaagaaaaauaugaaagacaucguuaauacucugaacccauucugacuuuugccuugauuggagugagaaccacuuaaauuuagugccuaacugugaagguaguuccugaggcaaugucaucucucacauagcggcugguuuaauccacggguagacucaaguuaugaagacuacugaacauuggaggcugaggcaagaggacuaucccaaauuugaggccacuugugcuacacagauacuuccaugccagccugaguuaagagagucuuuaaaggauaaaugauggucaaagagaaugugaacaagacuuguaguugcuacauuucaaaauuuuagauaggaaaaguaaguuuguuagaaucuauuacacugcauuucacaguaauaauguuauuguauaaaauugguaaucauaugggagguggacuucuggacaugucugcugagugagaacuaucuugauuacauuauuucaugugacccauuaagacccaucuuagcaaggcagugguggcacacuccguaaaucccagcauuugggaggcagaggcagguggauuucugaguuugaggccagucugaucuacagaaugaguuccaggacagccagagcuacacaaagaaacccugucucuaaaaaccgaaaaacaaaacaaaacaaaacacccaucuccaucuuaauuguaagugagaucaguuucugggcaggugguccuaagaggccacaacagaggaaggaacagcgauuuucugcccgucuugaauguggauguaauguaacuagcucacuuaaaauccugcugcuguggcuucuuagccuuagaaccuagaacuucaagccaaaauaaagccuuucucccucaugucgcuuugaccagggcauuuuaucacagcaagaggaaccaagauauugggcuauacagugagacacugucucaaaacagcaaaaacuaaaaacugcuaaggguagauuuuaaauguuucugacucccuuucucugucucucuuguccucucucccaagguaggugagaugaugagcauauuaaaaaacuucaucauuccacaaugugcacaucaaaacaugaaauugaggucaaagagauggcugagguuaaggguacauguugcuuuuacaaggaucuccaugcauuuccaacaucaaucucacuguagccuguuaucugacauuucugaccuucuaaagcaccuacauacuugggcauacccauauuuagagauacauaauuaaaaaauaaaucucuaaaaauuauauuguaucccauaaaauauacaauuauuugccggucaaaaguaaaacauaggcugcaagugagauagauagggcacuggccuagccugcaagaagcuguguaaaguccuggauucaauccuagcacuggaaacacaaacuggaaaacacauguacacacacacacacacacacacacacacacacagagagagcuggggggggggacgggcacaagcuacucaggacaauaacgcaggaggacagcaaguucuuagccugagccacauacauucuaagaugccaucccgaauuuucucaaaaaauugacacuacaaugaagguauuccuuuaggaaucagguuagagaucacucaauuauaggaaguaccaucucuugcugccaucuuccaguacugcaagugucacuacagaaggcugaagacuuguugaaaaggauccaagacauucuggauaacaaguauuacgguguguaugcauaugugugugugugugugcaugugugugcaaaagcacauaagccuaaauuacuuuggggaaaagcccaccucugcagcucacuagcuuugcaccuuaguuugcuuguauauaaaaacagaacucuuccaaagcuuuuucagggucauccuugaacaaagccuuaaacaaagcacagcacacauuguacaacaauuuuuauuaguccaaucacuggugaaacuuuguauccuuuccuagaggccaaaucuccauacuuuuaacaagccuagagauccuaguuacaaggucacaguaguagcucccuauuucuaucuuuuucagacagggucuugcccuguggggcuguucuggagcccucuauguaauccagguuugucuugaacucugaccuucuugccuuagcuucuccaaagccaauaacccacacaugagccaccacguucagcucuaaaugaaacuuuagugaaauuaguuuuuaacuguacugaguuuucugaugguacaaaguaugaauuuaucagcccaacaagauuaaccuuggauggcugaugucagugcagaaaaaguaaagccagagacauaauaacacagucacuaaacaagugccucuugaguggucacucccuuuguaggacuaaaugggguugucuuaaaacucacuaugaagaagaccacgcuggccuccaaccaagagaucugccugccauugccucccaagugcugagauuaaagaaacgcaccauuacacccagcucacuacaugaucuuuaaucaacaaaugcuacacaagugaguuuugagaguuaugacaagaaaaagugaaaguguuuugagaaaggcuggggcuuuguuuguucuuuaaauuuaucaaaucugauaaauuucaguaauuucuccuacucuugggaguucaggucuguccccaaauguuucuuuuauucccaagcuauauucucaaucaggcuaacgacacauacuuaugugcacaagggcaagcuccaaacacuacagcacgaucagugagcucccaagagccuaugacagaauaauugagcucaggaugccauuuuagaugaucgcuccuuuaccucuccgucuuacucaggcucaagaagugggacgggccuggcugacacaaaacugacccaaaguuuuccacuaacacuguuuucuugggucaguuccuccaaccacaacagaaaacaauuacugacaagagaaccaagaaguguuuucauacaccuaauacuguuuaaauuaacuugucauuccagauaccccaaguuauguaaguaucaccuuggaugcucuacauucuuuuauaggagucuaagggguagagccccuuaacacugacugugacuacuaaaauauguuuccuuacagacacacaaaacuaaauaaaagcuugaugccaagugugcccucuccccagcaggcagaggaggagaugaauccugguaguccaggccaaccuuagccuaccgagcaagaucuugucacuuaaaaaacaaaccaagggcuggcugggacuauagcucaguaauaaaaguagggggcuugcuuagcauccccagugcuacaaaaauaaguaaaccacagagguaaaguucuuggaagccccugcuugcaaugaaaggcacaagucacuacugucauuuauaugaguggcguaaauaaagauggucccaguacauuguuuccaaucucccaugacaaucucuccuucccauaaaaugaucuaagaacucaaauccugccaaagcaucaagaauacccuucauacaccuaagugcuugaaccagccugccaaucaacgcuccaaguuacauaaguaucuguuuuauucaaacucugcaauacagggcaagaccuauguauaacaagacacauuucaggacagcaaaacccaccauuuucucagccccaacugucuuaggaaugcugcagggaaggggugggugggugguugucaacuauuuucuaaauagcaugcaaaucuauggaaaaccagguaucuuuuggcuuucaagacugcagucaauagggcacggcaugcuaguaguaguuugcaaaccccaggcugaagcaggacuuuaaggcaagccugcguuacacuauuaacacagucuaccucaagagacaaaucagguuucuaggaacuuaaacaucuaaaucacucaaggcauagaaacuuaagaaaugcuaacuauuucugcuaucuaauaaagaaaacucuacuguggccucacuaauaacuacuacgacuccuauuauuucugucaccuccuuacaguauuuguaaaguuagcauauuuuacagcacuguacuuauggaaauaaaauagagaauaauuacaguacuuaucugaagagaggaaauaaguguggaaacacacggauuacauacaaagaaugcucaacggaaaagccguaguugccaagaauuauauacccucucuuaagauuucuggcccugaucuaaaggaaccuagaaaagcguuaaaccaacaaaagagcaaagcagaaaggcauaaccuuaucagacagacgaaacgaacagcaacguuucacaucacagaggcugggaaaaacaacugacuuggcuuuucaaauggaucuuagauuacaaauaaaagcuucauccacagucugacuagacgaagucauucucaccugcaaaagaucuggucuauauuacucaaaucuggggaagaauucacaacuccaaagaaaugaagaaacuaaaauaaacuguauuaacucacaggaagaaaauauaauuucagucagagcacaccgcugauagggccguuccucagugucugcucagugagccagacuuacagauucauguauaaacaacacgugaccagcacugucuuuuuuuuccccccucguuuucacaaagcugauauagcuguucacaaagcaaagucuuucaaguuuacuaucuuaauuccuugcuuaacuuaaagagaggccaccaaagaaauucuagagaucuacagcccggagaauacgcaucccuuuuccuuuagguagcuauaaaaaaaaggaaucuuaagagcuacuaggccaggcgcuuggcggggcgggaagugggggagagcacacgacagcagcgcccagucggccgacuuagcguccaguuccaacccaugauuuccgucuaaagcaaacagguuucaaagugcagcuuccccuucccacagcagagcacaagcaggccgaggacaacaggaccccggcuaaccuggcuaacucuugguuacugccgaugugccaagaaaaagaauuauaauaauacuuuuuuuuuuuuuaaaaaaaaaaaaaaaagggcaaggacgcggucgcccuucuccggcggccgcgacacgagccgggcaaaacagcucucccucagaaaggacgccgccccgagccccgcagcucgcgcaaggccgcgccggaaacaccgcgcgcucggcggaagcgccccaguuugaaagccgccgccgccgccccgggccacaaaggccgcccgccagccucgcgcccggccgggcucaccucguccccggucgcccagcucaccgcgccgcuccgccgggcugcacucacgcggccgcacgcacggcgggggcguggcgcugcggggauccgggccgcucgcuuccgcccccgcuuccgcuuccucgcgccuccugggcugggccgucacggccugccgcccgcgccagugcccgcgcccgcuccagcagcggcucugcgggcucccgggugcccgcggcuggaccccgccuucaucuggcucaccgcgcccuuuuccucugccccaccggaaagccaaaacaaucggagccgcgcaggcgcgggaaggaaacggaaagcaggaagggcggaggcggcgcgaggugacgcuggcg

SEQ ID NO: 3024 - RNA, 1609 nt, Mus musculus
uggacuacaucaucuuuuauauaaacgcuacuuucuuuuuucuuuuuuuuucuuuuguuuugguuuuuuuuuuuuuuuuuuuggcagggacucacuuacuggcuggcuuauaacaaguaacuugcuauuuagaccaggcuguccuugaauuuauagaaaucugccuaccuaacucuggcauacugagauuacaggccuaugccacuaugcccagauuaaacuuuguaaacuuuaucguuauugggucgugaccuaggaauuccauauucacgcagucaagaugaagagcagucccauuaacuacaaagaaguuccuugugcuaugugcuagguguucacaacgacgucggucaacuagauuuucuuuguauuauuucagggaagcaaaauuagaguggauagauacauuguauaccagcacgguuaacuauauuuucuuuguauuauuacaagacagcaaaauggaguggauagauacauuguauuugagagcagacaagauuuucuuuguauccuuacagggaagcaagauagaugcauugcauuguaaugcucuguaaugcauucugagggccuguuaacccccucuaccaaaccagcacuuuuaaauagucuggugucguucaugugcuccuguuaaaauuugaacucacuauuuagcgaaggacagccgggaauuccugauauccuuucucuagccuccugccaucugggauuagaggugucugucucuuugccuaaugcuuuauauguggccauucuuauuuucaaaacuggacuuguucuaacaguugaaguuaggaaguaggcaauucugaacguuuuuuguuucguuuucguuacauguaucuuuaggcaaaucuauaacauuuuugcuugccaacaagucucgcagaccacaggcacuugcuacuucaaggcuuugcuuugaaaucuggggcauggagggugucugcugcauugcaguaaaaacuggcuggaggcaucauuuguggagaccguccucugcacccauucgcuuccaaacugcggguuaucucgauggugccaauacuuccaaggccuuagcaagcggaacuucugaaagcgauggaggcuggaacuaaggaaagcagcccauauagcaaacgguccaauguccuccuccccuaacuucagcuucccggggugcagugcuggcccccacucuggcccagccugcaaaugucuguaucucggguggacaccucaaacacgaacaacugcggcugcacagaaguccaagugccgcugaauagaacuuugggaacugauuuuucuaggccaucccugaggauggguggccggcgcgaccccgcucugcuacgcgcacgcgccuuagcagcccgggaagcccggacccagacgccagcgucaccucgcgccgccuccgcccuuccugcuuuccguuuccuucccgcgccugcgcggcuccgauuguuuuggcuuuccgguggggcagaggaaaagggcgcggugagccagaugaaggcgggguccagccgcgggcacccgggagcccgcagagccgcugcuggagcgggcgcgggcacuggcgcgggcggcaggccgugacggcccagcccaggag

SEQ ID NO: 3025 - RNA, 36997 nt, Mus musculus
cucccaguggugaugaaugggagggacuguauccccccccacccccuucgggaggcuaucuuuucacuguuuuaggccguuuugaauuucuuuucuuuagaagagguauuuuuaaucaaaguagcuacuguuccugugauuggcgcacgaccaggggccgaggacacugacgggcggcaaggcugggcuggugaaaugcaguccguuuggugauggagcaucugaaggugcgcuuuucccuggucugcaaaucgcucacacuuugaaugaacccaucuuuacaggcuuucccuacuggaacgugagcuuucuaggcgugcguuuucucuagaaucucucggaaggacacggccacgggagaggcgaggguaacugggagacugugcggcucggcgggcugggccgucaggcugagagcugcugcugggagggcgugacuggcgaaggcuggagguucggcuuuuucgcgcuagcugcauccagaugugcaagccacuguucuccaggaaggcuucgccgcggagccccggcccaaacgccuuccaggagguuugucccugccugcgcgccgugcccugagcucucaggcagggaaagcgcgcggacaugggcgagaccaugucaaagagacucaaguuccaccuaggagaggcggagauggaggagcggucguuccccaaucccuucccagacuaugaagccgccgccuccgccgcagggcucgccgcuggaagugcggaggaaaccggccgugucugcccucuccccaccacggaagacccgggccucccuuuccacccuaacgggaaggugaguugguugccagggccgggaccagcgguugggagggugaggccaccuccgccaaugguagcguccggcggucacgcccugggugcgcugacgucaucggcguacgucccgcccgguguagguccugcccaagcagccggggaaaggcugcggagcugugcuuuccccaugaugagacacugaaacagucugauggagcacugugaugguuccuggcaguaaaaugugaauuugauguuaguuagguagaguuuugucacaccugccugugggcacacccuugcuuggagaaacgcuaaagucacgcccucuuaauuuuuuuccgauuuguuuucuucuuuaacaauuucauuuuucauacauguauuuaaugcguucugguugcuuccaccccacugucuuucaucuccuucccucgucuguacaguuaccucuccuaugaauugcuuccccccccccccauccauuuaugucuuuguuuguuuuaucccccuugggcuugaccaggacugucucugugaacugucccuuggaaccugguggguucagugggguacauacacaacugaagacaauggcuaccccucuuccagagucagucuguugcugagaguuuggcauuaaggauuagagucccgugagccccuccccaucugugacugacuguugggagggccuguccugugcacauccugcaaaaauaauuauauuuauagcaauucugagcucauggucacauuggcuguaucgucuaggauuuuuccauucauuuccccuaucuuuuggcucuugauuuuuuuucuuuuuccugaccauucuuccucaauguuccuaaaucuuagaggguguaguucaaauggcuuguuuauggccaaacccucaggugccaguugcagugauaaggauccuuuggguaugugcccaagagugcuauagcugggucuuaaaguauuauuuauguuugaaacaagagccucacuaugugucuaucuccuagcuggccuagaacuuacagauaccuacuugccguuggcucccaagugcugggauuaaaguuauacuccaucaugcucagcgcauaagguguuuuuguuucuaacuuuugagaacccuuuagauugauuuccaaaucggccgcaccagauuacacucucaccaauagucuaaaagaauuccacuuuccccacaccuguccuagcauuucuuuuuuuuuuuuaauauuuuuauuagauauuuucuucauuuacauuucaaaugcuaucccaaaaguccccuauacccucccuccacccugcuccccuacccacucacucccacuucuuggcccuggcauuccccuguacuggggcauauaaaguuugcuagaagaaggggccucucuucccaaugauggccgacuaggccaucuucugcuacauauacagcuagagacaggagcucuggggguacugauuaguucauauuguuguuccaccuacaggguugcagaccccuucagcucuuggguacuuucucuagcuccuacauugggggcccuguguuccauccuauagaugacugugagcauccacuucuguguuugccaggcacuggcaaagccucacacgagucagcuauauuaggguccuuuccgugcuagcauuucuuauuuguauucuugaugaugacugaggcacaauggaauuuuaaggcaauuuucaucugcauggcacucaucgcugaggauguugaacacuuuugaaaauguauacuauuuguaguucccuuuugagaacuuuaaacacuagaugcuccuuuuuuguugaaccuguaguuggaaaagacuuucuccuauuuugagauccauccauuuguugacuguugcugguauugccuaggcuacuggaguccuguuugaaaagugcucaccuaugccuguacauugaaguauacucucugcuuuuuucucuaguaguuuuagaauauugacucuuacguugagguccuucauccuuuuggacuuggguuuugugcagggugacaaaugaagauauuguuucauucuuuuguauguugcggucugauauucccacacugccaugaccuucacugcuuugggauugaccugauggagcaauggagggaauggagaaacaacagauacacuuacagaaaagcuggugucugcugagcuguuuucagcaggccaaacucagugcauuuauuaucuagaucguuuuguucaggauugguuuggcugucuguguuaaauuucaguaucaauuuuagcauuauauguucuauuucuauaaauuguugcuuggaauuugauaaggauuugcaguaaaucuguagauuacuuuugauaggaugguuauuuucacaauauuuauguuccuaacuuauauguguggcagcuauucccauuuucuaguaucuucuucaguuuccuuggggucuuaacguuuucacuguaaaagucuuuaauggccucagauucauuccuggguauuuugugugugcaugcuugugguguguguguguguguauugugaauugguuuaauucccugcuuuucuuuuucaguauguuugucauuguuauauugaaaagcuauggauuuugucuguuaaguuuauaugcugucaaauugugggaagugcuuaucaguucucaagagauuuguuuguuuguuuuuuguggagucuguaggauuacuuaugcauaggauugaccaucugcuaauagagauacuuuuaacuuuucuuauugcuauugcuuuguuuccuuaucuuauuacccuagcuaagaacccaggcacucugaagugcaauguagagcaugaaagucguuguccuacucaugauuuuugugggacagucuugaguuguugucacuuguuugauauuggaucuagguuuaucauauauaacuuuccugugaugagguauacccugcguuccuuaggcuuuccaugauuuuuauuaugagagcggguuggauuuuguucaaggcuagauaauaccuugauuuucaucuucauaugaugaauuacauuuacuuauguaugaugagccaacuguuuagcuguggaaugaaaucagcuugaucauggugaauauccuuuuuaucugaacuuuaguuuucuaauauauauuuuuuaauauuuauuuauuauuuauauguaaguacacuguagcugucuucagacacaccaguagagggugucagaugucauuacggaugguuguaaccacauggugaugugguugcugggauuugaacucaggaccuucagaagaacacucagugcucuuaaccgcugagccaucucuccagccccaguuuucuaauauuuuauugagaauuuucacaucuauguucaugagauagagagagaguugggucugggauuuuucucuuucuuguguguuuuuaauccaugacuuauuauugaaauuuguuuuacaacuaaaaccuauggcaaaguuuuaaaaaugcauuauucacauuuaauauccauugcuuuuuaaguauguaucucuggggaaagaugcccacuacaaagugaaguauccuggcagcugguugguggaguaacuguauccaugagaauagugaauacggcauugauauggccagcaggugacuuucacuuucaguaucacacaaagaagacuuaguccaguuuaaaguacugagauugaguaguuuucuuuucaucuuuuaucucugggcaaaugugauuaugauaucaaaaauauaucaaauuuacuuguuuaagaaagaaaacucacaaacaacaaggcuugugauaucucuaaacaguuaagugguaaauugguuaguaucuguggugguuugaaaaacauuuuuugugaggauauaauuggaggaggaaagauguacugaaucugauagaggaaaauuaauguaaggaguuguuauuaaacuagaaugagauuggcacaaugaaaaaugucuccuaagucguuaagagaacucuagagaauauagaaauagcagauaugagaacaaccuguacuguuaagacugagagaucauacaaggacauaaggacaaggcucuggguaguagcuaucugaugaugaauaauaaauuaccccgaauuuagcaauguuuaaacacuuaucucacacaguguuugagggugaggaauccagauccucacaguauugcagcucgcugugugguccuaacucaggguuugucaugaagaugcagucauuuuaaaguuacuaagguaaagaccaucuucucuccuucuucucauuguaguuggcaggcuauuggcugguggcuucacuuaacaauguuuuucuuuuccuuugugugugugugugugugugugugugugugugugugugagagagagagagagagagagagagagugugcacgcaugugcacauguuuauaugcauuucuaaugcuuuuucuuugguucuuucucuuauuuguuuucauuuuaucuuacuauauuucauuauuauuccuuagaucguuguuuucuagugagaaacaggaaggaucugaauccaaguaggaggggaaauggaaaggaacuaacaggaguggggggcaccaaucagaauauauuaagaaauauaugugugaaaaaaaucuauuucaauaaacggaacaaaagaaaacaauuaccccauuaaaaauggguacagauccaaacaguauucucaaaagaggaaacacaaaugguugagaaacacucaaauaaauguuugacaucuuuagucaucagggaaaugcaaauuaaaaguacuuugagauuccaucuuacaccagucagaauuuccaagcuuaauaaaacaaaugacagcucauaauagcaagggaguagagucagaggaacacuuauccaucacuguuaggaaugagaacuugugcagccagcacccagcaugagaaucagugugucgguucuucaagaaguugagaauagaucuacccgaagauccagguauaccacucuugggcacauacucaaggacucuauauucuaccacagagacacuugcucaaccauguucauuacugcucuacucauaguagccagaaauuggaaacaaccuagaugucuguagguagaugucuguaugaaaaaaaguauacuuucaauuuaaaaaagaauuucaacaaaaaggaauugcaaaaaaagaaauaucauccacaaagugauuuacaagaaguaugacaauuuaauaauauguauaaagguaauauuaacuuacuacuuacacuguguauggaauuuggauucacaucuuguucagaaaaauaaaauaaccuagaaacaaacagaugagauggagaaauguugacaagaauguaaggauaaguuuauacuuuggauaaaaaaagauuuaaaagaaaaaaguuagauaaugauaggauuucaugaguaaaauauuuuacuuuaaaaaugaaagguagagaaugaaggcaaauuaaaaaauuagaaccaaggcacacagaguccaaguaaguucuucaagguuugacagggauaagacuuauauguuugaugauuaaaagcuuauaaaauugucaaugccaaauuucaauacccaaguuaaaacccauccaugauucucaguucacaacaaggguuuguuaaguauugaucaguucuugugugcuguuguuugucaucuugacccaagcuaaggucauccgggaagacagaacaccucauugagaaaacacuucuaucagagugccuguaggcaagucuaugggcacaucgucuugauuaaugauuaaaguaggaaggucccaucuuuguaguccugacuuauauaaugaagcuaggagaaccuuggagggcaaggcaguaagcaucauucaucugugccuucuucaguuccuacuuucauauucuugccuugauucccugcccugacuucacuucaugauggaguguuuccaacucuguuggauacaguguuuaccacagcaauagaaacuaaccuaaugcagaaauuggugccugcuucaugagguguugcugugacagaccuggcccuguugauuuugggaggauuguagaagccuuuuagacuuugggaugagagcauucagagcuugaugagcugcuguuuugggaaccaggaagauaauaauggugugagaaaugcagaugauagaggccuggcuugugagguuucagagaaaaguuucacagauccugaaagauuauuaugucucuucaugugcuauauuuuauacuaagaacuucugcuuaucuggggcuaaagaaucaauuguggcuaacaagcuauuagcaccacugaaaugaacccuuuacuaggguguugaugcugguuagcuggguaugaaaagaaucagcuaugauuaagagacuagcaucauuucgaugaaaucuggaauuauuuucuaaggguuagcacagagaagcaaugauccauaagagcccaaggcugugucucuugcugguaacugaacuugguaauguguaagagucuccuauggguacugguuuauguggcaucagagccucaggauuaaggggagauaugaaggcuuggcacuuuuaagcacagucagaguccuaaagagaguuuaggagcggcuauugguaaagccuccguugcaguggaaacuugaguguguuggagaugcuagucggaucugaugggcacuaaagauagcagcagcugugguguggaguccaccugaaccuguaagggaagcugugugugcuguagaagguagagucagaaaagcugagcugccgagcuucccucuggaagcccaaguggcauacguucauuaaaaguacagauguauauguauaauacacuuauauguuuuauauguaauuauagguaaauaaaaauaauuugauucuuugugacuuuuucaaacauuuauaguguugcuucccauauauccucuucuuuuguauuguccuccuucucaauggagugcuccggucccauuucccuuucauaucacugugaucuaugauuccccucuauacugcuccauccaugccacuccaugguacuuuaaaaaacaaaucugguuucuguuuuuacuccagacuauauacuuguguugccuaagggaaaacaaacaaacaaacaaacaaacaaacaucauaggcauugccuuacaagauacagguauaggaaaggacuuucugguuagggcuccauuugcccaggaauuaagaccagcaauuggcaaguggaaccauauaaacagcuucuggacggugaaggaaacaagugagcaggaaacucacagugggugcggugucugccagcuauacaucuaacaaaggauuaauauccaaaacaugcaaagaacucuaaaaacaaagucaaaaccucaccugaaauauggacuauagauccaaacagagaguucuuccucauauagcuguucaguuugaccaggacaaauuguuaaagaagcucucuuucucucuuuucuucuuuucaauguguauuuauggcuuugcuaucaaaagucagcuguccauagcuguguggauuuauaucugggucaucaauucuauuccauuaaucagcauguuuguucuuaggccaauaauauguuacuuuuauuaauauauuuccauaguacauuuugaaguuggggauggagauaccuccaagcaguucuuuuauuagucaggauuauuuuagcuauccuggauuuuuguguuucuauaugaaauuuaaaaugauuuuuuucaguuucuaugaggaauuauuuuggaauuuuuauggaguguacauugagcuguagaaugcuuuuggugggauagccauuuuuacuauauuacuccuaccuauguauaagcacagaggaucuuuccauccucuggugucuucucugggucugugccuuuacacuaggacuuguuaauugauuuuaggaaucaggaauuuguuaguuguuauuuguuucgucccauuuguucuugaagguagguauaauugugaugaagaucaggccugcagcguauuugaggugucauuuuccauguuuagacuguguucaggguaguaugaucuaucuaucacuaguccucuuaggguaguuuuucugacuccaacaguugggccucugauuccuugguucuaccugacacccugcacauuuuuucuauuuuuuagaagccuugacucacugccaggaguugcucuguaagggauggucucauaccuguauucucuguuucuaaggacuauucuagaccaguguccaugucuuucuauauuucuggccccuaugccugauuuguuuuugacuccugcuaugucuuagugugguucagacuauuuuucuggcugaugcuucuauuuggaacuuauuuugcaucuggaucccucuuaccuuuuugaaugaguuccuggcauuucuguguugaguguaugcuugagcuuugugcuccuugugaacuuagcuucuuuggguuaaauacuaugugcaaugugaaauuaaguuguagagaaaauggcuguuugcuuguagguagguagcuguaguuaguuucugcuaaggaaccuugguuaguugguuguaguacagucucaaaccucaagggaaucuguugaugcugcacaguucagugggagccagggggcagguuuuucuuuucauggagggugcuugaaggguguguggguugggaggagucagguugcaggcaagcuuuucuggcgucaugagcauagacugaugauauguuguggcagaggaaguuaauagaugaguuggcacacaauuccuggucucaauggaauggcccaagugcaugugugagcugcugggcauguagucucuaaccucacugagguuguacagugagugauacaugggcuaacaggcucuugaagguguguggguguguaaucuuugaccaaaaggggauagugugagggcagaugggacaguaggaacccuuuuguuuuuccuuuuaguuugagaaagggccuggcagagcucauacuuaacuugaacuuacuauguagcuaaagcuggcauugaauugugucauuuuucuguaccucccacaugccaggauuaaaggcaagugcuacuaggucugacuuuguuugcuaucuuuauuuaagaacuauggcaagaaggcaugucucugggagagugagaguuugagauggcuugucauauugcauccuuagucacacacacagggagaagaaugcuggcauucaguugacuccucuuuucccuucuuagucguggagaauaguuaaugaguggcugccacccagauguacuguagguuuccucucaguuaaaccuacuuacaauuguacacacacacacacacacacacacacacacacuggcaacuucccuagaugauucuaaauccaaucaaguugacauucuaaauuaacuaucacccaauuuuucuuaguuuccuuauauggacuaaaaauguuugcagucaaaucauuugcuuuucuuuuguucccuuuccuugauuucugcaaauuauucuuugugacaauauguaagaguuauaaucuacauaaggcauuguuucauuaaaacaguaacuccaaagaaccagaauaggcucuagucaccuaugauaugcugaauaagaucauuucucucguguccagugcaacuuucuacugguuucaugaugcucucuuuuagugcaauuuaauucauuuuuuccuuugauuuuuagauuguucccaacuucauaaagcguauccagaccaaaaucaaagaucuucugcagcagauggaggaaggacugaagacagcggacccucaugacugcucugcauauacugguuggacaggugggguaguaacucuguuccauuccugaacuaugguguaucagcugaggcuuugacauucucuccuauuuuaagauggugaccuuuauaccuuugaaacacuagacaguuuuauuaugagauguuuuauaguuuuguugcugaagaacuacugucugaagguuugaucuuuaauauguaguauuuuuauaacauuauuuaauccaauguacagcagugcaaauggcaaaaaaagccuacuuuaugauuaauuuuguugguuuuaauuuuauuauauuuuucuuugugacaaguugugauuaaaugguuucucuugucuauuucauaaaugauuacuuuguuggcuauacuuaauuugauucaaauaauuuuaauuaaauuauuuauacacauguauauuuuuauuuuacugaugaauuuuuaaacauuauucaaacaaaaagucauauaauucagaacaaaaaaguaugaacucaaaauuaagaagccauaacuaauuuuacauuuuuacuauuauaacacuagaaucuuuuuuccugguucucauaauauaugaugaaggaauuuagaugagauacacagaauauaguuuaggaaauggcaaguauuuaucgcaaauuaaaguugagcacauucucgaggggauaaaaguagauaguggcuaaagggagugaaggaacaauggacaaagggucauugugcaaccuauguuuuaggcuaaauuuacacuauuucuggaacagauaacuuuuucugaggggucuuuccuguucaggacauugaccaaucuguuuggaugaacuauuggagaaagggacuuggagcucuucuugucccuuuucuggguaccugguagauaguaauccuacuagauuuagagcuccuggaacaauguuuagauacuuuucuauuaaugguauucuaggcaagucauuaugucaccucuccuucuggggccagaaauaugacuaaagucuuauucuuuugacuaguaaauuaguuuuagacuugguuuuacaagauguuaaugaggauggaguucagcucuaauguccuccaagccuacuaauaucuaacuagcuacuuaacaguaccagggagucagaacuuuuuuauagcuaagugaguuauauagaaugauagaucuuauucucagggaguacaguaaagccugauuaaagugcuaaagauucacauacaaauuuagagacuuuucuuauuaguuuugaaguuguauuuuuauuucuucuuugauauaauauuuucauugaacaguaaugcuggguuauuuucuggucuuguuuaauuggagcacauuuggccuuccuuuucuucuuaaaauaucuucuaucuuuagagcuaaggaguguuucugguagauaacuuacacugauuuuguuuugugauccauuuagucagccuaugucuuuugauugcagaauuaaggcuauuaauauuugaaguuaguauugaaauguuuguguugguucccguuauugugguguugauuuuuuucuuucuuuguguguguguguguguucucagugguacuuuuuguuuuagaaauuacaguaucccaucuuucuacaguuucucugggcauaccauuuuucuauagucucuaaauuacauuugcaucagcuuugacuuguuaauauuuguuaggcuagggcaaucccuuauuuccauuuauagauuacaggauuggcugggugggauuucauacuauggguaccacuccauuuagcuucagguauuucuucaaacuucuaauguucugaucacaaaauuugguuucaaaauuacauuccuuggugcucuuuuucuccccagauuauacauuuuguuauucuuuucuugccugcuugcucuuuuucauuauagaucuguauaagaauagucacugcucaucauauaacaguuagcgcuagguuauuuugaaaucuuugccagugauauuacuccaaaacucuucaauuuagacuucagaaaaaaaauuuagaacaaggauaagaagcagccacauuuuuccaauauaucucaagaaugucucuaguuuaguugcuauugcucuucucugaaaccucuugaucugggccuccauagucuacagugcuuucaguguuauugcuuuccaagcuccuacuaggauagcccauuaagcccuacuuacagagucaacugcuuuccuaaucugaagcaacaaagucuuccacacuccuaaaacagugguucucaaccuuucuaauggugugacccuuuaauacaguucuucauguugugguggccccaacaauaaaauuacuuuuguugcuacuucauaacuguuauuuugcuaccauuaugaaucacaaugugauauguaggauauuugauauaugacccccgugaaaggguuauuugacccacaaagggauuacccacaguuugagaaccacugcuauuauuuaguaauagcaugguuaguaucaucacagcaauauuucaguuccugguaccaacuucugucuuaguugcucuucuauugucaagaaaugccaugacugauccaacuuauagugaaauucauuuaauuaggggcuugcuuauaguuucauagggcuaguuaaugaucauuaaggcagauagcaugguggcaggcaagcaggcauggcacuagagcagaaauugaaaguuuauauccugauccauauguagguggcagagagacagugagacugggccuggcaugggccuuugaaaccucaaaagcauaucccaagugaccccacccccuccacaagaccacauguccuaauccuuccuaaauaguucuaccagcuagggaccaaagugguucaaacaccuauggaagucauucucacgaaacucaccacacaaaaguucugucagcuuagagauucucucuggagaucucuagaaacuuauagagggcucacaggauucuacaggugcacuauaaggggucagucacaaguggaggcgagugugguagaggccagauuuggugacuuuaauuagggucaaggacucaaaaugcuaauugguccuggggauucuuggcaggugggguuaccucacucaggauggucuuuuuuuaguucuacucauuugccuguaaauuuuguaaugucauuguuuuuaauagcugaguaauacuccauuguguaaauguaccacauuuucuuugaacauucguugaggaacaucuagguuuuccaauuucugaccauuaugaauaaagcuucuaugaacauaguugagcagguguccuugugguauggcuacuccuuuggacauaugcccaagggugguauugcugggccuugagguagaucuguucccaauuuucugagaaauggccaaauugauucccaaguuugcacuuccaccaguuguggaggagugugcuccuggcuccacaucuuugccauuaugaucuguaccuugauucugauggguguaagauggaaucucagagucauuuugauuucuauuucuauuguggauaaggauguucaacauuucuuuaagugcuucuuggccauuagaaauuccucuguugagaauucuguuuagaucuguauugccaauuuuaaaggggucauuagguuuguugaugucuaguuucuugaguucuucagauauuuuagauaucaguaucugucagaucugggguuggugaaggucuuuucccauucuguaggcuaccauuuuguccguuugaugauguccuuuuccuuacagaaguuuuucaguuuuaugaggucacauuuauuaauuguuaaucuuagugcuugagcuauagguauucuguucaguaaguugucuccugugccaauacauucaaagcuauuucccauuuuuucuucuguuaguuuuaguauaucuaguuuuaugauggggucuuugaucuacuuggacuugaguuugaacagggugauagauauggaucucuuugcauucuuccacaugcagacauccauuuagaccaguaccauuuguugaaggugcuuucuuuuuuuucauuguauaauuuuggcuugccaaaaucaaguguccauaggauuuacuacuguauuuuucaguuagauuccauugacaaaccuuuuuuuuaaugccaauaccaugugguuuauauuacuguugcugugcaguaccacuugaaaucggagaugcugauaccuccagaagguuuuuuuuuuuuuuuuuuuuuuuuuuuuuguacaggauuuaaaaaaaaagauaucauaggguuuuguuguuguuguuguuuuuccauaugcaguucagaauuguucuuucaaagucuguaaaagaauuaaguuggaauuuugauggaaauuguguugacucuguagauugcuuuugguaagauggccauuuuuacuauguuaauccuauugauccaugaguauggaagaucuuuucauuuucugauaucuucuuuaauuucuuucuucaaagacuugaaguucuuggcauauagaacuuuuacuuucuugauuauaguuacaucaagauauuucauaucauuugugguuauuuugaaggguauuguuuuccugauuuuguuuucagucuguuuaucauuuguauaaaggagggcuacugauuuuuuuuuaguuaauuuuauauacagccacuucacugaagguuuuuauaagcuauaggaauucccugguagauauuugggagucacuuaugugcacuaucaucuuuuggauaguaauacuuuaacuucuucuucuucuuuuuuuaauuugaauccccuugaucuuguuuaguuaucucauugcucucgcuaaaacuucagguacuaaugaauagaugcaaagagacuagacaucuuuauccuguuccugauuuuaguggaauuccuuuaaauuucucuccauuuaacuugauguugccuauugucuugauguguauugccuuuauuguguuuagauaugggccuuguaucucugaucucuccaagacugaauaguccaugaaaggaguguuguauuuugucaaaggcuucuucuaaugagaugaacauguggguuuuuuuuuuuucucuuucaguuuguuuuuaugguggauuauguugauagauuuucauauguugaaccaucccuggaucucugggcugaagccuacuugaucacgguggaugguaauuuugauguguucuuggauucaguuugcaaguauuuuauugaguauuuuugcaucaauguucauggaaaauuagucugaaauucucuuuguugaauuuuuuguguaguuuagguaucaaggugacuauagccucauaaaaugaguuuggcaauguuucuuauguuucuauuuucuggaauaauuugaagaguauuaguauuaguucuucuuugauagucugauagcauccugcacuaaaaccaccuggucauguuuguuuuuuugguuuuuuguuuuuuuguuuuuuuuuuuuuugguugagagacuucuaaugacugcuucuauuuacuuagcaauagaucuauuuaaauuggguaucugaucuugauuucacuuugguaagugguauuuucaagaaaauuguccauuucauuuagauuuuccaauauuguggaguacaggcuuacaggcuuuugaguaagacuuaaugauuccuuggauuuaccacauuacaauaguaucuauuguuaugucuccccuuucacucugaguuuguuaauuuggaugucugauucucucucuaccuuuuaguuaguuuggcuaaggauuuguccaucuaauugauuuucuuaagaaccaauuuuuuguuucauugagcuuuguauuguucuuuguuuuuauuuuauugauuucagaccucccucagauugguuauuuccugcccucaaauccucuugagugauuuguuuuuauucuagaacuuuugggugugcugagaaguuacuaguaugagaucucacuaauuucuucaugaaggcccuuaaugcuaugaacuuccuucuuagcauugcuuucauugugucucauaauuauggguauauuaugcauucauuuucguugaauuuuagacuucuuuauuucuguuuugaccugguaaucauucaguagagaguuguucaguugacaugaguuugugggcuuucuguuguuucugauaauauaguccagcuuuaauccaugguugucugauaagauacaggggguuauuucugucuucuuguauuuguugagacuugcuuugugaucaaguauauggucaauuuuugagaagguuccaugagaagaggauauauucuuuugaguuugggugaaaugcucuguagauaucuguaagaucuauuugagucauaauguuuguuaguuccauuauuucuauguuucguuucuaucugguugaccuguccauuggugagaguuggguguugaagucucccacuauaaaugugugggguuugaugugugauuuaaguuuuaguagcccuucuuuuacaaauguuggugcccuugcauuugggucaaguuuauccagaauugaaacauccucuugguagauuuuuuccuuugauguguaugaaauguccuucuccaucucuuuuguuuaauuuugguugaacaucuuuuuuguuagauauuagaauggcuacaccagcuugcuuccugggugcauuuaguuggaaaaucuuuuuccaguccucuacucugauguaauuucuaucuuugauguugugauguguuucuugaauguagcagaaugauggaucuuguuuucacauccauucuguuagccuauaucuuuuuauuggggaauugaguccauugauauuaagaguuauuaaugaccaaugcuuguuaauuccuguuauuuugauguuggucauggugcuggugguguagaugcuucuguguuuaugcacauguguguguuucccucuuggguuggaauuuucuuucuaauauauucuguaggauuggauuuuggauagauauuguuuuaauucgauuuugucauggaauaucuuguucuuuccaucuaaggugauucaaaguuuuguuggguauaguugucugagcugacaucuguggcaucauagagucuuuaugaccucuguccaggccauucuggcuuuagagucuuuguugagaugucagguguaauucuaaaggucugccuuuauaugguauuugcccuuuuccccuugcagcuuuuaauauuuuucuuuguucuauacauuuagugcuuugauugauauguggcauaagguuuucuuauuuguuccaaucuauaugguguucuguaaguuucuuguauauuuauagauaucucuuuucuuagauuagggaaauuuucuucuaugauuuuauugauaauauuuguugggcauuugagcugggcuucaucuucuucuguuccuauuuauuuguagguuuguucuuuucauagugucccauauuuucuggaaguuuaaugucaacaacuuuuuagauuuaacauuuucuuugaugguguaccuaucacuucuauuguacugucuaaaccugagauucuguauucuguaagugaugcuuguauaugucuuacuuguuguuuuaccuagauuuuaugucuccaggauucccucuuuuuuucuuuauuucuucuauuuccauuuucaggucuugaacaguuuuauucauuuucauuaccuguuugcuuguaauuuuuuugguauuucuuuaagggaauuuauucauucccucuuuaagggccucuauuaucuucagaaaguugaauuuaggauagaauuuucuugucccuucagcuguguuggaauaucuagggcuugcuguaggauagcuaaguucuuguggugccauauugcucuggcuguuguugguuguauucucaugcugacuucuaguaaucugccuuuugggaguuauuauagguucaggggcuuauuccuaauuuuugucuuuguuagauggguggguauuuuuuuuuuuuuuuuggauguuuucccucuuaguuucuauuuccuuuuugaucuugugagugaccagaaauuccaaugaccagugauucuucaagucugguaguguguuucugcuugcuuuuucuuuuauuuuuuuuauuuguuuguuuguuuauuuuguggccugugugaccucuggugguuugggugccaagguuaccucugagguccuuagaaccaguguggccucugggaaagcagaggucuccuguauagucuuauggcugaauauggagcccaggugaugagguguaguauaaggcuuuuggguaugcuauuagggggaguuggcaagcauaggacucaggguaggcucuuaccuugggucccugguacuguugucaccucuaguaaagcagcugaaguugugacccugaaaauggagcccaggggaugaggugcaguucacugcuguuaucugugcucuagggaaaguuggcaggcauugggcauaggacagggucuuaucuagggucccugguacugcuguggccucuaggagagcaggcagaguuauuguccagaaaauggagcucauaacucaggaguuaaaauaugcucucaaagcaaauuauuuucuaacgguugcugcaaagagcucucaguaauauuccugguucuaucuuuggugagagaagacauugauagagagucucagaguaucccauucuggccuuagggucacuaucauauaguugagaaugucuuugaacuccugacucugcuguguccaucagccacaugcugagccacuacaccuggcuuuggauuucuauuucuguauuuacaaagagguuggucacaggcugcuccugcugucccuguucugccacaucaugugcacucccuaaguggggaucugacucacuggucauauccucaauugcuuaaugaggaaaggaaaacaaacugaaaaauuguagaaaauuagaaaggaggcauaaaguccagaaaaguaaucauuuacucugguaucacauagaaugagaaauuauuugagaagaagcauaaggaaagaguuauauuagcuugagauaaagagaagauugaggcuggacuggaugugaaugggaacagggagugagugacaggagccgcaguaugucuugugucuuuuuucucuaacaguaaaauguggacauacuauaucagguuaguuaacccaugauaaauuucaaccuguuucuuguuuuuuuccacccuaauuuuugggucuuuuucguuucagcauuuucaguuuucugaaauaaauuauacuuuuucucguuauuguuuuauguuuuccauuucgaaauacagaaugcuaguagauguuuguguaauuauaaaauaacucccugaggguacaacugaagauaguaaugcuuuucuucgugggguggggaucauuccaggcauagcacuuuuguaccugcagcuguaccgggucacuggugaccagaccuaccugcuucgaucccuggauuacgugaagagaacacuccgaaauuugaguggucgcagagucacuuuccuuuguggagaugcugggccccuugcugugggagcugugauauaucauaaacucaaaagugaaugugagucccaggaaugcaucacaaagugaguucuaaaacaucuccaaauguuuuguugaagaauuacugugcaaagauguucaacaauuaaaguauugucuaaucugcuauugcaaagaggucucucugaaaugugaaguauguuaguuuaguagugggaccauguguacuuuuucuguauguacaugaguguguccuaauuucaguggaacuuuaauauucauuucuaaacaauuuuugguugucuucaguguaugaaagcaagugcacguccaugaaaauagcuugacuaauccugagcucaaucucuagcucuuagucaugguaaugagggaaugauggacugugaagguuucugcagugggcaguuuauagucuucucaaacaaguagaaaacaaagucccaucuuuggaucuaguagaguaucugacaugugcagacauuugauguuguugaaagauugagugacuuagccuugccuagguaguaaccacaucucggcuccaucuuuacauacauuuuauaucacucucuucuaacacuagauuuuaaaguauguacucuguuuucacuauaugauuuagaguaauagaaagguggaaaauuugggcugaaaaaaaucuuuuucaaagcuggagauucaauuuaggaucuccuauacuuguaauacugaucuauauacccaucccauauauuuguauucuuaaguuauuauuugaaacaggaaucaauagagagagagguuuugauuguuuuaugaacuugagagauguuuuagaaauuuucugagauaugucuuguuggucagacuucuacagaugcauagaacuauugucugucaagagucagagcuuccugaugaacugcuguauggacgagcaggauaccuguaugccuuacuguaccugaacacagagauuggcccuggcacuguuggugagacagcuauuaaagagguauugugggccuacuggacuuucuggcacucgaaacuguuagcauguaguuauauuaucacccagccucugcuucuaggugggaguaauucuuuacaggcaucucauaaauuguuuuuuguuuuuguuuuuuuuguuuuuuguuuuuugcuuuuuuuagaaacagguauguaucuucucaaaggucuuuuaaaaaaaucuaugaacuuuauuguuaaguuauguuccacuucaaaaccucaggaugagaugacugugauuuggugugcauacucuuucauuuuguucccuugaucucuacauaugcccuuacccacauaaccaaauagagcuuggcucccuuagccugccuggaaaaggaaaggaaacagcuuccuuugucagggaucuguuuacaagaugcccaccucguguuugcuugcaucucauucuaaaaacuuagaugacuagcuagaaggccagaucccaaguaaagugaagugagucugccacauaguuguucuagacauugauccauaacacagaagaccacauagcuccucccucaccaacgaagcuaguguguguacucugucuuggggauguaauugcuguccuuuagggaaacuguuauaacucugaagcaaguaagaaguauaggauaguuuuuaauaggaagaccauagaauuuagucaacuuuuuauacuaagaacuugaauuccauagguagacuucuuacauguuuuucuccuuaggcuuuauuuccugguuucucucugucugaauuuauuaaauaaaagcaauuguuagauaauggcugcuuccauuucuuuuauuuauuaaucugcauucucccacacacuguuaauuagaguagaugaaggugcuuguaacuuggucugauuuccgaugucuccuugucucuguagguagucagugcuauuauugagucgggaaagagucuaucaagggaagaaaggaaaucugagcgcugcccccugcucuaucaguggcacagaaaacaauauguuggagcagcccaugguauggcuggcaucuacuacaugcuaaugcagguaugugacaauuguguggaauaaugaauauagugaccauaucacaauauauuagaccauaugaaugggggauuaaauucuucauagaguucaaguaggcugaauuaaagguuccuauuuugacucacagauaauuaacuuagcuuuacuucagugaauuccuaaaaguacauucuguguauaguuuguaccagcauaguugcuugucacccacagcuuccuucugcucugauccugcugacugaaguaggaacuccuuaauggagguugugugauuuacaugcauacguugguuuuauuccuuaagagacauacucaucaugugaccuuuacuucuuugcuuuuaaggugaaaugcauagaagcgcuguuuaguaacugcuguuuuuagaagcaugccagcuuuugcagacauagcuaaguagugugacagagcuggcuugcucccuuuacagagguggcuaaauggugugcugaggcuggggugagaacucuguguacuuaugcucugugccacaccacaacuuguagccucugugcccuaauacauguccuggggucaucccagcucuugguugucaguuagaaggcugucaguagagucuauaugaaaauauuucuaauuacauuuggaaaaugaaagcucguuuuuguaguaccccuacaaaggcaaagcuuucuuaccaauuuuuuuuuuuuucaaaaauacagaacaagaacaggaauucuaguucuuuggaaagaacuuggagacauauaggaacucaaaaugaaaagauaugaacugaaaauaaguuuaaaaaauguaggagagaaaaccacacagauggccgaggagcagagacuguuucuccugcacaguacagaacugggggaauguaaaugacauacauguaccacagugucugcagcagguguauaugugaguugagaugaagccagcguaggagaggaaggggcuucuucaaacaucucuaaggagcguuugaaucuguuagauucuuccuuccaguaauuccuauuagcuacgaaaggaauugggacuugauaaacagaaacguucuguuuugagcagagaaagccuggcuuagaagagagcccgacuuuaaucccagcacucaggaggcagaggcaggcggauuucugaguucaaggguagccugguguacaaagugaguuccaagauagucagggcgauacagaaaaacccugucuugaaacccccuccccaaaaacaaaaacaaaaaccaaaaaaacaaaagacaaaaaacaaaaaacaaaaaaacaaaaaacaaaaagagagcaaagggaggacauucuacaaggcacaugggaucacuauguugugcuucagacacuuccacugcucucucacaguggggcaauacagccucuaccccaaagaugaggccacaaucuccuuuuggaaacacugauuuaauaauguguuguuguuguuccugugucacugagcuuucacucuggacuccucucaguucccaaagucuuugugaucuauugaaaaccuucaguucagacacaugaagaauguacuauacuugcauuauuucaagugcaaagggguaacaggaagaggaaccauccucauuuucgguagccuuccuacuauuucucugggaccagcagcuucucugaaggccauacuauaauaguuuuuaaaaaaaucagaaaaauaaauuguuuucccuuuuuguguuuuuaaagccagaagcaaaaguggaccaagaaaccuuaaccgaaauggugaaacccagcauugauuaugugcgccauaaaaaauuccgaucuggaaauuauccaucaucauuaagcaaugaaacagaucgauugguccacuggugccauggugcuccaggagucauccacgugcucuuacaggcauaccagguuagugcuccuaaauuacagguguuccagguuugugcuccucucuuauccugagcuuccagucggucauaguucucaugcuuucauguugcuucaauuguauacugaaaacugguuuuaaauuuucaucucuguuagagugaguagacaugugccaagucaugcgaauggacucaggggcagccuucaguguuggucuuugccuuccaucauguuugagcagggucuaguaugguuuugcuggcccuugugcuuccggggcguuucuuuucucugcuuccuguguccggguaggaauggugagacugcagaugugcaccgucucagcagcuucacauggaucccgggggucugcacuccaggacucaugcuuuaacgacuaacccaucuccccaccucacuuuccacuuucuguuuuaauucuuuaucugcgcauuugugugcauugugugaucacguaugcuuguguacacaaguguguccauguauugaaagccagugguuagccuuggauaugguccucuggaaccagucaucucacuuuuucuggauuucucacugcccggaguaugcuacacuagcuggcugcugagcucaggggaucaguguuucuccaccuuuccagcacaggauuacaagcauaucccacaaaucugacuuauuuauuuaaaugaggggggagggagagagauuauaaaauaacauuauuuuacccccuuccuuuuccuuccuauaaccccuccaauguaucuccagcuuucuuucaaauuuaugaccuugaccucuuuuucuguaauuauugauauauguauauauauuucccaguauauaaauaacaguguguucagucuacaugacacuacuuguauauguguuuugggccugaccgcuuuuuuuuuauuauuaguaaucuuucuguuuauuuaauaucaccuccauuuuauaccaaaggaaauuucaguggcuaagcuaaugaaauucagaaagcaaucccuugaccacacucugcacaauuccucuguccuuuagaaaguugccacaugaaaacauucauuuuuaugauagauaauuauauuacagcugaggaguugguauuaguuagaaaauaaagcacagauauauuugcaugaccauuuuguauuggauaaccauuucagugcucuuccaguaucagcauuccuuaauuuaaaagcaggagcaagcuggucauggugguauacuccuuuaaucucaguacucaggagccagaggucaggggaucucugugaauuuaauucuacauaguaaguuccaggccagcccggguaacauggaaagaaaaucuaucucaaaacaaacaauaaaacaaaccauagaaacacaaagcaaaaauaaauaaaaucaggacugagacagagcuguucacuauccugcuuuuuucaauauaguguuagucacuauaaagcagaaaaagagaguaaagggucacaagucagaaaagaaguuaagcuauuucuuugcagagcacacagcuucuuuaucaaaauaauguaugaauggcuaguuaaguaggacaauaauaaguguauacauauuuccuagugcauacauauagaugaauagguagauagagagacugagggaaaacagauagauggauguuagaugguagguagauggauaccagaugauauauaauuaaauagaugacagacagauagacagauagugccaggucuagcauggcuauguaaggggaggugugacacaguucccugguccugggucaucgccaggccuuuauucccugugugugcugaugguugcuguugcccugaagcugaucugcugucucuucuacuuuacuuucaaucucucuuucuggggcauauacuucucccauugcucggaacuaaucacucuauaacaaaugaaacauucgcuucucaagaaugaggaauggagguggucacgaggcuguggaggaugaggaacaggccuucaugcauuuuagggccaugggaaaggaucgagagaacauaaccacagagaccauaaaggccuacauggucauuuguggaaauugcuagacuuggccuucaacuuggaauuauaugaggagauacagauauucucugggccaaugacugaauuaaauuagccaggugaacuuggggauaucaaugacagagaguucaaguggucuaagaagaaaaggcauguauaagaaagaagaaagaaucuguacaaaacaagcaauggauagauggguuuaucuuauaggaggaaggcuuguguaugaucuagaaacaaauaguauuagaaggagaguaugguuuaauagaaaaggauggugggcuagagaauuaauguucauagagagguugucaguuuuggacaagaugccauggaauugcuaggacaaggaacaaagauuagagcauuaaaagaugaaauacaagcauaagaaaaguuagcacuuuguucuccuagcuacuugaaggauuggagaugaccaugccuagagagauaucggagagagccagcugguuuacuuucguacauuuuaaagcuuugugagaaaucauuucaaccuaaguaguccaucacuuuucuguucuuacaugaaagaaguuacuaaggacugcugugugcuguaccaggaaacacaagagcugugccuagcuacccaugaagagcaggcuguguaaaaacuguaaggaaaugugcuucugcuugguguuuaguuucuguuuuuugagaaagcagugguugagacuaaugaucugggauucauacaauuuauauaaauuuaagguuuucuaaaaacaguggucaaagccuugaagacguggcuuuaguaaauaaaagucugaguucaggcucucugguugaaagaaggaaaaagaaaggagaaggaagacaaaugagaaucccugggcaaagaaagagcgcuugaauugacagcuugcaaccaccacugacuccgaauuauuauugagucagugcugcucccauucgcccuuucucaugacccucuucaugcugaggcaagauaggugcuaccagauacacuagcauguauggagccuaguugcucuuacaguucuugcuucuuuccugagccucuugggcccuccugcuacaaucuuccuuucucuccagucagucuccugguaggacaaccugaaaagcccugcuuauagaauucaaccacuuuucuaguacagagucccaaagauuucauuauuccuaaaaacaaacaaauaagccaaaacaacaauaacaaaauuaaaccaguauagucagguucuugacagaaauauccccaaaaaccuagaacuaguuucuaugucaguuuacuuuuucuuuuucuuuuuucuuuugagagaauaaauucgauuacuggacauaccacaaccacaauuuaaacaugaccaaguuuucagguuacgaauguuaaacuucauuuacuagaaccaaugaccaugauucaguuuaaaccucagucucuccauugugugaauucuugcuuccuucucuuucagugucuucucuuggaguuguaucugauuuuguaccaguuuucaucugaaucacuugaggaauaggaugcuuuugcuuuucuuucuuggcuaggaaucuguuaacucugaaaguauugugaaaagauauaaugagaagccaagucaggaguauggugcacaguggaggaggaaaggaaaaguaggggccucauauuaguuuacuuuucuauugccguauaaaauuccaugaccaaggcagcuuauacuuacagaagugacuguuuuuuuuggcuuaggacucuagagaguuuauagucuaucaugacaaggguauguggcauugagcagcacuuacacugcuugaagcagaacuggaggcucacaucuuaaauugcaagaaggaagcagagagugaacuaggaacccauguggcuuuagaaaucucaaaguguaucccagugaugaauuuuuuuauagcagggccauaacucccaaguuucacugaacuguaccaccaacuggagagcaaauauucagauuccagugccuauaggaaauguucuuaugcaaauuaccacaggaaggaauucauaccugacaugguaaaacuagcccacuacccagcacuggugaagccaaggacccuagaggagaacucgauacugccaucucucuaaauuaguauaaucuucaaacacauucugaauacuuauucuucuacucacaggcaaguauagcucucaucucauuaagaaaaaaagaaaaagaaaaagaaaaaaaucuuuuugcaguauugaccauuacagaaagaugcaacuuguucaaauucagagaacaaaucucuauggggcuucccacagcaacugauauauaucugcaguacaaccccugaauguaucacucagagaagaccaugaaguggugguagaauaacugcuacaggauaauuauuguauauaugauagaaaaucugaaccuaugaagucucaacaauauuggucuccuaaacaagacaugaaaaaugacaauacaaguugacauaccaucacgaauagggaaaucucacaaggccccacccuaaauaagggaguuucaguuuucuccugggaggaguccccagauaggugauccaaucaaagcuguuagccuuaaacacauuugaauugugccaaaggccuuuucuauauugagaugauaauuuuuuuugauuuaggucaauuuauguugucuauaacauuuauugacuuauguauguugaaccauuuggauuucaagaauaaagccaacuuagucaugguagauggauaaucuuuuuuuuuugauauauguuuguauugcaagugauuugcuuuuauuuuuaugccuuguuuaaacucauuuaauuuuuugaaaacaucuauuuauuauucauuuaaaucuguaaccuauggcuuaucuagguauuucucuuuggcaaacauuuccacagcacuagaugguuuuggagaggagaugcuggcgugaccucuuguauugcucguaauuuuucgaaugugaccuaggcauggggaccucuuuucuuaguucugugucugauauggauagaauaaguaggagcagaagagagaaugugggggugggauugugcuuaaagguugaaaaugaguuagguggagugaugucaguugaacaggguagacugguaugguagguaagaugugagcccugguucaagccuugaguauaagguagaucuggguggauaaagagguugcagguguugugccaagggcauguggguucagaggcaggcagggcagguucuggggggagcugaaagguugguugccucacaggcacagguggccagucuagguaggccuggacacuggauguggcaccagugcuaggccugguggauuaaggaggaucuguggaggggagacucacugcgagaagagaccugacuagguggagagguucuuguguguauuuaacccuaaugccuuaucuguuucauaauguauaguguuuuaaucaagggggaaguauuuuucugacucuaaggcaaaacagucugcuaacacuguuuucgguuucuuucucuccagguuuuuaaggaggaaaaauacuugaaagaggccauggaguguagcgaugugauuuggcagcgaggucugcuccggaaagguuauggaaucugccauggaaccucuggcaauggcuauuccuuuuugucccuuuaucgccugacgcaggauaagaaguaucucuaucgagcuuguaaggugaggacaccucuaauccacacugcuccugagcuucccagaacagauuccaaaagcgcaacuccuccuccuccuugcaccuacuccucccaggcucugguuaaucuguuucuucuagcucagccuuguucuugggcccucuguaucucucugugaggugaagguagcagacauaaagguugcucugaagagcacagguucuggaaucauacugucuggucagaguacagcacuuauuuauuuguucgguuguuuuuugagaaaaagucugagcuagcacagauggaccuugguuugcugcugccaagaacaaucaugaccgugaacuuaaagcacauuuauucuucaagccucaauuuccuuauuugaaaaaaaaaaagggggagaaaaugauuaccaaagauguuuuaagaauuaauugauauaacauucauacuuucuacaguuguuccuaguuaaauccuucacugguuucccauuaaacugcaugucaaagcuacccuccugucuccgaguuucuguagucugcaugccuugacccuuuccuauuucccuaccucccugucacauccuauaccacuuucaggcauacuucacuagauagcacuauucuucccucucagcagaauggaggcuaaacuguuauuaccuauuuccuucaccaaaaauguacuuuccaugggcaaguugcauaggaaaucuuugccucuccaauguuacuuuaacuaugacauucuucagggucuuuaauacuaccagucauuuauugaacauuuugcuuaauacuuggcucaaacuggagaaauauaagcuuugugauuguacugauccaguacaguagagagcuaagggcugagaucuuuccacacuggaggauuguuccagcaaccguuauaaggcaguagaugugaggacacuggggaaaagaggaaugcugagcauguucuccauaaguaacccaggccaggggaagccggcagccaaggcugaggacagguucagagccagggaguuuuauucagauggaacaggugcuuggaaggaacagggugcuguugaguuacugugcauuucuucucuaggugucccuacaauguuuuaagguaaauauaaccuacagcgaaagaaaccggcaaggaaaggucucuagcucucauccuucuagggggguuuggccauacaguacaguucagagcccuggaaucacugcuacccaaacuggcucuuuaguuauuguuuuccaaguuauuuuuaauguuuuuaauuguguguguguguguguguguguguguguguguguguguguguguaggaauuuucauauaaguguaaguacucaaagaggccagaggagacaguucccaucaaggauggcauuucagguguuugugagccaccuggugugggugcuuagacucaagcuaggguccucuggaagagcacagcugcucuugaucucugagccaugucuugagcccucuucaauucuucuucuucuucuucuucuucuucuucuucuucuucuucuucuucuucuucuucuucuucuucuucuucuucuucuucuucuuuuuuuuaaacucguuaaaguguccauugccucuuagaaauucuauucuuaaaaagaugcgucuuuccuuuuaguuugcagaguggugucuagauuacggagcacauggaugccgcauuccugacagaccuuauucccucuuugaagguaagagugugaaaaauaaaauaaaacuguacauuuaaacacuugguuuaauagcacugauuuccgugcuuugaggacuagcaugaggacauuugguguugccugaguaaagccucagaacuaacacacaaugauagcaagccuguuguucuugcuauauuuugguccugcaaguaucuucaaaaguuuuagaacuuguaugaaguacauaugcagacaaagccuggaaggcuuacuggaugggggaaagauaguaugcuuauucuucugcauuuccucugugauauuguauauauaaauaaaauauucuauguguucaugggaaacuugaguagauacuuaauacaguuaauucuuuaaauuauauaaagaauuacuaguaucuaauauuaauagaaaguaguaauugaauauuaauaauuagaaaaauaagagugaauguuaaaggguguuuaauacuucuacuaauggcaaaaacaagaccauuaguuaaaguaacaauuauuaaaucuucccaguuaauaaauauaguauauaagaauauacuauacuauauuauuauaauuauaauugaaguucuagagacagagagauccuuauuguuuguuuauuugauuuuuuuuuaugauagggucucuccauguaguccugguuguccuggaauuugauauguagauaaggcuagccucaaacucauacagaacugccugccccugccuccaaagugcugugauuaaaggugugcaacaauacauuuggccuccuaaauacuuuguguguguauauguguguguguguguguguguguguguguguguguguguauucgugcacacaagcacuuguguguuuuggguaacuuauaacccacagugccaagacuuuauagcauuaggauaaauugauaauaacuuuagaaccacaucuuauaacuauaucccaauguaaaccucagaaggaaaaaaauauuuuaaaucauguagauaggaaauggauuuuaucaaugcuuuuucuguauaagcuaaagucauaaggaaaaauauuucucagaauaaaaucuuuaguuguuuacauaacaaaaauauaugacagacaugguggucauugccuguaaucucaucacacugguagcaaaagcauuagcucaugaguaugagucuggccuaggcucuauauugaggcccugucucagaaaaauauaaacaugagauauguuuauaucagacaauauucaacuuuaacauggaaacuuuaauuaaauauggaauuuugacccacauuuaauuaaauuuaaguaaagugggucaaaauuccacaguugaacuucuuuuuuuuuuuuaauuagguauuuuccucauuuacauuuucaaugcuaucccaaaggucccccauacccacccccccaguccccuacccacccacucccccuuuuuggcccuggcguuccccuguacuggggcauauaaaguuugcaaguccaaugggccucucuuugcagugauggccgacuaggccaucuuuugauacauaugcagcuaaagacaagagcucccggguacugguuaguucauauuguuguuccaccuauaggguugcaguaggaagucaacugaccauguuugcucugugccucaccaaugcauggcagauagaacuggcaguaacuacuaaccaaguucuuauguagaagccugacagcucuacugagagagaacacugaacaguaucugauguccuccaggagcacccacucugccacaggcagcauucugugggccuggcaacugccuaugaaauccagaaaccagcuguucugaggcuucucucuaggguccucucaagggcauuaagggcaacuuucugauucugauggguucuaauaggucugggauucuuuuauucauuaagcuucuagaacacuuucuucaaguaaaaaguuucagggaaggcuaggaccaacccaaauuuucuuuaguaacaaaauaaacagucuuugacuguacucugacaaagaaacaguacuuaguaagaagggcagacuauuggcagccauaaaucagauccuagcugcaggaaucugacuuaagaagccgguccccagaggcugcauacggauuccauccuggucaaguucugaaaaagacaaagcuuaucuauggcaguuagauaccucuaaugacagaauggacacagagugcaggaacacauagacccacauaugcugguagauccagacuguaacagacguuuguuuuauacagguuguacaguugucaagauucaaagaauacuuaugauuuauguauuuguuugugugcaaauuuuguggcaaaagaaaagcuaagcaaacugaaacugugacaggggacaguuuuacugucaauuccucugacugagguggacacauaggccuggaggcccacgaggacaagaagcucacaccccagaccccccaaggucucagucagucaacuucaauagcugcuguuuauucagugcccgaccuuguugacauaaacaaacugcacuuaauuaaaaauuacuuucuucaaagcuaaagaauauauaaaauaggauggagauuauaaaagcccugagaggagaguuucauuuuuggacauauaguuggcaauguucuuaaauuccucagggcauuuuuauuuugcuuuuuuguuuuaaaucauguaugcugauuaugguccucaagcccucacaccaguuagauaagcacuguaauacugagccacauccaagaucuauauccuuagaugcugcagugucaccuuaacauuucaaaugcaaggaaagaauccaaaagccaugucuuaaaacguagaguagugcaguagaggagauagcucaguagauaaacuuacuugucauacaaguguuagaaucugagcuuaaaccuccagaacccagagguguagauguguagcucagguguauuauuucaguuuuagagagaaauugggaagugagacuggaggaaacucagacacuugccagucagccacacuggaauguaugcagcagaaaacaauggggacccugucucagacaaaguggaaggcaaggacuuaggacuuacuccugaaguugcuugcugaggucuauacucacacuguggcaugcauuugccugaauacacacacacacacacacacacacacacacacacacacacacacacacacacacacacacacacaaaugguauaagugcuguuuuuuguuuguuuguuuuuuguuuuuuguuuuuuguuuuuuguuuuuuuuuuugagacaggguuucucuguguagcccuggcuguccuggaacucacucuguauaccagacuggucucgaacucagaaauccaccugccucugccucccaagugcugggauuaaaggcgugcgcuaccgagcccggcauaagcgcuguuuuuauugaugucauuuuaaauugaugaugguacuuuccuuauguccuuacagccccugguaauggaagagauuaaauaucacuuugcuuuauucaauaaccugugugguuccuaaaagaugcacauuuugcuuugcagguauggcuggugcuguucacuuccuuucugacaucuugguaccagagacagcacgguuuccagcauuugaacuuggcuuuuugcagaaggauuaaaaaggugcaaaaagacaacuaacauacccguuggaccaaaagccaccugauugauuagugccugacacagaacccacuguaaacccuaaaagaagaagacgacaggacagaaaccuucacaagcccccuuuguugcaaagacccccaauuagagcaugagcgauagaaaucaugucaucagcauucugugacagcgugucccuuaaaggugugaaaucugaauccuucaucucuaggcuccuucuagugugcauguuucuuggugcuugucuauagguguaaauugaauaacuagaaaagccacacucauuacaugaacucuuagcugagcacaugugaguguuaaaggugacaggcacacauuuuuguauauaguaucuaaacuaggguaucaucucuaucaacacagaaacaguugugugaugucugucuugaccaucagcuagcagaucuagauauccugugagaauacauguuagcauuuuccaugggcaugcgugagaggcagccucccaaacccgaaugaagggcaggucagugugcacugcagagcucaggaaggcacaauugacaccuccucccucugugugucuuguggucaauguaauuaauggcuaagcauuaggaauucugagacauuuacucagauacauauuauuaaaacagauaccuccuuacuguuuucagaauagcuuauuacuauauaaaacagaguagcuguaaugccagaaagaucuauccauagcccuucaaaaauuuauuucacauuuugguaaacuauuauaaauuugaaauuaauacauuccuuauuuuucauccaguuugaggugauaaaauaaauucuaagcugaauuuauacauguaagaagcaaaauauuuuaaauaagacaauuauuaucuggguaauuuuuaaaauuauuuuuaagggcauuaauuuugacucacaugcguuagaaauccugucauaaauuucagaguuugguugucguuugugguacaaguaggcuagauuuccuaagcauguuuuauuguguaagggaaauuaauauauguuuccugaaggaagcaccuggggccgucuuguaaaccugcaucaauguggaacuuguacggccaugauuuuggccaagggcccucagaguagcagcaguaguagugacucuccccaguauguuuacuuauacuuguuugguagauacuauuaucuuuuugaccaacaugcugagggaaaaauaaaaugaccauagaauaaauggagaugauuuuuuuuacagauuuccuuuuaagacagguggauugacaccuuccugcuuaccacuagguaucaacacaugugcauuucagugacgccauugacuuccuucguuauauccacuacaugugcugcugugcaucccaugaggcugcagccccaaucccaugagguaaaggagaaauggcacgugaaccaggauuuaggggucacuuauggccauuucagaguuauaaauguuuaaaauuaaauuuaagaacaucucacuuuuguuucuuaggcuuguacuaugucaacaacuguacucuaaauguguuggaaagcuuaaaauauguacacacaaaauaacauuuugaaaucuuaagggaaaacgucaguguucacaaaaaguguuugggguucuuugguuuuguuaauaaaagacaguuuuguggugaugacuuaugga

SEQ ID NO: 3026 - RNA, 911 nt, Mus musculus
uuuaaacagucugguggcauuuuagccacaaguuuuucagcacauugauuauucucuuaucagaacugauuuguaccaaaggaguuauugugggauagacauucaccacaaacuucugaacagucaggaugauugggucauaccuccacaacaggacugagguggaugagaugaugagguccacccaguacaugaccacaaagaaaaccagcagcagcaggauggucuguguggccuuuuucucaggggauguucucaggugccugaugcuaugaagaugcuugcauuuucuuugaugucuauacaagauaaucaccauguauauacuuguggucagcaugacuccuacaagaaacacaucuuuuaaaguuaucacuguuaaaaucaauuccuugaugauguuguucaugggaaagugugaacagguuuuagugauucucaucugguuggucucacuccuauuguuaaaaccaccaacauagacuaucaugugacuauugaucgagaaauuaagaaaccaaauauagaaaacagcauagaugauguauuuuuuuaguuuaugcuuaaauuuugccaacagugagguacugggacugauagugacagccuggaacacacccaggaggcaugugaugcacauagagaguccucucaucacccuaccaguguaaaaaguugccuuacauaugaagucauucucaauguucagugacucaaauaagucugaaagccaaauauccccugcagugaggaacaucaguaugugaacaaaggaaaauugacauaagaucagguccaugggcuuaggucugugaccuaggauuaugaaaauauaaaaaaacaguagaaacauauuggcuagaacuccaaguccagauuggaaauaaagaacauucuugauugaagacaua

SEQ ID NO: 3027 - RNA, 467 nt, Mus musculus
cuguauuuuuuuuuaaccaugcaacaaaaccuuuauuaacauuucuaacagacguucagcuauuauugaaacuuguaauuucuaaacuuuaauuggggcaaauggcuagagugcagaguagugccaucacugcccacugggaaugcagaccgaauaauuaauagccaccccucagauggagaaccaggugcagggauguuguaaucagagagagugcggccaucuuccagcugcuugccagcaaagaccagccucugcuggucagggggaugcccucuuuauccuggaucuuggccuucacguuccugauggugucacugggcuccaccucuagggugauggucuugccugucagggucuucaugaagaucugcauuuugaccuguuaacaaaugugaugaaagcacaaaccacccagcgccccgaaacacccucacagaaagaccgccgaaccagacaaagccucu

SEQ ID NO: 3028 - RNA, 467 nt, Mus musculus
agaggcuuugucugguucggcggucuuucugugaggguguuucggggcgcugggugguuugugcuuucaucacauuuguuaacaggucaaaaugcagaucuucaugaagacccugacaggcaagaccaucacccuagagguggagcccagugacaccaucaggaacgugaaggccaagauccaggauaaagagggcaucccccugaccagcagaggcuggucuuugcuggcaagcagcuggaagauggccgcacucucucugauuacaacaucccugcaccugguucuccaucugagggguggcuauuaauuauucggucugcauucccagugggcagugauggcacuacucugcacucuagccauuugccccaauuaaaguuuagaaauuacaaguuucaauaauagcugaacgucuguuagaaauguuaauaaagguuuuguugcaugguuaaaaaaaaauacag

SEQ ID NO: 3029 - RNA, 1302 nt, Mus musculus
acaagauuagcuucuagauugggauacgcgauuagauggcucaaaccuuuucuugaaauucagugagaaaaauucuugccauuuuaaaggucaggguaaugacagucgcauuuucuuucgagggccauuguaaagagaauugaggagacccgcgcauagcacacaauggauggugcuaucuugcuugggacgugggaggagagugcagcuugaaagcuagguuagaucgucagagugcuuguguguguguguguguguguguguguguguguguguguguguuuacucucugucgcuugagcauacacgugcguccaagcgagcgcgucuguuguuuuuuuuuucagaccaguucuggcauauuccucuucauuaagaauacgcgaauaaaauaaucacaggaggcagagggagggagggaucugggugggagaaggaagggugaggggaaaaggggaauaugaucagguaugggauuaugggggacaagagagaaguccugagggccagcaggguggaaauaugcaaccuccggggugggugggaggugaaaguaccucuagaggguaggagagaacugggaggugagagaccuuagaugaaaugcccuucaguagaaagacaggucaucaaguggaggaaugggguugccaucccacagucaaaaauucugacccagaauuguuccugucaaaaagaacugcagggacaaaaaaggagaagagacugaggaaaagcagguauagugacggcccaacuuggaauccagcucaaggagaggauucaaggccugauucuauuacugaugaugcuaugcugucugcuuacacacaggagccuagcauggcugaccucugagagggccaacaagcagcugacugaggcagaugcagauuuuuacacccaaugauuggacuuaagucggggaccaugugguugcauuagagaaaggcuggaagaagcugaggaggagggcaaccccauaggaagaccagcagucucaacuaaccuggaccccagagaucucucagacacugagccaucuaccaggcaacauacacgagcugguacuuggcccugacacauauacagcagaggacugccuggucuggccucagugggagaagaugcaccuaacccuugagagacuggaggucccaaggagugcagaggccuggccuggugggggaggaguggagacauccucuuggagacaggugggaggaggaaugggaugaggaacugugggaggggggacccggagggaggcaacgacuggacuguaaacaaauaaaagcaaua

SEQ ID NO: 3030 - RNA, 73476 nt, Mus musculus
cugggcugcguguugcgucaucacuacgcgcuccguggcuugcccagcgcugccuuggaaggucccggccaggcuaccgucgccucccucaaagaauuauuuuguucuuguccaccuuuguuccaacgaggagccugccaggcuguaagugcgugcgugcgugcgggcggcgggcucccuucggcggcgcgccggccugucaagcuuccuccucggccgggccucgccgcgucuacuuccgggcggcgcgccgcucccgcuucggcccuuuguguucccgcggcggaggcucgggccucgcgggcuuuguggaggcggcgggcgcucggugcgggcugcguggcgggaaggcgggcgcgcaccucugcggcccgggugaggaccucgugcgagggucggcucgggcucguggggucgcgcgggccgggucgagggcgcgacgggcauuuggccgggacugcaauccgccguccccguguggccuaacaaagcacagccggaaccgggcucgggcaucggugcggccggacccccuuucucugggagccaagugugguggcuuuguguggcuccuuguuuucaccgccucaucccccuguuuuuuguucccucccugcagcuaguucauugaaagcugucagcccccucaggguggugguuccucccaauaugaaucuuuucaacuuggaccguuuucgcuuugagaaaaggaguaagauugaggaagcacccgaagcagccccucagcccucccaggcccguccuucgucaccaauuucucuuagugcugaagaggagaaugcugaaggggaagguagcagggcaaacaccccagacucagauguaacugagaaaacaggugaguuacaauguugcacacugauaacaaccggaggugacaggcaggagggaauccacuuuuuuguuacacuuuaauguuacacagauugauacaguguuuccaguuuugugcauugaaauccagcauugggacugccauagccaccaacuaccugccaacccgagccuuaccuccauugucucacuuguaggaguucuugggauucagcauaaugguggacgcugaaagccgaguguagagaauucuugggucagaauggcuacugagagaagaauguaggcaguucuaguagacuucaagguuauuaauuuaguuacagguuuucauccauucuaauauuuucauuuuucgccccuuguucugucucuuuuguuuguuuugaggcaggaucugacuuuguggccuuggcgcuugugugaaaccgcguggacuggauggcuuugaacuugugauccuucugccucugccucccaguugcugggauuccagccacaugucaccgcaccugacaucuuuuccuggcuuuuugaaagcagugucccucccugccuuaccuucuccagugauugcagaugggguuucaugcuucccccagcacugaucuuuucugcaagcuagaugugacagaugcuugaagauaacaucuagauccaaauaaagguuaaagaaauacuccuuccaccuaacuuuuuggaaaucuccagaauucacuugaauaguuuguaacucuuagugaauaaaaaaauucaaaccaauuguagcagagcauuauggauaagcagaacugaggaguaaguucacaugaggauuuugaacaaggauaugacucaccauagcguguggaggucagagaacacggugagagguugggucucucuccaucaugguucucaggauggaacucauguugggagguuuguggggcaaaggcuuuuauuugcaggcccaucugacuggccacacaguaguuugaacacuuauuuuuagguguagugggaagugcuucucauguguugccugauaaucuuacagguuaaguagucccauuuuuggaaaugagacccagggagguuaaguuuuaagaaccuauuuaauagaaccuauuaaaaauucaaacauuccugagaaugagacaggagucauauuagacaguuucugaugaaugugaugguaauguuagaaguuuuucggucuguuccaauacuauacuucuuuuugauuuuuuucgagacaggguuucucuguauagcccuggcuguccuggaacucacucuguagaccagacuggacucaagcucagaaaucugccugccucagccucucaaguggugggacuaaaaggcgugcgccaccaccgcccggcccaauacuauacuuauaauggcaaacaauauuucaaaagcuuuuaaguuuauguggccagaacaauuuuuuuuuucucacccaguauaccggcuaguuuuagggaagcugagcacaagugaacaucacguaacagggagaaccucaguuaagaaagcauccauaagaccaggguacacucacuccuguugggcauuuucauaauuuaguuauugaugggagaagggcccagucuguuguggguggugccaucccugggaucuaugagaaagcaggcugaguaaaccuugaggagcaauccaguaagcagcaugccuccauggcuucuacauccacucuugccuccaggucucugcccuguuugagaucuggucuuucuccagugaugaacagugguguggaagugugaggauugaacuugaaucuucugcaguaaaagcaauaugugcuuuguagccccagucuuuuuuuuuuuuuuuaaagauuuauuuauuuauuuauuuauuuauuauauguaaguacacuguagcugucuucagacacucuagaagagggagucagaugguugugagccaccaugugguugcugggauuugaacuccggaccuuuggaagagcagucgggugcuuuuacccacugagccaucucaccagccccaguagccccagucuuaaaugaguuuuuuuuuuuaagauuuauuuauguauaugagugcacuguagcuguacagauggcugugagccuucauguggugguugggaauugaauuuuuaggaccccugcuugcucuggucaacuccacucgcuccgccccaaagauuuauuuauuauauauaaguacacaguagcuaucuucacacacgccaaaagaaggcaucagaucucauuacagguaguugugagccaccaugugguugcuggguuuugaacucaggaccuuuggaagagcagucagugcucuuaccugcugagccaucucaccagccccuuaagugaguuuccuuuuggguuuuuccuuuuguuuaaguuuaagacaaggcugguguugaacucacagagaucuaccugccucuguaucagaggugaaaauuaagaauaaccuugaauuucucaauccugcuuaaacuucgcaaauguugagauuacaggucuuuuaucauccuuuauccuuuuuccuaucgacuauguaugugcaugcucucucuuccccucccccaccuucugucuacccccuuuccuccccuucuucccucuuccccgucucccuguuccaucugucuuuuccuucccauggccuuauaccugcaauguaagcauuucacacugagccacauaaguaguccuuagcauuuggauuaggaaguauacaauuaauucauguccaucugucugucuuuuacacagaagaagaccagaucuuuagaaauguuaggcaagugcucugccacugacuaguccucaaguuaucaauacucauacuuuuuuuuuaguuuggcuuuugagcacaaguggguuuugagggauuaaaauaauggcagaugaaugaaaacaagccugcuauauuuuaguuauguguuagaguagugaauuguccuuaggagcaguagggaggacguuuaaguaugcauuuuagacagaugcaugcuauacccaugucuauacaggcaagcucagacacugagcucucacgcugcucugagccgugucuucagugcuuuccuuuuucaucuauagcacacauaacaaaucauaaacccuuuccuuuuucuacuuaaagaauaguuuauguauauagguguuuugcuguguauauaucugugcacuacgugugugccuuuccuguggagccccgcagggggcaucggguacccugcagcuaaaguuggacuaaggaggugcuuuguaggugcugagaauugaccccagacccucugcuaagagcagccagugcuuuuaacugcggagcuaucuuaauuccccacaaagcaucuauuuuuauuucauuucauuuggggauagggucuuacuguguagcucuggcuguccuggacuaggugggccucaaacucacagaggucccucugccacucacugcauugagugaugggauuaaaauccuucacuaugccaaugcuuagugugaaaaacaggagaaaccguggaacacagucaaguuuccccauuaaaaacaaacaaacaaacucugggguucuauguaugggucagguuagaggcaaggggauucaagaguucuaguucucagccaccaugguauccuguuacaugaggauaccaugccaugcauuugaaugccagccuucuccagggacagugauccaaagcaugcaccuuuuuguccucugauguagcuuuucugucugcaaggagcucaguuuccuucccguuuuuuuguuuuuuguuuuguuuuuucgagauaggguuucucuguguagcccuggcuguccuggaacucacuuuguagaccagcuggccuugaacucagaaauccgccugccucugccuccucagugcugggaauaaaggcgugauaggguuucucuguguagcccuggcuguccuggaacucacuuuguagaccagcuggccuugaacucagaaauccgccugccucugccuccucagugcugggaauaaaggcgugauaggguuucucuguguagcccuggcuguccuggaacucacuuuguagaccagcuggccuugaacucagaaauccgccugccucugccuacucagugcugggaauaaaggcaugcgccaccacgcccggcuccuucccauuuuuauuaauucauaaguguucuucaaacuauggcuggcaaauauuuuuguuauaaaauaaauuugcuggguccugucuaaauauauguaaccguuuuguuuugagacaguguuuguaggucgcccagcuagguccuguacuuagucuucccucggcucucccacagccuccaguguggacuauagacuacuguuucuggcugugcuugcaguuguuggaggguagaauagucaacaauuauuuaucaaaauaucucaauuauaucaccagcuucuaaagcuguauuuucaguauaaauagcuaacaauugauguuaggaugacacucugucguauaguaguuccagucacaaacguuuauaaagcuauucuauauguuaauuauuuuuguguccuuuaaugaaacuugaggugugcuuuugacugccauauacauccugcaguauuggcacauuuuguuauuaucaaccaagauuuuccaguuaaauguuuauuaucuaugaaauucuaugaucaaguuccucccacagguguacugcguuucuuuuccauacuggccauagauaaacaguuuauaccaucuggcuguauaacagcccuuuaccuuaguuuucuucuugacuuaaaucugaaaugauuuuauaugcacauuucaucuugaaauaugguacuagaaauagcucuucaauccuguauuuaguguauucauuuuuuuuucuagaacuuuccaaaggugggggggggagggggagggagggauugagggagagcaugcgaauuaucuggaaaguauuguaacauaguaaaaugauuuuucuauuauaucauuggccucaaacuuaauauuuuccugccucagccucuaauugugcaugcuggggcaggaaauucauguugaauuuuguuccuuuuagaaaaguauuuagaaaauugugugcaugcaugucucucucucgguguguguguguguguguguguguguguguguguguguguguguguauggauauggauagauagaugugcacacauucguguguauguauguguaccauuugcaugugcagaggucagaagaggacauuagauagucuggagcugaaguugguugugagcugccugaugugggugcucauauuuaaaccuggguccucuguaauagcaucugccuuuaauggcuaaccucucuuuuuagaucuuuuguuuugacuuuugucuuuuugauguguguuuuguuuuguauuuuuuugaaaccggguuucucuguguagccuuggcucuccuggaacucauucuguagaccaggcugaccuugaacucagagaucugccugccucugccucccaagcgcugggacuaaaggcaugugccaccccugcccguccuugauguaugauuuuguguuacacaggcuagcuucaaacacauguaaacauaaacaagacuggccuuacauuucugauccuccuguacuucccaaguucugggauuacaggcauguguuaccauaauagugcaugccuaacuuguuugucucccuccccccaauauguauuauuuuacuugcuuauuuacuuaaauuuguaugguggcaaaaggacgucuaugcgucuguguucauguguuuaggggacaauuuuguguacuuguuuauacuuuuauguguguuuuacuucagcucaccaggugggggcagcaaauacugccccucugauggaccaucuuaccagucccauucuuuuagaaggacaacuauguggguuaauugauauuugagggaauuaauugucuuagaaauaaauugucaggccuggcgugcuggcgcaccccuuuaaucccagcacuugggaggcagaggcaggaggauuucugagaccaggcuggccuugaacucagaaaucugccugccuuugccucccaagugcuaagauuaaaggcguguaccaccacugccuagcaacucucagaacuuuuuuuuuuuguuuguuuguuuuguuuuguuuuguuuugcuuugcuuuguuuuuucgaggugggauuucucuguguaguccuggcuguccuggaacucuguugaccaggcuggccucgaacucagaaaucugccugccucugccucccaagugcugggauuaaaggcgugcaccaccacugcccggcuucucagaacucuuaaaguucauuauucagauaugagaauggguguaagggaguuuaaaaaguuguguuugcuugggcaaacugcuugugaaaaacuuuaauaagcuuauguuauaggcuccuauguugguaaugauaaaaaauagccuacuuuuaaaaagcuacuugaauuguuuuuauauggggaaauuuagcauuuuguuuagucaucuuucauuccaucucacuguaauuuguauagauaauucuuguguccuguuuguuucuuuagggcaagaugaacaguaacuuaccuucuuucuggagccuuuuguuaucucuacugauguggugccuugaacacagaaggcauuuggcugugagucagugcaagggucugaacuguucuaguguucauugucuucuuagaauguuguagauagacaauucacuuaaaguggcuuugaagauaauaauuuguauuuaacuaagucuugccauacuacaguagcugucucugagaaaaugacauuuguuuuugguuaacugcucacuuuuauaggacacaauuaguauuauuuggccuuuugaagcauggucuacuucuuuuacuaccaagacugaugaugaccugggucagacaacaggaccaacaugaagagaagagaaaaacaacucaccagaguuuuccucucaccuccacaugcauacauucuaggaaggaaguguuaaaaacuacucaacaguaaucagagaaggcuggacagauauuacugucucugcuuguacaacugaagcagaacuuuuuuuuuuauacaaauaaaugaaguagcuggugaacuugacuuacacauauacucacauuccuugugauugcuggggccaacauagggcaggcgcguaguucuccugugggaggcacuguuugcagucccuagaacugcauggagaauaauggaauaauuauaaugauucuuacuucuugguucuggaguucuagaaaaugcuaauuuagacuuagacuuccagaacggggggagggggggugucacagcuacuccuucacuuuaauuuuaaucuacaaaacagugauauguguguguccugcgggguuuuuguggcugagggcuugaugauaacuuagucauugacccagguauuuucauuauuacuuagcuuuaaaaccuugauaucuccgccccccccccccuuguuucucuguguagcccuggcuguccuacaacucacucuguagaccaggcuggccucaaaucagagauccaccugccucugccucccgagugcugguuuuaaaggcaugugccaacacugccuggcuaaaauguugauuuuuuuuuuugaugguuuauacuuguauauaauauauucugccuguguucuccauccuucccaucuauuucucagccuuaucaaccucuccccacccaugccuucuauuuuccagauucgcaacuguagguuguguucugugaaccauuuaguuuagccaagacugccuguuugacuguuggauuaaacccuaguggugucaucugcugguuaucgcucccuaaucuguguguagggagaguagcaauuuauuuuuuuguuuguuuuuuugucuuuuuaaucugagauuuaaaguuguaggagagccggguauauugguuuauuuauaccuuguaaucccagcacuugaguagugaaagcgcguggauccagggacguuugacuuugagcauagggagauguuuucucaaagaaaagaaaaaagaaaaaaaaaaaguaguguaagcagugguaggggaauucacuccagucuguuacuuguaacagccugaggaguuccuuuuaugauuuugguaccuuaaguauuuuuguguucuugcagagaauaacuccugguagauaagccugggugcagcagauugauguuuauucaaagacacuguuaagcaugauggcuaagagguugcuuggguagaaacuaauucagaccccagaacaugauaguaguggaugggguaacucuguaggauuuuggauuuucuugcucuguggguguagaggcaguuuuguuucuuuuuuuucuuuuucucuuuugauaaaugagauuagauggcuuuaucaguggaauuauaguccgauaagauaaaacuaagccacuaaauuugcaaaagggaguuagaacuuuuauuguaaaucucuggugagauuucuagcaaacuuuagguuuacaauugggaagggagaacgccuuaagcaaauguugagucuauugugauucuuguuuugguuuuuguuuuuccuagacaggguuucucuguauagcccuggcuguccuggaacucacuuuguagaucaggcuggccucgaacucagaaauccgccugccucugccucccgagugcugggauuaaaggcgugcgccaccaagcccagcuucuguugugauucuugauucucugcuggggagaagcuucagcaagacuuuggggugagggauucauuuccuuuuuauguuccuguaguuuuuccucuccuguucugugucaguggaaagaaauuuugguuuuaagacagaaacagggagcuggaaagauggcucagagguuaagagcacuggcugcucuuccagaggaccuaaguucaagucccagcacccacaugauccacaaccaucuguagugagaucugaugcucucuucuggugugucugaagacagggacagugugcucacguuacauaaaauaaauaaagacagaaugcaaagaauuggugaauuuuuuuuuuaauaauagcacaugaaugagaugaauaaaauuuuacuuugguuuugcucagaauaucuuucuuuuuauuuugcagaagauucuaguguuccagaaccgccagacaaugaaagaaaagcaaguuuaucauguuuccaaaaucaaagagcaauacaggaauauauugauuuaucaucugauacugaagauguuucuccaaauuguuccaguacaguucaagagaaaaaauucagcaaagacacagugauuauaguguaagccauuucacugucaguuaugcuugaacauaacuaguuuucagauugaaauauuugugugauuauuuugucuuuagucuucauuuuuacuguuuuuccugucuucuguuuccugcaaaaugauuauuuauaaagguuuagugagaaaauggugauauuaaucuucucuaaagauaaggaaaugauuuuaacuaguacuguuaaucaucugucauugcuggggguuguuuuguuuguuuguuuguuuguuucgagacaggguuucucuguguagcccuggcuguccuggaacucacucuguagaccagccugggcuagagcucagauauccuucugccucagccucucaagugcugggauuaaaggcgugcgccaccacugcccagcugucuguaauugcuuugugauuaacuauugagucccagaacuuuuuaaauuuuuuaauuaauuuauuuuuuugagacuggguuucacuguguagcucugguuguccuagaacucauuagaacucuaucuguagaccaggcuggucuugaacucaaagcauuccaccuguugcuucccccccugaaugcugggauuaaaggugugugccacaacugcccagcaaaucuaggaauuuuaucauuuagcauuuauuagauguauucgaugagcaggguaccauguuuuccuaggaaaagagcaacuucagccccauagucuugcccucaagaaaucucuacuuagcuggaaagauaaacuauaaaacauacuaugucaaagaaaaaauaagggaaauaaggguucuagacccuaauauugauuucaaagaaaggcuucacugaggagaugaugcugagcaaagaccugagggaauagcguguuuaauggcucugaggugguaauugccuaguguuuguaaguaaagagggaugcaggccaugaggggaggaucucaauguaaaguauagggccacagucacuucuuuuuucuugcuuuuguguuuuguuuugagacagggugucguacuguuucuagguuggucuguguaguagaggcuggugucuaauuugcagagaucuuucugcuucagccuccugaauucuaggauuauagcuauguaccaccaauucugacuguuuuucauucuggaugaaaugggaaguccacagagaauauugagcagagguaaaaugauagauguuuaaaaggccuugauaguuuugggagaaauuauaguagccauagaugcuauuguuacccuccaguagaaaauacuggagguucaaaugcagccaguacuugugaaaagugguuaaauucuagacauucuuugaaaguagaacagaauuuguucuuugauuucauaugguuugagagaaaagagucaucccaucacuuuuggcugagcaaguagcagaaugaaauuaccuuuuaccaagaaaaagacuuuguugugauagagaaagaacuuuagaaugaaagucagcaauucagucuuauguguguagugguaagaaaacuuggacaucugaauagagaugugaaguaauuaacuugugauauucaagauuggaggagaccagcacuugggaggcagaggcaggcggauuucugaguuggaggccagccuggucuacaaagugaguuccgggacagccagggcuccacagagaaacccugucucaaaaaaaaaaaaaaaaaaaaaaaaaaucugaggcgaaaucuaguuggugcauccaaauucaagauuccauagaguauuucucuguuuaccuaccuaccuaccuauugcuucugucuguuuaucuuuauuugguguugguuuucaaacucaagaccauguuuggcaaguguuuugucuaauuugaagcucuuuuaucuguguaguucagguugccuugaauucaugaccuccagucucagccuguugaguaauuugacuuuuaaagccucauagccauaggagaucacuaaaggauacagguaucacugaagaaggcagggccucuaguucuaagugcuuaggccagagggcuucucguuguuaggaaggugagaugacaucuguacaguugaggugacagucaaccaguuauguggucucaggguuggagagauggcucagcaguuaagagcacuggcugcacuugcagagaggaccccagauucucuugucagcaccuacauggcaguuccaacuccaguuccaggggaucugagguguccucuucuguucucuggucuuugugcacacauguagugcaugauauauaugucggcaaaauacuuaguuauacaucaaaauaaaucuuaaaaaguuauagaauccaagcaaagaaaguguuccaagaaggaacaagaugucagaguuuuccugauggcaguuugacacagacuugacuuaaacugaacaaagccaugauuacauaucuuauucugaaauaaaaaauacugaagcaccuuaauguuuaguccugaagaaaguguaugcuauaaaaguuuaguuguuuucucaucaaguguuaaguggcuuauguuguauggacaugcaagcaguuagggauuggcgugauagcagucaacucuuggaccaugaauugaaugggauuuuauaguaauuuuuaucuggaaucauagaguggauugacuuacuguuguuauuauuuugagacagggucuuaaaugccuaguaguucugccuuacuaucauauuugucuuugucaugucucuuuaauuucauuuacugugaauuguuaucuuagcauguguuuuacuauaccuaucuuuaaaggugccaggucagcuuuucuuaggguaucuuuaaauuuuaauuuuucugcuuuuuuuuuuuuaaauaauuaaauguaaguuuagugggauacuacagaaaugaucuugugucuuuguuauguuacaggaaguacaugguauccauuugucagucuuugcuuauuguuuuuguuuuguuucugguaugagcuggguuucccugaugagcuaccuuuuuuuuuuuuuuuguucucucucccuuuguaaugauuaagcagucuggagagauucuucaagauuggguaauacccauguucauuuuuauucuauaauccuggccucuguuggaagugggguauuuugacugucauuuuagaacuuacacuuuuauuaguuuucuacuauauagaaauguacacuuuucuccugauuugcucauuuauuuccauacagaguauaacaaaugucaguauauaaauccugauaaccuaacuacucaaauauuuuguauuuccguaucaguguagguaucauauuuccucagcaucaucuagcaugcugagcaccgacagaacuuuaggaaggagcugagaaguugguaacuguguguagauauaucaaugagacagacaguucucuauuuuuuuuuucuuuaugguugaaauaaucugagaacuuuuccaauuauaauauauacuugaauaccuaauaguguuaagaugguaaaaguucauuuccuuuaacaaauauugauuacauuuaauauuccuguaaaaguucucugaaucaugauagaauacgugggauacauuaaaauuguguuuucccaugugauaauauuuguaguucagagccaucugaagaugaagaaucccaugaccuuccuucuguuacacgaagaaaugacaguucagaacuggaagaccuuucagaauuggaagaucuuaaagaugcuaagcuucagacauugaaggaacuguuuccacaaagaagugacagugaucuucuaaagguuguaccugcuuaaaaauugcacuuuaguuuacuuacucuuuaaagacucccccccccgccccccuugcccccaauuuaugugagugcauguuuugcuugcauguguguaugugcaucccuugcaugccuggugcugccugagucuggaacagggguggcagauaaccuuugaacugaguucggacugucaugugacugcugagaaguaaaucagaguccugcaaaagcaacagcuucucucagcuacugauaguuaggucuuuccagcucucuaugguuagacacacaccaccaccaccgccgccugcugccuccgcacucugcaggucagagcauaacuugucugagucaguucuucccuuucagcuugggauccagagagccaacucaggucaugaagcuuguguagcaaaguuugugcccacugaucuaucuaucuuaucuauuuuacucagguuauagcuuuuaugacaguuauuuguaguuguaaugagaaaaaaaaucucuugaauucaguguuguagucauaauacauugacauuuuaaaaaagauaucuuggcuccuguggaggccugcugggaacaggaccucuaaggcauauauugccuggacagcagugcuguaaggccauuuuuguugacuauaagugaguucccgagagugaaagagaacagacacaugggucuucucaaaacugaaggugguuaugcuggaagugaaacugaauuccacuccggccagagaugagccuauguguauaaaacagcacagcgaccccugcagguaaaccgaacacagccagaguaaucuggggaacagugcucagugcacaguccaugcugaacuccaaaguggcuugacuaggaaaagguuguuggguacagaacucaugugauccugaaccuuucauggauuaaacuaaagaaaugcaaauaaauaggugguggagacaccuuuaauccuagcacuugggaggcagaggcagguggaucccugagugugaggugauccugaucuacaaagugaguuccagaacagccaaggcuauucaacagagaaaccaugucuugguagaggaggaagaaaagacaauggauuugugcucguguuuguuuguuuuuuaaaauuuuuuuguuuuguuuuguuuuguuuuguuuuguuuuucgagacaggguuucucugugcagcccuggcuguccuggaacucacucuguagaccaggcuggccucgaacucaggugugcgccaccacacccggcauuuguuuguuuuuuaaagauaccuuauauuugaauuuucaauaacaaguauaagcucccaaaauaaauuuaucauaggacuuaaacauugaucacacauucuuucaccuacaugaugcuuccuauguuuguuagauauguuaguuauaugguacauauauuacuauguuagaaaaugaggucuuugugaaauauuucuucagguguucauaugucugucauuuuuccuuguuaguugauugaaucaacaagcacuauggauggagccauugcugcugccuugcugauguuuggugaugcagguaugcuuuuuuuagccuuaaguucuguauacuuacauguaccaucuguuaauguuugccuaccauuuacucccaacuuugugaagugucaguugcuuuaguuucuggcagagaaaccggcuuagggagguuaggcagcaucacugaggucacuuagcuguuuggugacugcuuuuuuuuuuuucugcagaucagauuccuuaauucaaacuuuuggaagucaugcuuacucaacucuccuuucuaauuacaugcuugucuuguuuauaagucuacaaaccugagucaguagugacauuagaucuuguggaaagcccuagcuggaaaucagcauucucauuguguaacaauagaagcucuuuuaggcuucugauggaaaaccaaagggaugugaaggaacuuaaaguagaaaacaucuucaauuguuuaucacuuuugauuuuucuuuuuuuuuuuuccucucuguaaaagguaucuguaauacuacuaaaaaaagcauauaaauugauaaaaguaaacuuaaacucuauuaacugcuuuuaaacuucauuuuuuuuuuaaacuucauuuuugugagugauuguguuucaagacauagcuuagccucgguuggccuugaacugucaaaucuucugccucagcuuccagagugcuaaaauuauagguauaucuucccuaugccacacagcacauauaaguguacaaacugucuguaaaacuguuagugugcauuuauguaacaugauuuacuuuagcaccgauagauucuuacuucaccuggauuuaacgggacucuaugauacuacuuuguaauuccucuuaugacuaguuuauucuuuccuguuggccuuaugucuuucuuaguaugcuaauaaauaucauaaguccuagguuauucaucuagguuaaauuuuacacuaaaaguuguacaaguuugugauuucagcagugaauguccauucccugaguugauuuuucuuuugacuuuuuuuaaaccuaaaaugcauacaaaaagaaaauagugacagacccgucaucacuaucuuuauuuucucaaaugaaguaacuuuauuuuauuuuuuuaccuccuuucuucacauauguuuuucuuuccauuaauuuauuuuuuuuucauucacuuuacacccgauccucuccucucccccuucuuuccuccuaaucccacccuuacaaaucucucuccccauaccuuuucccuggggaaccccucccuuggguaccagacuguccugggacaucaagucccgguggggcuaagugcagucucuccauaugaggcccaaccagguaguccaguuaggggaaggaaagucaauagcaggcaacaaagucaaagacugucccugcauuugaggcauagaucuucaaaguugagacaucaucuugauggauuuucccuuugaguaugaagugucauuuuccauuucuuuugacaacuuuuguuugcaagucuauuuuauuagauauuagaauggguacuccagcuugcuucuugaguccuuuugcuugguaaacauuuuuccagcccuuuacucugaaguuaugucuaucuuuguguuccuaagguguguuucuuguaugccaaggaaugcuggauccaguuuucgcguccauccuguuagcuugugucuuuuuuuaaaucuaaauuuaauuuuuacuuauucacuuuacauccuguucacugccccccacugguuacccacucccacaauccuucccccaucuuccccucuucucauccucugagugggugggguuccccccuagguaucccucuaccccggcacuaaaagucuccgcaaggcuaggcacuuccuauccuacugaggacagacaggggagcccagcuagaagaacauauuccauagacaggcaacaaaggguuuuaggauagguuuugggauagcugccauuauaguuguuggggacccacaugaagaccaaguugcacaucuguuacauaugugaggaggccuaggucuagcucauguauguucuuuaguugaugguucagaaucugagagccccaaggguccagguuaguuuacucugugaguuccuaaacccuuuugggggccugcaauccuuccuccuguucuuccauaagaguccccaagcuccauccacuguuuggcuguggguaucuguauaugucugaaucagcugcuggguggagccucucagaggacaacuuguuucugucugcaaacauaacagaguaucauuaauaguguuagggauugguacuugccugugggaugggucucaaguugggccuguuauugauuggcuauucccucaaucucugcacuaacccuuauuacuuguagacaggauaaauuaugguuugaaaauuuugugaguaaguuggugucuuuaucacucuacuggguuuccugccuggcuauaggagguggccucuucagguuccauauccccaauguugugagucacagcuaaggucacccccauugauucuugggugccucccuuaucccagaccucugucucaucuugcagaugcccucccuccuuuuacuccuaucaguugcagauuucuacuuauuuucauggccaucuagccaucuuucuuguucauucccacaccugauccugaacuccugauuccccuucccauuucuucuccuacccuugaucugccucuuaugacuauuuuauuccucuuccaagugagauucaagcauccuuguuuaugccuuccuuguuguuuagcuuauuugggucugugaaauguaauguguguauccuguauuucauggcuaauauccucuuauaaguuguugggagcuggcccguggcucacauggaccgggguuacuccugggaggcaaacugaggcugaaaagacagaaacuaggcggucaagagaaauaauggagccaagucaagguuccugaucaaggcucuaauguuuaauagcaaacugugcuuauaaagugggggaggccauacccccccccccccaauccauucuuggagccuggaaccagcugcuggauaggguguagccuccagaauaccucagcggccucucagcagguagcagugucuugggggagcaguggcugguggcagaacaauagagccaucuaggcaggaaggcuccaccucagguaaucuccuuaguggcugcaaggucagagucuggaucagccuguuucaggcugggggagguuacaguaagugaguguauaccaugcauauacuuuugguucuaucuagguuacuucacucaggaugauauucucaaguuccauucauuugucugcaaaauucaugauguacuuguuuuuaauagcugaauaauaguauuccauuguguagaaguacuauauuuucuauaucuucuuugguugagggaugucuggguuguuucuaguuucuggcuauugcaaauaaagcugcuaugaacauaguugaacaaagugucuugugggauuuuugaguaucuuuugugccuaggagugguauagcugggucuugagguagaacuauucccaguuuuuugagaaacugcugaauugauuuccaaagugguuguacaaguuugccaucccaccagcaguggaggaguguugcccuugcuccacauccucuccaacaugugcuaucuuuugaguuuuugauuguagccauucugaugaguguaaaaugggaacugagaguuguuuugauuuacauuucccuaaugacuaaggacuuugaauauuccuuuaagugcuucuuucccacucaagaucccucuguugagaauucucuguuuagaucuguagcccauuuuuaauuggguuauuuggguuguuggugucuaacuucuuuuuuuguuuuuguuuuuucuacacagagacaggguuucucuguguagcccuggcugucuuggaacucacuuuguagaccaggcuggccucaaacucagaaaucugccauacagaagcuuuucuguuucuagauguuucccuuuuaucaguuguugaucuuagagccugaaccauugguguucuguucaggaaauugucuccugcaccaauauauugaaggguauuuucuacuuucucuuguaugauguuaaguguauuugguuuuauauugaggucuuucauccacuuggacgugaguuuuuuuuuaauuuaauuuuuuuuuuuuuaagauuuguuuauuauuacauguaaguacauuauaacugucuucagacacaccagaaaagggcaucagaucucauuacggaugguugugagcuaccauuugguugcagagauuugaacucaggaccuccagaagagcagucagugcucuuaacugcugagccaccucucuagccccuggacuugaguuuuguguagggugauaaauauggaucuauuugcauucuucuacguguagacauccaguuagacuaguaccguuuguugaagaugcuuucuuuuuuccauuguauaguuuuuagccugugcuucuauuguggaauugaaucuauugaugcugagugauauuaaugaccaacaauuguuaauuccuguuauuuugauuuguguguguauuuauuuauguuuguguguguggaugcgcucaugcuuguguguccuucccuuauuuugguuuugcuggugugaaguuguuuauuuccuuuguuuucauggguuaguuaaccugcauggguuggaauuucccuuuuaauauuuucugcagggcuguauuuguggauagaucuuguuuaaauuuagguuugucuuagaauauccuguuuucucugucuauggugauagagaguuuugcugaguauaauagucuagguuggcaucugugguuucuuaggggguucauacaucuguccagguccuucuaucuagcuuuaagagucucuguuauggauacagguguaaaucugaugucugccuuuguaugugacuuggcuguuuuuccuugcaguucuuaauauucucuuuuuguuuuauagauuuaguguuuuuauuguuauauggcaggaggauuuucuuuucuggcucaaucuaauuuuaguguucuguaaacaucuuguaugcuuauagacaucuuucuuuagguuggggaacuuuucucucucucucucucucucucucucucucucuuuuuuuuuuuguuuuuugagacagaguuucucuguacagccuggcuguccuggaacucacucuguagaccaggcuggccuugaacucagaaaucugccugccucugccucccaagugcugggaauaaaggcgugcuccaccacgcccggccagugauucaauauuuuuuaaauuguaucuucuacauccgagauucugucuuccaucucuuguauucuguuggugauugaugcuugugucuuuugauccuguucucuucuuuagguuuucuauuuccaggauuuccucaguuuguguuucccuuauugcuucuauuuccauuuucagaucuugaacagauuuauucguuuucuucuccuguuuaauuguauuuccuuguauuuauuacuuuuguucuuuauuaguuuuuucuuuaaagacauguaacuuuaauuuuauuuucguguauuucuuuaagggauuuauucauuuccuuuuuaaaggcuucugucaucuuuauaagauuggauuuacagucauuuucuuaugguucuguuggguuaggauauccagggcuuauuguaguaggauugcaguacucugaagguaccauauugcccugccucauguugauugcauucuuaaugguguucuuuagccauuugguuguuccaggauguuccuguuguaauaggcuuccagugcgcagccuugggcuggacagugaaacuaaggaggcaguacacgucucagggcagcugggugugccuuggaggacuuggugggcagggaaauggaacuaauggggaugugaacuuaauuuagauguuccuggggcagcaggcuugguggaggcuagaggagcuguggcuggacaacaugggggagggaggacagcauacaguucagggcagcugagcaugccucugggacuuauugggcagcaggauggaugggugaaucuaacuaggauguuccuggugcagcaggcuugaugaagguggcagaguguugaccaguggugguuggacaauggagauccuuggcauaacuuucaacagguugucuacauccuuuucuaucuccuuacugaauugauuggaauguauucuaaguaugauacuauuucuuucuuauuaaauaccugcauacuauuaauuuccuugaguuuuaagaagggaaaaauagugugugggugcgauaugcacagaauacugaggauaucuuuguguuuauuucuuaaguggcuuggaacaguccugcccaacucuuuugggucuuugucuccuuugcaguaaaugauaauaucaaacucaucagcugugaggaauugauaaagcugaugcuguuucacuguguugaugggugcauguuguagcucuuaccaccaucgggauagagaaaugcuacaggaacagguugacugucuuuuucauuguuuuugauguuccugaaaugaguaggcuccguaaauacaagagugcaugauggccuuuucuuuuuugauuucuuaaauacuguucuuuaaucuuuccauuuaaaacagguuguagaauaaccauugaguuauaaacacuaaucuuuucuuucuagucuuauagaacuucucauuuaaugucuuaauuuaacaaguaguguuucuauuaguauuauucuacaacuaguagguaaugcuugcuguuuuagguacugaagcuuuauagaaaauccugacauccagcccugccuuggugaaguuuauagucacauugaacccuaaccagcuggguuuguuccuuuuaucuuugccugguucucauauugucacuuaaaugcuauguggcaaauuacaagaaaacaagaaauugggacuuucuuguuuuuuaaguaccuuucucuucuuuuuauuuuuuaauuuuuuaaaaaauuuuuuauuagguauuuuccucauuuacauuuccagugcuaucccaaaagucccccauacccuccccccuaccuuucucuucuaaaucuugggaugaacaagguaguggcaucaaacaucuuccuuuuuaguagaaugaacuuugagguauugucuaggaugguaagcugaucuuuaauauaccaccugucauuaagacaacauuauuuuggguauuuugagaucuuuuuguaacaaaaggguuuuuaaauaccuuggaguaaucuuagauagguauaacaauugugacuuugaacacugguuuuagcaaaaauugcugucucuagaugauaucacccuuggauaauaaauaaggaaguuacuuuuuuuuuugguuuuucgauacaggguuucucuguguaacccuggcuguccuggaacucacucuguagaccaggcuggccucgaacucagaaauccgccugccucugccucccaagugcugggauuacggagugcaccaccacgcccagcuaggaaguugcuuuuaagcugaaaauuuuucaguuauguauuuuguggguuuuuuuuuuuuugucacacacauaccacacacucacaaguauauauuuauugguguguguauggguauuuuuccugcauguaugucuauguaccacuuguguaccugcugcucaugggucagagagggcacugaauccccuagaauuggaguuacaaagucuaugaaccauuauguuaucauuguggguuucagagaucuuaaccacugaaccccacauacugaguuuaaaagauuauguauauaacuccauguuuuacuugaugaaacaaaaaaaaaaagaauuuauugauauugucagagagaauauuccaguuauaucuucuuuuuauguaaaaauuaaacgugcauguuacauaacagaaacugucuaacuugaaucuuuuaagaguaaaauguuaaauaucaauguuuacuuaaaucuaccaauuaugugugugguaagguuguuuuaauuuuuccuuuuaaaaguagauuguguugcugggcauggugguacaugccuuuaaucuuagcacauaugaggcagaucucugugaguucaaggccagccuggucuaugaagagagcuuuaggacaggacuuuuacacaggaaaacccuaucucaaucucccaaaaucccaccccccaaaguagauacugaaaauguguuguguauacaguagagaugaauugugaaauaaaccaggaggaaacauuaaguauucauacugacaugauugcuagucuguagaaaaucaggagucauacuaucauguuagucuauaggaaaucaagauucaguuuucucuuggaaccaucacauugugaaguuuuuaaagaaccucagagcugucauguauguacuugcuuugaauaaguguacuuuauuguagguuaaaaacaucaaauauguacauuuuguaucuucauuuauaauuugugaaaaaacauuacccuuuugcaggcuuuuuauggaaaggaagugaaaaaguuuauauaaggccuugcauaaagcuuaauaugcaguagaugcuuauuuauuggugucaguuaugcuguucugauagcuuccacuugauaaguaucuuuugaacagucauuggugaguauuacucuguagaauuacuugucagacagaagaaagaauauuuagcaccaguaauaucauauuuuuuaaaugcaauguaagaucgacgguggagagucuuuccuuuccuuuaaucuacuuacauagcucuggcuggcagcuauauccaugcaauacaccuuuacuuuugguuugaauugauucuuguuauuucugugaaaaaucugagugugcuucucuguuuuaaaaggugguggacccaggaaaaggaaauuaucuucuucuucugaggaggaugacguuaaugaugaucagucuguaaaacagccgcgaggggaccguguaagugacauuggaauuguugcaucagaauuagacuaugauggguguggggcuagcuuacccuaacccuaacccuaacccuaacccuaaccaguauguugaauguggguuucaaaaguuaagaacacugguuucucuuucagaagacuuagguucaguuccaaccauggauguucacaaaccucaguaacucuacucccaaaggaucuaaugucuucuggcuucaguaggcacugcaacuguaugcaugugguacauacaugcagguuaaaaacucacuauaaacauaaauaaauucucaaaauaaaauaaaauaaaauaaaauaaagggcugugcugaauguuuggaugucagaccugaaaguccacccaagugucucccaucucuuuuccagcuccuaagagauucuguacuauaguaguucuuugugccaugcuaguaaucuaccagauguucuguaagccauguuuaaaguuuguuguuuccuuuauguggucauaaauaacugcccauagcugucaaauuuuuuaauucacuuuccauccugaucacuguccccuugcugguccuuccccucucugagaugguagagcccucucccucaacccucccagccuauccccaugcucugguacaugaagucucuccuuggcgggugcauccuuuuccacugaggccagacaaggcagcccaguuaggggaacauauuccagagauaggcaacagcuuuagggauaguccccugcuccaggaaagcuauacauacugcuugaagaauuguuuggguuaguacuuggacaggccuaagaaguuaaacucagccuacugaccaaaugaagacaguaaaaaccuaaaaacuugaauuacaaaguguuugcauaauuccuagaacuccuuaagauaagcaacugcuauaaaauagcccaccugaagaauuuugcaggcugggguuguacagcucaguugguagaaugcuuuuguucggcuugaaaauuuaaucuuaauuauuacauaaaacuaaguguuugagguguaggccuguaauuucaguacucagaaagaaauggcaggaugacuagaauaucagucauauacccuuggccauauauucaguguaagaaucugucuaaaaauaaaaggcauugcaagagaaaaaugugucaauacaaggcauaauaaauggaguugaaacuauagcucagugguagaauguuuguuacuauguccauagcccuuaguucuagcccuaauacaaccaaaaucauagcuagagcacacacuuaacagcaguagaaagcauauauuauuaguccugugacucaugaaguaugggaccacuguguaguuuaaaaagcuugugaauggaagguguuuguaauccuaucauuugagaggcugagguagguuuuaguuaaaaccucaaguucagaauagcagcuacaauuggaaucguuaucuugguuuauuuauguuacucugaacaaauucuccaaaagcccauccaguuuugcugugagccaaggauguguauuacauugggcuggguugauaauuuuauucugugcaguuaccuuaggaacugaagauuugaguuagaagagcaauuuuuggaacuuauuugguuuuccuacauagugacuuaugggccuaaugugugcuuucugccauugauuaauauguagucuagcuagugcuagaaaaacaacccuaagauuaaaucauaacuucugggccugcugagagauuuuuuggguucacuaaaaccauuggauauuuucagcaaacagugacuagcugauagaaguaugggguccuagaggaaacacaaacaacaggcaaggcagccuugcucgcugacucuuucauuugugcucucauacauuucauuucaaaaacugguccagaugucgacuuuuggagggcuuucauugcuuucaauucaauguaaaaguagggacuuuucuaugccugcuuuugcucuguauauuuacuaaaagcuguaggcaccguagcugggcagauucugagcuauucugaccugacaguguuggucuggccuacuuccagccaggugguuguuacuugcaaacuuagucuuacuggccuccuccgucauuccuguccagaugcugacuccccuggucuccaccugagaccucucuaucagggcauggaagucccaccuuuucuucuuccacccagcaauaggcuauuuaacucuuuauuuggccaaucaggugcuggagaacaccuuuuccucucccacucagcuauaggcuauuuagcuuuguauuugaccaauuaugucauggagaacaauguuuuacaaaauacggagucaggcgaugcuucauaauaaugacaguaccaaaauugggacugccaccagaucucuggauauagaagucaucauuugaauaacaguuguuuacuuuuggagaugugauccaaacaaagcuuuguacauguuaagcucucacucacccuaccgagcuccacaucuuacuuuacugaggagaaauucacauagcauaaaauuaauuuuuuuuuuuuugugguuuuuucgagacaggauuucucuguauagccuuugcuguccuggaacucacucuguagaccagcuggccucgaacucagaaaucugccugccucugccucccaagugcugggauuaccacgcccagcaaauaguauagacaguuuagugcacuuaggacauucccaguguugugcuuucugaccuugccugucuagcuccagauauuuucauugguccaugauggcaggaugcacucagaaauagggucuuauuucuucauuuccacagcccaugucaaucagcagucugccuucuccaucucuagauuguauacuccagauauuucuuuuauaaauauaauuaugcaaccauuuuugugucaucuuugaagguuuauccaagcaauaacauguuguuuauauuucuuucuuucuuuucuuuuuuuuuuuuuuuuuugguuuuucgagacagaguuucucuguauagccuggcuauccuggaacucuguagaccaggcuggccucgaacucagugauccaccugccucugccucccgagugcugggauuaaaggcgugugccaccacgcccggcuguuguuuauauuucuugaacgccuuauauuaaguaagucuaggcuuaccuugaacuuaugguaguccuucuaccuuagccuccagagugauggaauugaauuuucuauuuaauggcuaugccacauugcccccucucuccugccauaguuuuuuuucucauucuucauugguagacauuugaaauauuuuuaaagcaaaggaagaguaaacugaacugugguacuagagccucuaucccuacagcacuugguagguggagccaggacaaucaggagaacagggucauccugacugcaguccauggccagucagccuuuagagcuacuugagaaaccuagcucaagagauuguucauugauuuauagcacaugcugcuuuuuagauacucaaguuugguucccaguaccauguuaggugccucagaacaacuuuuaauugcaguuuacuguacuggaacuccuucuguagaacuggcuggccuugaacacagagaucccacuucuucugccuucuaggugguaggacuaaaggucuaugccacuacaccuagccuaauacaaaucuuugaacagaugaaccaagggggccugggggucuggcucagucggcccagcaccgaugcuugccgcauaagcuugagaaccugaauugugaucccucgcauccaccuaagaagcucugugcaguggucugcuucuguaggcccagucccaggaaucagagacaggaaucuuggagcuugguauccaggcaguuaagccaguugcugagcucuaguucagucaggaguaccugugugaagaaaggucuagggugucugaggagaacagugcugucacacugcggccuccaugugcacauccacauugcacguauacacacacauacccaccugaacacagacccuccagcaugacugagguuuggaaauguuuuguagcaaacaccuguuuggccgaguggcuguuguuuaucucucaucuguaaucuuuuguuuuguuuuguuuuguuuuguuuugagacagaguuucucuguagcccugguuguccuggaacucacuauguagaccaggcuggccugaagucacacuccagagugcugggacuaaaggugugcgccaccaugccuggcuucuguaaucuuuaaagugauuguuagagauucaaugcccucauggaaugcaauguuccaugaucuauguucuguuucucagauaauaugaauaaguuuggguucacuagugcuaagugauacuguugguaugaguguauuuucugaggguuuugaaauauuuucuccaaacacuauauuuuuucuucugcucaaaagucuuacuaccugugaugcuuccacauagacuuguagcucugaagcacacuguauaccaacccacuacguuacucuuuggcauguaauccucuuccuuuuguugucagugcacauagccuguuuuuaucuauagagcccugugcaggugagguacaaacauucccauaggcuuuaugccccagugcucccauagcacuugguuugccugugcucuuauagagugucaucuuguccucggugccugagaauaccaaucgugauuucuucuuuggcuauuaagagagaaguguagcagcuccauugcuagauaauauaaaggagaguggggaagacuugaucuuguuuccuucuuuuccuuuuccccuccucccugccccauagggagaagaaucaaaugagucugcagaagccagcagcaacugggaaaagcaagaaaguauuguguugaaauugcaaaaggaauuuccaaauuuugauaaacagguaagaagagaacuguucaaauguuuguguacuuacauguuuguauuauaaaauguuguuugaguuagacugugcaaauuuaaggugagcuuuauauuuuugaauuauauacuccgguuaguauuauaugaauauuuuagacuacuugcuaguuaccuuaguuacuguguuugcuaguugcggugucagcauuauaaauggcaucauaauaaacaucaucauaguaaaauugugaauccuuaagugcaaaaagcuguccucacccccuccaucauguccucacucuugaacuugguuguaagaauuuuaaaguauuacauuucagugucuuuaaugcuccguaaagaucuuccuuuccagauaaacaaaacuguucagggucacuaaugacucauguaccuuucucucucucucucucucucucucucucucucucucucucucucucucccucucucucucucucucacauugcuguguauuuauugaggcauauacuuuuuuaacguaugggaaauguuuacauuuucauggauguguucuuuuugugcucaggcgcaucugaauuccggugaacaauucacagucuuguuauacucguccuuuacaugcauuacaucuucauguuuucagcuggggauagagugcauuugccauauauacacauaggauccgcccccagagauguguuaaguugcauauacugaagcaucccuguuaugcaagcccuagaggaauugggcaagaagaaaaaaggucacauuccuaucccuguugaacacuguauuuuauguguaaggugaaguuaaacaggaaggaugcauaaaguaucacuagaacagugccaguacuggaggaggcggugcacacauuuaauuauagcacuuggaaggcagaggcugguggauuucuaugaguucaaggccauccuggucuauauagaguucgaggucagauaaugcuauauagugagacccugucucaaaauaaaaacaaagauagugauauaaauccuuuauuuuucagugauuacauuuuaaaagagcauaaugauuuuucugaaucuuuaacuucacguuuuuaacagaaaaaauaacuuccuuucaggaauuaagagaagugcuuaaggagcaugaguggauguacacagaagccuuggagucucugaaaguguuugcggaagaucaagguaaucagagaugggcuccuucagucccauguccuacugcagaagagagccugacuugaaagugauuccagaguaacguuguaaaauguucuaaaggaugaagucccaaauauuuugacuuguucuucaccauaguaauagccaagacaguacauaacuuuuucuucuuguauaaucuuuucugauucugaagacauuuaaauucucuuguucaguuguuuacauguugacaucugucacucuaggaugcaucuuacaguugguugcuuauuagccugcacuugcaugaauuuggaaaacacuagccuuaagaauacaagugugucaucacucuggagggacagucucccaauccauaauagagcucugagcugcagagaaugguggaagagaggugggggacacaaaguuagguuguacagauuuagagauguuucuaaccaaaaauuaaauagacuuaagcauuuuauaauuauaaagagcuuuuaaaguccagcacagugacuuuaguuuuuaaauuuuacuuaauuuauucaauuauguuuuuuacaugggcaaugcaagaacauauaauaauuuaacucugaagguucuuugaauaaauagaaaauaaaaauuuuaaauaaagcacagucuuuaccuguagguuuguucagggccuacacugauacuaaaaauuaacuggcacccaauuccuuuguguaaagggacaugguauuugcguaugacccauacaccauuucccaucgucaccuucaagucaucuuaagauuucuuaccacacccgauagggcacaaaugcugugcaaguuguuccuaucucauguagggaacagggauggaaaaaaauuauguucaguguauauccaguuccuuuucuaauauauuuuuauauggcuuguuggagccaucaguuuggagcccacagauacaggacagggccagugguauauauguauccauuauuaguaccuauuuucuuaugaauauaaugucagaaaacuguaccuucauucacaggaagcuuagaauucaacuaaauagagagcaguggcacuuugagguuauauauuuaaguaauguuaaaaugaugauaaguuaguugucacagugauaggaaaaaugcuuuuacacugccuugccacuuccgcaggcugcagugagccugggcugcuuuguucucuugggcaguuggugcacaugcagcugcugucuauccucaggaggcuugcuuaggaggcacauuuauguuuaaaagggaggugccauguacuuuugaaaugucauucuagcuuauugauagcuuuaaauucuguuuuauauuauucuuaauguguguucagauuugacaggaaguugugguugaauucaguauuuacaaggaaaauguaauguuuacauaaucuuucuauuuaccaucuuauguuuuauauuuaauuuauauauuucuacguuagcuacaacuuuuuuauuuuuuuguacacagacgugcagugugcuucacaaagugaaguuacaaauggaaaagaaguugcaaggaaucaaaauuauucuaaaaaugcaacuaaaauaaaaaugaaacagaaaauuuccgugaaaccacaaaauggcuuuaacaagaaacguaagaaaaauguauuuaauccuaagaaagccguagaggacucugaguacgauucagguucugaugcugggagcucacuggaugaggacuauagcaguugugaagaagugauggaggacggcuauaaaggcaaaauucuucauuuccuucaaguuucuucaauugcugaacugacuuugauuccuaaguguucucagaaaaaggcucagaaaauaacagaacuccggcccuuuaauaauugggaagcucugguaaggcgugugugugugucugugugugucugugugucugugugugugugugucugugucuguguguuuuaauuuacaguaccguuuauagucagauugucuucagcccagggaagcauagauggguggccuucuccuguguagagucaaacauuacuuucauuguaagccaauaguauuucaaauagugucauaugaccuaauuuugaaugaauuaaggggugauuuuccugaaaaaacccaagcugauuggcugggaaugcugucacucauccuuuugcauagaaacuugguucauuucacugcagaagaagaaauuagagcuuacuuuugagagggaguuguuugcuagccaguucugaucuguuacugcugagacaccaugcagaaggcaagaauguggcagauauuugacuacaacugcuugcagagcaguagcagcggccagacgcguuccauggcccacaugccagccugagugcuuuaugcuuccccacaaagaggcagguguuuauuuucuuuuucuucuaaaugugacagcucaguuucuaacauguuucuccugguuaaacaacguggccauuugauggaguguagcaagcugcagcauuuuuaauuggaaaaauagcaaaguuguggaagcauagaauucaaguguaggcgaaagaaaggcaugagcucugucuggugaguacacuuugcacgaucauuuucugguguuugacuuccugugaaugaguuuuaucuaaaauaccugcuuuuugaguuuucuaaaucucaacauuuaucaaauauuauuccuaugaauaugcuuuuccguuuuagauuuuucaacuuucauggaaauguggggcuuuauucauggcuuguguuuaggccauccaagcaaagcaauauggaugguuauguacagcuuggagagaggagguggcuccugcagcuuuguggagguuuuggaguuuuaguucuugugcuguggaguguagaugcaugcauuugugacuaauauuguaccuauaacaaaccuaaaugagcaugaaugaccucgauaaaugucuuagaguguugaugaggguggucuuugcacaacaauuuucaaaagcauuuaaaaaauuaaaguaucucagcauauagaaaauacuaguccagcagaacuugaaggaaaaaaaacaagaagaaaaaaauacauguaaccagacuuaaaaccuuucguuuugccccaagcgcaugcuuuucuagagaacaucugucaaagcagauccuuucaaaacuuguuuggcuucgccugagugauuauuuguugagguauuugcugaagggcuuucuguuuuuucuuuucucccguuuuauuuuuccuuuaaucuuuaauggacucuuguguuauuaugggguuggguugcucaggcuuguuaggauuuuaauguauuuaauaagggaugcaguuaucuguacuaguuuguguagucacuguaacuacuugcccagauagcuuauaauaaaagcagauuauacaguuuuaccaagguuuaugugccagauguuuuaaaaaaaucuuuagcaacuuaacauggacaagacauauuuccuuaauuaauuggcagaguuuauaucagucgugacaugaauuuggagauuaugcauuacuuacuaagucuccugacuucuuuuuccuucaagaaauugaacauaaagaccacauuguuugucuuagccaacucaucuuaauguugaauauuuuaugaaguagugaaaaaguaucuuaaaaguagacgaauuauuucacugaguacaguguuuuguuaucccaagcaaagcguauaaauaagcuauuguaaauugauaauuagacaaguaaaucucuaagucuaaaauuuuaacuuccuuagacauuuuuugcuucuacuuucuaggagccagcauuuugagugugauuggauauaaaguaauuuaauauauuagugaaauuauuaacaaaacuuaauauguauauuucuauaaaagcuauauaacuuacugcccuuuuuuauuaauaaugugauaauauauucaauguuaaagcaaacaauagcaaaaauaccccuaaugcugcacucagaaauuacagauuugaaguuuuaauuguguuaacacagagcuaaaugaaauuagaaguuauuacagauuuaggacagcauucuuaaacguuucaauuccuaaagugguuguugaaguuuaguuuuaaagacugucuaacaguguaugaguaaauguaaauucauaaauauuugaucaaaaaugcaacuugaauguaaaaaucuuagucacaccuuuaaaccagacuuugaaacaguuguagauuauugguuuucauuaaagcuuuagauauauaauguaauauaaaucugauucacaaaauguauaugaauauauucacauaauaucuuugcauaauauuaaccauuuauaauauaauucuaaauccugagguugcaguuuucuguauugcucuuauuuucuuuccagaggauuuuucuccguccuucuuuuucuuaaguuaaaauguuuucaauuuaaucaccuucauuuuauuugaggaaaaaauaugauuauuuaaaagaugugaauugagaggauuuauguuuguagcuuuauuaauuuuuuucuuuguccuugcauugugauuucaauaauguuaguuuuuuuuauccauaguuuuuuaaaaauaguaauacuuuauaugcuaauuguaaguaaacuacaacguuaacuauagcagccuuugcaguguagcaagccaaaaauguuauuaguugaaaauucaguuuuguuaaaguagggaaaauggaauuuuuauuggcaauguucaaaauugaugguauuaguucaccaacuacuugcugaauguuggucuuucuagccuaguaucagagaggauaggguacuauugugucauguuguguuuuuaauugcacuuuuaugugcuaauuagagcauuauuuauggaagguauagcucaguugucauagggcuuucccagugcacaugaagcccaugguucaauccccaccaccaaguaaaucaggcacggugacacacacugcacuugggagcuagaaacaggagaaucagaaugucucaguucucuuuggccacaggacaaauuuuaggcccuauuaggguaggcuacaggagaaucugucuuaaagaaaauaaaacacauuuuauuaaaaagcauguguauauauacugcucaaaguaguauuuacaaauagguugcuucauaaauauuuaccuaccaucucuagauuccuaucucuuuucaguguucagcguaaaugagguauuaacauugccccagcaggcacagcuucugucuagugcuuuguucugccagugcugcuuugucuucuagugauuugcaggacuggugcccgucuucacuuuguuuagcccuauaaaaugccugucuucauuucaucuuaaacacugaaaugguucuuucuguuuucuuuuucuuuuguuuguuuauuucuguuuuuugguuuuugucuuuuuuucugagacaggguuucucuguuggaucuggcuguccuggaacucacuuuguugaccagguuagcuuugaacucacagagcucaaccagccucugccucccaaguccugggauuaaaggugcaugucaguacaccugacugcuuauuucuuggagauagauagagggguuucauugcuuucuaagauugcuguacuggguguuguuucaauauacacaaguuugauaaacaacuucuucuccuccucuuucuucuccuccuucuucuuaauauagauauuuaauguaugugaguacacuguagcugucuucagacacaccagaaaaggacauuggaucccauugcagaugguugugagccaccaugugguugcugagaauggaacucaagaccucuagaagugcagucagugcucuuaaccacugagccaucucucuagcccuuugauaaacuucuuuaaaaauugcaaauggauucuguaguuugccauauacauauagcugcugccagcuauguguaauaacaaguaagacugucccggagcuguuucuugauuaggaauuacauaacuuuagaaauuuaccuuuaaacaauuucuuccucuuaaccaaauccaaaagcauuuguuuugcaagagugacacauuguggcaggagagagguacuucaguuccagggucuacuggucccuucucuuuucaguacaggcagggucuugaacucaaagugcuugcucuaauucagggauauccccaccuccagauucagccuuucagagaagaaaauucuugggauacuacuggaguuuuuagagaugcuaaucaguggcauguugauagucuuuuugcauguagguauccaguaaguaggaauuuuuauguuuucuuuauucucccuaaauaaauaguuuuuaaguugauuuuguauguguaaaagcgaagcauaguaggaacuaaaaauguaguuuauacaaaauuccaccaaagauacccaccacuuaaaauaguuucaguacuaucuacuuauugauacauuuuaugccauguaagcaagauucuauuuucuaugcuuaucugugaccaacguuuauaggcugaccuuguccugcuuauguuuggauuuaaaaucucucauaauuguuugauauuucuuuugcucuuuugugcaacuuuucuguguuauaauuaaaacaugaccuuguuuuucauauuuucauacucaggacuagaguuaagcaccucacuccaagaauuacagccaccuuuauaguacaacaauuuaaccacagaguuuuguugcuuaacaauauuccuuuuuaaaaaaaggauauuuacuugaacauuuacuuaaacauauuuugcuuaauuaauuuuuucuguauaugggcauuuugccugcauauauaauuguuuaccauauguuugcuaggugccauaaaggcuggaagaugaggguguuguauucccugaagcuggaguuacaacugggaccucaccuugcuggugcugggaauuaagccuggacccuuuggaagaauagccaaugagugcucagaauugcugcuccaucucuugaaucccuucuauuuuacuuuuuaaagacaagaauguguuugccuagugugauaucaagcucaugauucuuuuguuuuggccuccugacagcugggauugaaaguauauauaggucuuauguagcccauucuggucuucacucguuguauaguagaaaauggccuuaaacucuugauccuuccgccucuaucucccaagugcuagauuuacaagcaugugccacaggaacuuagaacuuaccaggcauaauguguuuuguguucaaguauucacaguguccuuuuaaaacaggaaaucuuuucuuauucuuuuuugacuuaaaaccuuucaauugcuuuaaaguguucauaucugaacucaucagaaugguccuucuguccuuucccacuuguugaaauaaucuuguguucuucuaagcugugacauuuugaucuuaugguuaaaaguucuuuauuacaucugaaaagacuuucuagguuuuagcauucugcuuaugguacaggucugugaaauuccauccuuucuuuuuagcaauuagaaugucuuugcuaauaacaguauaccauguaaaggagagacuguuccuauauagcagauacuuuuaccaguuagacagucauauucacuagaguacaaaacaaaacucccuaauuuauauaauaaaguuggcuaaagaaagaaauagcaauuuacagaagugguaucacuucacugaaaaaauacuacuuguuuugagcuuuaaaaaauauuuuucuuugugcaugcauucaugucuguguguuuuuauguaauuguguaugggugcuugcagaggucagaagaguacuugggagcuagagcuauaggugauuguaacuuaaccugauguggguguugagaaccaaacuugggaccuaugcaaaagcaguaaguacucuuagcucagagccaucucaccugcucuuggcuucagguuuuaagguacuugagaggaucuguuaacacugaaaacaaagcagaaacuuuggauuuucuccagcuucauaauauaaauguuauggauucagaaauggauuuaaugaauuguugaggaagauguaccuuguaauuuuugcucacaaaguuauuuguguucuuuuuugauuucugguuaauuuugguguuuuuuuuuucucauaugcaaacuuccaacaaacugcacaguagauaugagaugagaauuuuuguucuauaauuuuuuauuucauuuaaaauuugauauuuuaauuaaaucuaauaaaaacucucuaugccuccugauuauggauaauucuccccuaaacuuaaccaggagggcaagggguuaccuaaugauugugaauauucucccuguagaaacauaauacacaaacaucaguauuucggacauugcagagacaucucagugauuaagcucuucuagaggauccaaauuugauuucuaguguucauaugacagcugacaaauuucucuaacuaguccuggaguaucugccaucaucuuuuggccucugugggcacuauauauaagcaguacacauacaugaaagcaaaucacucacauaaguagaugaaauucuuuuaaaggaaaaguauaucaaguauaucaguguuucauaguuccauuuuguaauauguugggcaugguggcacaugcuuuuaaugccucuacuggggagccagaguuaggcugaucuguucaaggcacacaaggucuauauagugaguucuagaucagccagcuauacauugugagagacuugucuuauaaacaacagaaaucauauagaauagauuagagaaauuguuuccuaccaaucuacucuuaguauaaaaaugaaaauguauuuuguuacaaauuggauuuuuuguuuuacaaaaaacauauuucagaagcguugaauuucuauuguguagauuucucauuacugauagaaacaccauaaucacaaggaugauuuuucuuguaacuuggaagcauaucauaaauauuauauggugauaugaaucaaaaucacccgucuuuauucuagcagauggcugucuguuagcuuccucgcuucaguuauguagggaauuucuuuuuucucagugggcugccaagugauuucuuagccuuuuuauccuuugcauaagaauauuugggcuuuguuccuuagggcauaggucuuuucuuauuuagcaucucuuuuuugaaaacauucuuuuaaaguuucacauacaaucauuuacauuuacacaggugcuauauuauaguugauuuuuuuuuuuuuuuucgugacaggauuucucuguguagcccuggcuguccuggaacucacucuguagaccaggcuggccucaaacucagaaauccaccugccucugccucccaagugcugggaucaaaggugugugccaccacugcccagcugauaaccuguuuuguguuuuuguuuuuuuuaaaucuguaggguuguacuuugauacgacuucugguuauucuuaauauucaguagucauagaaagugacagaaauggaaggaaguuuagcccuauagucuauuuugcucuauuguguuuacuaaugggugaagcuaagcuuuuagggggaaaauuaguagauaggaaauguuguggugaguuuuuacuuugugcccuugggugggcugcacuguuucaucuuuggaucuguggaugaaagacagacacacacauuagcuuauuucuaauaugcuuuuagcucauggcuggucacuucuaagccucccguggcuagcaugcuuucccuuuaccccuagcucaguaccuucuaaauagccuuaccuuugcugcccuguuacccucugaggcccauuggucucugcuguccaaaaugcugcugagcagccuuucuggggaccucuuucucuuuauacuuauauuuuggcugauauuccuuuuguagcucuaauucugaucugucucucucccccuggucauggcgaucuucucuuuuucucuuagccugcacaacucuaaggucuugcccugucuccccuuucccagccauugaccgcuggcgucuuuauugaucaguaaaaaccaauuggggacaaguaucuccugcggcaguacuagcagauuuccgauuaaaucaaaauaucagaaccauuccuguacaaggaaauaugaaaacuuaauauuuucaauauaaggaaacauuugcuguaucaauaaacuuuauaauaaauuugaguuuacguauuucugugugaaaagacguuguuugaaguggcaguaugucaaugaagcacauaagaauucaaauguguacaugaaaagccaguucacucaucacucuugauggcuuuacaaacuuuucuccccucaaagaaagaauuuggauuuggcugcucagugugguugugcacuccugcuacccacuguuuggaagcagaggugagaagguuacaguucugaggggagucugagucauggcacaaaaccuuuaauuaauuaacuagaaagaaacuuacauucugacugcuagauuugaacuguugaacuauuuuucuuuuuaugccacaguuuacaaagaugucuaaaaucaauggccuaucugaagauuugauauggaauugcaaaacgguaauucaagaaagggacguaguuauaagacuuaugaacaaaugugaggacauuucaaauaaacugaccaaacaaguuacgaugcucaccgggaauggaggcggauggaacagagaacagcccucccuucuaaaccaaagguaucauucacucauuacagauauuuugaucuuauuuuauaaaguaucuaaacuuuuauuugcauugugguuagggaaaccaaaugugauucaguaacuaagguuagaagaaaauucuccaagguucucagugacaaacagggguaugccaguauauuuucauugaucccuuccuaggcaggggauuuuacucuaguguguuguuaugcggccuuauauaaucuuuaucuuccuuauccgguaacagauagcuuuauguguauccacugaggcuaauaagaaugguuuuagccuauagguggaacaacauuaugaacuaaccaguacccaggagcucuugacucuagcugcauauguaucaaaagauggccuagucggccaucacuggaaagagaggcccauuggacaugcaaacuuuauaugccccaguacaggggaacgccagggccaaaaagcgggaguggaugggucggggaguggagguggguggguaugggggacuuuugggauagcauuggaaauguaaaugaggaaaauaccuaauuaaaaaaaauccaucaaaauuaaaaaaaaaaaaaagaagaagaaugguuuuagccaugcuguguaaacugacgauuuuguucuucguguuuuuuuaagcacuuugagaagucuucuugggguuagaaacaauucaagaggacacagcagaccacaacuguacacaguuuguuuucuaugugcuacuuauuaaaauaccuugccagaagcccuggcaaaaacuaaauaugcacaaccaucuaacuaucaguacauggucaaguggcauuuuguaguugugcagaaugcacaugguguuggaggauuguaguacgagaaaguacauuuugaauuucuuuuaauaauuugcuuaguuuuaaguaguuuggaaauauaaaccuguucagaauacuuccuuuucaggaaauacauucaguugcucauuuugguauuugcuuguuuuuacauuuguuucuguuuuuuguuuuguuuuguuuuuguuuuugagaugggcuucuuauacauacauagccuuagcugccuuagugcucacugugaagucuagucuggucucaaacuaauggcaauucuccugacucauauacuaagugcugaguuuguaguuguacuccauggaaccaccauacuuggcuguaauacuuuuuguggagcaaaaaauaaaaauagcccacgucccuaaaaaucaaggacuaguuggaauagauugugaaaaaaguacagcacgcaguguuuaugcaauuguaaaugcuaauuagagccaggcauacugccccaccccuggaaucccagcaggguggccaagacaggaggaucauccccaguuugaggccagcuugggcuacauugugaauugcgagcuugggccacagggugauuaaaaaacaaacaacaacagaaacaacaaaaaaaaacuugucuuacagagaguuagguuuguuuagaauauuuauacuuuuuugauguugaaaauauuucuuacaguuuuuuauuuuguuuuuguauuuuagcacuaggguuuggauuaccuuaguuaugucugguauuuuucuuaguuaaugaucaaagcauauuugcugaugaucauuguguuaauaguucaaaaucauaguaugaagcaaagagaaaaagauaugauaauuggccuuuaauaguaagcucgaaucuuuucugugcccuucuagggugcuauguggugguguagggaaacgugaugcagcucccacaaaagaagcaagcccuuuguguguugcauagacagaacuaugucagcaaguucuccuaaguguaguuggagcugcugcugcugcuuguucuucagcguggacguggggaguucuucacucugccagacuuucccaguugaguccacuuuaucauaacucggaguuuaaaaaugaguacuuuacugcaucacuuaaaaacucucaacccacauucauaaguuucucuucuaaguaguguggucagguaauaaucuccuuucccuuagaguaagguuuuuaagacauauuuuaguuauaaauguuaauguguuucuucauggcauuuuuuauuuuuaaugaaauacuuaacaagaaaugaaauuuuaaguucuccuuagagcagagucugaguuguagccccgauuuacuugguggacuggccagccuugucagcugccaauguugaaaaauuuguagaugaucauugccucacagagguaaacacuguccagacaauaacugccauacucacuuguaucuuuuuauacauacacauacauauauauauaucuccauccccagcacuuggcuuucucucaacagagcagaaccuuuguggcaaauacacuugcaagcaguuagugcuagguguuuuguuuaccauggccaauuguuguucauuuuaauaggagaaaaauuuucuuuguagauacagacauuucagaacuuccuguuagaaauuaaauauuaaaauuagggagauggcucagcuguuaugagugcugcuguuuucacaggacuuaagcucaguuccuagcacucacaucaggcagcacacaaaugacugcaaauccaucuagcucccaagguuugaugcccucguuuaccucuguggcauuggauacucuaguccucccauacacauaguaauaaaaaccaaucuuuaaaaaauaaaauuugucacguuuacuucaaaaccauuacauauucauacucauuauuucaaaauguuaaacuugcuuaagauucaaauguacugauguaaggaacuaguggcauuaaauuugagcuuaauuaguucaaauuuuagaauaaguguuggacaguauauccugucuuaguuuucauguuuuuucuuacuauacuuauaacuaucucuaagacuuuaguaguugauagggaauugauaaacucuuaacucuucucauugagaagguuucuaacuuauucagcauacaguagguugucuuucuuuuccaagcgaaacucaugaaguccuuguuugacaggaggguuuuuuuguccugguuuuaagcaggaauucagaccuuuggcaaaugaucuggugacagugcaaauaguuuaacuugaauacuugaaucuauugaaauaacuaauaacauuugaggagccauggcacucuuagaagacaugaacuuugaugggauggcauguaggcuuuguguggaacauuucaaacaagcuuccuccagcuccacacuuuugcuuuucacacucauuaggugcaguccuggaagcucugcgucucuccuuucuuucacuccuuugaaaaucauacuaaaacgagcuuuucuuaaaauaaaugcaucauuucacacugaaagaaucauaaugacugggauucuuuuuuuucccccaguagaaaagcacccgcaaaauaauccauuacuuuucuuuuaugaucccagaagaucauauaguaguauuucccucaguggaagguaggagaaccuccagccuagagauguuuauuagauugcacauuagaguucuggacauuucuacauucuuauaaguaaauggaugguuggucuucacauguaauuguuaaaauucuuaggaaauugucaaaauaaguggaagggaaguuggaauacauaacaccuucuagagaaagaauauagccuaccuauugcaauaauuugucauauuaguuucuucauuugacuuuuucuguuucuucauuuguuuaguuaguacuggugauuuuacccagagcuuuaugcaugcuaggcaagcacucuuaacaauuaagccauaucccuauauaguaaauguaguuugaauuggcuuuguuaaaccuaucuacaucuucguugauccuuuuagguuggucuauuuguguuugaagaagcaguguguauaaggcagcaguuuuguuguacuaagcaacacagucacaauauaggcagaacaagcaaggaacauuauaugcaugaauauacauacacacuuauguaugaauauguauuuuugaaacaaauacucuaauuuaauaaagcuauuuagucaaguaucuaauuaaagugccuuacucaggcuuucuugugguuguaaauaagucaguauuccuugaaugaauauuucuguauacuggaugcuuuucacuuacuacauuuaaaaauuugugugaaguuuuuugccagagcuuuuaaacuuuauauuagugaugaaaaacuuuguaauuuuaguugaagaguauuccuuguuuuuuaaaugauaggcuguguguuggcauguuaugguggcccucagauacauuuauaaauauuguaauacuccuccccuaucaaaauuuuauuuucaugaaaugugaacuuuacaucuguaugaugaguaaagaaagcauugguaaggacucaaaagcaauagagaaauagguuuugccuugaccaugcaugggcuagagcagcaaaagcuuuaggguuuugcuauuuuguggguaaaggcuuuggggcuaagggaguagcuuagcccuuaagagcaugugcugcguuugcagaaaaccugugugcaguuuccaguauauugagcagcuccucaucaccuauaacuugauuucuggucaauaucgguacgaguaauauaugucgugcaaagacauacauacaggcaagcaccuguguauacauaaaaauaauuuuuauuuuuauuuuuuuuaaaggcggccuuuagaguaggucugauugaauaugagggccuugagaaaguuuucacguuucuggaggcaauggugcugcauccguacaucauugccucugugggagcauagaaauuacauuuguaaauaguauucuuucuuuuuguaaggagggcacauaacuuugaugacuuuagaaauguggacaauguuuuucuucccuguauuguuaacuuuuagugagaaacauuuuugugaaaggcugaaugaaacauagacucuuguuuaaaguggaggacuuuccaaccccaccucacuggauaaagauguuuuaguuucagaauuuaaccccauagucacuuauacgcuacauacaguuuacguccagaccgcuuuuuuguguacagacuaauguguguagagggaacuaagaaggcauaguaaaagcuggagaauguuacaggcuuccacacugaugugugcugagugcugucugucugaguaugagaauaagcuuuggauuuacaauaacuucccaaguuaaaaccuuagacuugauaguuuguaguuuuauagccccagggucucauuucaucugaaaaaaaaaaaaaaagauaauagcuacuuuauagcauucuuaaaagguuaauaagguuaguaaaaauauaugaaaaacgacaugcauucuuuauauagacuuucauuaaaaucauugcuaagaauuuuagccaucuaaaacauuuagaaaaauguuuucauccacuauaacucuaauauaaacaaaguuguuccuaggauuaauuuguuuaugcaucucuaaguuaaaaaguuagaaaaugcuuguauauuacuuugauacucaucaaugcuuaguaaauuuauauauguaaaucuaugcauaugcacacauacauuacucuagaacuaaacaaagccauuauuaagcaaccuggcagaagaacaaauuauguuuguggguuuaguucuaaaacuuguaauuucuuuaacaugcuaaaagucuagucaauauaaucuauuuuucuagacuaaauaucacuuuaauaauacauuauuguauuuaaucugaucauuuauagaauucaauaaaaauuuugauaugacccaauauaaaaauguuuuauguaauuuguacugcuaaaagaaguaaacaacaaacauugaguaaauauuuaugagauuuaaaaaauuuuuauggauuguguuuuagauuuacuuuuuaaaaauguacauagcuuuuuaagagucaggcuaaaagguaaggcucaucuagauaguuuuggauuuuuuuuuuguauguauggucauuauaauccaagugucagaaauuagaauagaaaauuaauaaaacaaguauaaaucugugauauuuguuguuucuucaucaguuugucacucaagcccuaucagaagguuggguugaacuggcuggcguuggugcauaagcauggacuuaauggcauucuggcagacgaaaugguaggugugcaccauugauagaauuuguaauucaacauggcauaaagagauauacugcuauuuaagacauuaaggcaucuucccuugcugguguuuugcuuucuuguguuuuuuuuuguuguucuuugguuggcugguuuguuuuguggaguuaccaaagccgggacauguuaggcaagcauccugccacccagccacaucauuggacauuggaguuucacugaacccauuacaguagcucacacuuucuuuuaccuuucuuuauguuuauugcuuuaguuuuagcccuaguccuccacaacugaaagaaguuuaucuuucugguuaugauuauauaucaauguaaauauuacaaaaguaucagcaaaaucauuucaguguuugaguuaauuuuuccuccaaauuacauuuacuuuaggcuaagcucaggaagcuuguugcagccauuaguccagggauugucauauaugaacuucacuguuagucugaugugaccucacccuuucuucaacucuacuuguaaaaaguauuuauugagcaugaguuaaaugcugccuguauugccuguagcacuugggagacaaaggcuggaggauucagguuugaagccagucugggcuacaugcaaacccuaccacaaaaagucaagccaaccaaagaaaaggcuguauucagugaguaacaaaaaugaacaaucauaauaaugcuguuccugcauauuucuacugucacuuuauacuuauuaagagaaagaugcuauuuauucaauauaaaacuaaugucuguggcaugucagaaugcuuacaaauaaggugcagcgugacaguuauaacugaacugggaaucagaccugagcuugguugucaaccucgccuuucacaggcuaucagauucuugcuagaugacauaauauuccaaaacuaauaugaauaaaaauauuuaaugucuauacucuaagauuauauuggugucaaaaagaauaugugaugccauuuuuguuauuuguaaagcauaaacuuguaaauuugcagaaugaaaauaccauggcuauaccucacaaguuuguuucccauagcuaguacaagauagaggugcuagcaggcuuggcaucuuuuugaggccuccuccuccuguuuugcuuuuuaaaaauuuauuuauucacuuuauaucuagcucacuacuccccucccauucacuccccuccuauaacccuuccccgccuucccucuugugaguggguaggcccccucaagguaucccccuacccuggagccucuucuuaccucgaaagcaagggauacuguuuguguguucagauaucauugccucuuuguaccccuggucucucccuaaaaggucauuagcuugacuggguuaagacagcaccuuccugacugcauuuacccugaaucucuuccuuauggccaguugaaugaauacuguaucuuugaguguuagcacuccagcauauguauuuugagggaagaacaagaacacauucaguucauaauauuggcaguacauugcucuccuaaugcuaguucaguguuuugcuuugguuuuguuuugaaguaggauuuuauacuauuccccaagccagccuagaacuuucuguacuguagcccaagcuguucccaaauuggcauagaucauuccuuggucagccucucaguuggcugggauuacagauaugaaccaccaagcuucgcucugaaucucaguucugacacccaucacuagaggcugaugaccuuaggccacaguaugagcaguguuguucauacuguucugucuggcucaugcaguacagcaugaugcugcugggauucaucugcuacuaugauaucagagguuuguuuuugauugcugugugacauggucuucuuauccuuaagagugcaauugcagaguaauagaguuggguaauguuuuucuauauuuaugaaacaguccgcaguccaucuaggccacauuaaguccugggccuauauaaguaauaaugagaaguaggcacuuucuaugcaaugcaaaauucuucacuauuaauguaugucauguauaaaccaacuguuaagauccaucauucaugcugcucauuaaaauaacuuuauagaaccacuugcagauucuacucaaaacucauuugaacuucauagaaauucuucuuagaaauagaaaguggauuaugcgaaauggaaaaauuuaauccugccaaaaaauguucccuuuucuuuugcacuuucaaguauuuguuuauuuucauucauuuuaaaauuuuauauauugucuuuuaaacuuugauuuuuagggccuaggaaaaaccauucaagccauugcauuccuggcauaccucuuucaagaggguaauaaagggccucauuugauuguuguuccagccuccaccauagguuuguaauccggggacaacuguuucuguguuuuggaauguuuuauauugaugugcauguguggugaugaauauuaauguuuuggcuuauuuucucuuuuuuuuugaaaaugauacaugucuauguguuuugcucgcauuggcaauauuuuccaagaaccugugauggucauuuauuuugguuucauaguacuuauaaauuacuuuuuaagaguuaaaggagcugggugugucaacauacaccuauaauguuaaauacuuggaagguagagucagaaggagcagggguucaaagucaucuucauauguguguugaguuuggugucagccucggucacaugaggucugugcuggggaaaaaauauagccaaaugcaaaaagaaacagaaaacaguaugguauugaaagaaagaugaaauuucaagaccuguaagucauauaaaguacucagaaauugcugauugugugccuagaggcugccuggggcugagaaaaaagaaaaacaaaccuggguaugccccgaaguuaaaacauuccugggaacagcuuaaccuuaaagauaaagaggaaugugaagacauaacagggcuaucuaaacugagucaacaagucacagaacucugacacccugcacguacauguaaucuuucugcugaugauugaauaagccaauagugugucgcuaugcugaauuccacaccccuaagccccuuaccccauaagaaccccuagcuuucgagccucguggcagacauccguuaucuccugugugggaugcaugucgguccggagcuccguaauuaaacgaccucauguaauuacaucaagaugauuuuuugggugcacgccgaaucgggaauugaguggggguuccccacuagguucuaucaguauaauuaggugggauggggguugagaggaugucuuacugugugccgccuauccaugcuuuuauaaauucuuggacuugagugauccuccugccucagauucugaauagcugguacugcuaacccgcccaacauucuuuuuaaaaaagauuuuauuuauuauauauacaguguucuuucugucuguaugccugcaggccaaaagagggcaccagaucuaauaauagaaggucauaagccaccaugugguugcugggaauugaacucaggaucucuggaagaguagccagugcucuuaacuucugcaccaucucuuuagcccuacucugcccaacuuuaaaacauuauuuggauuuaaaaguauguaauuuaauucuugcuuagucauuuauccaauuuuuaugaguuaauguacaaguuggugugagagaguuuuguccauauaaguauaaaauaaagaccaucuuucccuaaauuagaauuaucacuuaaaugggguuuucuucugccccuugcaccucugccccuuuagaaccucucauuuuaucaugagggguaguuuucauaguguuuuuuuuucaaagcaaaauuaacuuaauaaauauauccuguaauagcagauucauauaaucucuuguuuuuuauagauaacugguuaagagaaguuaacuuauggugccccaguuuaaaugugcucuguuacuaugguaagucauuuugcuuuucauuuaguaauuaaaaaaaauuaagauauauaauuaaacacgauaaauauaaucaaaguaagcuucacuuuuaaauucuagguucucaagaagagcguaagcaaauuagauucaacauccauaauaaguaugaggauuacaauguaauuguuacaacgugaguauuaagaaaguuugggaaaagguggggagaauuuauauaguccucuucccccugaauccuuccgccaccccccauuuuuaaaggcaggguuucauuauguaguacuuguugaccuggaccucucuuuggacgaaacugaccaaacuugccugccucugccucccaaguacugagaugaaaggcaugugccaccaugcuuagaaaaauaucuuguggugguaacauguagcuuaguuuaugcugugauugugaaacaagggaucaagugauuuauccugauagugaaauguuuuaaaaaaauuauuguauaacagguuuugcuugaauauguuuuguuuugcuaguucacuaaaaaugggaguaaacauuuuguucauuuaauuuaagcuucagauaaaauuugagauaccaugccaaagacuuauaaguguuguccgcaaauauaauggaaaucuguucccagucagaaauaggaauuagagcagaauaaggaugacagagaaacuaauuuuuuuguuuguuuguuuguuuagcuuuugcggggguggggagguaaggggggugggagggagggucucauuuaguugggcugcucuccaagucauuuagcugaguacauccuugaacccuugauccguuuuuuuuucaccacucccagguucaauauauuuuugaauagucacuauaugguuggaauuacugaguauaguauaguacguguuagagaacguaauauuuuuauaguucauuaaaauuuuuauuacuguuguauucugucagggucuauuuuggaagaauuuaucuaaaauuuccuuuuuccuuuuuuaaggauuuaugguauuuuuuguucaugaguauguguguuuauguauauauguaccacaugcauagaguugugagcagaggccaggagagggcaucauauccccuggaauuggaguuauguguagcuaugaguugccagugugugugcuaggaaugaugcccagguccucugugcaggaggaagaagugcacuuaacuguugcccauuccuuucaaaacaauuuuuuuuuuuuuaaaaauaaauggacccauauuuagucuugaacucuuggcucuuaccuaguaauuccuugaacuaauccuuuguuuuaccuuuguguucuuuucugcuucuuagaaacaauuaugagacaaaguauauaucagugccagauuauuucuauuugcucucaaauugucugcuucccaaguauauuaaaguugucuagaacuguuucauauagauuuucuuuugguuaguacuguaugauuuggcuacaggugcauaaauauucaauacaaguacgucaguguuugagagccgacuguguuuagugcuuucuuguaagagcuauuugaaagguuaaaagaaaaauaguuuaaaagccagugcaauggcuuagugauaagguaauugucacuauaucugauaacuugaggaaggaaggaacaugaccuuucuaccugugccucuggugucacacauguacuuacauagcauacaauaaguaaauuuaauaaacuuuuuaaaagaaaaauagcuuuaaagaccacauuguguccuaauaaacucuaagcuccuaaaaggcauaaucagaaauaauuagguuuuguuuuguuuuguuuuugcaacagguauaauugugcaaucagcagcucugaugaccgcagucucuuucgacgacugaaacugaauuaugcaauuuuugaugaaggccauaugcugaagaauaugggcucuauccgcuaucaacaucuaaugacaauuaauguaagagugugcuuuguaaauaauugugauaaaauuuaucuuuccuaauuuaauacauacacacaugauuuuaaaucaugaauuagcaagcuuuuccuuuaaaguucuuuuugcuuuuggggcccuguggccacugucauacuuucuucaauaauucuuuaaacauguaaaaaaaacaaaaaccccaaaaccaaaaaaacccccauacuuuuagugcccuauugcacaugagcuccaguuuguauaaauauaguuuauuuuuuaaccaccucucagaaguuauuugaggauacacaauugugcuuucaaaagaugccagcagguucauguucugccugagguauaguagaugauaguaaaugacaucaaauaucucaccuuuuauucuaucacagaauguaaaauuguaaaugauaauugaauuaucuuguuaccuugucuccuuuacugaguaagauagacaauuagggagggagaggugcuuaaagaagaaaacuaaugugaguuuugucuucauucucaggcacguaaccguuuauugcucacaggcacaccugugcagaauaaucugcuagaacucaugucauuguugaauuuuguuaugccacacauguuuagcaguagcaccagugaaauccgaaggauguuuucuucuaaaacgguaagcaugcauauauguuuccccagaugugaagguguuuuucuaggcucuuuugucuguuucaguuauuuucauggcacaugcucuaucaaaagagcuuaaauuuuugugaacauaucagccauaguauggagaaaaauaaugauuauuucuaugaccaguagucaggaguuuugagguucaguaaucuaaagaacugaguaauaauuuuaaaugguggagagcucagauguauguauguauauguguguguguguguguguguguguguauaaauauaugguaccuuagguucauauauguuccuuuuuuuaauacauccuuuuuuucuuguauauccuuuauuggccuuccacuaauuauaaaaacuuguacaauuauggugccauuaucaaaacaaaacugguauaauacuaucaacuaaagacauagacugaaaacucguaccuaauuccuaaucuaaaaauguccuccaucuuggaaaaggugacuggccuuucuaagcuaguacuagaacucuacuuuaggauuuccagauacccggagguagcuucuguuucuauaacgguuguuuagaagucagaggcuucauaagguagagcuuaaaggucuuacucagaagccugacaguaauccaaugauuuccugaugacaguaauccaaugauuuauaucuaugguuucuccguguacagucugaugagagaaaauaguaugcucucagacuuagauccagugcacaagacucuauugugguauaugacuaaggaaacugauuauaaauaguuagguuuuaggagccagugugagcaugugaagacgcccaugaagaugccaggugcauugugcaggaagcuccauuuuacugcuccgccuucugcagcguaaagagaguugacugaacucaggcuuugagccaugugaccuuaucuaagcugcuucauuugaagccucuugcuuaaaagccgagagaacacccauucuugauauucuuaagaugccuaucuccuuuuacuuuuguauuugcauacauacacacaguguguguacacauucaggcccgagguugacuugagggaucuucuauucuccaccuuguuguuuuacuguuauucauuuauucuuugauaauuucauacauguuuauaaugcauucuggucacagucauuuaccagcccuuccuaacuccuuguuaccuguaccugaaauacaucuuuaguauguaauucuccaaaacccugagcuuugacuggauacugcucucugugguuuucaucaaauuauauugacuuuguuuucguucugcaaauacauaguuggauuccccccaccucuuccacuuuacuuguucucuccuguuuuaaacacaagcacaugcacacauuuuuauuccaugugacacauuuagucagucaaugacugaauuggauguuuguaucuaaguaccaacuagucugguuuagauuuaucacuucaguaaaauauauaguaaccuaccgugaaaccucaaaauauauauggagcuucaaauagauuauagcucagaauucagaaaugacuuuguaggcccagacaguaacccaguauaaagcaccugccuuuuauuuauauccacggccaugaguuuaacccauaccauuauguaggagaaaagcccaaacagucaaauuuauauuuuguuaugugaagugggagucuauagauuaugcauauuguaauaugggauuauugugaugacuuaaagacauaauuucuaaaggguugggcuauuauuuugcuuagaaaccagcagacgagcagaguauauacgaaaaggagagaauagcccacgcgaagcaaaucauuaagcccuucauccucaggagagugaaggaggaggugaguccuucucugcgggcccgugggugcagucuuucagaaggacucuguucuuagaacagucacuucaaagcgguucuccuuuccaagguucuuaagcuccugccucccaagaaggaucggauugagcuaugugcgaugucagagaagcaggagcagcucuacucgggccucuucaacagauugaaaaagucuaucaacaaccuggguaacuuacagcugacuuccacagcuuaugcaaaaaaggauuuuugccuaugauaauuuuaagggcuguucuuuuuguuuguuuguuuuuuugagacaggguuucucuguguaguccuggcuguccuggaacucacucuguagaccaggcuggccuccaacucagaaauccaccugccucugccucccaagugcugggauuaaaagcgugcgccaccacugcccgacuggggcuguucuuuuuaaguuagaauuugaagaaauauuuuuaagacuuaaaaauugagauagacuuuaguaaauugcucugucacuuugauuuuaaaaaaauguauauacucuuuggaucacagaaaaaaacacagagaugugcaaugucaugaugcaauugagaaaaauggccaaucacccuuuacuacaccgccaguauuacacaccugagaaacugaaggagaugucucagcuaaugcugaagguaaggacuuaacguuaguuagacucuuacugagcuuugcuaauaauacugggaaauacuuaggauggucuuaugcugaaagcucaucucugaaccacugcgggccgccuugcacgugcuaaccaaacucuccaccauccaccauccaugcuauagcccuagccugagugagauauacuuuccaggcauagauaacuugauagacaagagaauggauagguaaucaggccuggcauuagcaaacuguggcuaagaacuaccacuuuuuuuuuaagguuuuuuuguuuguuuguuuguuuguuuagaacauaaccauacccauuuucauuuguacuguuccuuuagggauucucauuguaggggcagagcuagguaaauacagucuauaccacugccugccaagucaaaaauacuuauuugacaguuggauaguggccuuuuaugagaaagaagaguuugcuaaucccacagacuuuuauuuuucuuauuuuauugauugauugauugauuuuuuuucaagacaggguuucucuguuccccuggcuguccuggaacucacucuguagaacaggcuggccucgaacucagaaauucgacugucucugccucccaaguacuaggauuaaaggcgugcgucacaaugccuggccacagacuuuuauaauacacauuuccuuccccuccccccgccccccccaaaacauggcuucucuauauagcccuugcuauccuggaacucacuuuguagaccaggcuggccucgaacucagaaaucugccugccucugcugggagugcugggauuaaaggcgugugccaccacgccuggcucaauaauacacauguuuuuaaaguucugaaaacgaaagcuaaaccagaguaagagaucccucauauuuguguccugcuuaauggaacaguuuucccauuuauuuucccuauuuuguuuuuccuuuguuguauuuuucucuuugucagcuuacucuuuacuuuuacaccauucuuuccuaauuuuuuguuuguuuguuuguuuguuuguuuauuuuuccauuuuuauuagguauuuagcucauuuacauuuccaaugcuauaccaaaagucccccauacccacccacccccaauccccuacccacccacucccccuguuuggcccuggccuuccccuguacuggggcauauaaaguuugcguguccaaugggccucucuuuccagugauggccgacuaggccaucuuuugauacauaugcagcuagagucaagagcuccgggguacugguuaguucauaauguugauccaccuauaggguugcagaucccuuuagcuccuuggguccuuucuguagcuccuccauugggagcccugugauccauccauuagcugacugugagcauccacuucuguguuugcuaggccccggcauagucucacaagagacagcuacaucuggguccuuucgauaaaaucuugcuaguguaugcaauggugucagcguuuggaugcugauuaugggguggaucccuggauauggcagucucuacaugguccauccuuucaucucagcuccaaacuuugucucuguaccuccuuccauggguguuuuguucccacuucuaaggaggggcauagugucuacacuucagucuucauuuuucuugaguuucauguguuuaggaaauuguaucuuauaucuuggguauccuagguuuugggcuaauauccacuuaucagugaguacauauugugugaguuccuuugugaauguguuaccucacucagaaugaugcccuccagguccauccacuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguuggggcaucuucuggauauaugcccaggagagguauugcuggauccuccgguaguacuauguccaauuuucugaggaaccgccagacggauuuccagagugguuguacaagccugcaaucccaccaacaauggaggaguguuccucuuucuccauauccucgccagcaucugcugucuccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccaguuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucaauucuugaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucaauucgcauucuucuacaugauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaucacaauugcucuguaguaaagcuuuaggucaggcauggugauuccaccagagguucuuuuauccuugagaagaguuuuugcuauccuagguuuuuuguuauuccugaugaauuugcaaauugcuccuucuaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagacuugaaguuuuuaucauacagaucuuucacuuccuuaguuagagucacgccgagauauuuuauauuauuugugacuauugagaaggguguuguuucccuaauuucuuucucagccuguauauucuuuguguagagaaaggccauugacuuguuugaguuaauuuuauauccagcuacuucaccgaagcaguuuaucagguuuaggaguucucugguggaauuuuuagggucacuuauauauacuaucauaucaucugcaaaaagugauauuuugacuuccuccuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauguuaaaccaucccugcaucccuggaauaaaaccuacuuggucaggauggaugauugcuuuaauguguucuuggauucggcuagcgagaauuuuauugaggauuuuugcaucgauauucauaagagaaauuggucugaaguucucuaucuuuguuggaucuuucuguggcuuagguaucagaguaauaguggcuucauaaaaugaguuggguagaguaccuucuacuucuaucuugugaaaaaguuugugcagaacuggaauuagaucuucuuugaaggucugauagaacucugcacuaaacccgucugguccugggcuuuuuuuggcugggagacuauuuauaacugcuucuauuucuuuaggggauaugggacuguuuagaaggucaacuugauccugauucaacuuugguaucugguaucuguccagaaauuuguccauuucguccagguuuuccaguuuuguugaguauagccuuuuguagaaggaucugaugguguuuuggauuucuucaggaucuguuguuaugucucccuuuucaguucugauuuuguuaauuaggauuuugucucugugcccucuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuucuuuuuuucuagagcuuuuagauguguugucaagcugcuaguaugugcucucucccguuucuucuuggaggcacucagagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccacgugaguguuggcuuucuguuauuuuuuuuguuauugaagaucagccuuagugcauggugaucugauaggauacaugggacaauuucaauauuuuugaaucuguugaggccuguuuugugaccuauaauguggucaauuuuggagaagguaccaugaggugcugagaagaagguauauccuuuuguuuuaggauaaaagguucuguagauaucugucagguccauuuguuucaucacuucuguuaguuucagugugucccuguuuaguuucuguuuccaugaucuguccauuggugaaagugguguguugaagucucccacuauuauugugugaggugcagugugugcuuugagcuuuacuaaaguuucuuuaaugaaugugggugcccuuguauuuggagcauagauauucagaauugagaguuccucuuggaggauuuuaccuuugaugagaacgaagugccccuccuugucuuuuuugaugacuuuggguuggaagucaauuuuaucagauauuaggauggcuacuccagcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuaucggggaguugagaccauugauguuaagagauauuaaggaaaaguaauuguugcuuccuguuauuuuuguuguuaaaguuggcauucuguucuuguggcugucuucuuuuagguuuguugaggaauuaccuucuuguuuuuucuagggcguuguucccauucuuguauugguuuuuuucuguuauuauccuuugaagggcuggauucguggagagauaaugugugaauuugguuuugucguggaauacuuugguuucuccaucuaugguaauugagaguuuggcuggguauaguagccugggcuggaauuuguguucucuuagugucuguauaacaucuguccaggaucuucuggcuuucauagucucuggugaaaaaucugguguaauucugauaggcuugccuuuguauguuacuugaccuuuuucccuuauugcuuuuaguauucuaucuuuauuuagugcauuugauguucugauuauuaugugucaggaggaauuucuuuucugguccagucuauuuggaguucuguaggcuucuuguauguucauagguaucucuuucuuuauauuugggaaguuuucuucaauaauuuuguugaagauguuugcugguccuuugaguugaaaaucuucauucucauccacuccuauuauccguagguuuggucuucucauuguguccuggauuuccuggauauuuugaguuaggaucuuuuugcauuuugcauuuucuuugauuguugugccgauguucucuauggaaucuucugcaccugagauucucucuuccaucucuuguauucuguugcugaugcucaaaucuaugguuccagauuucuuuccuaggguuucuaucuccaguguugccucacuuugaguuuucuuuauugugucuacuucccuuuuuaggucuaguaugguuuuguucauuuccaucaccuguuuguauguuuuuuccucuuuuucuguaaggauuucuaccuguuugauuguguuuuccuguuuuucuuuaaggacuuguaacucuuuagcaguuuucuccuguauuucuuuaagugauuuauuaaaguccuucuugauguccucuaccaucuucaugagauaugcuuuuaaaucuaggucuagguuuucggguguguuggggugcccuggacugggcgaagugggagugcuggguucugaugauggugaguggucuugguuccuguuaguaggauuccuacguuugccuuucgccaucugguaaucucuggaguuaguaguuauaguugacuauguuuagagauuguucuucuggugauucuguuaccgucuaucagcagaccugggagacagauucucuccucugaguuucagugcucagagcacucucugcuggcaagcucucuuacagggaaggugcgcagauaucuuguuuuuggaccuccuccuggucgaagaagaaggcccaaaacagggccuuucucagaagcuguguuacuuuggcaguucccagaagcuguccgguucucuggcgcacccucucaccuguucagacuaauuuccuaaguucugcugagucccggaaccaagauggcgaccgcugcuccuuaggcugaggccgccucccaagccaggcggacaccuguccucugguccggacgguggccggcugucugcggcccgccaagggugcugccucagcggcucugugcuuccgccugucccagaagcuguccgguucucuggcgcacccucuaaccuuuucagacuaauuuccuaaguucugcugagucccggaacccuguuuguuuguuuuuuucaagacaggguuucucuguauagcccuggcuguccuggaacucuguuuguagaccaggcuggccucugucuccugagugcugggauuaaaggccugugucaccacgcccggcucuuuuuuuuuuuuuuuuuuuuuuuuuuuaaugucgauaguuuguauaucuguguugaaugcaacaagcugucucaauuaaaaaaagaaaagguuuauuuauuauuauacauaaguauacaccagaauagggagucagaucucauuacagauuguugugagccaccaugugguugcugggauuugaacucaggaccuucagaaaagcaguaagugcucuuaaccacugaaccauaucaccagcccuuaauuuuuuuucuucuccuuuuuuuuuuuuuuuuuuuuuuuuuuuuguuauuugaaacuuacggaaaaauuuaaacacgaaagugcaaagaauuuguauaaugaacccucugcacauguuacuuugaaucauuucuaguuagcauucauaccuacacuauuuguauccuguaaaugccuagauucuuuaccaggcucauuuagaacuaaauuuaaaauguggaauaguuauuuacacacuaaggguaaugguccuuguauacauuaguaauggcuaucuuaacaagacauguuuggguagaaugagaggaauuucuuaucuguaaguguuuagacauacuaucucuaaaagaguuaagaauuuuccuuuuggggggauggagagauggcucaaagguuaagagcacugacugcucuucuagagguucugaguuuaauucucagcaaccacaugguggcuuauaaccaucuguaaugagaucugauguccucuucuggugugucugaagacagcuacaguguacucguauaaauaaaaauaaauuaaaaaaaaaagggaggaagggaagaaaaaaaggaaaaaaaaucuccccuguuuuaugauaucccaaauuagcacucaugucuuaucuuaaucuguuuuacuaaaaugucugauuugggcauuuuuuucaaaugugugauguuuuuauuaaauuaaucuauucauauugugaauuguauaugauguuuuguuauguuucauuuuaaaaaggaaccuacgcacugugaggccaacccugaccugaucuuugaagacauggaaguuaugacagauuuugaacuacauguacuuuguaaacaguaucaacacauuaauaguuaccaguuagacauggauuuaauuuuagauucugggaaauuccgagccuuaggaugcaucuugucugaguugaaacagaagguauuaaacagaaugacugacugucucucucuauuugccuuguugguugaacuuaugaaacaggaguguuagaaaagaugacgcuggcuugauuguuuguuauacuuuuuaaaguuaaguuuauguucuuccagaaccuagugucuuaaaguugccucauauauuuuuucuguuuauuuuucuuuuuauagaacuuaagaaaauaauaaguuagauuagaucacaucuguguugauuuuuuuuuuuaauuuuaauuauuauuucagaggugaccuauuucuucaaaggacucugcaauuuguaugaaguugcuuaacuuuucaguauuuaggugcaaguagugauuauguacuuggucuuaauaaaugauccuuuuuuaauacgaaaaggaaguaguaaugauccacuucuuuaacuuaaaaucagaauuaaacuacuacuuaaguucagaaguuaaggaaaucuauucauauaauagaaaaaauaaauuuauucuugguaucguuacuugauuuuuuuuuuuacuugaaaaaacuagcgcaauugaacauuauguaauuuuaucaugaaguuuauggagaguuggcagaugucucuuuaaagcauucuuuauuuuguaggccucaaacuuuggguaaggguaaugauuucacuuuccuguuucuaauucauacauaucuucccacagggugauagaguuguauuauucagccaguuuaccaugaugcuggauauacuagagguucucuuaaagcaucaucaacauagguaccuccgauuagauggaaagacucagauuucugaaagguugguauuagcugccaaguaucauuugcuuauucauuaauuagcauuuuaaauauaaggaguauuuuuuagaaaauucuuguuuaaaguguuagguucugcuauuucaaauauucaguauucaaauuauucaacuauuacugcuggauuguuauuuuguuguuguuguuuuucaagacaggguuucucuguguagccuuggcuguccuggaacucacucuguaggccagguuggccuccaacucagaaauccaccugccucugccucccgaaugcugggauuaaaggcguaugcuaccacgcccggcuugaauuguuauucuuuuaauuuuuucccccaauaaguguauucugaaaaauuaugaaaauuguaugcuuuuaauaauuuuucucuuguauuuuauguuauuuuuauuuuugcacuuuagggaucauacccauaguuuuuuacaugcuaggcaagcacucuagaacuaaaccacaucccaguccuaaauuuuuuuccccuguaaaaaauauucaaggggggcuucaucuagcagcugauugaaacagaugcagagacccaaagccagacaguaggcagcggucagggaauccuucugaagaggggaggauugcuuauagaagccagaggggucaaggauaccacaagaaaaaccucagaaucaacuaaccugggccuauagggaaccacagagauugaauccacaaccagggaucccauguagaccugacccagguugucuguauauauguuauaguugaguagcuugguguuguuaugaagcuccuaacaguggaguucagacucucucucucugacucuuuugcccacuucuaggacacuuuuccucauauuggauuguuucaucuagccuuaauacaaggggcagugcccagucuuacugcucaauaagccauguuugcuugauaaccauggcaggccugcccuuucuaaagagaaauggaggaagagugaagggggagagaggaauggaagguaggagauacucugagcaggauauaaaaaaauaauaaaaccauucaagguuugaggcauccacuguuuaaucaagauuguuuuaaagucagauuuuucauauuuugaagguuaaugaaaaaaguuaucaguuaggaggaggaccuaauauuugagaccaaccuaggcuacuuagugagacaucccccaaaccccuccccacuccaaaaaggaaaaaaaauccucaaaaccaguucuuacagauuuuucuuuuuuaaaaaaaugaagaaaauagaauccuugguuccuucuguauacuucucucuuuugguaauagcugugagauugcugagaaaauuagacuggauaaguauuauuuagcuaaauuugaagcacucaaaaaauaaaauaauacuaauauguacuugacauauuaaucaaguuggaauaguuggauugacuuaaggggcucuucacugaucgcagaggaaaacguagguguaaugagaagaguauguguguaucgcuccuagguuugcuuuccaugugaagugacuauuuucaguucuacguauuuauccuucagugaaauugaaccuaaucuguuugucuuacaggauucaucuaauugaugaguuuaauacagauauggauaucuuuguauuucucuugucaacuaaagcugguggacuaggaauaaaucuuacuucagcaaauguuguuauacuucacgacauugauugcaauccauacaaugacaaacaagcagaagacaggugccauagaguuggucagacuaaguaaguauugucuguugaaauuuaguuuucaccagcuaccagcuugauuaguauagaauauuaaagaaaguauguguuggcuaucuaaucuguagguuuuauuuuuuucggcaaaguauagaugcuauuuuuuaucagcaaucucaaugccgucuauauguaaauuacuguguacucauucauuuucuaauaauuaaccuuccaccuccauaccaaguaguuucacaguuuaugagauguauauuaucaguagugauaguucauacuuguacuccugacacuugaaagacuaagaagucagauuacuccaagauccaggccaacccaccugacccuauagaacaaauacuaggauagccugggcuccauagacacuugagcuacaaacaaacaggagaaacaguauaauaaagcagucaugcuuauuuagcaaucauguucuaucaucaagcucuuaucuccagucccauuguaaugugguuuuaucaauaauuuucaaagcauauauauuuuuuacuuggaucaguagggaaggauagauguauaaaauguuuaaauacuccuaaaugccagucucaaguacauuaaauaaaagaguuauuuauggguagucuuguucuauugccgugaagugaugccauaaccaaggcaacucuuacuuuaaaaaaaaaaaagcauugagccaagugugauggcacacacuuuuaauuccagcacuugguagacagagacaagugguugguucuuuugaguugaauccagccugaucuacaaaauggauucuaugauagucagaacuauacagagaaaccuugucuuuaaaaaaaaaaacaaaaaaaaccaaaaaacaaagugaauaaauaaauaauaaaagaaagcauuuaauugagggcuuucguacagcauggcagcaggcaugguggacuuggugcuggagcagucguugagaguugcauccugguccauaggcagagagacccugggucugguaugggcuuuugaaagcucaaagucuaccucuagugacccacuuccuccaacaaagccacaccuagaccuaaucuuuucaaauagugucacuugcuggugaguaaacauucauauagaugaaugggaacaauggauucaaaccaucagagucauuaacuuuucuucugcuuguugaacuuuuauuaucuaaauaacaccagugaccuauggacgugucauguguuuauuuuuagagaaguauuaguuauuaaauuaauaagccaaggaacuauugaagaguccaugcuaaaaauuaaccaacaaaaguugaaacuagagcaagacaugaccacaguagaugaagguaagcuguuuguuuguuagcagaaauacuguuuuuuaugaaaauagagauugccagaguucuuaacuaguaugaauggucuguuuggaggacaaaguagacgaggauauguacgcuuauauuaaguacaacaguaacaaagauuuguuuugucagaauugauuuaaaagaacaacuugauuuugaaaacaucugucucuucugucuuauauaaugaacaccauaauauucucaaaauaaagaacaaauuuggaucuauagcuucacucacaauuuauaauuuguucacuaaaugaaauauuaucaacucaaagguugaaaauguauuuuauaguguaauaacuuuaagagcccuuacauauguaaauauguaauacuuauguaaucuuacuuugacuuaguaaauauuuaucaaaauauauagcuguaaaaugcacuuaaaaauuguauugucaguuucagguuuaauuacuugggccuuagaaagaaaccuuaaguaaaugucacguuucuagcugcuguuggaaaugauaauguuaaguucuauaaauuuacaaguuuuauucauguguauaauuuuugacaaguaguacauuagcauaguuuagaacuuaagaguuagaaauguuguaguggugcugggaaggugagccaguugucagcagagagagagagcuucuaaugcucccgagcuccuuuccaagcagcccacagcuuccucccaugccuucccucugcucugggaaagggguuuaccuauucugguuuguuuuucccgaagggaugcuuaaauuuuuuguccaauaaaaccaaggauacaauauugucauuuauuuaguuucaauuacaauaauuuuaucuuuggauguguccaguuucauuuuuaaaaagaagugacacugggucuagagaaugugaucucuuuccgccucacacugaguucuguugcccugugaaugacguguguauuugcagaugaguguguguaucagcaaucauuaggaaaccucuggaaaaucagcauggcuaacuaaagacuauagagucuguuucucuagagcuggccuuggucucaggaucugcagcuaugucacccaggcacuuggcagcuggaaaugcagauuucuaaauucucuauaagauuuaaccugcuuagaaacucuggcagugguacuuaguauaauuuaacaagcuuucuuguugacuuugcuguauauuaacuggaaucauugcuuuaugauaaaaaucgugggacucuuucuuaaaguaacuggcuuauuacacuuuugaacucuuauuacaaaacuuuuuauauaaaaaaaucuuagaaccacgguaugaaggaaagcucgcugaccggcagcugugaaggguuggcauguguugggcuucucucuuccagagccagucugaagguaguuuuaggugugacaggauuuuagauaaauauuuucuaaguuguuacaaacaagaacauuuuagauagaaucgaauuuccuacucagauuucuuccaacuguccguuuacuauauuauuacugagguucauuucuuuuguuucaugcgaauaggucuuuugccuucguguauguugcguacuggauuuguaccagucacguagaagccaaaauaggcacuagauucccccgagacuggaauugcagcugguuguaagccaucaaucaugugggugcuuggaacugaacccagguccuuuggaagagcaaccaaugcucuuagcugcuaagccaauuuucauccaguacccuuuuaauauuuuuucacuuucuuuugaaacaaggauccugcuaagguucacacuuuagauuuuauuuuguucuaauaguaucuaguaaaaacacuaaaagauuuuauuuaguaaagacacuaaaagagucuccauagucuuuucuccacauuucucuagugggauguggaaugccaguuaguuuuaagagaauugauaucuuaaugccaugggcugucuuuagucuguuaaauacgcuugaagggaaggguaucuguaaacuccuuaacaguuuguccaguguucagugucuuguacguaugcaucuuuuacccagagaguagaacacaugaaaguacuccuguaguuuugauugucucagauuuuugagagauuugauucauugugcugcauuucagccauuuguaguuuauugcugcacacaucagaaauaguugugacuuuacagcuaugcuauuaccaguaagugggaaaguaaauaacucagcuguauagguuaggucagguuuuuaaugagaugacaccaaaacaaacuaggaauuaguuauagguaggaauucaccaaagagaagaaagguugggaggaagauacaucuuagaagcccggauauuucugcauaacuuucacauuauuuucugcccugcagcugaugaaggaaguaugccagcagauauagccacauuacuaaaaacaucaaugggccugugaaggagagcgcggaauuccugauugaugaggacauaucaacuuggugcauucaaggacauucacaucacggugaccaugggguuucugagcauuuguaauuuuuuauaauuucauguugcauuucacauaguauggacaacuuuuugccacuaacuggauucuccagauccucacauccugaaaauguugacuaaucauuuuucaaagcaguuuucugaaugggguuaguuggugauuguuuguaacaaauaugcuaaugcuuuagaaaugucaguauuuuuguaauuauuucuaccuccagauauauauacauauauauauauauauauagugucuuucacuggauaauguguguagauuuacaugugccuuauuugacaauguuuaugucuuguuuugcuugucugauuugaaguuuuuauuauguuaaagaaugcagcuguauagguuguucagucuucauuuuauugcuauuugaugcagauguucaccaaugucaguaagaacucagccugaaucacaagguggcauuccauccacuaauguccccagguccucuucuuccuccuguuagaacacauuuguuuggcuaagcacuaaguuguuuuccagugaguaggaacugaagccuuucuccugcucuggggggucaguuccuucuuucauuuucuuauugcaccucuggcucauuaacucugccuucgcuuguguguguugcuaucagcuuccucucccgcuuuugcuucucuuaaccauugcccagucacuucugcuccaguuuucucuuacacauuuccuucugcugaaucaccaagaucagcagauguugguggcauauuucuaguccagcagaacagauuaacuuaaagauacuuucacuucaaaggaaacuggaugugacuucauaccaagguaaugcuagauacugcaugaaaauaggucauuaacuuuaaauucuuaacaaaauauaauuuaccaguucccaggauuuccaauacagaaccaccugaagagaagccauuguucaauuccaguucagugugggugacaaagugaaauuuagaaguaaaauugucuauuugguauuucagucuuuauuaacuuuucauuuaaauuuugccugucagucuauauugcuguuuuuauuauacaucagauucuuuguauaacuugugaguuuuaugugcuuuguuuuauaauguaaauaucauuauaaauaaacuuauuuauaaaugagagauuuguuaauuauuguagcucauacuuuucaagacacccccagugcugaggugcuagguaaacacuuagaugggugacacaauccuacagugcuauuuuuuuuucagguaucugagacucugaacuccugacucaguagauuuaauauugaagauauaugacuguaucaaauuuaucuccccacuacggggcugccaggaauuugcagguguuaaugcuaccuccuugugaucacaguacccaggucgcuuagucaaguuguuggaaauuguaccuuuuaaacccacagugaauuucccuuaacuuuucugugugaaaugugucucccacaguaggcucauugguugugguguuguuauaucugaauuuuuucuaaugaaauguaguuggauucucccuguaauauuuuauuaugucuuggguuuaauaaaaauauuugugaucauuaaguuguauuucac

SEQ ID NO: 3031 - RNA, 729 nt, Mus musculus
ggcgcagcgggcaggcgcuguggcuguugugcucccgacucugcucgguccuuccucugcgggugguggaggccccaagcggugcggggcucgacccuuccuucccuacguccugcccagcucuucucgcgcugcgcggucucucggaugccagaccggcccggccgggauauggcucguggacagcagaagauucagucucagcagaaaaaugccaaaaaagcaggcuggacaaaagaagaaacaaggauaugaccaaaaggcugcugccaaagcugccuuaauauauaccugcaccgucuguaggacacaaaugccagaccccaagaccuucaagcagcacuuugaaagcaagcacccuaagacuccacuuccuccagaauuggcugauguucaggcauaaaguuguuuacaggugacuucacggcaccuuuggcucuacugucucagaccuuagguaacaaaccugcggcugcuuuuuuaaacuguuggucagcaaacaauaaaggggcuacagaaacacucguuuuugcgcuguucccuuugggcuucaggcaaagacaacucuguguaaauguacagcugacucugauguggaaaucugaaaaaucaguccauucuuguuauaaaauuuuuuuuacaauuguaauuauauugauguucauaguguguaaauaacucauuuaauaaaguagugcuuugauuuuacaacaccgcaaaaaaaaaaaa

SEQ ID NO: 3032 - RNA, 2557 nt, Mus musculus
uacugaacaagagcauuaaagauaccuuuauuaauauaugccaccgacguucacaccauauaugagaaucacagcaaauucuauagacuaacagaaucaguaccaaccaauuuuauugugguagcauaugacacaauauaagauaggaaaauucuacacaauaugaaaaacuaagcaaccauuuaucaaugguuucucuugucucauguuucccacauuuacucaucucacagguguugugucgaaggacagggcaagcuucaggcaugcuaauuucuccauuuuucuuucauaugacuucucaguauccuauccuagugaaauucuggcucaggacuaaguacuaccacucauaaccguagggguggacagagagaugcacauguucagagcuagaauacucucacacguccagguucuacuguaucuuaacuuguggccuuggacacagaguguaccauuucuuuguucuuuccucuugguaaacaagaaugcaacccuguccccaucugaucaucuggucauugcuaugagcacugaacuguuucaaauguucggcaucagugugaccuuuguuuucccugcuuuuccagaaggaagcaugaugacaucacuguccucauuuuacaaauaaagaaguuuauuucccagauguuuuuuuuuuaaaaaccaccccaaauuucauuucuaccaguccccuuucucuuauuaaggaacauaacuuuagcaggacauagaaagcucagcagaauaaaggaguauuuuccucuuuuuaauaugguuaagacugugaaagucggagugagcauuaugaagcacaaucagcaaucuaagaacucuuaaaaacaguagcucugcuccucccagauuuccacagcagaacaugaauguucuguauguuuugguacccaaaucucuaguacacaguacacaucugcccacuuccaguugggccuccuggaaugccugcucaugggagcaacuaacgggcugaugucugguauuuagaggagcuacauaugcgcagcacacagcugaguugaagcuccagucgcuaacauuauucucucagaccuauacaacaaugaacuguuuguguugugacucaguaccuuuguuucaaauuucugucauuucccugugccaaagcauuguguuuuguguuggugaaaggcugagggauucaaccgucuguaccuuucagcugggagacagaaauggcaaucucccauaagaagauagaaaguuaaugcuacuaauuuaaauggcuuauaaaacacuugucaugauaagauggcugggauguuauuucugcauuuaagcaaauguaugugugcuuguuugucccacccacagcucuuaccauauccagaaaaugcaggcagcaugaaaugcucuaugguuuagccauugcugacccacguggaaaccaaguguuggacuacaggggugcuguuaacugcuuguagcuaucugugcccauagucaauacuaugggaaugguuaaguuguuaauucaaacacauuuaaaaguaauauacuuauuuuauguguauggauguuuugucugcauaaugucuguguaccacauuccugccuggugacugcaaagaccagaagaggguguuggauaugagauugaaguuacaaaugguugugaauugccauguaggugcugggaauugaauucagguacccuagaagaacagccaguguucuuagcccccgagccaccucccuagauucagguacagagaauauuuaggacucaccuuccccugugcuucaucuggugucugacuagcacuguguggcuauucaagccagugugauaaagacauucauaugcuaagucuuccuugacaguucaggguacauuuuauagaacaccucaaucaacuuucuguguuccaaguacuauaugcuugguucugcuuaguauagguauguuuucucagaagcaaaaucuuauuaggauaaugauuaguuauguauaccuuggggcuuuguaagguucccucccccugaaaacugcuuacauuauccugugcuaucacguuuucacaguuggagagauuauaccgagacaauuaaauaaaagaacuacauauuuacuuauuuucaaaucaugaugguuugaauggaaacuaauuuuaggcaguuuaugagaagguggagugagggggagaaggauaaaaggagagggagaggggggagaagggaagaaagaggguuaaaggaaaggagggaaggagaagaagagagaaaaaagagagggaaggaaagagggagggagcacaaagcucaaguccaagagaaucaaagaccucaacauuaaaccagauacacugaauuuaauagaagaaaagugggaaauagccaugaaugcacagggaaaauuuuccuaaacagaacaccaauggcucgagcuuuaagaucaacaauugauaaaugggaccucaugaaacuggaaagcuucuguaaggcaaaggacacugucaauaggacaaaauggcaaccuacagacugggaaaagaaaaaagaagaaaaaaaaaac
